United States Patent 11,337,426 (BIOLOGICAL CONTROL AGENTS AGAINST FIRE BLIGHT) - sequence listing, part 4

SEQ ID NO: 19 - DNA, 4049253 bp, Pantoea agglomerans NY130 (residues 2,024,628-4,049,253 of 4,049,253)
gtgaagtacgccccttccgctttatcgaagaagagaagaagggtttcctgaaacgcctgttcgggggataaaccatggcattacttgatttctttttatcccggaagaagaacactgccaatatagccaaggaaaggctgcagattatcgtggcagaacggagaaggggcgacagtgagccccactatcttccgcaacttaagcgcgacattctggaagtgatttgcagatatgtgaagatcgatccagaaatggtaacggttcagctcgaccagaaaggtgatgatatctcgattctggagctgaacgtgacgctgccggaaacggatgaagtgactaaatgacgctgaccgtttgctgaatttcccctgcgctctggcaggggaaatttaaccggttaacaacccgccagaatctcctcaatgccgggtttcagcagttcgccccgccatccggtgagtaactccggctgacgtccctgtggcttcaggccccagtgctgacttaatacctgattaatctgacgtcgtgacgccagcagctcctgactgaatccactctgctcactcacctgctgcaccagcgctttcatcgctttaaacactggcttgtagtgcggatggtcaatcagattgcccagcggagccggcagtttcgctctcatccagcgcctcagcttctgccaccagcgccaccagcgctttgccgtggaaacgaatttcgtggcctgacagccccagatgatccagctcgcccagcgagccgggcataaagcgcgccactttccacaggtgctcttcgcgcaccacaaagttaacggccatatctttttcacgcgccagcttcagacgccaggacgccagccgctgtaacgccgccagctgacgcgggcgcaactgccaggcattggtaatatcccgccaggcttcatccggcgacaggctatccagacgacgctgacacaggttatcgcactcactgagtgccgccgacatattgccggcctcttccgtattgatcatcagctgacgcgcaattggcaacagatagtgaacgtccgccgccgcatactcgcactgacgctgggtcagagggcgcgccagccagtccgtgcgtgattcacttttatcgagttcgacctgagtgaaatgtgccaccattgaggcaaaaccccaggagagcggctggccagaaaaggcagccagaatctgggtatcgatcatgggcgtcggcagcacgccgaaacggtgcaggaagacttccagatcttcacccccggcatgcaggaatttggtgacgcgggtgtcggtcagcaaggcaataaagggtgaccagtcacggatattcagcgggtcaatcagcaccagttgctgatcgtcgaacagctggatcaggccaagctgagggtagtaagtgcgggtgcggacaaattcggtatccagggccaccgccgcgtgctggcgcgctttctgacacacgtctgccagttgatcatcctggtcgataagggaatagttcacgtctgatttccaccgcagccaacaacgcgcggcgctccatgttaaaaacaataaaaacgccggacatgccggcgttcaacctcaatttctgcccggattcagctcgcgccgggtttcgcctcgtcgcgcagctcacgccgcaggatcttgccgacgttggttttaggcaactcatcacgaaactcaatgattttcggcaccttgtaaccggtcagctgacggcgacagtgatcgagcacctcttctttggtgagcgatgcatcttttttcacgatgcagacttttaccgcttcgccagaaagatcgctgggcacaccgatagccgcggcttcacgcactttaggatgctgcatcagcacgtcttcgatttcattcggatagacattaaaacctgataccagaatcatatcttttttgcggtcaacgatgcgaataaagccttcctggtcaacggtaacaatatcaccgctgtggagccagccatttttcagcacttccgctgtcgcttccggatgctgccagtagcccagcatcacctgcgggccgctgatgcaaagttcgcccggttcacccggaggaacttcattgccgtcgtcatccagaatcagcacatcggtcgagggcaccggcagaccgatactgccggtatgacagctgatgtcatagggattgaccgacaccagcggagaacactctgtcaggccatagccttccagcagatagtgtccggtcagtttttcccagcgatcggccaccactttctgcaccgccattccgccaccggcggaaagacgcagcgttgaaaaatcgagtttattaaactgctcatcgttgagtagcgcgttaaacagcgtattcacgccagtaatggcggtaaacggaaatttccccagctctttaacaaagccgggaatatcgcgcggattggtgatcaacagattctgaccgcccagctccaggaaacagcaggccattcaccgttaaggcgaagatgtgataaagcggcagcgcggtgacgacacactctttaccgtcacgcagcaccttgccgtaggtcgcgcgggtctgctcaagattcgcctgcatgttgcgatgggtcagcatcgcccctttggccacgccagtggtgccaccggtgtattgcaggaaggcgagatcgtcattggaaaccgtcgggcgttgataattgagcgtttcgccgacttccagtacgtggcgaaatgagattgcccccggcagatggtatttgggcaccagcttcttcacatacttaacgacaaagttaaccagcgtcgcttttatcggcgccagctgatcgcccatccgggtcaggatgacgtgccgcacagcggttttcgccaccactttttccagcgtgtgcgcaaaattcgagacaataacaatcgcactggccccactgtcattgagctgatgctgcagttcgcgcggcgtatagagcggattcacattgaccacgaccatacctgcacgcagcacaccaaacagggccaccggatactgcagtaaattcggcatcatcagtgccacccggtcccccgctttcaggcccagctgttgctgaagataggcggcaaaagcgcggctcttctcttccagctgacgataactcatcttctgacccatgttcaggaacgcgggttgatcggcgtagcgttttgcggcctgctcaaacagatccaccagcgaggtgtaacgatctgcacttatttcggcaggcacatctgccgggtagcgtttcagccaaaccttattcaaggatccaccccgataattatgttgtatttccatcgctgcctcagccaatctggtttgttaacaatattttaactgattgtaccagtttgcctgttttggcatgttgaggttgcgaagtgcatcactaaatttcgtgctgataaaacaggcaaataaaaagcccggcagcgagcaccgcgaccgggctgatacttaaatgttttttgcacttactcggtcagaatggtctgcacctctgccggcccactgttcatcattccccagtagggattcggaccccagtatccgccgcgatggcgggtcggaccataccagatccagggatccatcggctggggtggtgctgtcacctgctgggtaagtcgccagcgctgataaccgcgcacatcgatgaccgcaaatttgtaatctgcttcgccaattttgccctgctccgtccccttcagggtacccagcaccgtcacatactgatttctgacatccaccggatcaacaaaacctcggatatcggcataaatccgaccgaccgaggccgcacccagacgtggtctggcgctatcatccagcggctgtgcagcaatctcaagccgggttttgccgttcaggttagtgacattcactaccttgccgccaaagcgcgattcctgcccgacaaagagcgaaggattgctcatgacccgcaacagatcctgctgcggctgaggtgagctgccctgcagcgtgtcaggaattgagacacaaccggttaacgccagtacacaggtcagcagcagacctgaaagccctttaccacacattgacgacatagacgttctcccgttaggtaaagagttagactggacgcataacaataagttgcgtgcattttaccggccaggtaattttttccaggcgacttcattacgcagataagtgggctccgctgtttccggcagcagcgtcttcccctgcgccagcgcaagggtcgccagcggcagcatatcttctgcagcgggcagcgtaacgtcactggctttcagggtaagtttcgtgtccctgctgcagggcaggataagcctgccagccggtgcctgcggtcatccattcgccagaaagcgcctgcatccaggccagtgccgcttcgggcgacagcacgctttcgctggcctcaccctgccaggcaccctgttcatcacgctgatattcggcccagtagacctcgcccatccgcgcatcaatagcggttaatacccgggtagcaccgtgcagacgccatgcgccttccgccagcgttgccagcgtggaaaccgcgatcattggcagagaagcgcccagtgccagtccctgcgcaataccaatgccaatccgcacgccggtaaaactgccagggccgcgaccaaaggcgagcgcgtccaggtcggtcagttccagctgctgtgccagcagtagctcttcgatcagcggtaaaatacgctgggtgtgatcgcgcggggcaatttcgaatcgggcatcaatctgttgctgattcagcaaggcggctgaacaggcttctgtcgccgtatccagcgctaaaattcgggctgacatgactacctcagaagaaagaaaacggcgcgcatcttagcataaaattacgcgtctggttcgggttgctggcggataaaggcgatggcgcgggcaatgtcccgggtgcgcggcgtcggtggcaggctattgagaaacagcgcgccataaggacgagaaaccagacgctgatcgcaaatgaccagtacgccacgatcgtcggtatcgcggattaaacgtcccacgccctgcttcagggtgatcaccgcatccggcagttgcacatccgtaaagggatcgccgccacgaatccggcaatcttccattctggctttcaacagcggatcttccggtgaggtgaacggcagtttatcgatgatcaccagcgacagcgcatcaccccgcacatccacgccttcccagaagctgctggtcgccaccagcagggcattgcccttatcgatgaactgtttcagcaactgacccttgctggtttcaccctgcaccagcacgggcagcgtcattgaggcgcgaaattctgcggccagctcacgcatcatcaggtgcgatgtgcacagaaagaaacagcggcctttattagcatcaatcagcggcttcatcattgcggccagctggcgtgcaccacccggacggttaggctcaggcagattgcgcggaacgcagagcagcgcctgcttcgcaaaatcgaacgggctgttcagaatcaggctttttgctgcattcacacccagccgttcggcgaagtgtgccattttctcatccaccgccagggtggctgaggtgaagatccatgcagccttacgattatccattacttcacggaagcgtttctgccaccgagagcggcgtcagcgccaggataaagtgacgtgaggtacattcataccagtagctgtagcccggctcgttaatcgcccgcagccgttttaaccggccacggtagagcgcggctcgctcgaaggcggcatccagcagggctgaacggcccagtgagagtttgataacgtcgtaacagagctcaagcgcatcatccagcagcgtaaacattcgcaggatgttgttatcgctcagcagttcacgcaggttaccgcgatagccgggatcgcctaatgacaggcgaaaatcctgcgcgcactgcgccaggcggtcagcggatttctgcagctgctgagcatcacgcacctcggtgcggtaggcggtaataatatctttggcgagatcgagtaactggcggctggagagctgctgaccaaaatactgactggcgatatcgggcagctgatgggcttcatcgaagatcatcacatcagcttcgggaataagttcgccaaagccgccctctttcaccaccagatcggcaagaaagagatggtggttcacgaccaccacatcggcgtccatcgcgcgtttacgcgctttgaccacaaagcactctttatagcgcgggcagtcagtgccgaggcagttatcgttggtgctggtgaccagcggccagaccgggctgtcttcggtcacgcccgcacagctgctgatgtcgccatcttccgtctgcgatgaccagctgcgcagcgtcaccagatcggtcagcccctgcgcggtgagatcgccgcccgccatcgattgctgttccatgcgttccaggcaaaggtagttggagcgtcctttcagcaaggccgttttacctttaaaatccagcgccttgatcatcgtaggcagatcgcggccatagagctgatcctgcagcgccttggatccggtggagacaattacttttttaccggcccgcagagcgggagccaggtaggcataggtttttccggtgccggtaccggcctcgaccaccagttcaccctgctgttttacggcttcagataccgcctgcgccatctcacgctgtgcttcacgcggcttaaagcctgcgatcgccagcgccagcgcgccatccactgcaaaatcgtctgccacataccctcactaagaacggcaaaaacactgtaattatgtcagtattggatcaacaaagcaaaattgataattatcaatagcttatctatttttagccgttgggagtgtggcaaccagtggctcaggatcgcgtctgaaagatgggaaaaaggcggcaggtggccgcctgaagagaagcgctcgcagcaccgggatgcctgatggaaaagttgcaccgcgaaaggcagcagaaatcgctgtgactactctacaatcatgcgcccattgagatgctgcaacggacgattattggtggttttcagcgcctgtttaaaggcgtcgagctgcgcctgagagagcgaaaccggctgtttcagcaccagccagcgaatcccttcgctgcagggtggcgtcgtcagggagccgctgaaacgataatagtgcagatcttccgggaagagatcgcgtaaatttacctggcgattaatggttacctgctggttttcctgtttcggcatagcgtcgatcaacggtgccagcgccggattctcttcaccgaccttaaacatcaccgcgaccacggccagatcgccatcctctttgctgtgtacaaagtgggcttcaaggggaaaggtgtgcccattgatctggttctcactcggcgtatggaagtgatactgacgcagcgtgaacttttcccgatccagtacaaaatcatcttcttcatcaacggtcacctgaatcgtgtggccattgttgatcaccttctcagccgacgtatggtaggccagatcgagtgcctgtaaatgcccctcaatcggatctttaatattgattggcgactgggacttaccttcgtgacagatgtggaagtcgctggtcagtttcgctccagtgttccgggccagctttgccttcgtacgtccagtgcggttccgccgcaccggctacgttgagggtagaaagcgccacaaccagacttaacatttttggtaatttcatttttatccctgctttataagcttatttgcggcagggatactattccgctgactactgaatcagcaaggtgacaaaatgcgttaaatcaaaatcagaacgaataaagagtttataattacaatcaatgttaatttaattaacaaacatcacgatgtgacgtttttaagcatttcaggaaagggttgatatcaatctctctgaataaaagagtttcattttcctgtatttatcattttgattgtcgaaacgagccgggagggaaattttgcactaaattcaggcgacgtaagaaaccgcaaaactgcacgcaggcggttttgcggtgcaacgcgataacgcgtcataaaagattatgcaggtgacgctagacatccttttctaatggttcctcttcttcatcttcttcctcatcttcaggataaatctcagcgtcatcgggcagcggctcatcgtaatcagggcgttcagacataacttcctccggtgtcagatagcaattttgctatgccctttgagtgtagcttactcctgccatctgttttgcaaggctcgcaaaagatatcagaaatgcgggcgctgccgcagactctgcttcgccactgcgtgaaacagccttgcgtcacagccggtgctgatagcgtaccggttaatcggatgcccattcgcctcccccagccgcgttatcattgacgtcagtcggatagcgggtttaataattcgccgctgaaaaaactgtgttttcaaaaaaacctcttactcgtttaatgaataaaaggccggaacttaactgcctataatatagggatacgaaaagttaatgatgcgattcaaagcacaattatgcacaaagaaaggtaacattaaataaaaacccaacaggagtagcattaaacatcgttctgttgttataagaaaaaatccctgatataaaagagacagaatttaaacgtaacctgtgagcattagcggattgaatatttcctctgatgcagccacgctgacttaacagatggtagagaggtaattaaaaattcaggcgttctgttatctctcacaggcaataaaaaattgtcgccggatgagtcacatcacaatagaaaccatgccccacggcatccgtcctctttaaaaggccgtttaagactatctcgctaaagatatccgttaatgtaaatgaagtggggttttatattataagttaaatgggatgtaatctggctgttgctaccctgttgcatccatctgtcagtcaggacacaattacctcaacaaggagaaatatcattgttcccaaaattaccccggtatagcttagtgattctgacgctgagcggttgcgttaccaacgatgaggtcaaacttaacccagttggtcaacatagtgaacctgtcatgccgcatataaaccaggggatcagccctgcacagcggcgcgcgattatgtccggcgaaacaaccagactggtctgacgtttatcctcagcgaatcaataaaaactcgtcagctgtcaggaaatgatctgcacgtcgtagcagttaacgtcgttactccaccactcacatagcgtaaaaaacactgtggaaaataatcaacacgtcgatgatgtctccctatgggattggattgtcacattaattttaaccggcatacccgtattaaatcttttcatgctgctttactggtccttaaaccgaaggactaaacgttcaaagaaaaactacgccagagcgagtttattattgatattcatcgtacttatcttctatatcatcaccctggaagttacaacgggctattttctttttaaacattactgatccttaaactgacagcgtcacaccctcaaatggagtttttatggtgcgttatttcacttttctattattgggcgtcacttccgcttgctgcatagcaaaaacgtcagtggtgataaataacaccctgaaagcgcaagagataaaatcggcaaaaatcgtttacattggagaggttaatggcactaaagtggcagaattgatggcaggcatcgatgatattaatgcaagttaccccgctgtaaaagaaatatcgctttatataaacagctttggcggcgacatggaagctggctatatgggcggccaggccgtcagggggtcaaggattcctataaaaaccatcaatgccgcaatgacgggttcggcggctaccctgatttattgctcaggggcgcaaagggaaacattacccagcgcgacatttttaatccatcctgcagcgagtcaaaacattcagagcaactatctgaaaaaaaatgaagtcattttactcagcagagatatcgataatgtcagtaaaatattcagggacacctatgcatcctgtttcaaagatgacgggaaagagatagataaagccctattcagtgaagacaaccgtatttacctgcgttttccagaatctgtaaaacagggtattgcacaaaaacgtattgaaggaatcgtacccgctgatgtcgcttattacattttcacttcagaggccagcggctagcaaaaataacgttatttatgcctgctggacgaatactttttatcagatatgcgccgcctggacagatgggcgtgctggcggggagacatatcgagccgttagcgggtaatccagagaagaacataacgcagacgacgttcagatgggacgccgcaggaactcaccatcaatatcacggtggattttcgcagtaagcgctacccttgcatggtgagttttttgagcagcaatagcagggttgattcaacactggccgataaaaagcggcaaataaagcaggccgctcagccagatacggcttattctggtacagggcgtttatctgtttctggctggtgacctgatatcacgattattggcgacgctgctcttgcgacctgcttataagcggacgtacaacgcgcccgccagcataaagatgaacagaatagcgaaggtaataaagccctgcttactgccacgggacaatcccacaaatgccgaaaccacaataaacagcagcgtcagtgcgccgaccatcacccaaaaaagatactgcgtattcgccatgcctgaatcctcatccgtagcgcgatttatctgctgttttataacatttttatgccgcgcgtgccctcacttctcccgctctttcgacgctttatgctgctttagtgcagcagggctgcaacagtgacaacgtccgcggctcatgatcatgatcatgatcatgatgcagacagtgtgatgcagttagcaaatgcagaggaacgcagcgagtaaacaagcgcgcggattataatgattaaatcagcttaccgttgggatgtggcacccgtaggctgacgtgctgagactggtttaacattgccgtttcaggcggtgtaaaacagatggccttaacccgactgcctgactcaggcggaggaatgtatgaactgtttccgcatcggctctctggctggcgtgctgctgctctgcggctgccaggcacccacgcctgatcaggctcgtctgcagcagcctgtttttcagggtcaaagcacccgcaccgtccctcagctcagcgactgtatttatcgcggctggtccaccaccagcgtcattgccagagataacaccacccacacccagcccaacggcagcgagatcagcgtttttacctgggaagattcgatttttgcggatgtgtcgccccgccgaaaaggggctgaggtgaaatatttcacgactttccggatggcgcctcaggtgatggcggacagacaggcgattgttgagcgctgcctgtaaggcgtaaggggtgacagcgatgtcgggagtgtgccaggctaatgcgcaattaaccagggagaaaccgatgagtattacccgcattgacccggaacaccgtatgtccgaagccgtgatccacaacgacacgatctattacaccagcgtgcctgagaatctggatgccgacgcagaagcgcagacagccaatgcgctggcagtgattgatgcgattctgacacggctcggtagcgataaaagcaaaatccttgatgcgacgctgtttctggtggataaggccgatttccccgcgatgaaccgcgcatgggacgcatgggtctctccaggtaatgcgccggtgcgctgcacggtacaggccgggctgttgaatccgaagtacaaaatcgaaattaaaattatcgctgcacgttaaaacgccgggcgttattcctcttcgttttcttcatcttcgtcttcgaatagcgcccgaatccgttcgcccttgaaattttgtcggatctcctgcgccacctgggtgatcgcttcaccgctcgacaaacctcccgccatcaattcctgaatacgttcgacggcctgctgctgctgctcatgagagagagccggtattcctataaacatgtttcactcctgcgttggggcagacagtatcccacgcggaactaacaggtgccagtcaggaaaaaatatggcagtctgaccgcctctttgctctctgatttctctgcccgatgattgttgaaaccctcagtcttgattataccccggatgcgctgactcagcgttttgccccgattgcccatctgccctgggcgatgctgctttcctccgcgcaggcgaaccacagcgacaaccgctttgatattctgaccgccgatccccgcgccaccctggtgacccgcggtgcgatgactaccctcagcgacccgaccggcacgaccgaatcaaccgccgatcctctgctgctggtacagcagcagtgtgatgcgctgggcgtgacgccggctgccagcgatgccctgccgtttcagggcggtgcgctgggcctgtttggttatgatctgggccgccggtttgagtccctgcctcagcaggccgcagccgatctcaccacgcctgacatggcggtgggtatctatgactgggcattgattgccgatcatcatcagcagaccctgacgctggtggcgttaaagaacgcggaagaacgcgccgcctggctggcgcaatggccggcgcgcgaggccgtgcccttttcactgaccagccgctggcgctccaacctgagctatgcagattacgctgcgcgttttgcggcggttcaggcctatattcaggcgggtgacttttatcaggttaatctggcgcagcgctttcaggccggttaccagggtgatgagtggcaggcgttcagtatactcaatgcggctaaccgcgcgccgttcagcgcttttctgcgtctgccggagagcgcaatcctgagcctgtcgccggagcgctttctgtcactgaataataaacagatcgaaacccgaccgatcaaaggtacccggccacgctgtgacgatccgattgctgatgcgcaacaggctgagtcgctgcgccatgcggaaaaagatcgggccgaaaacctgatgattgtcgatttactgcgtaacgatattggccgcgtggcgctacccggctcggtcacggtgccggaactgtttgtggttgaacccttccccgccgtgcaccacctggtcagcacggtgcgggcgcagctgcctgacaccctgcaggccaccgatctgctgcgcgcctgttttccgggcggctcgattaccggtgcgcccaagattcgggcgatggagattattgatgaactggagccgcagcggcgcaatgcctggtgcggcagcatcggttatctcagcctgtgtggccggatggataccagcatcaccattcgcacgctgatcgctgaaggtcagcagctctactgtgcggcgggcggcgggcttgttgcagacagcgatcccgaagcggagtatcaggaaacactcgataaagtcagccggatcttaccggcactggaacaaaccggaggttcagttggccctgacgcttgatgattttcgcagccgttttctgttgcagcagccagcccgcagcacacaattgctatccgggcgccatgcggcggtgctggtgccgattgtggcacggcctgaacccggtctgttgctgacgcagcgctcacacgccctgcgcaaacatgccggacaggtcgcttttcccggcgggatgcaggatgacactgacgcatcgctcatcgccacagcactgcgtgaagcacaggaagaggttggcattgagccgcatcaggtcgaggtattaggcgcactgcccgccgtgaccagcagcaccggctttcaggtgacgccggtactggggatcattccggccgatctgcgattaacgattaatccggatgaggtgagcagcgcctttgagatgccgctggccgaggctttgcagctcagccgctacagcgcgctggaggtgcatcgggctggcgttcgccacccggtctggctgtcgcgctatcaggattatctggtgtggggcatgaccgcgggtattatccgatcactgagtgctcagatcgcattctgaaacctttctcgtttttctctctccggcccgtcaggttactggcgcgctgcactataattttttctataagttttgataagtttatttcatgcgaaaagctgctctttcctggtgcatgaccattactatgggcgccataaactgccccggcagactgagaataattgtgaggagtgtcacctgtgattagtgtttttgacatgttcaaagtgggcatcggcccctcaagttcgcatactgtcggcccgatgaaagcaggtaaacagtttgtggatttgctgtgcgaacaggaaaagctgcaggaggtcacccggatcgccgtggatgtttacggttctctctctctgaccggcaaaggccatcacactgatatcgccattattatgggtctggcgggtgaatcgccggatacggtggatatcgatgcgatccccgcctttattaaagatgttgagcagcgtgagcgactgctgctggcgaaaggcgcacacgaagtggatttcccgcgcgaaggcggcatggtatttcgcagtgagaacctttcgctgcatgaaaatggcctgcgcctgctcgcgtttgcgggtgacctgctgatcctgtcaaaaacctattactccgttggcggcggtttcattgttgatgaagagcatttcggacagtcggcactggatgaagtctctgtgccctggccgttccactccgccaaagatctgctggctcactgtcgtgaaaccggcctgtcactctcaggtctggtgatgaaaaatgagctggcgctgcacagccgcgatgagatccatgcctatttcactaacatctggcagacgatgcaggcctgtatcgatcgcggtctgaataccgaaggcgtgttgccagggccactgcgcgtgccgcgtcgcgccgcctccctgcgtcgtctgctgacctcctctgacaagcactccagcgatccgatgattgtaatcgactggatcaatatgtatgcgctggccgttaacgaagagaaacgccgcgggaggccgcgtggtgactgcgccaactaacggtgcctgcggtatcgtgcctgcggtgctggcttactacgatcacttcattgagccagtgacacccgacattttcctgcgctatttcctcgcctctggcgccatcggcgtgctgtacaaaatgaacgcctctatttcaggcgcggaagtgggctgtcagggtgaagtgggtgtcgcctgttctatggcggcggccggtctggctgaactgctgggcggcagtccggagcaggtctgcgtggcggctgaaatcggcatggaacataaccttggtctgacctgtgacccggtagccggtcaggttcaggtgccctgcattgagcgcaatgctatcgcctcggttaaagcgattaacgcggcgcgcatggcacttagacgcaccagcgaaccccgcgtctcgctggataaggttatcgagacaatgtatgaaaccggcaaagatatgaacgccaaataccgtgaaacttcgcgtggcggtctggcgattaaagttcagtgcgattaagcgaaacgattaactgactaaaaaacgtgcaaacgtaataaaatccgcatcctgcgctatctcagcgcaggtttaaccggtagagtgatttccgcgcagccgtccggcttacgcaactttccagacccgcttttctgcattccggcctcaatgttgatctgaccgtgccgatactcaccccgttgtgttttgctttttactggctttttgggaaggtgaatacagatgtttatggcccagcaatctgttggacaattcagacgcaagcgtgtgctgatagcgctgtcgatcgccaccgtggtgctgatattaaccctggcctttcgctatatcgaagagaagtcacgtatcgagcagcaggcgatggatttcgccgataaagcgattatgcggtttgaccggatgttttcaccgctggaggtttcagccaataatacgctgggtctggtcggcgttccctgtcaggatgttcgctttccactcatcgaaaaaatctcttccctgcagacggtccgggcgatcctgctggtggataacgacgtgctctactgctccagtatctacgggccgcgcaccattccctttagtcagacctaccctgatttagcctttaacagtcagcgtatgacgctggcaaccgatgaatatctgctgaaaggctcgcccattttactgctgtggacgccaaagagcctggataaccgctccgggattttgcaggtgatcaacatcgaaatgatgagcaattatctgctggagccgcagttgccctgggtggagcgcgctgtctttaacgtcaatggagagagcctggagtatggcaatccactgatcgagcccacggtgccgtcagaagacgaagtgagctatgagcagggctcgctgcgctatccgtttacgcttactctctatggcccctctccgacccgcctggcgctggcgacgcttccctcacagctcccgctggcgctgctgctgagtctgcttatgggttacatcgtctggctggcgaccgcaaatcgtatgagcctgagctggcaaatcagttatggcattacggcccgtgagtttatggtttattgccagccgctgatcaacaccaaaagtggtgagtgcgacggtattgagttactgctgcgctggcataatccccgtcagggctggattgccccggatgtctttattcccctggccgagcgacagaacctgatcaaaccgctgacgcgctttgtactgaatgaggtggtaagtcagttaccgcagctgcccgacgatcccgcgttccatatcgccattaacgttgccgccagccacttccgcgaccacgccattctggaagatctgcacaacctgtggtggcctgccaatccggtgccgaaactggtggtggagctcaccgagcgcgatgccctgccggtcgtggatcagtcggtgattgcgcaactgcacgacatcggtgtccggctggcgattgatgattttggcaccggtcacagctcgctctcctacctgaaagatctgcagccagatgtgctgaaaatcgacaagattttcaccgcagccatcggcactgacgcgattaatgccacggtgacggatatggtgatttcgctggcccagcgcctgaatatcagtctggtggccgaaggcgtggaaacagctgagcaggcggcctatctgcgcgaaacgcggcgtggatcatctgcagggctactatttttcccgcccgatgccgctgcaggacttcccggcgtggctggcgcagcatcaggctgatgcccgcaggtgacaatcgcctgagccccgtttcgccctgcctgatgaccttacgccacagacaaaaaaacagccgcggcaatgagccagcggctgtcggagaattcagcgcggccggtaaacccggcagcgccgctgcatcaacgagaacgattagccctcttcatcctcatcatgcggtttatctttagtgacacgcaccagatcgatacggtagtcggtcgcttcgataatctggaagtgcagcggagtaatatcaatcacatcgccaggaagcggtaactgccctttctgctcaatcagcaggcccgccagcgaggcgtggtcttctgtcggatcgaccagttcatggaagtcgagcaactgctgcagcgagtgcagatcggtcccccctttcactaaccagccatcaccatccgcaataatatcgggcgtttcatcttcatccgggaattcacccgcaatcgcttccagcacgtccagcggcgtaatcagaccctgaaccacaccaaactcattggtgacaatcacgaagctgcctttggcacgacgcagcacgccaagcaggttgatcggatccagcgtctccggcaccacgatagtcggtgtattggccgcaaaggtcgccacatccacaccgtgctccagcgccaccagcagctctttggctcgcactacgccgacaatttcatccagttcaccccgacagaccgggaacaggctgtgtggcgtatcaagcagctgaccgcgaatctcatctaccggacgattcgcatcgacccaggagatttcaccgcgcggcgtcatgatgctgcgaatcgagcgggaagccagcgtcagcacgccattaatcatatagcgctcttcatctttaaacgcttcctgcggcatcgcttccgccagcgcagcctcttcgctgctgctggtgttgccattgctggcggtctgggcacggttgcggccccccatcaggcgtaaaatcgcttcggcggtgcgttcacgcatcgggcgatttgactgatggcggataaagttacgacgtgcaacctggttgaacagctcaatcagaatcgagaagccaatcgccgcatagaggtagcctttaggaatatggaaaccaaagccttctgccaccagcgacagaccgatcatcagcaggaagctcagacagagcaccaccacagtcggatgcgcgttaacaaagttggttaacggcttagatgccagcagcatcacacccatcgcaatcaccacggcggtcatcatcaccggcagatggttcaccatacccacggcggtaatcacagcatccagcgagaagacggcgtccagtaccacaatctgcgtcacgacagcccagaaactggcatatccccgattaccggatccgtcgagctgccggtttctccagccgctcatgcagctccatggtcgccttaaacaacaggaacagaccacccgccagcagaattaaatcacgaccggcaaagctgaaaccgcctacgctaaagagaggcgtcgtcagcgtcaccatccaggagatcagcgacagcagacccagacgcatgaccagcgccagtgacaggccaatcaggcgtgctttatcacgctgcttcggcggcagtttgtcggccagaatggcaataaacaccaggttatcaatgccgagcacgatttccagcaccacgagcgtcagtaaacccgcccagattgaggggtcgaataaaaattccattatttatgactccagaacagggaacagatcgcggtgccgcttatcagcgcagcaatgcgtgacatgcaggtagtcgggaaagcggtgaaaacgccgtgaggcgaagggtgacgcgccagcaggcgcaaagaacagattaagcgacgtcggtgacgatccataaaggtgggctgaagcccgttactcctgagtaataaacagaacgttaatgtatcaggtcggcgaattgcgtcaaaaaattttcttatttttacaatctgcctgacggatgatcaggcgcataaaaagggttactggtcacttcacaggatgaatagctgacagacatcacataatttattttttcgatcactaaaataaatcgcgacttaatcgccttgacgtagttaacccatgttttttcgacgctataccgataattcgaatcatccggttaaacagatcatcaaagcacttcaatacagttcattgactcagatgagcatctctagcgaacggaggtagcacgtgaccattgcgatagtaattggtacacacggctgggcagcggaacaactgctgaaaacagcagaaatgctgttgggcgagcaggacaatgtcggctggatagattttgtccccggtgaaaatgcagaaacgctgattgaaaaatatcaggcacgactggcagaacttgatacgacgcagggagtcctgtttttagttgatacctggggtggcagtccgtttaatgcggccagtcgcatcgtggtcgacaaaccgcagtatgaggtcatcgccggggtcaatatcccgatgctggtcgaaacgctgatggcgcgcgatgacaatcccggttttgacgagctagtcgccgtggcggtggagaccggccgtgaaggggtcaaggccctgaaagccaaagaagaagcgccggcgccagccgcggcaaaaccggccgctgcggcgcaaccggctaagccgatggcgcccggtgaccacatgaaaatcgggctgacacgcattgatgaccgtctgattcatgggcaggtggcgacgcgctggacaaaagagaccaacgttcagcgcattatcgtcgtcagcgatgaagtggccaacgatcatgtgcgcaaaaccctgctgacacaggtcgctccgcccggcgtcacggctcatgtggtggatgtcgataagatggtgcgggtgtggaacaacccgaagtatggtcaggatcgcgtgatgctgctgtttaccaatcccaccgatgtactgcgcgtggtggaacagggtgtcgatattaaaaccgtcaacatcggcggtatggcgttccgccaggggaaaactcaggtcaataatgcggtctcggtcgatgaaaaagatattgccgcattccgcaaactcaatgaacgcaatattgaactggaagtgcgtaaagtttccagtgaccagaaactgaaaatgatggatctgatcgcgaaagttaacgcgtaacagaagcacttatgcgcctgcgtttccgggctcctggttatcctgctgaggacaagaagtatgatggaaataacctcgctacaaattgttttgatttttattgtcgcctgtattgccggtatggggtcgattctggatgagttccagtttcaccgtcccctggtggcctgtaccctgattggtatggtactgggtgatatgaaaaccggcattattatcggcggtacgctggagatgattgcgctgggctggatgaacatcggtgccgccgttgcgcctgatgccgccctcgcctccattatctcgaccatcctggttatcgctggcggtcaaagtgtcggtgccggtattgcgctggcgattccgctggccgccgccggacaggtactgaccattatcgtgcgtacgctgaccgtcgccttccagcatgcggctgacaaagccgcagagaaaggtaatctcacggccatctcctggatccacgtctctgccctgctgttacaggcgatgcgtatcgccatcccggcgctgattgtggcgatttcggtcggcaccagtgcggttcacgccttactcagctctattccggacgtggtgaccaacggcctgaatatcgccggtggcatgattgtggtggtcggttatgcgatggtcatcaacatgatgcgcgcaggctacctgatgccgttcttttacctgggcttcgtcaccgccgccttcaccaactttaacctggtggcgctgggcgtcattggcgtggttatggcggtgctttacattcagctcagcccgaaatacaaccgtgtggcgggagcaccaacaggtgctgcgaccgcaaacgatcttgataacgaactcgattaaggaacaggtgagcacatggttgatattacgaaagtcgaaaagaaactgactcccggtgatgttcgcgccgtctttctgcgctctaacctgttccagggttcatggaactttgaacgcatgcaggcgctgggcttctgcttctcaatggtgccggtgatccgccgtctctatcctgagaacaatgatgatcgtaagcaggcgatcaagcgtcatctggagttctttaatacccatccttatgtggccgcgccggtttctgggcgtgactatggcgatggaagagcagcgtgctaacggcgccccgatcgacgatggcgcgattaacggccttaaagtcggcctgatgggaccgctggccggtgttggcgacccgatcttctggggtacggtgcgcccggtgtttgccgcgctgggagccggtatcgccatgagtggcagtctgctgggtccgctgctcttctttgtgctgtttaacctggcacgtctgctgacccgctactacggcgtggcctatggctatcgcaaagggatagatatcgtcagtgatatgggcggcggtttcctgcagaaactcacggagggggcgtcgattctcggcctgtttgtcatgggggcgctggtcaacaagtggacacacgtaaacatcccgctggtggtgtcacgtattaccgactcgaccggtaaaaccaccgtcaccaccgtacagtcgatcctcgatcagctgatgccgggcgtggtgccgctgctgctgacctttggctgtatgtggctgttacgccgtaaagtgaacgcgctgtggattatcgtcggcttctttgctatcggtatctttggttactggatcggcctgctcggtctgtaatttcacccggccgggagcctgcgctcccggcttttaagcgtggtgagctgagccacaaccggctgagctcaccctgtttgaggtagatgtgatgtcattaaccgacgcgctgattgcgtgttgtattgccgccctgatggggtttgccatttatcacgaggcgattctgccgcgtcgccacggtccgacccgcttacgggttgcgctgcgcaggcagcataagctggatagcctgattttcatcggcctgctgctgatcctgctgtggaacaacgtcagccatcacggcccgcagctcaccacctcactgctgatggtgctgagttttctggcgttctggctattctggctgcgaaagccaacgctgctgatgaaaagtgaggggttgttttacgccggtgtctggatcgattaccggcgaattcagggcatgaatctctctgaggatggcattctggtgattcagctggaacagcgtcggctgctgatcgcggtgcagcaactcgacgatctggagcgcatctataacaccctggtcgaggcgcgctagtcgcgctgccacacagtcagggtaaagtctgcgtcgcagctgaactgctcgctctgctgcagggtctgccagacctcttcacgcgcccgccaggcgaacggcgtcatctgaagcagggtcgtcgcggctgtgccggttaatgccatcgggtaacgcagcgcatgctgcgccacctggcggaatccgggatacgctttctgctccggcacatgcaactgcacttcgcggtaaatcagcgccttgaactgctgcagatgatgcgggcccggagtcacggtcagcaccaggccacccggcttcagcacgcgggccagttttccgcttcattgcagggcgcgtagattcggacaaccgcatccagggcgtgatcggcaaagggtaagcgctggctggaggcgacgcagaagcgcaccgccggatagcgctttgctgccagccggatcgccattctggcgacatccagcccatagacctgcccggcctcgcctgctccgtcagccagtgcggcggtgtagtaaccttcgccacagccgatatccaggattttgcactccggctggctcagcgcgggcgcaagcaggctgacgacccgatcacgcagcggctggtagtagcctgcctcaagaaattcgcgtcttgcctgcatcatctctgcactgtcacccggttcacgtgaccgtttatgttgaacgggcagcagattgacatacccttctttcgcctggtcaaactgatggcgattctcgcagcaccagctgcgcgcagtaaaggcgagaggagagtgacaaagagggcaaatcagggacatagggtgctccggcatcagataacgcggcgcagtgtaaccttaacgtttacgcatcggaagcataaagaaagccccggctgagaagccagggctttgagatttcatgtcagggtgcaatgcaccgaggcggagttgaatcagatagccgtaacgttaacggctgccgggcctttctggccgtcctgaatttcgaactcaacgctctggccttcagccagggttttgaaaccattgccctgaatagcggagaagtgaacgaacacatctttgctaccgtcagcaggggtgataaaaccaaaacctttagactcgttgaaccacttaacctgacctttaatctttgccattttgcaaattcctttagatgtttatttagcccgaaggctgtcgtacagaaaaaccagagacattactgcatgaggcactaattaaggttcggcaaggaagcggtattcaacgtcaacgtctttactcgttcttctttacagacttctttacagaagatgccatgcataaacagaactgtacctcgtttaactcaggatttgttatcacatatcctaaaaacaatggcaagccatttttaagggcctcagccagcctgcgcacataattgccagaaggctcacattgcctgttctgtggcgcttacaaatgccgatgcaaattaagcacgctctccggccagacccctctccggcctctgttgtcgggtctaacccaatggataccataagaaattaatatttcacaaatatggcaataacagaatgaataagcgaagcgcgaaaagttgaaaatatcaataatccggcttcaatcctgtacagcgccttttatttcgtacagataacactttttttgcaccaaaagcaggagccagacagtcgtcctgctccaaataaaagcattgagcccgattttacttattaagaatttaacttttgatttgaaaaattgatatcagataataaaaatcgggcctttgtttatctctgaggttttaggataattcctgggtatccttattcagcccgcggctttcgcctattcgccacggtgcgaaaccgcccttttgctcgtttgcccgcagcagcgcatccgccagttctttgggtggtgcatcaagcgactcatcggccagttcgaacacgccccagtggatgggcagcgtcagcggcctgcctgctgcctgccacagcgccaccgcctgatcgggattcatatgttggcccgccatgaaccattcaggtgcataagcgccaatcggcaaagccgccaggctgaacgggccgagtcgggcagcaatctccggcaggctatcgctgtagccgctgtcgcccgagaaccagaagcgcacggaggcagaacgcacgacccagccgcaccagagcgaaacggtttcgatcgcgcggcgttcgcatactccagtgacgtgccggcaccgcatcaaaacagaggtcgccgacagtaaactgttgccaccagtcgagctgatggacctgtttcacgccccgcgccctgcaccatttttccaagcccagcggcacaatgaaggtcgcctgcggaaaacgccggacgatcgctttaaccgtcggccgatcaagatgatcgtaatggttatgtgaaataagcacgacatccagacgcggcagatcagcgatgctaagcggtgctggcgtttttcgctgcggcccggcaaaagagagtggcgaggcgcgtgacgagagtgcgggatcgatcaggatatattgctggttcagtcgcagcagcacggcggcatgtcccagccaccagatgcgatcgtcactgccgctgatataagcggtctgccaccactgttcggtgaaagccctgtagccctgctgcggtggcagcggcagtccctgtgctttgcgctccctgcgccagcgctgcagatcgcccggcttgcgccgttccggttcaggattgcagaatccctcgggcgtgtgatgcgctttgctgctgtcataccacggatttttccagaccatcccgcctctctgctgtgattatcgttccggaatcaaccggataaagtcgcgtttctcgcgatcgtcatcggtttttttactctctgcccctggctgcatctcaatcagacggcgcagcagctgattctgtttcttctgctcttccagcaaagactccagtaaacggatttgctcaccggcgcgcacactggcgcggttgacaaagaaccaggcgataaacgccacaatcaaaataatgaccagcaagccatagctgaccagtgggcccgaatttgcggctaactcattcataactgcctcgtaaaactcagtggaaacgccagaacatggcaaccgcccattctacctgtcgccatcgcaaaagataatggggttaacatcaatgcagaatttgccgtttcagttatctctgatcgatcccaccagaaaagcgaggcatgctgatatcatcataaccggcggcaccaggtggagcgctgagttatctttcacaaggagacataatgaaactgtttattcgtacggtaggcttgctggcggtgatctggctggcgatgctgtttaccggctatggcgtattaaccggcagtactaaaaatgcagccggccttggcctgcagtgcagctatctgaccgctcgcggtgtgatcagtgcgcagtatctgcatactgacagtggcgtggtgggcgtgactgattgtccgttgctgaagaaaagcggagaagtgatcgataattaacaaaacagcgggccacatggcccgctgttttcagaacggatagtcgtgatagcccatctctgaggagagcgtgcgcgccgcccgatgcaacatggccacgtaatcctggcgggcatcttctgaaaagcgaatggtgggaaaagagatactcagtcccgcaatcaccacgccaaaacggtcaaataccggcacggcaaggcagcgtaaaccctcttcctgctcttcgttatcttcaccatagccctgcgttcttacctgatccagcgccgtaatcaacgcctccgcgcttaacagcgtattggccgtgctccgtttgaattcgacatcccgcaggatctcttcaacttcgctgcgatcgcgccaggcgagcagaactttcccaatcgcggtggtatgcagcggattacgacggccaatgcgcgaatacatacgcaggttgtagagggagtctattttgtggatgtagacaatactgtcctcttccagcgcccccagatgaatggtctctttggtcagacgcgaaagctcacgcatctgcacatccgcactgcggattaaatcgacgttctgcagcgctttagcgcccagttcaaacagcttcagtgtcagtgagtacttctcgctctcaccttcctgcgtgacataacccagcgacttcatggtctgcaggaaacggtaaacggtgctttttgacatcatcacgcgctgcgcgagctcagtaataccgtgatcgcgctcttcacccagcgcctgcagaatgccgaacactttaagtaccgaagagacggaatcgggctgtttatcattttcagcagaggacatcgcgcaccttgttaaacctgtttcaaaaaaaatggaacggactgtcagtatagagtgaggcatacgaaggcagcaatgctttaaccattacgtcatatttaaagacagttttttatccatccgatcgctgtatttcagcgttaatttcattagcatgatgatattcaccctctttagtaattaacttatgacactctcccctcctcaggatggattacccgcgcgtcagcgctatatggcaatcgtcaccatcgcgctgggtctgaccatggcggtgctggatggcgcgatagccaatgtcgccctgcccactatctcgcgcgaactgaatgccagcccggcgcagtcgatctggatagtgaacgcctatcagattgcgattatcgtctcgctgctgtcgctctcctttctgggcgacatgctgggttatcgccgcgtctatcaggcgggcctggcgctgtttattgccacttcgctgttctgcgccttctccaccaccctgaccatgctgactttcgcccgcgtgctgcaggggttagggggtgcagcgctgatgagtgtgaataccgcgctgatacgcattatctatccgcagcgtcatctgggacgcggcatggcgatcaactcgctggtcgtggcggtttcaaccgcggcaggcccgacggttgccgcagcgattctttcggtggcaagctggaagtggctgtttctgattaacgtcccgctgggtgccattgcgctctggctggcgctgcgcacgctgcctgataatccgcagaaagcgacggcgcagaaatttgatgttcccagcgcgatcatgaacgccctgttctttggtctgatcatctctgcgctaagcgggtttgcacagggacagagtcatctgctggtgctgtcggaggtcattgctctgctggttgtgggctggttctttattcgtcgtcagttaaacatggcggtgccgctgctgccggttgatctgctgcgtatcccgattttcagcctgtcgatgggaacgtctgtctgttcgttctgtgcgcagatgctggcgatggtgtcgctgcccttctttctgcaaaacgtcctgcagcgtgatgaggtggcaaccgggttactgctgacgccctggccgctggcaaccatggtgtttgcgccgattgccggccggctgattgaacgggtgcatgccgggctgctgggcggcatcgggctggctatgttcgccctggggttgtttctgctcgcctggcttccggctaacccgggtgatggcgatataatctggcgcatgatgctctgcggtgccggttttgggttgtttcagtcacccaacaaccacactattgtcacttccgctccgcgtcatcgcagcggcggcgccagcggcatgctgggcaccgcgcgcctgctgggccagagtatgggtgccgcgctggtcgcgctgatgtttaatctgtttgatgaacgcgggacgcacgcttcgctgctgctggcgggcagctttgccgccgtggccgcgctggtcagtgtgtcacggatgacgcagacccgcgcctgatggcagaaacagaaaaggcgaccacctgacagagtgtgacccgattcgctgtaaggccgagccttcacagggaacccggtcagatcggaaagacttctgtcatccatgacggtcggcccgcaccatccatggcgcgggacgctttcctcctttgcccgggtttccctgcatgttgagctaagatattgctgtcagattcagtctgattatggtttctaaacagaaaaggcgacccagggtcgccttttttgctctgcttaacgctacttcagatactgaccgctacgcagtgcttcaatacgcttatctaacggcggatgcgacataaacagctcgctgaacgatttgcctttaccgttgatacagaacgccatcatgctgctcggctcctgcggttcgtagctggttttcaggcgctgtaacgccgcaatcatcttctcacgacctaccagcttcgctgaaccggcatcggcatggaactcacggtgacgcgagaaccacatggtgatgatgctggcgagaataccaaacaccagttccagcaccatcgacaccgcaaagtagaccagcgggttgccgttgctgctctcctcaccatcgcggttgccggacataaagcccgccgcgatctgcgccagaatacgtgaaacgaaaatcacaaaggtgttcaccacaccctgaatcagcgtcatggtgatcatgtcgccgttggcgatgtgtgacacttcgtgtgccagcaccgcttccgcttcatcacggctcatgttctgcagcagaccggttgagacagcaaccagtgaggcgttacgccgtgcgccagtcgcaaaggcgttaatgtcaggtgcgtgatagatcgccacctgcggcatcgcaatacccgcctgttgtgcctgacggccaattgtatccaccagccagcgctcggtttcgttgcgtggctgttcaatcacttcaccgccaaccgatcgcagtgccatccacttcgacatcagcagtgaaacaaacgcaccgccgaagccaaacaggcctgccatgatcatcaggccctgaacactgcttgactggatccctgtcaggctgagaatcagcccgaataccaacatcacagccaggttggtcatcaggaaaagagcaatacgcatcatttttgttaatcttcctcagtagttcacgcgcctatacgcggatccatatcctatgggcattgggctgcttttcaagcaaccttaacgtttaagtgcctaaaaagacataactttacattctgacacgcctgatgaggagcccagtcttcaggcaccttcaccagcgctaatcattgcttactggaaacttttctgagtacaaaaaaaagcaccgctgagcggtgctttttctggcaacagcggattatttagccgctggcgcctctggctgggatttctccagctgcgcaagatcgttagcgatcttcaccgtctcatcaagatagggatccggctctttataatctttcggcaactcatccaggtttttcagcggttttttgccttcggcctgatagcgcgcgttgatccgctccagacgagacgcatcatcttcgtggttctctttctcgcgctgagcgagattaagcgacacgatgttgcgcttatctttcagggcattgtaacgggcaatgtccttcatgatgtactggaactcgcgatcctgagcgatgcggtcagcatgctgcttagtcagctgcactaccagcggtttcacatcaccggttttgacataggtcgctgctttgatgctgtcccacggcagtgcattatcctcaaatttctcaccggtttcagccgcttcaacgccggttggcatcagcagatccggcgtgacgcctttacgctgtgtactgccgccgtttatgcgatagaacttctgaatggtgtaagaaacggagcctaacgcaggccactccggacgcagcatctgatcgtagatgcggttcagagagcgatactgctgaacggtgcctttaccaaaggttggctcgccgacaatcaccgcacgaccgtaatcctgcatcgcggcagcgaagatctcagaggctgaggcgctgaaacgatcgaccagcaccaccagcggtcctttgtagtagacaacgccgtcgttatcgctgtcttcacgaacccgaccattgttgtcgcgtacctgaactaccggaccactcggaataaacagaccagaaagcgagactgcttcggtcagcgcgccgccgccgttggtacgcagatcgatcaccacactgtcgacgttctgtttctgcagtttctgcagctgtactttcacgtcgtcggtgaggccgacatagaaaccaggaatatcgagcacgcccactttctgcttgccgacatttttgatggtcaatttaaccgcgcgatcttccagacggattttctcacgcgtcagcgtcacagtacgggttttagtacccttaccggctggcagaacttccaggcgcactttgctgcccttaggtcctttaatttttgccacgacatcatccagacgccagccgatcacatcttccatcggcttgcctggctgacccacaccgacgatgcgatcgccaacggtaatggctttgctcttcgcggccgggccgcctgcgaccatcgagttgatcaccgtatagtcgtcatccatctgcagaaccgcaccgatgccttccagtgacaggctcatttcggtgttgaactgctcggtgttacgcggcgacagatagctggtgtgaggatcgatttcgcgggcaaaagcgttcatcaccagctggaaaacatcttcaccgttgctctgggccagacgacggatagcgaagttgtaacgcttggtcagaacgtcgcggatctcgttatcatctttacccgccagcttcagactcagctgatcatatttgaccttggcatcccacagcgcattcagttcagactgatcttttggccagggtgctttcgcgcggtcaatgtcgatagtgccattgccgctgaaattcatcggacgagccagcaccgtcagcgcatattgatagcgctcaaaacggcgtttctgcgccagattataaatatcgtaaaagagatccagcttgccactgcgcagctcatcgccgacggtggtttttttgctggcaaactgcgccacatctgacgccagcagcacattgtggctgtagtcgagcatgttcagatagcgatcaaaaattttcgctgaaaagttctgatccaggtcgaactggcgatagtgggaacgggtaaagcgcgaggttacgcgctcactgaccgtcggatcctgcggatcttcgtgaagctggggaatctgatcggcgcgggtaatgttctccgcgccgaaggttgggcctgctaatagcaggcccgcaataagtccaactttaaaaagggtgttcatgccggggttagcctccgtttcagaactgcaagtgttctgcgcgcacaatcattgccatgccggaagcgagctggacccgaaacgccgtcttttgatacttcaagaacggtagcgtccatcgcacttttgcctgctttaactttaatactctggccgggttgcaaagttgaggtatcagtgatgggtcgggcttcctgctccggacgtggggctggcttgcgatgctgtgaggcggtcgcacgcggtgcagtggtctgcggacgcggtttacgcgcggcttcgccttctgcaggcttacgtgccgcgggcttgcgtggacgacgcggtgccgcgccctcttcgctttcgcctgcttcacgacgcgcggcgcgctgctggtcacgctgcgcctggacgcgtgctttcgcttcttccagttgcttgcgtgcatgctcaacgtgttgctcatccagcacgccacaggcattaccgtcgagatcgacacggatagcaccggctttgatgccgtacagataacgccagcttgacgtatagagacgcagcgcggaacgcagctgtgttttgctcagacccatttcgccctgaacacgctcgaccagatcctgaaagataccgattttgagcggacgcgcttcaccttcagcgctaaagcagtgcggaaagcgctccgccagaaaagtgatgacttctttactgctattcaacttaggttgattttccatgaaatttcctgattacaacgggtttgccgaccagcgcaggcatgaacaggcgacattataatgacaacatcgctaaatgccatgtgatccagtcgattagctgcgcgtcagctgcagatatttttctaagtcgctgttcgcaagcacttcacaaagcccatcagtcagtgtgaccagccccgattcgtcgtcgctgtcaaagcgattgtacgccacgctgtcgatgtccagcaccccaaccacagtgccattcactttcagaggaatcacaatctcagcattgctggcagcgtcacaggcgatgtggcccgggaaggcatgcacatcatctacgcgttgcactttttcttctgccagcgccgtgccacacacacctttaccgaccggaatgcgcacacaggcgattttgccctggaacgggcccagcaccagcgtatccgcttccgtcagcaggtagaaaccagcccagttcacgccatcgagacgttcgtacagcagcgcgctaaagtttcccatcgcggcgaggaacgccgtttctcccgccagtaaggcgcgcatatcgcgattcaaatcggcgtaaaaggcagttttgttcattatttaaccgttaccaatgacatctgaacggggcattgaagaccgttcgttaaaaataagttttaaatatccagagccacaaggtgaatcatagcgttagttgctatacccttagcattctgtggatcgaagcgtgatgcccgagacaggcacacagacaatgtctttacgaccgatatctgttacttctgaagagcgaagattgcatcaccctatgaaaattcacgctatcagccagacattgcctcacgcacgttatcagcgttgcccgcaatgcgatacccttttttccttaccggatgtgaaatctcatcagtcggcacattgcccacgctgtaacgccgaaattctcagtggtcgcgactggccgatgacccgtcttatggcgatggccgccaccatgattgtgttaatgccttttgctttctccctgccgctggtagatatccggctgcttggcatgcgcatcgatgccagcgtactggaaggtatcatccagatgacccagcagggtgatgtactgacggcctcgatggtggcgttctgcaccatcggcgcgccggtgacactggtggcgggtatctgttatctcggtatcggccaccggctcggcatgaatctgcgccccgtttctgctgatgctggagaagttgaaagagtgggtgatgctcgatatctatctgatcggcatcgccgtggcgtcaattaaagtgcaggactatgcttcgctggagattggctacgggctggcagcttacatcgccctgacagtgctgagcgtgctgacactgatccatctgaatatggagcagctgtgggagcatttctacccacagacgcctggcaatatggcccgtgacgatatgcaggtctgcctgaactgtcacaacaccagcatacccgatgaacggggccgctgcccgcgctgccatacgccgctcgacttccgacgccgccatagcctgcagaaatcctgggccgcgctcatcgcatcgattgtgctgttgatccccgcaaatctgatgccgatctccgtggtctaccttaatggctcacggcgtgaggacaccatcttctccggcatcctggggctgggcgaaggcaatattccggtggcggcgattgtttttatcgccagtattctggtgccgtttatcaaggtgctggtgatgctgactctgctgctcagcattcattttcgctgtgaacaggggctgagaacccgcatccggttactgcggtttgtcacctgggttggccgctggtcaatgctcgatctgtttgtcatttcgttaaccatgtcgctggtcaaccgtgatcagctgctggcttttaccatgggaccggcggcgctgttttttggcgcggccgtcatcctgaccattatgtctgttgagtggctggacagccgcctgctctgggatgcacatgcaacaggaaacgccgactacaccgactaacgcaacgctgcgcaataagcgcaaaatttcgcccttctggctgctgccgattattgcgatgctgatcgcctgctggctgctctggaccaattatcaggagcgcggcaccaccatcaccatcaatttccagacggcggatggtatcgtgccgggtcgcaccccgatccgctatcagggcgtggaagtgggcaccgtgcagggcattaatctcagtgatgattatcgcagcattcagattaaagccagcatcaagagcgacatgcgcgatgcgcttcgtgaagatacgcagttctggctggtgacgcctaaagcctcgctggcgggtgtgtcggggctggatgcgctggtcggtggtaactacatcgggatgatgccaggtaaaggtaaacccagcgagtcatttaccgcgctggatacgcagcccaaatatcgggtgaataccggcgaattgatgatccatctgcatgcgcccgatctcggctcgctcaacaccggctcgctggtctattaccgcaaaattccggttggccgggtctatgactacagcattaacagcaaatccgatggcgtgtcgattgatgtgctgattgaccgtcgctttatcaatctggtgaaaaccaacagccgtttctggaatgtgtcaggcatgaatgctgacgtcagcctgagcggggctaaagtgcagctggagagtctggcggcgctggtcaatggcgcgatcgcgtttgactcgccacagggtgcggaaacggccaaagctgagcagaattaccggctctatcccgatctggcacatagtcagcgcggcgtgcagatcacactggatctgcctaacggcaacaatctcaaggcgggcagcactccgctgatgtatcagggactggaggtcggcacgctgaccaaactgaacctgcaggatggcggcaaggtcaccggcgagctgacgattgatccctctgttgtcggtctgatgcgcagcggcacccgcattgagatgcacagtccgaaaatcagcctgacggataccagcctcagcgcgctgctgaccggcaacacgctggaactggtgccgggtgaaggcgaaccgcagcagcactacaccgtgctggcgtccaatgagactctgctgcaaaagcccaatgtgctgacggtaaaactcagcgcgccagagagctatggtatcgatcagggccagccgctgatgctgcacggcatgcagattggtcaggtgatgtcgcgtacgctggatgaaaatggcgtgaatttcgtggtagcggtcaatcctgaaaatcgcaatctggtgcatggcgacagtaaatttatcgttaacagtcggctggatgtgaagttcggccttgatggcatgcaggtattaggtgccagcgcccgtgaatgggtggatggcggtatccggctggatccgggcaaaaagggtgagccaaaaagtgcctatccgctgtttgccgatgctgaaaaagcggaagaaggcattaccggcgatggcccttctaccacgctgatgctgaccgccaccagtctgcctgatgtgcaggccggctctgtcgtgctttaccgcaaatatcaggtgggtgagatcgtcaaagtcacgccgcgcgctgacgcctttgatattgcggtacatattcagccggaatatcgcaagctgctgaccagcgaaagcgtgttctgggctgagggtggcgcacgcgtcagccttaacggcagcggcctgacggtgcaggcatcgccgcttaaccgcgcgctgaaaggcgcgatcagtttcgacaatatgagtggtgcgcagtcggccaaaggggccaaacgcgtcctctatccgtctgaaaccgccgcccgcgcggtgggtagccagattacgctgcacacctatgacgccagcaagctctctgccggaatgccgattcgttacctgggtattaatgttggccaagtggaatcactgtcgttaagcaaagataacaatcaggtggtggcgaaagcggtactctatccggagtatgtcaacgatttcgcccgtctcggcagccgtttctcggtggtctcaccggagatttccgctaccggcgtgaatcatctggaaaccctgttgcagccttacgtcaacgtggatccaggtaaaggcggcgccgcgcgcacgtttgagctgcaggagagcaccattaccgattcccgctaccttaatggcctgaacatttatgttgatgccactgaggccggttcactgtcgctgggtacgccggtgctgttccgtggtgtggaagtgggtaccgtgaccggcacctcactgggtaatatggcggatcgtgtgcagatcgccctgcgcatcagtaagaagtaccagcatctggtgcgtaataactcggtgttctggctggcatctggctataacctggacttcggtctggtgggtggcgtagtgaaaaccgggaccttccagcagtttattcgcggtggcattcagtttgcgacgccgccgacggtgccgctggcgccgcaggccaacccggataaacacttcctgctgcaggatgaagcgccgaaagattggcgtaactggggaaacggcgatcccgtctccgcgctaaaggctatctcaaacgggcagcctggctgcccgtttcctttcctcatggtacactgccgcctttgctttaactggaatgtgcccgtgtcagatgcttcttcgcttttccccgccgattttctctcgttaattcgccagagcctgcccgatgaggcgagcctcgcgcaatttattgcctacagtcagcaacccctgcgccgcagtattcgcgtcaataccctgaaaatcagcgtggctgactttctgagtcagaccgcgggttatgactggcagctgacgccggtgccgtggtgcgaagagggattctggatcagtcgggaagatgagagcctgccgctgggcagcgtggctgagcatctcagtggcctgttctacattcaggaggccagctccatgctgccggtcactgccctgtttgaagctcagccagaggtcagcgccgtgatggatatggcggcggcaccgggttctaaaacgacccagattgctgcgcggatgggcaatcagggcgttatcctggctaacgaattctcttccagccgggtaaaagtattgcacgccaatatcagccgctgcggcgtcagcaacagtgccttaacgcactttgacgcgagggtcttcgggccagccctgccggaacagttcgacgccatcctgctcgatgctccctgctccggcgaaggggtgattcgcaaagatgctgatgcgctgaaaaactggtcgctggcaagtacgcatgagatcgccgcgacccagcgcgatctgctcgacagtgccttccacgccctcaaacccggcggcacgctggtttactccacctgcaccctgaatcagattgagaatcagcaggtcattgcctggctgctggagcgctatccggacgctgttgaggttgtagcgctcgatgggctgtttgagggtgccggacaggccgcgacgcccgagggctatctgcatgtcttcccgcagatgttcgacagcgaaggctttttcgttgcccggctgcgtaaaaccgcgtcggtcgagcccttaccgctgccgggctacaaagtgggtaaactgcccttctcccacctcagccgcaagctggaaagtgagatagcccaggccgccgccgctgtctctcttaaatgggatgcgtcgctggagctgtggcagcgtgataaagagatctggctgttcccgaaggccgtcaccccgctgctgggtaaagtgcggttctcgcgcatcggcctgaagctggcagaaacctttgctaaaggctatcgctggcagcatgaagcggtaattgcgctggcaaaaccggatgcggcgcagacttttgagctcaccgcagcagaggcggaagagtggtatcgcggccgggatatctacccggaaacggaacccacccgtaatgagatgattgtcacttatcagcagcagccgctggggctggctaaaaaagtcggcagccgtatcaagaacagctatccgcgggagctggtgcgcgacggacgcctgttccgctgagtcactttatttgcagcatcgtcagatgattgccaaacactgcgccggtatcgatgtagtgcagattggcaatcgtcagcgactgtttcagcggcgtgtgtccgaagtaaaaggcgtctgcgccacggatgcccgcccgttcgcctgactccatcgcctccagccgctgacggctccagaccacctgctgccagtcgagtggcttattcaacgcatattcccgggccggataatcagcatgagcaatcacaataattcgctcatcgagttgcagatggagaatcagcggcagctcacggcaacgctgcaacgcgtgacgcgccgcaatcaatgctgcaccacgcagccgaaagaaccagtcgccaccgttcatctgccagagcgccatttcctgcccctgtagtgctgaaagcgccatctcctcatgattcccccgcacgcagcgaaaccagggctcctccagcagcgccagacaactcaggctgtcgggaccgcgatcgatgatgtcacctaccgaaatcagtaagtcctgctgcgggtcaaactgatgctgctgcaacagcgaatccagttcgcggcggcagccatgcagatcgccgaccacccagatccgtcgccacgctgcgccattcagggattggtaatacatcgctgcacccggcctttgtctgctgaaaccatcttcagagtatagtcagggccgacactgtacttgcatgacgcactggaaagcagaatgcaaaggaggctggctgaaagggagcaagggagcaagggagcaaggaggccgggcgaagcgattaaagagagatgaaaggtacgtccctcccggcgcttatctccggcactcagtaaaggtggtagctctgtcagggacgaaatacatcataatgcgatcaggcgcgccaggctattctgcccccaccatatctgtagtcatttgggatcagctacgcattttagccggatatttctgcagtttctctgccggacgcaccgggcggcgcaccagctcaccgccgcagttagggcaaagatgagtgagatgctcagcacagtcagcgcagaacgtgcattcaaacgagcagatgcgtgccgccagagaagatggcggcagatcaacgtcgcagcgttcacaattggggcgaagttccagcatggtgtgactccttaaaaaagcggtatgcgccagcttcgcggttgctgacccgaatgtcgagccagcaaccggacaagagtgtgtcagatccggacatcctgctttaatggtgcagtcagcggtgctttgccgctgctatttgtgccgctgatcctcaggaaggtcatcgggcaaatcctcttcgtcagctgtgtcatcgaactcagcactctcctcttccggctcctgaccgcccatcgacgcatgaatcacctcctcttccagcgtcgggatcagcgcggcacccaatggcgaggtcgccagactgtcaggcatcaccacatgcggtaacggcacttcggtcgtcggaagcggacccggcgcacgcacataactcagtccgccaatcaccagcgcacagagcataaagaagagatagagcatattgctgcccagcggctgcatcagcgcaccgaccaccagcgggccgatactggcgccaataccaaacgccatcagcagacaggcggttaacgagacacggcgatcggcggcgacctgatcgttggccagcgccacctgcaacggatagagcgcaaactgcatcatgctggcggcaaaggcgataccaatcatccagtggaaggtcagatgcggcagtaccaccagcggcacgcaggccacggcaaagagcatggcaataatgaataacagccgctggcggtcgtagcgatcagagagccagcttagcggaaactgcgacaccagcccggcaaaaatcgtgagactcataaaataaccggtctggctggtggtgaagcctttgctgctgccataaaccggtgccaggccatagaaacgcgccaatcgccatgccggtcaccagggtggtgccgagcagtttgggaatagtgcggataaaatagcccagctccatcggcgccggtgtcataggcctgacgtgagtgcgggtggtcagtgcaatcggcaccagacagagcgcgaaacagagcgccacaatcagcagcgtgctcaccccaaaccccgattgcaggctcagtatcacctgtccgccactgagtccaaggtaggtggcgaccatatagaggccgaaaatcatgccgcgctgggaagattccgcctgatcgttgagccagctctccagcaccatgtactggcacatcatgcagagcccgataatcagacgcagaaagacccacagcggaataaagtccgtcagcccgtgacctacaaccgaggcggtaatgatcccggcacaggccacgtaggcacggatatggccgacgcgggcaatcaggttgtgccccaccttgccgccaatcaccagcccgatatagttggccgcaataatcgcgccgatcagcgcaccattaacctgctcactggccagtcgtaacgagacgtaggtagtcagtaaacctgaacccagcagcatcagaagcgtagtggtatagagcggcagaaacgtactgaatatttttcccatatgactccctgtctacgcttttcaggcatcaggccagcaaagccctaaagatagtcgatttcgtcaggtgaagcggtattgttcatagcgacggtagcgaaaaaaaagcccgccagcaattgctcactgacgggccctgatttaagcgcttgggaagctgatgttgctgcccggcgcttcacggttgagatggatgaagttcaggtgtcgctcatactgatccagtatgtcgatgatcacctgctctttgctgtaatccattaagtcgttaccctggctgccctccatcaggaaggtttccagccggtagtaggtcgacttaccgctgcgggcgcgataggtaaagcccggaatcgaatattgctgcggccagacctgatagataaagtcctgctcctcgcccagatggacgcgcagatccagatagccaatcggattgctttcatccgcctcaacgctctccagcgtgacccggccatcccgcagctccagctctttcgccacttcctgcatcgccggatagatggttttttccatcatctgctgggtataacgcgagcctgggtagttcatcaggcgcgacagacgcttcttccaggtcaggcgatcggtcgcatgagccagatagggcgcggtgtcgcgcgtggcgctggcccgacggtgatcttcaatcttcagggatttaaacagccccgccatgacaaagaagataacaaagctgaacggcagccccatgatcaccgtggtgttctgcaaggcagtgataccgttggtcatcagcatactcagtgtcagtaccccaatcgccacagaccagaagatacgcagccagttcggtgcatcactgttgatatctttcaggcgcgaggtgaagttacccagcaccagcgagccggaatccgccgaggtgacgtagaacagcataccggtgatcgtcgcgaccgaggcgctgagtttaaacgccggatactgcgccagcaggctgtagaagccgcgctccgcatggttcatcacttcctgcgcaaactccgtattgccgtgaatgatctgatacagcgcggcattaccgaacactgacagccacaacagcgtaaaggtaaacggaataatcagcgtgcccagcacgaactcgcggatggtacgaccgcgcgaaatacgcgccaggaaacaggccgacgaatggcgaccaggccacccaccatgcccagaagaagagcgtccagctgttcatccactgggtcggacgatcaaaggcaaaggtattgagcgtcatgcccatgaagcgattgatgtaatccccgacgttcagcaccagcgcattcagcaggaactcggtgttgccgaagaacagcacaaacagaatcagtcccagcgccatgatcacgttgagttcggagagaaaacgaatccctttatcgacgcccgacgtaacagaaatggtggcgatcaccacggaaaggacaatcagcgcagcctgcgcggtcaggccttccgggatatcaaacagcactttgaggccatagttaagctgcacgaccccgatgccgagcgtggtggcgataccaaagatggtgccgaccacggcggcgatatctacggtgtggccaatcgggccatagatgcgtttaccaaagatgggatagagcgcggaacggatggtcagcggcaggttatagcgatagctgaagtagcccagcgcgatgcccatcaacgcatacattgaccagccggtcagtccgtagtggaacagcgtccagaccatcgcctggcgagccgcttccatcgtctgccctgccccctccggcggctgcatatactgcgtcacgggttcggcgaccgagaagaacatcaggtcgatgccgatcccggcggcgaacagcatggcagaccagctaaggacgctgaactcgggtttggagtgctccggcccgagcttgatcgaaccaaagcgtgagcaggccatatagagcacaaaaacaatatagagcgtggcagccagcatgtagtaccagccgaaggtggcggaaacccagtttaccgccttgaggatccagctcgcggccagttcactgtagagaatcgtcacaagtgaaaacgtcagaatcaatccggcagaggtataaaatacaacgggattgagtctgtctttttcaccggcaggtggattattcatcggttacctctggttaatgtcctgaaaatacgcaatggataagtcttgccgtccacggttttccggccgtgcggccctgtttcgttctgtcacttcctgttaatcgctcagacaaaccagcctattttagcactcattgccgtttcgctttcgctacatttaaagaacagcatcctaacaaattttctttttatattgaacgtgcaatcaaaaaaagtttaaataggggctcgatttgagggtggagctggagctatgccaaaggtagggatgcagccgatacgtcgtcggcaactgattgatgcgaccctgagcacgattaatgaagtggggattaatgatgccactatcgcccagatcgctcgtcgggcgggggtatccaccggcatcatcagtcactatttcaaggacaagaatggcttactggaagccacgatgcgtgatgtgacgcgtcaactgcgggaggcggtactgtcgcggttagaaccgctggccggtgcctctgcagaacagcggttgtgtgccatcgttgagggtaattttgatgatacccaggtgcacacggcagtgatgaaagcctggctcgacttctggtcgagcagcatgcatcagccccagcttaatcgcctggagcgggtcagcagccggcggctctactcaacgctggtggtcgaattccggcgtgaactgccgctggagaaggcacgtctggccgcacacgggctggctgccctgatagatggtctgtggctgcgcgccgcgctgagcggtaagccatttaacccggtcatcgccctcacactgaccacccaattcatccgtcagcaactggctggcgagcacgaataacggaaggagaaaacatgtcccgattcaccgagcagaaactctacatcgatggcgcttatgttgccgcaacgtctggcgaaacgttccagacgattaacccggtcaacggcgaagtgctggcagaggttcatgccgccggccaggaagatgtcaatcgcgccgttgctgccgccagaaaaggccagaaagtctgggccgcgatgaccgccatggagcgctcgcgcatcctgcgtcgcgccgtcgatattctgcgtgagcgtaatgatgagctggcagagctggaaatgctcgataccggtaagccttacagcgaaacctcagcggtcgatattgtcaccggcgcagacgtgctggagtattacgccggcctggttccggcgctggaaggtcagcagatcccactgcgtgaaacctcctttgtttacacccgtcgcgaaccgctgggcgtggtagccggtatcggtgcctggaaactacccgattcagatcgccctgtggaaatccgcgcccgcgctggcagcgggtaacgcgatgattttcaaaccgagtgagatgaccccgctcactgccctgaagctggcggaaatttacaccgaagcgggcctgccggatggcgtattcaacgtgctgccgggcatcggttcggtcaccggtcagttgctcactgagcatcctggcatcgacaaagtctccttcaccggtggcgtcgtcagcggcaaaaaagtgatggccaatgcagcaggttcaacgctgaaagaggtcaccatggaactgggcggtaaatcaccgctgatcatctttgacgatgccgatctcgatctggccgccgacatcgccatgatggcgaacttctacagctccggtcaggtctgcaccaacggcacccgcgtctttattcctgcaaaactgcaggccgcattcgaggcgaaaatcagcgaacgcgttgcccgcattcaggcaggcgatctgcgtgacccggcgaccaactttggtccgctggtcagcttcagccatcgcgacaatgtgatgcgttatatcgaatccggcatcgctgaaggcgcacgcgttctgtgtggcggcaaacgtctgaccggtggcgatttcgaccagggtgcctgggttgcaccaaccgtattcaccgactgccgtgatgagatgaagattgtgcgtgaagagatcttcggaccggtcatgtcgatcctgagctacgaaagtgaagaagaagtgatccgccgcgccaatgacaccgaatttggtctggccgccggactggtgacgcaggatctcaataaggcgcaccgtgtgattcatcagatcgaagcaggtatctgctggattaatacctggggcgaatcagccgcagagatgccagtggggggttacaagcactccggcattggccgtgagaatggcctgatgacgctgcagagctacacccaggtgaagtccgtgcaggttgagctgacgcgttttcagtcagtcttttaatcacttaacctgaggaacgatgaatggaatttgattacattattattggagccggatccgcaggaaacgttctggctacccgtctgaccgaagagagcaacgtgagcgtcctgttgctggaagcgggcggcccggattaccgctttgattttcgcactcagatgcctgcggccctcgccttcccgttacagggcaaacgctataactgggcttatgaaaccgagccagagccttacatgaacaatcgccgcatggagtgtggtcgcggcaaaggtctgggcggttcatcactgattaacggcatgtgttatatccgcggtaacgcgatggatctcgataactgggccagcgaacctggactggagaactggagctatctggactgcctgccctactaccgtaaagcggaaacccgcgatatcggcccgaacgatttccacggcggcgacggcccggtgtgcgttgcaacgcctaaagcgggcaataacgtgctgtttgaagcgatgattgaggcgggcgtgcaggcaggttatccgcgcactgacgaccttaatggctatcagcaggaaggtttcggtccgatggatcgtaccgtcacaccaaatggtcgtcgctccagcaccgcgcgtggctatctcgatatggccaaaggccgcgccaacctgaagatcatcacgcatgccaccaccgatcgcatcatcttcgatggcaagcgtgcggtcggcgtggagtatctgcagggcgacagcaacaccatcaacaaagtgaccgcgcgccgtgaagtgctgctgtgtgccggcgctatcgcctcgccgcagatcctgcagcgttctggcgtgggttctcctgagctgcttaagcagtttgatatcccgctggttcacgacctgccgggcgtgggtgaaaacctgcaggaccatctggagatgtatcttcagtatgagtgtaaagaaccggtctcaatctatccggctctgaagtggtggaatcagccgaaaattggtgcggagtggatgtttaacggcaccggtatcggcgccagcaaccagtttgaagcgggtggctttatccgcagccgcgaagagttcagctggccgaacattcagtatcacttcctgccggtggcgattaactacaacggttccaacgcggttgatgcccacggcttccagtgtcacgtcggatcgatgcgtttctccaagccgcggtcatgtacgcctgaagtcacgcgatccgcgtcgtcatccggccattctgtttaactacatgtcgcatgagcaggactggcatgagttccgcgatgcgattcgcatcacgcgccagatcattaatcagccggcgctggacaagtaccgtggccgtgaaatcagtccgggactggattgccagacagatgagcagctggatgagttcgtgcgtaaccacggcgaaaccgcttatcacccgtgcggcacctgtaagatgggtaacgacccgatgtccgtcgttgatggcggaggtcgtgtgcatggactggaaggcttacgcgtagtggatgcgtcgattatgccgctaatcatcaccggtaacctgaacgccaccactatcatgattggcgagaagattgccgataagattcgtggtcgcgatccgttgccgcgcagcaccgccgcttactatgtcgcgggtgatgcgctcgttcgcacggttccgcagcgcgctgaataattagtgacaccgtcacttaataatagccgggcacttctgttgcccggctatttttttcattacggtttaccacacatccttttccacacgtcacccttttcaaatcatcaaaccttaacagacatcaaacaaagcagcatctgctgttgatttggtgatgtgcagaatgctataaatccagcgtctatttaaccggaggcactatccgtccactgatgagaagcaacaatgtggatgtgttgtaaattttatgagcagaatgttcatgtcaaaccccctgcattccccctcttgcctttctggctggaacgccgccgatcagcactggcgtaacgccctgtagtcccctcaccacttcgaaactgttctgagtctgcccgcacattgtgcgttgttgcaggtcgtcctttatcgttgctggagagcacccatgcgcgcctgggttttattatcactcgctattgttactgaaattattggtaccctttttatgaaatggtccagcctcaatggcagccattccggctacctgatgatgctgggcatgattgcctgttcttatattctgctgagtttcgccattaaacgtatcgccctgggcgtggcttatgcgctgtgggaaggtatcggcatcatgctgattacgttattcagcgtgcagctgtttggtgaaacgctgtcagcgctgaaaatctgtgggctggtgacgctgatcgtcggaattgtgttgatcaaaaccggcacccaatcatcagcggaggttaatcatgctcatcgctgatcttgttcatgcgtcctggctggcgctggctatcgtgctggagattgccgctaacatattccttaaatattctgatgggtttaagaaaccgctttacggtctgctttcactttgctgtgtcctgctcgcgttcagcgcactcgctcaggcggtcaaaggtatcgatctctcgatcgcctatgcggtctggggcggttttgggattatcgccactgtcgcggccggatgggtattgtttggccagcggctgaaccgcaaaggctgggccggcctgaccctgctgctggccggtatgatcctgttaaaactggcctgatcggccatctcaatcagtgatattgattaagggtgtgccactgcacgcccttaacttcctgtgctttcccgccctgtttcggttgatttttccctcttacctgtgctcggaatcttcttacttttgtaaaggcccgtttacatatctgttgccttagggcttagtgagcgccgaaggtcggataaaaacgaggaatagttatgtctgcaacacgaggttggtctacggagctggagggattacgcggcatcgcttctctctgggtattagttggccatatcagcttactggttcattgccacatcacgcttatttcatcccctggcattggggtcgatctgtttattctgttatcgggttatctgatggcgaaaaactacgtcgagcgtcagcagaaagagccgtggcagagtacagagaccattaagaagttctggatccggcgcttcttccgcatcgccccgctctactatctgctgttaatcatcgccctgatttatggcccgtggtttggcgagatgcgtgacaccattgctcatttctattccggcaccgccactgagtcgtcgcgttacaatgaccagtcgctggcaaacatcctgacccacttcagtttcctgttcggcctgctgcccgaatatggttttaatactgtgctgcctgactggagcatcgggctggagatgcagttctatctgctgttcccgttcatcatgctggtgacgctgcgctttggttatgccgcctcgctgattggcatcatggcgctctgctgcgctggccggtatgtgctggcagattattatgaggcgtttgagatgccttcaatgatcctgataaagctaaatatgttcctgtcggggatgctgctggccgaggcgattcgccgtaaatccctgctctacgtcgcctttgcgctgctcggcccggtcgccagcgtggcaatgggcctgggcgcgattaagctgcaggtgattatggaggcgctgatgatcgtcggtatgacggcaattctgtggcaatacccgcaaggcagcctgatggcaacgctgattgctctgccgcgtaagctgctgaacaaccgtctcagcacctggctgggcgacgtgtcgttttctgtctacctgctgcatctgctgattgtaatcccgctgatcgcactgctgctcaatcacaccgacattgagtttaagagcgacatgatgcgcttcctgattgtctgcgtctctgccatcccggtgacctatgcgctggcctctttactctataagtatgttgagaagcccggcattcagattggtaagcgcgtgctgaagccgaagctggccgatcagaccagctgagtttttaacgcaggccatccctttcttaaaagcccccgacttcggggcttttttttttgccaggaaaagcgcaattggctgtgataacgagcctgctaaggcattgattaagcccgtcgccagcacacccgctgaggtgaactacactttgccggttagcaatctgactcagaggagagaacatgagcattcagcatctgctgctatccaccgacggtggcgcagtgatcattgaagcagaacaactcgaaagtgagctggttatcccgccccacctgcagaccctgaccggcggtgaagctgacagcgataccggccatcgggtggcggtaacaaagcactactgcaagggacgctactatgcggttgcccttgatcgtcatgcggccagcaatgaaattgacgacgtgatcgacctgctgcatccggccccgctcgattagtctttgtcagaccgaacccgtacatgttccgctgaactgctggcgggaaagctcagtattgccggtgtgcggcatttacctattcagaagaggataagcattatgcaaaagaagaagtggtttgtttcttacgtgattaagcccaaaggtgaaaatcatgtcacgactcacgcctttatcgagggcgacgatgtcgaggaggcgctggaagcctttatgttcgaaaccaaaaaaagcctgtcgctggaaaccgaagagctgactctgctttcggtgagcctggtgtagactctgattaacctcgcgattgcggggttttttatgtcctgtatcaggatcggttatctatttatattatttataatttccctggtgcggcactcaattacttactgggatacggccaggcgtgatcaacgccagttgatgacagcagaccggtaaccgccagatacgccagtatcaggacaaacagcacaatcgctgcaatttcaatggattttagtaagtgatgcttagccataaataaccctccttcagatgtgtgtaatcagacttcaccccataaactataatgttaccggtaaagttcaagtgaaaatcacatcatgaaacataaagccgcgcttattaatgctttaacggaatgtgctcttacgcattcagagggagggaactggccttacaggcataaaaaagcccgcacggcgcgggcttctgcgattatcagcacggattattcagcagactgaccgctaaagtcgattaccatcctgccgcggatcttgccctgaatcatctcatcgaagatggcattgacctcaccaatcttccttttggtcaccttcggcaccaccttcccttctgccgcaaactggaaagcttccgccagatcgttacgcgtcccgaccagcgatcctactacctgaatgccatcgagcaccagacgcggaatattcaggctcatcgcttccggcggcagtccgacagccaccacccgaccaccggccctgaccgcatcgacagcagagttaaacgctgctttggcaaccgccgttaccacagccgcatgcgccccaccggtttgctcctgaataaagcgagccgcatcttcgctggccgagtttacgaccaggtcggcacccatctctttcgccagtgccagttgcccatcgctcacatcaaccgcgatcactttggcgttaaagacatttttcgcatactgcagagcgaggtttcccagcccgccaagaccgtaaatcgccagccactgacccggttttacctcggacactttcaccgctttataggtggtgacaccggcgcaggtgacactactggcggcgtagggatcaagcccgtcggggactttgaccgaatagtctgcaacgacgatacactcttcagccataccgccatcgacggtataaccggcattgacgacctctctgcagagcgtttcgttaccggagttgcagtattggcagtgcccgcagcccttaaagaaccatgccacgctggcacgatcgcctggcttaagtgaggtcacatctggcgcgacttcctcaacaataccgataccttcatgacccagcgtcacgccggttttatcaccgaaatccccgttcttcacatgcagatcggtatggcatacgccacagcattccatcctgagccgtgcttcgcccgttttgagaggacgcagcgtcttctcaaccacttcaaccttgtgttcactgttagcaattgccgctttcataaacgatgctccttttgattgaagctttaaggataagccaaaccgcggtgatgacaagatgacaggtaagctttgggtgcgaggctggcagggttgtttctgcttttgcagagtggagtgggtttttaggatggagaccgggcaccttaagctaatagggttattttgcgttagcttttcaacccaaattttaagctcactaatatgtcaggattttatcaataccatcggttaaatttaatatacacataagaaactacgataacccaggcaaaactaagaagtgctgcatactgcggaacaaagcagatgaagatatacacgccagccacaataacttcagcaggtaataaatagaaaaaagactgaatcagccataaaatagcacgcttcatttatgcagattctcatatagagcatcagcaattttcccttcgctgttagacatagcctgcacccaatattttttgatgtttaccttcaatttcaagaacctatatgaattaaagatttcataagtaaacatcctgtaatgcagccatagagcaccccataacttatatttacttttttcacaaatcaacctattggtttcgcaataactaaatatctgttatgaggcgcgttgacctttatatattgacagactctttgctttttcttctcgctggcaaaacctgccatagtagcaatgatgagatgaacgttagtaaaactgcattcaaagcatgcatcaagtgatccgccattgcgatgctagctactgtgggctgaggaataagatgcatagatcatgctgcgtcaacgacccgagcgtgcgcatcgtgatcgtttgataccagcggagcgacaactatggctttgagagtcgcaaaatgcatcagatagcgccagccagcatctggcagtgaccggaattgatgtgatacagttttgaccattacagtacccatttaagggaatggtatggatacaacggagcagttaaacggaacttacttctatggcggacttactaacctttctgcaggagagctttatttctggataatgattgatgtgactgcagagcacttcagcggtaaaaaggatatcatcgctctggttgcgatttactcgggacaaaatacgattgacgtatccggtaagctaaacggagcatggaaaggcacctcttatggttcggtctattctcgaaagctgttacgggattaccgtcttccattcagattacctacgtggatacagaaccctaaaaaccctcttcaaattaaaatgttaatgactcacaagctggggacgttcgtcggtcgtacaatcccggttttaggctgggtaattatggccgctgatgtggcagaaattggctggaaaactacggcaaaatataaccttcttgctcataaggaagacaagatatggtaaacgaggatatagagaaagctgtatttgcgctggttgaagattataacggcagaagtttgtttacgttcagacgctataagcttgaactggataccgatctgaacaatgactttcgcatggatcctcttgacgcgtatgaattgctagagcggtatgctgaaacatttggcattagtcccagtactatcacgtttgccgaatatttcccggaagatttcaatgcgccgcacgatccgctgactattcgtctgttaattgagtctgcacaggccggacgctggttgggtaaataattaacgcctgcaaacgcaggcgtctgtctgttcagtttgttgcggctacttttagaggacaagtgcggaaaacgtgccgtagatttgggttttaaatttaaggacgcgaccgcgtcctctcggagtttctgtcaataactctacggagccaacaggctctgaagcagctatcgatttcacaaagccccctactcgcgccgagcgtggaaggatttttaaacgattaagaggaatgtcaccgctacaacagttggtgccggaaaaatatcactctgaactaagtcattgcacggaacgggaggcgatgaaaaagagtttcttcgagatctctagattaacactgtccgacggtgaggttttgcgcatgatgaaaggccacacaattaaggttggggagctttactgaagcggaacaagcggctatgtgttccatagacagagcaacaatcatactcccttaaagcgcttcaatacgcttgcgaaaaaagaggcatacatgtgcctgattaataaaacggcagtcggactaatctgagccgcacgattgtttacaattttagctcaccacggcactgattatacatacagtatattttgactaaaatgagttaatcatatgatgaatatagataatctaagcgaaacggttgcacgcatccagttcattgctgacgtatcgctgatcgcacattgcaaagaagatgaattaaaaaatggcactgtcgatgatcagtgatatggcaggtacaatcgatacatcagttttcgaagcagccatataccgccaggcttaatgattaattgccccttccctatcaacctccactagccacctttgaggtggcttcttgcttctgcatcaaagtgcaaagcttgcatgaatccgcatgatccaaattggatcgctaatcctctgttaggtctgtactggcgcgttttgagatgttgtatgcacatgcatgaaaagtgatgcataaagcgggcaggcgtggcggggatagcattgcgcgcaagcggttaagatgagcagactaattgcttggatccaggctgagaaagttagtaatctcatagcggaggagtaacattttcataatgcccatgttagattttactttccgcaacgatcaatcaactagttcttaatctttatacttattaatgagggtaccgtgattaaaagaaacttgggccgaatgggagaaacatttttcaataatttatgtgctacggtgggtttaacatgcaatggaagcattgaggatagtacagggtgggattatattgtggagtacccacatgaatatgacgaagtagttttagctgacaaagcacccgcatcaaaagagttcaaaatacaaatcaaagctacagatcatagaaaaaggaaacttgcaataacactgtcaaatcttatgcggctgtgtaacacaccattaccaagctttattttatttttagagtataacaacaaattagaaccagatgatgttttccttgttcatattagcaaggacatcatatttgacgtccttaaaagtgcaagagaaaatagcttgaacaaggccagaaagaattttaacaagaaaaccttgacaataaaatatgatgaatcaaataaattaagtcatctggcaggtgatgcttttattaaagccattgatagctacatcccaaaaggaatgaatgaatatgttaaagaaaaacaacatcaattaaaaaccttaggttacgagaaaagctgggggcaaatgaaatttaaagctagcactcttagccctgaaaatgatgttgttagtgcatctctgggatggattgataaaattaaagttaccgatgtgatgacttatgatactcgctttgaaattttatcagaagacgcagaccttcgttcacctgaggcatttatttcctttgatgttaaacaaagtactgataagggaaacataactttcacacaccttaaaagtaaaaagcgcttaagatttgaatgcgagttatttttctcacaggtttcagccgtggctcctaagcagatggctaagttcagagttaaaactaagagtttcgatatgttagttgcgttaactggcaattcacattataagttcattgacgatggtgtgagacttagtctttttgagctgagagatgcaataatttttagaaaatggatcacctcacaagaaagccagatggaaataaagattttttccgaaaaattcagaaaatctcttgttatgattagcgataaggtcattgaggggagttcagaattaaagtacattaaacatttagagtcacttgagaaatcaattgtcattgcttcagaactagctgggaatttgaatattgaatcacaagtgcaaatgtcttttgatgaactaagaaatagccaagagtcgcttcaatctatcgagcctttgctgagttcaaataaacagccttatgacattatgagattccatatagatcaagaagaatctgccaaaaaaattgaaggcgaagtggtttgcataatggttttatcttcaaaaatgggcaaccttacaatctatatgattatatctgttaaggggcaggccaatttacttgatggttggcatgcaattggaaaacctaaggtgtctattgaagagttaattgactgcccttctggagaaaatgtcacagagcagataaaagactctattgattcaattgttgatagctatagtagtgaaggagtggtaactattaacttcttcaagggttagtaaaaaagcccaccacgggctttttttaaccatcactgcctaagttataaattttaaatcttataacttcttctccaatccaattatttatctctttcatacgttcctcaagcggagtcagctcgttacacacgaatacctgagacgctttcacagcatccccgaatccgccggagttgtccgagataatccccatcatctgcggcggcacgcggtgctcgctgggcaggtcgtcgtggctggccttcttgatgttaaagaagtcgtctttcgtcgccacttcactacacggcagaatcttgatgctgttcgtcgcgtacatgaacaggttacggaagttacctagccctttcgtgtcgcgcatcgcctgtcgcatccggtcaacgtcacagcgactctgcgccgcgtcggtcatatacaggatgtaaccggcgtgcgcgccgtttctgataatacttacgacggaacagcgttgccgcctcattcaaccaagcggagttaagcgcgctgagctattccggcaggccgtacagcttctgattaatatccggctccagcagttgaaacacgctgccggccgaaaattcgtgcggctttttccagtcattcacaaaccagtaaatgcctttcttcaaacctctgcgggtaaatttggccggggtggtttcaaggccattgcggcgcagctcggcaaaggcgttaccgaaaaccagataatcaagcgcaaacttgctgaactcctgctgactcatcattgggtgcgggataaaggtcgaggccagaattttgcgctttacgtaaatcggcgagctgtgatgtacggccgagcgcaggcttttagccagcgcgttaaaactgcgggcggctcaaaccagcgcccgttactgatgcactcggcgtaatccagaatgtcgcgtttatccatgaccagcatcggatcgccaaaggtaaacgcctcggcgtgctgctgaggtgcgtttgccttatcagtattgagttgcagctgatcgagcgcgtgagcgcacaacaggcagacagcgcgctacatgtgacttacgttggcgagaaaacccgctgcctgagagtgacgcgcggccggtgcagctctatgtttacggtgagctggtcagcgagtggcagacatgagcgagctgtagctggtaaatgaccggctggaagcgcttatcagcagcctgtcagccccggcacgtaaaaagatggctcgcagcattggccgtaagctatgcgcgagtcagcagcaaaacatttagcgccagcagtttccagacggcacgccgtttaagccccccaaaacgcagctagtgagcagcaaaaagggccggataaagcgcgagatgttcgcaaagctgcgcacggcaaaatacatgaagacgcaggccaacccgaatgaaactgtgatcgagtttgcgggtaatgtgcatggcccgcatgcatcattacgggttgcgtgacaggccgtcaatcaatagtaaaacaatcaaatatgaatctcgtccacttatcggtttaaatgacaaagacagaattgaatttgatagcaatattttaaaaacgttaagtaaagggttctagctgaactctgatttttgttgcataacgcattaatgctatgtaattttatcgaaccaaacctagcattatgggcgaaattcccatcgggccatgagtcatggttccgcctcgtatttggactatgcccgtcgttcagttcgctgagcggcgtctggtggccgccgatcagcgaactgaacgacgtgctcaagtaggtttggttcttcaactcaatcttaattttcggaataaaaaatgattgttccgttcaggaagtcaggcagtgagcttaacagggcattgtttatgctcaacttttttatagaaaaagatagagtgaaatgccctggtgacgttagaaagtttgttttcctctgcggagcgaacaactcaaaaggtgagccttcagcacgaaggcaagaactaattaaattcgcggaaaaggatcttaccaactgtcatttcttcttggctgaacttatatttaaggagctttctgaggatgatacatctcctttagaaaatctattggatattgaaagcgaactttctgcccttgctgattacatactaattatcctggagagttattcatcttttacagagttgggggcattttcatatagtagcgaattaagaagcaaacttattgtagtaaataatactaaatacattaaagagaagtcattcattaacatgggcccaattaaagccataatggaggtcaataaaaacgggcattttatgcattataaaatgaatgaatcaagcgaggcaattgagagggctgatggtattggggctattttccctgacctttacgagctgttagtgaaacctgaaagaaaacaatctagaacattaaagaaacatgagctgaatcctgcgacaaatttcaacaaagactcaattcgctttattcatgatatagttttcacctgtggctctataacattaaacgaattaatagatatattaatagagatatttgggaacaaccactcctttaaaaaacatgcgcaaaagcatttgggcgtcctaaaggcaataaatataattaatcgttataatggataccattactcccttcaaagacaatattatctaaagtatggcttcgatattgagagtatatcatcgacttttaaaaccttctttttaaaaaacaacccggaaaggatttataatagatgattctttataagataatagacaccgatataatgatgcgtgacggtttcactgagtcggttatcaaatcctctgagccgcctaagaaatggactattcccaaaaaaagtggaggtgtaaggtcgattcatcatccatcaactaaaaacaaactattacaatactggctcctgaccaaggtttttaataaccttccacaacatcctgcctcctatgcctttataaaaggacgttcaataaaagataacgctcttcgtcatgcggaaagcaaaaacaattattatgtaaagctagatatagaagatttttttccatcaattacctatgatgattttgagcgttgctttgttaaatatagggaccttataacaacacctacaaaatgggataaagacctattaccactcattcaagatgtttgctttcttaaacctcagaaaatattgcctataggattccccacctctccagctattgctaattttgttgcaagagaactcgatgatatcattaacgctgagatggcttcatttgaaaagcacaaccctgtttatacgcgctatgcagacgatttgatattttcagtagccgacaaaggattaagtaaaaaaataataaccgccgttagaaagtcacttagaaaatgcagctcgaatttcaaacttaatgcaaataaaataaaagtctgtagtgcttccggcggtagcgttgttgttactggtttaaaaatttgcaatgaccatcatttaacgctacataaaaaaatgaaagattcaattcgattgatgttgagtttgcattccagaggaaaacttaaagaagaagattttaacaaactatctggctatattgctttcgcaaaaagtattgatgaacatttttacactagattgagcagaaaacatttcaaagaattacgtactttagaaaacaggcatttactatgagttaagcgtctgatttcccttttttttagtcattgtttagcaaacacttttttattgaggatgccgcaactgatcggcattctcatcctatgaatgaacaaatctctaaaattcagcgcctgttacgcaacctgatccgcataggaaccgtgtcggccgtcaaccttgacgactgactatgccgtgtcgctacagtaaaaacataaccaactagctgcactggttgtactggttgtactggctgagcgcccgcgcgggtaaatccctgttctgtttgccttggccgatgcgctgtaatggtcgtttcctgacggcgcggtgatcgagtacgagccgtaaaccggcgcgctgaccgcaaccggaataaagacggtaaccatcaaagcggcggtaaaaatcctgtttgactcgccagaagtggaatgcacagtgctactcaaaactgcacagctgtaagtcacccaagaggcgcgatgaatggaggtgttacgcataccggcggcaatctttcctccaacggcaaggtacggcgtttcgcatttatatccgggcgacaaagatggaaaaacgggagcgccagtatgagaactgtataatatatcggcatgggccgagaaatcggcgacatgctgaccgacctcgattacatccggcaatccgtgcgtgacattctgctgacccctgtcggtaccagggtgatgcgtcgccagtatggttcgcttttatccacactgaatgaccaggcgcaaaacgaggagctgcgcctgcagattatgtcggcctgctatatggcacctctgaggcaaagctcgccgcctgagtaacggcgcagaagcgcctcggccgtgacattagcctttctgcgctgtatgccgccatgcatgttaagggcgtgcagcgcgtcaaacttatcaagatttgtgctgacatagtgctcgacaaacgcaggccgcttactgcacgggctatcccctgatagtggcggcatcgcttacggtatggatgaaatgcatgcaggcagtacaggtgctgatactgccgcatcgaaaattgcatggacgaaaaagactcaataaaatccattctacgcacaaagttttcagttaaaaaatttcaatggaaaaatatttaattctgccattgaatcatttcatccagcctcttcagaatgtcggggaaatagctttcattaaggccaaagctgcctttaacctgaacgctgtcggcatgaggctccggtcgaaggataaaatcaatagtaacgctatcaatagtattttcatttgtcagtatcatatcaagctgatgaatatcgctctgatatttaaacgactttaactttttctgagcaattatcgcctgatgaaaagctgaaaattctttcttcaacattttcaactctccaacagtgaacttagtcttaaacgccaccttcaggccgcttaccgagaattctatccaggactgtatccaatcccaattatgattaaccggatcgacttcgttatcgacaacccgttcaaaaggcgacaccgcaaaaacgaattcttcatctctgatatcaaacatatgtacgttcctgtcggttaatcaaaaatacctaaaatgagttatcgtccaatctgatacccttaccacaacctcaagagtgtacttcttatactcagtgatatttttcttacggtgtaatttatacatttccgtttcataacgatacataccctctccgttgcgaggatcggccatgcgtctgccatagcggatagctctttcctgaatatgtaacggaacatagcgacccggctcatacatgtgcctcgccgctgtttcggtcattgtcaggttacacgccgataaacccgtttttaacctggcacgcaggaacattattgttgcctggctgagtctggcacttatagcagctcgtgtaccagcctccaataatgcgcggccagcgcggaaaattcgaaatacaccaaacgcaagaagcgctatgtctgtaggatcaatcagtggcgtttcgagaggtgcctcttcaagtcgaacaaaatgcccctgcacatcgtatatctgccacagaccgggagcctgagccacagaataaccaatgcacatgccgctggactcatccagcaccggctgtgcgtttcgtggcagcacacgtggtctcaattcaaaaaatacgttgcccgatagtggtgactgaaatgtgtaatatctgccaggtttctgtgattgcattccctgcattcattatcgttccctcattttcatgtgacttaatagagtgccacaggatagtagagcggtcattaccgagtactgcaacgccgttcactcagcaaacttctctcgcacgggctgcacagcctatacctgatgctcctggcagggcttcaaccatgagtaaaacaggtggcagattatcgccacggtgtccctttcatagagaggtaataaagcagggttgtaacttatatgaataggaaaaatggcaatgacataatggaatggcgtcttgcagaagagtggagaagaacacaacggaaaaagactaagttattgattgaaaatcattaactgatgggcggcatctgacaaaaaaagaccgaatacgattcctatattcggtccagggaaatggctctcaaggagccgtgcgctaaaagttggcatttatgaaggcgatgtcgccttgccatttaacattagaacagcgcggtggaattgccagcaaacgggaggcgcaggaccataaaccggatcagtttgtgatcgcaacggcaaaaaagaggggttgggcgcagcgcgatgctacacccgacaggtttatttaccgcacagcgcctgggtgcgctcaacaatcggctgtagactcatcatctggcccggatgcgctttatcttcaacctgaatcacgctgatcggctgcgctttcacctgtttgtttttgaacagtgtgtcggcgatatcgttcagggggtatgtcatcagcgtgctcgggttgatggcaaacatcgcaccatctttctcacaggtcagcatcacctcttcacggttaaacggccacttctctttaccgatctcaaagcggctgacggtaatgatttgtgccgccagcgcctggccgcatacggataacaacaggattgcggggatcactttcttcagcaacataactacccttttctctcttaaaccacattcaggctggcgacagcgtggcaaatacgctgaccagcccaaccactccacacgccagcagcagttcaagctgcgtcatgcgaataaatttttgctgcgtcccgctgcccgccaggcggaatcgcggtaccagccagtatcggttaatcagcgctaccagcaccatcagggcaaccagcagcactttacacagtaacaatacaatgtagcgtgaatcgtgccacgtcagcggccagcccgcgatcatcacgctgtttatcaggccactcagcagcgttaacgccaccgccagatggccatagcgcgaaaagcgcatcatggtgcgaatagcgtcggtgcggcgatcgatctggcgcgcctcccgcatcaacagcaacagaggcactaatccgcccgtccagaaacgccgcggcaatcagatgcagtgcatgattgagctgctgaaacaatcccggccagccatcgcgcatcgcggcatgacctatcagagccatgcaggccagttgcagcacgcccgccagcagtaacacctgctgacgcagccgcccggtcagtagcaacccggcaacggccagcaggctaaacaggatttcccacagccacacgccaccgaagtgcgtgccaatcaccgccagccagatatggacatcggccagattggcgctgtcgccgctcatcaacacattctggcaggccagcatcgccagtgcactcagcagcgccagccaggcgctccctttcaccagcgggtttaatcgtcgcgccagtagtggtcgatagcgtccgggtgccagcagcgcactgtaacaggcgctgccggtcagcagcatcacggcggcaaaatgcagcgcgcgcaacaggatccagaaggtggtcaccggagttacttcacgctaaagcgatagcttcctgcggttttatgtccatccaccgacagcacatgccagttaacctgatagctgcccgcttgcagtggctgagacaggcccacaatcagccggtttttctggccagattcaacgcgggctttagcggtggcgacaggcttctgttcactatccagcagcgtgacaccgctgaatgccgcttcaatatcttcactgaagttcagcgtcagcgcatcggtggatgtcgttacctgcgctttggccgccgggatagaagactggagatgcgcatgcgccgctgccagcgaactgaatgtcatcagtcctgctgctgccagcgcaataaccatgcgggaaatcagttttttatgcataagatcatccttttaaccgccgccagggcgataaacgtggcaaaaggatacgctgctgtatttgcactgtcgaggccagcgatgcgatcctttatccttgattcagaccgccgaaaacattacttttgcccgctatcgtcaggagaatattatgagccataaccttgccctgctgtcccaggaagagaaagacaagattaatgtcgatttggcggcagcaggtgtggcgtttaaagagcgctataacatgccgatcgtcgccgaaatggtggcgcaggagcagcccgaagcgctgcgtgactggtttcgtcagcgtctgatgcactaccgccaggcgtcgctcagcctgtcgcgccttccttatgaaccgaagatgaagcaatgatatttcgcgttattgataccgaaacctgcggtctgcagggtggcgtggtcgaagtggcgtccgtggatgtggtcaacggccagattgtgaatccgatgagcgatctcaccctgcccgatcgccctatcagccgtcaggcgatggccgtgcatcgcatcaccgaagcgatggtcgccggtaagccgaccattgaagaggcgatccctcgctatcacggcagtgctttttacgtggcgcacaacgccagttttgatcgccggatgctgccggaaatgtacggagagtggatctgcaccatgcagctggcgcgtcagctctggccgggcattaaatatggcaaccaggcactgcgtcattcgctgaagctggatgttacaccgcccgccgacctgcatgctcaccgcgcgctctatgactgctatgttacggcagcgctgctaatccgtattatggagacctccggctggagtgcctccgagatgattgtgcgttcacaaccggcggcccagcgcgacgacgtttctgccgtttggcaaataccgcggccaggcgatcgcggtggttgcgcgcaaggatccgggctatctgaagtggatgctggataacgtcagcgatctgcgcccgccattgcggcaggcgctgcgtaagtacctgaccgaatctcagtaatcctgagctggcggtaaggtgccctgcgccagtcccagcaggaaggtgtattccatcgcgatcccttcataggctttgtagcgccccgacttgccgccgtgacccgcatccatgtcggtgcagagcagcagcaggttattgtcggttttcatcgatctcagcttcgccacccacttggctggttcccagtactgcacctgcgaatcatgcaggccggtggtgaccagcagatgaggataggctttcgcctcgatgttgtcataagggctgtactggcggatataacggtagtactcaggatcattagggttgccccactcgtcatactcgccagtggtcagcggaatcgactcatccagcatcgtggtcaccacatccacaaacggcacctgggcaaccacgccgtggaaccgctgcggtgccaggttaattactccgcccatgagcaagccacccgcgctgccacccatggcatagagtcgttccgggtgtccgatgccacgcgccaccagcgcgttagtgacatcgataaaatcggtgaagctgttcattttgttcagcaggcgaccgccgtcataccattgctgccccagctcaccgccgccgcgcacctgtatcagcgcatagacaaatccgcgatccagcaggctcaggcggctgacgctgaaatcggcatccatactgctgccgtaggcaccgtagccatacaccagcatcggattctgaccgggttgataatgtttgcggtgatagaccagcgataccggcacttcggtgccatcgctgactttgatccagtggtgctcgcttttgtaatcttccgcgttaaagcctttcaccgcgctctgcttcaggatgcggcgttcgccggtatccatatccagttcaaacagcgtggtcggcgtggtcatcgacgaatagccgtaacgcagtttgctggtgcgcggcgtcggattgtaggccagccaggtcacataggtcggatcgtcaaaggcgatgccgctggtttcaccgctggcccagttgatctgccgcaggctggttaagccgcgctggcgctcctcgaccaccagccagtcccgaaacagctgaaaatcttccatcactacctgttcacgtgccgggatcagggtttcccagcgtgactcgtccagatagcggctgcggtacagcccgaagttttcgccttcccggttggatcgaatgaagaactgatgatcgtagtggtcgatgctgtactcatgatcgcggcggcgcggcagaaacacatggggctgcgcgtcggggaagttcgcatcaatcagctgaatttcgctggtgttggtgctgtagagggcaatcatgatgaactgcttggaggtggtcttatgtacgctgagatgataagtgtcatcctgctcttcatagaccagctggtcgtcgaaactgcggcgtacccagttcgtgtcgccacacctgataagaaagcagcgtctgcgggtgttttcgcacatagtagagggtgcgcgagtcgttaccccatgcgaagctggaagaggcattgctcagcacttcagggtaccagctgccactctccaggttacggaagcggatgccatattgccggcgagacaggaaatcttcagccagcgccatgacaaggttatccggactgatatgcagcgcgcccatggtgtagaaatcgctgtgcgaggcgcgctggttggcatccagcagcaggctccactcgccagactcatcgctcgcagcgggctggcggtaataggccggatattcgttaccgctctggtagcggctctgataacggtagccatttttcacatagggcactgagtgatcttcaggcggcagccgatcgataatctcttttaatacccggtcctgcagtggctgctgtgacgacatgatttttttgccgtagttgttttcggcacgcaggtaatcaaggacctcgctgttttcgcgcttgtcgtcgcgcagccagtagtagtcgtcaacgcgcgtctcgccgtgcagcgtcatctcatggggtattctttttgcgatgggtgctttcatccatccgtctccgtgaacgtaatgatctgtaagcgtaacacttcagcagcgggaagccaggtataggttgagaagcagccgctggcggatcacatcctgtgtcccgccagcggaatatcagagggattaactggcgggtaaacgggctttctcagcctcaagatcctgctggatgccgtctcggacatcctgggggattttcagcgcgtcgcccagcgcggagagatagctgcgctccatgaagtgatcaacgtcgatggcggcacagctcaggaagtagagctccagcgcctcctcctcgtttttcacatcggcggccagccactgcggatccagcgggcggttcatcgctttctggatcagttgttccgcttcctgaccgtagccggactgatgaatattctgctcaatcgctgcccgttcctgatcgtcaatgtgcccgtcgcttttggcggcaaacaccagcgccgtcaccagacgttcggcccgcaggttaactggcgtttgcgccacgccaaagtcaggttcattctggtgtgcttcgctgacccgctgcttgtatttgttccatagcaccgcgcccgcagccgcaccaccgccgataatcagcgccttgccgccatatttagtcagcagtttgcgcgacgatttactggcaatcagcataccggccaggccgcccagcgcacccggcgccagcatgtcgcttaagccgccgcccgatttgccctcaccgcccttcttcgtcagcaccgactgaatttgttgcaaccagttattcatcatccactccttttaagatgtcagtccgctatcctgacgaaaaggatgtcaggaaacgtcagagcgggaaaagtaaggcaaaaggtcgggtcagctggacgaaagatgagaacgcaaacgttttcgtttatacttgcgcgcgaattttgactgcttaggtgaatgtatgacgactctcggaacagcgctgcgtccggcagcaacgcgtgtgatgctattgggttcaggtgaactgggtaaagaggtggcgctggagtgtcagcgtctgggtgtggaagtgatcgcggttgatcgttacgccgatgccccggcgatgcacgtcgcccatcgcagccaagtgattaacatgctggatggcgcggcactggctgcgctgattgctgaagagaagcctgattttgtcgtaccggaaatcgaagctatcgccacggagacgctggttgagctggagcagcaaggccagcgcgtggtgccgactgcccgtgccgcccggctgaccatgaaccgcgaaggcattcgtcggctggcggctgaagagctctctctgccgacctcccgctatcgctttgccgatagcaaggcgcgctttgatgaagcggctaccgaaatcggctttccctgcattgtgaagccggtaatgagttcatccggcaaaggtcagagctttatccgcgatgccagccagctcgataacgcctgggactatgcgcaacagggtggccgcgcgggtgccggacgcgtcattgtcgaaggggttgtcgacttcgatttcgagatcaccctgctcaccatcagtgcagtcgatggcattcatttctgtgcgccaattggtcaccgtcaggaggatggcgattaccgtgaatcctggcagccgcagcagatgagtgatgtggcgcttcagcgggcgcaggatgttgccgcgcaggtggttaatgcgctgggtggctatggcttgtttggcgttgagctgtttgtatgcggtgatgaggtggtgttcagcgaagtttctccgcgtcctcacgacaccggcatggtgacgctgatttcgcaggatctgtcagagtttgcgctgcacgtgcgggcgtttctcggtctgccgattggcgcgattcgccagtatggtccgtcagcgtccgccgttattctgccgcaactgaccagccagaatgtgcagtttgtgaatgtcgaagcggcgctgggtgccggtctgcaactgcgcctgttcggcaagccggaaatcagcggccagcgtcggctgggcgtggcgctcgccagcggtgacagcaccgatcaggcgattgcgcgtgccgttgccagcgcagcagcggtcacggttcagggataaacgtgtgcggtgagcagacgctcaccgccataacttacttcgcgccttcaacagcttcgcgtgccaggcgggtgatgcgatcccagtcgcccgcttccagcgcgtcgttgggcaccagccaggaaccgccgatgcacagcacgcttttcagcgccagatagtcacggtagttcgccggagagatgccgccggtcgggcagaatcgcacctgcgggaagggtccgccaatcgcctgcagcgctttaacgccgccgtttgcttctgccgggaaaaacttgaactcgcgcagaccgtagtccataccggtcattaactcagaaacggtgctgatgccgggaatcaatggcaccggcccttcaacggccgctttcagcagcgactcggtgacgccagggctgatcacaaactgcgcacctgcatcggtcacttcctgtaactgctgcggattaatcaccgttcccgcaccgacgatcgcatccggcacttctttaatcatcgcacgtaaggcatccatcgccactggcgtgcgcagcgtcacttccagcactctgacaccgcctgccaccagcgcttttgccatcggcacggcgtgttccagtttgttcacaacgatgaccggcaccacaggtccggtggtcagaatctgttctgcactcgttttccagtttttcatcagttccccttgcttgataacaccgggattgcgacccggtcatggagcatcggctcctgccctgtaaattgcgtcactaccatacatgatcaacttcctgagcgtctatcatcctgcgaccattttgaaacggcagttcaattttattcgtgttgactggcccggtttaagggcgaaaaaaaagcccgcgttgcgggcttcatcatcacttccgttattcgaactcgttccacgaacggccatcgcgggtaatcatcgccactgaggccaccgggccccaggtgcccgcctgatacggcttggaagagtcaccatccgcagcccaggcgtcgataatggaatcgacataggtccatgcggcttccacttcatcgcgacgcacaaacagcgcctggataccgcgcatgctctccagcagcagacgctcgtaagcatcggcaaggtgcgactggttaaaggtctcggagtagctcagatccagcttggtggtctgcagtttgtgcttgtgatcgaggcctggcactttgttcaggatctcgatatccaccccttcgtccggctgcagacgaatcgtcagcttgttctgcggcagctcggagtaggagtctttaaacaggttcatttccgggtttttgaagtagaccacgacttctgaacacttggtcggcaaacgcttaccggtgcgcaggtagaacggcacacccgcccagcgccagttgtcgatatcgacacgaattgccacgaaggtctctgtggcgctcgacttattggcaccctcttcttccaggtagccaggcacttttttgccctgcacaaagccagcggtgtactggccgcgaacggttttctcacgcacgttggtctgatcgatgcggcgcagcgagcgcagcactttaactttttcgtcacggatgctgtcggcgctgagatcggacggcggcgacatggcgatcatggtcagaatctgcagcaggtggttctggatcatgtcgcgcatctggcccgctttatcgaagtaaccccagcggccttcgatacccacttcttcggccacggtaatctggacgtggtcgatggtgcggttatcccagttattcacgaagatagagttggcaaagcgcagcgccagcaggttaagcaccgtctctttgccgagatagtggtcaatacggaacacctggctctcatcaaagtactcaccaacgctgtcgttgatctcctgtgaggtttccagtgaggtgcccagcggcttttccatcactacgcgcgccggtttagcattcagcttcgcggtgcccagtccctgacagatggcgccaaaggtgctgggtggcatggcgaagtagttgatggtggtgcgatttttctggtccagcatcttgcccagtttcgggaagtgcgtggtgtcgttgacatcgaggttgcagaagtcgagacgattgctgagtttgtcccacagcgcttcgtcaatcttctccttcatgaaggtttccagcgcttcacgtaccactttggtgtattccgctttatcccactcggcacggccgacaccaataatgcgggtttcctcgtggatctgccccgctttctctaactggtacagtgaaggcaacagtttacggcgtgcaagatcgcctttggcaccgaaaatcaccagatcgcatgcctgggctgtttgtgttaccgccattttcctctcctcgttgcaggatagtccggtggtgatgcatcctctgccaccgggtccaggttattattttctttgagcacaatgtacttttttccccgcgccaggtaaaccgactcgccgggtcaaccgcattaactctgtaccggatgtgctaagcgcgtgtgatgacacgtgcggattgccggatttttctgtgtctgttggtgtcaggaaaatcaggcaccggtcaaagtatcccaaaaaaaagggcaatcgacttgtccgccgttgcgcctggcaggtgctgacacgatatagtctctgttaatcgactctgacgacagggataattgaaattggtaaaagtgattatggtcatcggcttatgaatatgctggaaaaaattgaggcgcagttcgccgcgctcagcaatgcggaacagaaagtcgcccggcagattctgactgcgcctcaggcggcgatgcactccagcattgcgaccctggcgcgcgaagcgtgcgtcagcgaaacccacggtgaatcgcttctgtcatcgactgggcgcacgcggctttcccgactttaagctgcaactggcgcagagcctggtgaaaagcagcaactgggtcagccggggcgtggaggacgatgacagtgtggagaactacagccacaaaatctttgactcggcgctggcagggctgcagcgggtgcgggatcaactggatagcgcccaactgcagcaggccgtcaccctgcttactcaggctgacaaacttgcctttttcgggctgggggcttccgctgtggtggcgcatgacgcctttaccaaatttcttcgctttaatctgccggtcatctggtcagacgatattgtgatccagcgcatgagttgcataaatagtcgagccggtgacgtttttgttctcatttcgcatactggacgcacaaaaaatatggtagaactggctcgcctggcccgtgtaaacggttccaccgttatagccatcacctctgccgattctccccttgcccatgaagcagcgatagctttagtgcttgatgtaccggaagatacggatatctatttgccgatggtatcgcgcctggcgcagttgaccgtgatcgatgtgttggcgaccggtttcaccctggaacggggtgcgcccttccgggaaaacctgaaacgcgtgaaagaggcgttgaaagcgtcgcgttacgaaaagcacaccattcgggaaaaggatgatcagtaaaaaaaattaacatcacatttacaatgtgagtcgtatcacaacccgtcgatcatatagaatagataaccatgctgtgtccacagaccagggcacgcttaaatgtttacggagtcctcgatgtcaagacgtctcagaagaaccaaaatcgttacaaccctcggcccggccaccgatcgtgataataatttagaaaaaatcatcgctgccggcgcgaacgttgtacgactcaacttctctcacggcacgccagaagatcaccagctacgtgccgataaagtgcgtgagattgccgcaaaactgggtcgccacgtggccatcctcggtgacctccagggtccaaaaattcgtgtttcaaccttcaaagaaggcaaagttttcctgaatatcggcgaccgtttcctgctggatgccaatctgggtaaaggcgaaggcgataaagagcgcgtcggtatcgactacaaaggcctgcctgcagatgtggtgccgggcgatatcctgctgctggatgatggtcgcgtgcagctgaaagtgctggaagttcaggatatgaaggtgttcaccgaagtcaccgtgggtggcccgctgtctaacaacaaaggcattaacaaactgggcggcggactctcagctgaagcgctgaccgaaaaagataaagcggatatcatcaccgccgccaaaatacgcgtcgactatctggccgtctctttcccacgctgtggtgaagatatgaatctggcacgtcgtctggcacgcgaagcgggttgtgacgccaaactggtcgcaaaagtggaacgtgctgaagcggtcgccagccaggaagcgatggatgacatcattctggcctctgatgtggtgatggtggcgcgtggcgatctgggcgttgagattggcgatccggaactggtcggcatccagaaagcattgattcgtcgtgctcgccagcttaaccgcaccatcattaccgcgacgcagatgatggagtcgatgatcactaacccgatgccgacccgcgcagaagtgatggacgtggcgaaacgccgtgctggatggcaccgatgccgtgatgctctctgcggaaaccgcagcgggtcagtatccggctgaaactgtctcagcgatggcgaaggtctgcctgggcgcagagaagatcccgagcgtcaacgtctccaagcatcgtctggacgtgcagttcgacaatgtcgaagaagcgattgctatgtcatccatgtacgccgcgaatcacctgcagggcgtcaccgcgatcatcaccatgaccgagtcgggccgtaccccgctgatgacctcacgtatcacctcaggcctgccgatttttgccatgtcacgccatgaacgcacactgaatctcaccgcgctctatcgcggcgtaacgccagtgttcttcgacagcaataacgacggtgtggctgccgcgcacgatgcggttaacctgctgcgcgacaaaggcttcctggtctctggcgatctggtcattgtgacgcagggcgatgtgatgggcgccaccggcaccaccaataccacacgtgtgctgcgcgtggattaattgagcccgggtttacattgtcggtgtagaataaacgacgcgactgccttgcagtcgcgttttcttttctgacaaggaggccagatggcccgtttccaccccatcagccagcttaccggccgaattttactctttcctctggcgttagtgctgttcgagtttgccacctatattgctcatgacatgatccagcctggcatgctgatcgtcaccagtgaattttccgtcggccctgaatgggtctccacctccctgaccgcttacctgattggcggcgtggtgctgcaatggctgctgggtcctctctctgataagtttggccggcgaccggtgatgctcttcggcatcctgttttttgccgtcgcctgcatgctgatgcactgggtcagctcgattgaagaatttgtcagcctgcgctttattcagggcatcagcctctgctttatcggcgcggtcggttatgccgcaattcaggaagccttcgatgaggcgctggcggtgcgcatgatggcgctgatggccaacgtggcgctgctggctccgctggcgggtccgcttgccggtgcagcctggctcaccattggcagctggcgcagcatgttctggctgtttgccgcctgcagcctggtcgcctttgtggtgctgtggcgtgtgatgcccgaaaccgcaggtgaccgcagtcactccatcgccctgcccaatctggcacgtaactatggccggctgatgaaagaccggctggtgatgtttggttccttcgctatcgggctggtgtttatcccgatcctcacctgggttgctctttcgccggtgatcctgatgcacgacgaaggtctgtcgcgtatgcagtacgccctgctgcagctgccggtgtttctggcgatgatcgccggtaacctgacgctgagtaagctggcgggacgcgtgccgattgaacagccggtgaagtttcgccgcctggccgattctgattggtctgagcctggcgctggtggcgagcctgatgaacagccacggctatctgctgataaccgctggcctgagtctctacgcctttggcgcgggcatggtcaatgccggactgtatcgcctgacgctctacgccagcaacgaaggcaaaggcagcgtggcagcgatgctgggaatgatcagtattatgacgctggcggtgggaattgagctggcgaaaagcggctacttcagcggcggcacgctgtggttctgcctggtcaactttatcagcggcgtgctctggtttggcctggtgatcctgtttatgcgcgagcgtaaacgtcgcagcaggctggaggcattataaacaggcagcgcagccacaggtttgccctgagcaggccgctcagaagctcaaagcgacgggagcatacgcctgtagccagcgattaagtgataagaaaaggccgctttcgcggcctttttgctatttgcgcggatagagatctttgcgcgaatagggctcgatgtcaccctctttacgggtcttcagcagcttgaggatccaggtgtactgctcgggatgcgggcggacaaacacttccacttcttcattcatctggcgagccagctgatgatcgtcggcttccagcagatcgtccatcggcggacgcacataaatctcaagcttatgcgatttgctgttataaaccgggaacagcggcaccacacgcgcgcggcacactttcatcagtcgccctactgcaggcagcgtcgctttataggtggcaaagaaatcgacgaactcactctgctccggaccatgatcctgatcgggcaggtagtagccccagtagccctggcggattgagctgataaagggcttgataccgtcgttgcgcgcatgcagccgtccgccataacccctgcgtgcggtattccaggcatagtccatcagcggatcgctctggttatggaacatcgccgccatcttttgaccttctgacgccagcagcatggcggggatatccaccgcccagccgtgcggcaccaggaaaatcacattctgctgctccgctttcatctggtcgataatttcacgaccatgccactctacacgttcacggatacgtgccggatcgcgcagcaccagctcggtcatcattgccatcgcctgcggtgccgtcgcaaacatctcatcgaccagcgttgcacgctgcgcctcgctgagtttccggcagacagtaatagaggttaatcagcgcacggcgccgtgcaccctttgccagcttaccggcgaatttgcctaaccgacccagcagcggatcgcgtactttcggcggtagcatcgccatcgcggccagaccaccaatcgccagccagctgccccagtatttaggtttgagaaaagaacgttcaaaaacgggaataaattcagtgttattttttttacgggtttccatgcactcgcctcaagcaatgaccggctaatgatagtgacgacctgaaaatttgcaatcatcctgcgccatatagcaaaaaaccgacgggaaacccgtcggtttttgcgcgatttgacgaaattcgcttacttcagacccagctgaggcagccaggatttaacctgtgccatgtaatcgctgcgatctttaccggtcaggccttccatgcgcggcagtttcgccgttaaggggttgaccgcctgattattgatccagatttcaaaatgcagatgcggcccggtggaacgtccggtgttgcctgacagtccaatacggtcgccacgcttcactttctgacctggcttcaccagcactttcttcatgtgcatatagcgcgtcatatactgacggccatgacgaatggcgacgtagttacccgcggcaccgccgttcttcgccaccactatttcaccatcacccactgccagcaccggcgtaccgatcggcagcgcaaagtcgacgcctttatgaggcgcaatgcggccagtaaccgggttaagacgacgcggattaaagttagaggagacacgatactgcttaaccgtcgggaagcgcataaagccgcgcgccagaccggagccgctgcgatcgtagaacttgccatcttcggcgcggaaagcgtaatagtctttacccccgctacgcaggcgcacacccagcaactggctttgcgcactcttgccatccagcatttcgcgtgacatcagtacgctgaactggtcacccgcacgcagtttacggaagtccatctgccactgcagcgctttgatcacggcgctggcttcggcactgctcagtccggcacgctgggcgctggcggcaaaactgccgcgcacttcgccctgcatcacgctgttgcgccattcacccttctgcatctccgcatccatcttaaagccacctttaggggtgcgctcataggtgcgggtttcacggcgggaaatttcccagctcagggttttcaggccaccatcatcatccagcgtccagctcagctgctgaccaacctgcagattacgcagatcgcggtcgctcatcaccagcgcattaatgtcactgatgtcgatgccatactgattcagggcactgctcagagtatcgccggatgaaacggtgtagtcgtgaacaccggccgtttcgggcacgtcggtgtccacatcgtccgcaggcaattcttcttccggttccggtgtgctctgatcgataggctcactggcttccggcaacagcgtgcggaacgtgttcttatccagttcgatgtttttgacgatgggcgtcacatcatccgaaggatgataaacgtaaggccgccagacagcgacggccagagtgactacagttaaagaacccagcattacgcggtgggggcgcggcaaattattaaatgcgagggcgacagagcgggctatctgctgcacttttacctattcctcatgctccattcaggcagctttcatactggctcgacagttgtgagaggaatttcacatagctgtctttggctaagctgatgtctgttcccaggggatcgagcgtgcctttacgcacctgcgttccgcgggcgacagcatcgatgactgctggcctgaattgtggctcagcaaagacgcagaccgccttttgctcaaccaactgtgttcgtatctgatgtaaacgctgagcgcccggttgaatttcaggattgacggtaaagtgcccggtgggcgagagaccgtattgtttttcaaagtacgtgtaagcgtcgtgaaaaacgaaatatcctttatttctgaccggagcgagttgtgcgctaacgcgtttgtccgtgtccgccaaagctacctcaaactgctggaggttggcgtcaagtttggctttatcttgcggcataagttccaataattttccatggattgcaaccgcggtcttgcgcgcaatctctggcgacaaccacaggtgcatattaaactcgccgtgatgatggtgatgggcatcggcgtcctgttcttcggatttttccgctgtgtgttcatcttcatcttcactaccgctaatcaataacggttttaccccgtcgatgttcaccatcgcgaggtttttttgggccggaagttcagccgcagacttcgccataaaggcttccatttcaggcccgacccatacgactaagtccgcgttttttaagcgttttgcatctgagggccgcagggaataatcgtgttcagaggcaccgtccggtagcagaacgtcaaccggtgtgacaccatcggcaatggccgcagcgataaaccctaccggtttgagtgaagccacgacattcgcctgagctggaagggttaacgaagctgtaacggagaaagcagttaaggcgaaaattgcgccctttttattatgtaacatattgcgtcattccatcgtgaccatgaggtggaatgtgatattataacattcgaaattctgtgcaacctgtaaatactatgacctcacttgtcacactcgataatgtttcgataaagtttaaccagcgcaatgtgttatccggtgtcagcctggcactgcagcctggccgcatcctcaccctgctgggtcctaacggtgccggaaaatcaacgctggtgcgtgtggtgctgggactgctcgctcccaccaccggtagcgttcagcgtgatcccggcctgcgaattggctatgtgccacagaagctgcacatcgacccgaccctgccggtgaccgttgaacgctttatgcgtctgacccgtggcagcaaaaacgccgagatcctgccggcactgaaacgcgtgcaggcgggtcacctgctcaacgccccgctgcaaaagctttccggtggtgaaacccagcgtgtgctgctggcgcgcgccctgctgaatcagcctcagttgctggtactcgatgagcctactcagggtgtggatgtgaatggtcaggtgtcactctatgaccttatcaatcagttacgcgttgaactaaactgcggcgtactcatggtctcccacgatctgcatctggtgatggccaaaaccgacgaagtgctttgccttaaccatcacatctgttgttccggcaccccggaagcggtatcgcagcatccggaatttatcgccatgtttggtccgcgcggcgcggaggagctggcgatttatcgtcatcatcataatcaccgtcacgaccttcagggacgtatcgttttacgcaaaggacagggtcgatcatgattgagttgttattaccgggctggataggcggtgtgatgttagcgctggctgccggtccgctgggatcgtttgttgtctggcgcaagatgtcctatttcggcgataccctggcgcatgcctctctgcttggcgtggcatttggcctgctgtttaacgtgaatccttactacgcggtgattctggttacggtctgcctggcgctgggactggtctggctggagcgtcgtccacatctggctatcgataccctgctggggattatggcgcacagcgcgctgtcgctgggcctggtggtggtcagcctgatgaagaacgttcgcgtcgatctgatggcttatctgtttggcgatctgctggcggtgacgccagacgacctctggatgatgggtggcggcgtggtgatcgtgctgctggtgatggcgtggcagtggcggtcgctgctgtcgatgaccatcagcccggaactggcacaggtggacggcgtcaatatccagcgtacccgactgattctgatgctggtcacggcactgactatcggagtggcaatgaagttcgtgggtgcgctgatcatcacctcactgctgattatccccgctgcgactgctcgtcgctttgtgcgttcaccggaaggcatggcggccgtcgccgtggtcatcggggtgattgccgtcaccggcggcctgaccttctccgccttctacgacacgcctgccgggccgtcagtggtgctctgcgccgccatcctgtttattttcagtatggtccggaaaccagcagtctagttactcttcgcgcgtgatgccgaagtgacgataagcgtgctgcgtggccatccggccacgcggtgtgcgctgaatgaagccctgctgaatcaggaagggttcaatcacatcttcgatggtttcgcgctcttcaccaatggcagcagccaggttatccagccccaccggcccacccataaatttgtcgatgatcgccagcagcagtttacggtccatataatcgaacccttcgctatctacgttaagcatatccagcgcgctgcaggagacttcaccgctcaggtcaccatttgcccgcacttcggcgaagtcacgaaacgcggcgcagcaagcgattggcaatacgcggcgtgccgcgggcgcgacgggcaatctctaacgccccttcgtcactcagcgccagacccagacaggcggcgctgcggcccacgatgtgctgcaaatctttaacctggtagaactcaagccgctgcacaatgccaaaacgatcgcgcagcggcgaggtcagcgagccagcacgcgtggtggcgccaatcagggtaaacggcggcagatcgagcttgattgagcgcgcagccgggccttcgccaatcatgatatccagctgataatcttccatcgccgggtagagtatctcttccaccaccggtgagaggcgatggatttcatcgataaacaggacgtcatgcggttcaaggttggtcagcatcgccgccaggtcgcccgccttttccagcaccggacctgaagtagtgcgaagattaacgcccatctcgttggccacgatgttcgccagggtggttttacccagtcccggcggaccgaagatcagcagatgatcgagcgcatcgccgcgcagttgcgctgccttgatgaaaatctccatctgctcacgcacctgcggctgaccgacatactcggtcagcatcttcgggcgaatagcgcggtcaataacctcttcttcgctgatactggcagcggagatcaggcggtcggcttctatcatgacttacctcaaatggcggcgcgtagcgcttcgcggatcagggtttcgcaatccgcatccggtcgaccgactttactgatcatacggctcgcttcctgcggtttataacccagtgataccagcgctgcaaccgcttcggattccgcatcattggtttccggctcggcgctcggcgtggtcagcgtaaacgcagaatcgccgccaaacaggtcgccgtgcattcctttgaagcggtccttcatttcgaccaccagacgctcagccgtctttttgcccacgcctggcagtttcaccagtgacgcgatctcctctttctcgacagcggtcacaaactgctgcgccgacatgccggagaggatcgccagcgccagcttaggtccgacgccattcactttaatcagttcgcgaaacagcgcgcgctcctgcttgctgttaaaaccaaacagcagctgagcatcttcacgcaccacaaagtgggtaaaaatcaccgcttcgtgctgaacttcaggcaactcataaaaacaggtcatgggcatataaatttcatagccgacgccgtgtgcctcaagcagcaccagtggcggctgcttttccagaatattgccccgtaaacgacctatcacctgaacgcttccttaactaacgaatgtggcggattttataacataaaaaaggctggatgaatatccagcctgtgagtgcggcctgagcgatgacggctaacctgatcgtaaccgtccgcgcgtcagcaccagcttactgtcactcatgcgagccgcattctgagccacatgacagtgcgtaatggcaatcgccagcgcatcggcggcatccgcctgcgggttcgccggtagcttcagcagggttcgcaccatgtgctgcacctgacttttctcggcgctgccgatgccaaccacggtctgttttacctgacgggcggcatactcaaacaccggcagatcgtggtttaccgcggcaacaatcgcggcaccacgcgcctggccgagcttcagtgcggagtctgcattcttcgccataaacacctgttcaatggcgaagaagtcgggtgaaaactgcgtaatgatttcacagacgcccgcataaatcagcttcagacgggcgggcaactcggtggtattagtgcggatacagccgctgcccagataagtgagctggcggccagtctgacgaataacaccataaccggtgatgcgtgagccgggatcgatacccaggataatcgacattacgcctctttggttaaagtgattacggtagacgccattacagcgtttccgctacctcgtcggagatttcaccgttgtgatagacctcctgcacatcgtcgcaatcttccagcatgtcgatcagacgcagcagtttaggtgcggtttccgcatccatttcggctttggtggtcgggatcatcgccacttctgcagtgtccgctttcaggccgagcgcttccagtgcatcacgcaccgtgcccatctcttcccatgcggtgaagacatcaatcgcgccgtcgtcatagctgaccacatcttctgcgcctgcttccagagccgcttccatcaccgcatcttcatcctgacccggcgcataagagatcacgccttttttgttgaacaggtaagccacggagccgtcggtgccgagattcccgccagttttggtgaaggcgtgacgcacttcgcccacggtacggttacggttgtcactcaggcattcaatcatgatggccgagccgccaggaccgtagccttcatagatgatggtttccatgttggcattgtcatcgccgcccacaccgcgcgcgatagcgcgatccatggtgtcacgcgtcatgttgttcgccagcgctttatccattgctgcacgcagacgcgggtttgagcccggatcgccgccgcccagcttggccgccgtcaccagttcacgaatgattttggtgaagattttgccgcgcttggcatcctgcgccgccttacggtgtttggtgtttgcccacttactgtgtcctgccattttaaattttctccgatcttttacagggtgcaggctatcctgcttgcgagcctgtttaccgtccgtacgcatacaggtgactgacaacctgaatgccccgagggcgagcgtcgcgaagcatcctcacgtacaaccgtacgctgacgacgtcgcgcgggcggtgaacaacctcacggtgccgattacgcctgactgttcaatatgttggtgaagtcctgttaaaactcaccagattcataaaatttaatctttccgccgccggaataccgggcgatggcgagcattcagataaattcttcaattgcctggcggttactccatgatcgggttaatgctgcagcgtcagcgggtgccagccagcgaaacgccagatgctcggtgagcatcacatcgcgctccgtcggcagttgcaggcgaaaccagtgctcgtgattatgagtgacatcaggggcgtagcgatggcggaaatggggaaagatttcaaagtcgatctgacgctgacaatcctccacctccagccgctcggccagcacgtcgatgccgatttcctcattcacttcacgacacgcggtcgccagcggtgactctcccgcctccaggctgccggtgaccgactgccagaacgtgggatcgtcacgccgctgcagcatcaacacccggccagtatcgcgcgccgaaatgacgaccagcactgaaaccgggtgtttatagcccattatttattctcaggcttttcttttttaacgacctgaatgccgagctccagcagggaagccggattagcttcgcttggcgcttcggtcatcatgcaggcggccgccgtggttttcgggaacgcaatgacgtcacgaatattatcggtgccggtcagcagcatggtcagacgatccagaccaaaggccaggcccgcatgcggtggcgtaccgaacttcagcgcatccagcaggaagccaaacttctcacgctgctcatgctcttcgatacccagaatgctgaacaccgtctgctgcattttgccgttgtggatacgcactgaaccgccgcccacttcataaccgttgatcaccatgtcgtaggcgtttcgccacggcacgggttggatcggcggccagctcttctgcgctcatctcttttggcgccgtgaacggatggtgcatcgcagccagaccgccctcttcgtcctcttcgaacatcgggaagtcgatcacccatagcggtgcccaggctttctcatcagtgatgttcagctcgcggcccactttaagacgcagcgcacccagtgcatccgcgaccactttggcgcgatcggcaccaaagaagataatgtcgccatcctgagcaccggtgcggctcagaatgccttctacaatctccgcattcaggaatttggcaaccgggctctgcacgccttccaggccgtcagcacggacgttaaccttcatccacgccagacctttggcgccgtaaatctccacgaacttgccatattcatcaatctgcttacggctcagctgtgcgccggtcggtacgcgtagcgcggcaacacggcccttttcatcgttagccgggccagagaagacctggaactccacgtttttcagcaggtcgccgacgtccaccagctccatcgggttacgcagatccggtttatcagaaccgtagcgatgcatcgcctctgcaaaggtcatctgcgggaactcgccgagatcaacgccctgcacgtcctgccacagattgcggattaaacgctccatgatttcacgcacctgtggcgcggtcataaaggaggtttccacgtcgatctgggtaaattctggctgacgatcggcgcgtaaatcttcgtcgcggaagcatttaacgatctgatagtagcggtcaaaaccggacatcatcagcagctgtttaaacagctgaggtgactgcggcagcgcatagaatttgcctttatgtacccggcttggcaccagatagtcacgcgcgccttccggcgtcgctttggtcagcatcggggtttcgatatccaggaaaccttcgtcatccataaagcgacgaacgaagctggtgatttttgcgcgggttttcagacgcgtcaccatctcagggcggcgcagatccagatagcggtacttcaggcgcgcttcttcgctgttggtctgattcgagtccagcggcagtggctcagagcggttaataatagtcagtgcctgggcaaacacttccacttcaccggtcgccatgtcgctgtttttgttcttctcatcacgcgcacgcacggtaccggtgatctggatacagaattcgttacgcagttcagaagccagcttaaatgcgtcctggcgatcgggatcaaaaaacacctgcacgatgccttcacggtcgcgcatatcgataaaaatcaaactgcccagatcgcgacggcggtttacccagccgcaaagcgtgacttgctgacccacatgagacagattgagctgtccgcaatattctgtacgcataacactatccttttaacttcgccgctgcatctgacagcatccggccgcgttacctgttgcgatgctgtcgcaaaaatggcggtcattataatggaaaaagccagacaggataagcagatccgcgccaaagcgccgatttcctctgtgcatttgccccccagcctgaccatagcggataatggggtatcttaatctgcagccaggagcgcgcgtgacacttcgtattggcctgccccagtggcagcattcacactggaaacgctggggtatcgaaagcctggcggactatgcccgctatttccattgtgtagagggaaataccacgctctatgcgctgccgaatccggaaacggtgatgcgctggcgcgatatgacgcacgatgcgtttcgcttctgctttaagtttcccaataccatcagccatcaggcggcgctgcagcacagcgatgacctgctgaccgatttcctgcgcctgatggagccgctggccgatcgcatcggtcagtactggctgcaactgcctgccagcttctctccgacgcagctcgacgacttgtggcgctttctcgacagcctgccgcgccgttttcactatggcgtcgaagtccgccatcctgctttcttcgctaaaggggatgctgaacgggcgctgaatcgcggcctgctggcccgcggcatcaatcgcgtgatgctcgacagccgtccggttcacgcctctacctcgcaaagtccggccgcgctggtggcccgcgcgcagaagccccgggtgccgcctcatgcattgcgaaaccggctcacagccgatggtgcggtttatcggcagtgacagcgtggaagagagcgtgccgctgtttcagatctggcgtgacaagctgacagaatggcagcaacagggcgacgccatgctgtttctgcacacgcccgatatgggccaggtctttccgctggtgcaggcgctctggccgcagctgcagcagatcgaccccggcataggtagcggaccggactggccgcagcagacgtcactgttttgattcctgcccaggacagcgggctgcacgcccgttagaatagaagcattatggacagtcgcaggggtggctatggttagcgcgttatatgtggtgatgggtgcattactggtgatgaaattcacgctggacgtggtccgctatcgccgattctaccgtgtggcgtatggcgatggcggctaccacgacctgaaaatggcgattcgcattcacggcaacgccatcgaaaccattccgctggcgctgtttctgctggtaatgatggagatgaacggtgccgatatctggatggtgcatcttacgggtctgctgttctttatcagtcgcctgctgcacgcctggggtttgcgcagcagcgcaatggcaggccgcaaatatggcatgctgctgacgctgttttccctgtgcggcatggtgatttttaacctgatctatatgccgtgggaactggtgctgacgctgcattaagctggcctgggttaaggggtgcagcccgccccactttctgcgagaatagcgccctttccgtcgtctcttcggattttcgatatgtctgaccgcgatcaactcttctcagcgcccattgcaaaactgggcgactggacttttgacgagcgtgtagctgaagtctttcctgacatgattcagcgctcggtgccgggctactccaacatcatttcgatgattggcatgctggcagaacgttttgttaccccggacagcaaggtttatgacctgggctgctcgctgggcgcggccaccctgtcggtgcgccgcaatattcaggtgccgggttgccagatcatcgcagtggataactccccggcgatggtggagcgctgtcgtcgccatcttgatgcgtttcgcgcggacacaccggtaacggtgctggaagcggatatccgcgacattgagattgagaacgcctctctggtggtactcaactttacactgcagtttctggaaccgcctgcgcgtctggcgctgctggaaaagatctggcagggactgaaaccgggcggcgcgctggtgctgtcagaaaaattcagttttgaagatgccgaagtcggtgagctgctgtttaacatgcatcacgacttcaagcgcgccaacggctacagcgaactggaaatcagccagaaacgcagcatgctggaaaatgtgatgctgactgacagcgttgaagctcataaagcccgtctgaaacaggccggtttctcgcacgccgaactctggttccagtgctttaattttggatctctggtggcgttgaaatgatcgactttggccgtttttatcagcaaattgcggtgggaccgctggcgaagtggctggaagtgttaccggcgcaaatcagcgagtggcagcgtgaaaacctgcatgggcacttccgcgactggtacaagtcgctggagtatctgccgctgctggagcctcaaaaacttgacctgctacacagcgttactgccgaccgcgatgacatcagcgatcgccatcgtcagggtattgagaaattactgcgcaacctgatgccgtggcgtaaggggccctatttcctttatggcacccacatcaacaccgaatggcgatctgactggaagtgggagcgcgtgctaccgcacatctctccgctggccggccgcacagtgctcgatgtgggctgcggcagtggctatcacatgtggcggatgattggcgcgggtgcccatctggtggttggcatcgatccaatgcagctgttcctggtgcagtttcgaagcggtgcgtaagctgctgaacgacgatcgccgggcgcatatgctgccgctgggcattgagcagttaccggtattgcaggcgttcgataccgtgttctcgatgggcgtgctctatcaccgccgttcgccgcttgatcacctgttacagcttaagaatcagctggtcagcggtggcgaactggtgctggagacgctggtgattgagggcgatgtgaatcaggtgctggtgcccggtgagcgatatgcgcagatgcgcaatgtcttcttcattccgtcagctgaagcgctgaaaagctggctggaaaaaagcggctttgtagatgtccggattgtcgatttcgccctcactaccactgaagagcaacgccgtactgactggatgaccagcgagtctctggctgaattcctcgatcccgatgaccccagcaaaacagtcgagggctatccggcgcctctgcgcgccgtgctggtcgccaccaaaccgtaatgccctagcggcgagacaacgccagtttcgccgcaaatcctataaacacacagccggtcaggcgatccatcaccttcagcacccgcggtttgcgcaaatgaccggcgaaatagtggctgccgccaatcagtaccgcattccagatcagccccagcagcatgtgtgccagcgccatcagactacaccagagcgccaccgacgcccccgccgggataaactgtggcaaaaaactcacatagaagatccccactttggggtttagcagattgcccagcagcccgcggctgaagcaggcaagatagccctgctgcagcgacggttgttgcgtgtcgattgctgtttggcggggtttcagcaacaatttcagccccagataaagtaaccaggcggcacccagccacttaagcaggttataggccatttcggaggccagcagcagcgcgcctaatccgaatcccaccgcaacaccccagaccagacagccgagcgtgatacccagtgccgtcacgctggcgcgctttgcgccctgagcgactgcagagcgcagcaccagcgcggtatcaaagcccggcgtcagcgtcagtatggtgatggcaaacagaaatgaaaacagcgtggtggtcatggcgtttctccctggaggtaacagccggtcagcagcgtatgggtgtcctgccagcgtaacaggcccgtcgaattatctcacccttgtcactctccctgttcgtcagcgtgtgccaggctaagggcggtttaacttcatattaaggagctgtgattatgagtaaatttatcttctcttcaccccgtaaatatgtgcagggcgcgggcgtgctggacgagctgggcccctacgtggccgaactgggtgataacgctttcctggtcgcggatgatgtcgtctggaaattgattggcgaacgcgcccaacaggcgctgcaaaaggcgggcgttaccttcaactggcacccgttcaacggcgaggcgtcgagcaatgagatcacccgcctgagccagctggcaaaaagtcagggctgtaatgtggttgtcggactgggcggcggcaaaacgctggacaccgttaaggcggtggcggatgagctgaagcagccggtagccatcgtgcctactatcgcctccactgatgccccctgtagcgcgctgtcggtcatctattctgatagcggcgtatttgagagctatcgcttctacagtaaaaatcctgatttggtgctggtggacaccgcagtctgcgccagtgcaccagcacgactctttgcctccggcattgccgatggactggcgacctgggttgaagcgcaggcggtggcgcgttcgcattcaaaatcgatggtcaatggtgatccgacaattgccggactggcgattgcccgtgcctgtgaagaaacgctgcttacctggggttacagcgcctatgttgccgtcacccaaaaacgagtgacgcccgccgtggaagcggtggttgaggcgaatacgctgctatcagggctgggttttgaaaacggagggctggcagctgcgcacgctattcataatgggttcaccgcgattgatggtgatatccaccatctgacccatggcgagaaagtcgcctacggcacactgacgcagatggtgcttgagaagcgtccggatgaggacattgcgcgctatatccgcttctatcgctcgatcaacatgcctaccacgctccgggaactgcatctggaaaatgagagctgggagaatctggtcaaagtgggtgcactggcgaaacagtgagggcgacacgctgaaaaaccttaatccaaacctttcaccggaagatattgcaaacgcactgctggcgctggatgcctttagtcagacggttaaataaccacccgaaaggcgatcatccgatcgccttttactccgccgccgctggctggtcccagtactcatatttataggcggaactgagatggcgctcaatagtgccgcgcgtgaagatttcggtctcgtgcagatagctcagggtacagttacccacctgatcccaggactgacactcatctactgaccggatggtgctcagcggtgtggtcgccgtgccgttgagccgcacttcacgccattggggatcgtaggtataactgtcggtgctgcgggccgatgtggtgcgggtcaccagaccttgcggattccagtggtaatgattttcaccgttggtcaggggatcgctgccgcgtgccacgctcttctccagccggaactgccgatcatagcgataagtcgtgtcggtaaagccgcttttacccatactggtaaacctgtcggaggcgctggtaatgttgccatgctgacctttctgccagttaatcgtcccctgtcggttatcgaccaccacctctttgccctctttcagcacttttaccagatacgcatattccgccacccagccgccctgcacccgggcaatgtgttgctccatgctgagaatcacgttgcgctcacttttgtcatagctgacgtcggcaaccgtcagatcgccacaggcgtcaaactgccccagtacccgcttttgcgaattcacatctttaccaaactcgcccgcaaccacctgcttgaccgcgcctttcgcattcccgcccagcaaaatcaggttattgctgttagccacagcagcgttgtttgggctgcatgcgctggccgcagcgctgccactgcagagagcagtcaggatcagagtcaggacagcaatcggattgggtttcataggatacttttccaggcgacgttgctttcagtgtaaacgctgcggtgatgaacagcggcaatctgtgaagatttcagcctgcatcgccttttaaggttttaaggaccggagaggcgacacggcatcagcataacgaataaagcaggtgattacgttgctgccgggcctgaaagtcctggatgacatgtaatgattaataaggggcaggtgatttttatcgagccaggcgaaagagtgataatttcgctgcagccagatttagatccctctgacatcaataacatgccagagaagcgcaaaacaatttaaccgggacggagtgtgttttacacaaaaagaaccccagcaaggatactggggtttggtacttgcaaacaccacgtcaatgatcggcgtgctgcgcggcaaaatctgttgtagttcaggcgacccgaacggtgctcatctgcatcacgcttttcatcgcctcaaccacatcgccgtctacacagtagcggctgaactcgtcagtctcggcttctgaacacatggagacccccgctttacggtagcgcatcggcgacgcgacaaggcggctggccgagctgtgaacttcatcaatccccatgtcgagaaacttttgcaggttgctgagacgtaccccagcacccgccataataataggaccggtgctggcctcatttagttccctgagtaatgcaattccgttttcagcgctctgctgctgaccggatgtcagaatacgcgccacacccaaatcggttagttcttccagcgcacgcttagggctgtgacagagatcgaaggcgcgatgaaaggtcacggccaggccgtcacacagcgccataatctgccgcatctgaccatgatgaatgtgagcatcttcatccagcatcccaatcaccagaccaggaaaaccgagttcacggattaacgccacatccgatttcattgcttcaaattcgcgtgcggtgtaacaaaaatcgccaccacgtggccggacaataggatgaaccggaatcgaaacttcttgcctggcggcattcagcatccccgctgatggggtcaggccgccttcacgcggtgcggcacagagttcaacccgatcggcgcccgcctgttgtgcggtcacagcgcaatccacgccatagcagcaaatttccagtgtggtcattctcttctcctttacatgactctggttcaaggcagattcatcagttagtctggctgctggaatgagtttaccgggaaagttaactatggcattcaatttcgaccaacggatagaccgtcgtcacagcgatagccttaaatggaacaaatatgcggaccaggacattctgccgttgtgggtggcagataccgatttccgatcgcctgactgcgtcatcgatgcgattaaaacccgtgccgaacatgggattttcggctatggcgacacgccagttgaatttatcgatagcgcgatagcctggctcgcctcgcgctatcagtggcacgttaatccggaatggattgtggttttgccgggtgtcgtaagcggtctgaatctggcagtgcgcgctttcaccgcgcctgatgagctgacgattgcgccaacacccatctatccgccgtttcgcggtgcagcaaaactggcagagcgcggtcagatcacgctgccgctgacgctgcaacagggacgctggcgactggatctggatgcgccggaaggtcagctggacgataaagcgcggctgttaatgctgtgcaacccgcagaatccgggcggcaccgtctatcgccgcgaggaactgcaggcgcagctggaatttgcgcagaagcacgatttgattgtctgttctgacgagatccacagcgatctgctgctggaacccggcgttaagcacataccctttgcttcactgagcgaagatgcagcccagcgtagcgtgacgctgatgtcgccctcaaagtcctttaatattgccggtcttggggcttccatcgccatcatccccaacgccgggctacgcgcgcaattcaaccgggtacgacgcggcattgtgccggatgttgatattctggcactcacggcagcagcagcggcatggcgcgagggtgagccctggctgaatgcgcagaatgcctatctgcgcagtaaccgtgactggctggtgtcgcaggttaataagatgaccggcctgtcactcgcctcgccggaagcgacctacctggcctggatcgacgccagcgcgctgggtgtggccagcccggcgctctattttgaaaagcacgggctgggcttaaccgccggacgtgagtttggcaatgaccagtttgtccggctcaatttcggctgtacccgcgcgctgctcgacgaagccgttgcgcgcctgaagcgtgcgttagccgcccgcctttagttctgttcgctggcgacaatctcctccagtcgccacggatggaacttgattgtcgtctgcccatccgtaaccgccagggtcggattgggcaggcgctcattctcgccctgtggtgaactggttttaaatgagatacccggctgcgtcagcgcctcatctgacagcaaggccatcgcgcgcacgcccagcgtctgatgatcgccgcgtaacaccacctcaatatgctcccagccttcatggcgataacgcttttcacccggccatggcagttcaaccacatcaatctgcctgcctgcgacaatcagcgggtcatggagtttaaacaggcaaatcttcctgccattgatcatcgccgccgaaaactgcgtgccaatctgctgcaaaccttgctgccagcgcatcgccgttgtgtcctgatggcaccgcacggcgatatggtccacctccagatcggtaaggtgcaaaccgagccgctgcgcaaaactttgcaacgattcttcaaaacgtcctaaatctgtctttaaatcatccaattctgccggaaaagatctcttcaccaccccacttcctctcaatttgtttagcatttataacccgcctgccttttggcgcgccgcgtgctgagcatcacataatgataagattcatcttatttggcccgaaatttaacgctaatcctcataataacatctttcatttcggatttatctcctgtttagggccatgagttccttgatgaaagcatgttaaatatatgatttatatcaacttctttaatacaataagataactctcatttacctggcaaacaattgcagcccaccccgccttcctataaatttgacctaacacaaccaaaaggaatggctctatgtctatgctcatcgttgtcgctgtcctgatcgcactgatgggatttgcaatctcccgccattggaaggtgcgtgaagataaaagcgtaaagaacccacgccgtcatctgcgacgtcgttaatgcttcagggaaacatctgttaagctctgtttccccgcttcatccaactgctgacgcccactgacatttcacgtatacttttcccctcatttttttccgttttgtctgccccatccgtttctgcctctccgtgacgcgatgcgctcaggcaagatgatgacagcccggctttctggtccgggcgttgctcagcacatgaaggtaactcggtgaatattcaggcacatctttccgcaaaagtcagtcaggcaatggttttagccggcgcacccgccgattgcgaaccccaggttcgtcaatccgcccgggttcagtttggagactatcaggccaacggcattatggccgtggcgaaaaagctgggacaggcaccgcgacaattagcggaaacggtgattcagcacctcgacctgaccggcatcgccagcaaagtcgaaattgccgggccgggcttcatcaatatcttccttgaccacaactggctggccagtcatgcccgggaagcgctgcgtctgccgcgccttggcgtgcagctggccgaaaccccagactatcgtcgtcgactactccgcgcctaacgttgcgaaagagatgcatgtgggccacgtccgctccaccatcattggtgatgcggcggtgcgtacgctggaatttctcggccataaagtgatccgagcgaaccacgttggcgactggggaacacagttcggtatgctgatcgcgttcctggaaaagcagcagaatgaagatcatgcagagatggcgctggccgatctcgaaggcttctaccgtgaagccaagcgcacttatgatgaagatcctgagtttgccgagcgcgcgcgcagttatgtggtgaaattacagggcggcgatgactattgccgccagatgtggaagaaactggtcgacatcaccatgagtcagaaccagaaaatctatgaccgcatgaacgtcacgctgacgcgcaacgatgttatgggtgaaagtctctataacgatatgcttcctggtatcgtctccgatctgaaacagaaaggcttagcggtagagagtgaaggtgcgaccgtggtgttcctggatgaattccagaacaaagagggtgaaccgatgggcgtcatcatccagaaaaaggatggcggctacctttacaccaccaccgatatcgcctgtgcgaaatatcgttacgaaacgctgaaagccgatcgtgtactctactacatcgactcacgtcagcatcagcatctggttcaggcctggactatcgtccgtaaagcgggttatgtgccggaatctgttccgctggagcaccatgcgttcggcatgatgctgggcaaagatggccgtccgttcaaaacccgcagcggcggcaccatcaagctctccgatctgctggatgaagcctatcagcgtgcctacacgctggtgcgtgagaagaacccggagatgagcgaagcggaagtgaaaacgctggcggaagtggttggcatcagcgcggtaaaatacgccgatctgtcaaaaagccgtaccaccgattacattttcgactgggacaacatgctggcgttcgaaggcaataccgcgccttacatgcagtatgcctatacccgcgttctctccgtgttccgcaaggcgggcattgatgccgattcgctggatgcggagattgtgatcagcgaagagcgtgaagcgcagctggccacccgtctgctgcagttcgaagaggttattacgcaggtcgctcgtgacggcacgccacacgtgatgtgtgcctatctctacgatctggctggtctgttctccggattctacgagcactgcccgattctcaccgcagaatcagacacaacccgtctgagccgactgcagctggccgcactgaccgcgaagacgctgaagcagggtctggatacgctgggcatcgacaccgtcgagcgcatgtaatctctgaaacggagaggggtttccctctccgttgctgaattcgtatatccgctctgatcccccaaatcttcgcagcaggatggtgttatgtctgtagccgcgcacctcatcagcagccaccttcccacgataaaacagttgcagtgctttctggctgttgcgcacgagctgaattttcgccgggccgcagaacgtctcagcatgacgcaacctccgctgacccgtcagattcagagtctggaagatctgctgggccactcgctgttcagccgcacgacccatgaggtaacgctcaccgattctggccgtgcgctggtcgcgaaggcggaagcgatcctgactgcgctgaatgccctgaagcaggatgcgcagcccgccgcggcacggctacgcatcgggctgacccgcacgctgaactttgaactgattgcgccacttaaccggcagctcgccgcttttcatgccagcgaagagatggagatgccccgcctgacctcccctcagcttttgcaaagcctggccaaaaacactctggatttaatactcaccggagaaaaggggtcggatgcggaagacaccgttcagtacgcctgggtttaccgtgagccgctgctgattgccatgccgtcggcgcatcctgccagtgtggcggagcaggtctcgctggaagcgctggccgatctgccgctgtttctggtttgcccgcagcgccaatccgctgtttttcgataaatgcgagcgctacttcgccacgctcagcgtcacgctgaaacgggtgagagagccggacgattccctgctgatgctgtcacacatcgccagaggaaaaggattcgccctgatgccgcagtcaaaatgcacctttaatcagacagggctctgttaccgcccgctgacagaggatgcggcgcagcagctggcgattgatgtttacgcggcgattcgcgccgatgaaaaaaatgaggcggttcttaatgcgctgagagaactctctcatcccgggtatgcgataaagtccgcatgatgccgtgccgctgaaacagagcgaagcaccaccacactcttcttccttgttaatccccgctcagcctgttgctgagagcttactgtgtcgacacgccggatggatgtctgaagccctttcattcgcctgataccttttttgcatgacggaaagagcaattcattgctttcacgcggagtgaaacaatcgcgtctcacatacgaggagcgacaatgaaaaagcgaacgttaactcagggtctggacgtcagcgcaatcggctatggcgcgatggggctcagcgaattttatggtcagaccgatgaccgtcattccctgcaactgctcaataagctgcgcgatctggatatcacctttatcgataccgccgatctttacgggcgcggtcacaacgagcagttgataggtcagtttcttgccgggctcaatcgggccgaacggctgaagttcaccgtggccaccaaatgtggtattgaacgccctgctgatgcggcctatgcccgcaccatcaacaatcagccggactacattacccgctgctgccatgcatcactgaaacggctaggcgtggagcgtatcgatctcttttatctgcaccggatcagtccggcgacaccgattgaggagagcatgcagtgtctcagccgtctggtgcaggagggaaagattgcccggattgggctgtgtgaagcatcggcttcaacgctgaatcgggcgcaggcgatccatccgctggccgcgctgcagacggagtattcactctggacgcgtgacatcgaacaagagattctccctatggtgaaaaagctcggtatcggactggtgccctattcgccgctgggcagaggattcctgacgggtaaataccgtaaaaacagcgattttgccgagggtgatttccgcaaaaataatgaccgtttccggcaggaaaatatcgatcacaatctccagcttcttaacgcggtgacgccactggctgagaaatatcacgccaccaccgggcagattgcgctggcctggctactggcccagtatgacaaaattgtgccgataccgggcaccaaacagatcgcttaccttactgaaaacgcgcaggccgcagatatcgagctggaagaggaagatatcgcgatgctgaacgctgttcatcagcagattgaggttaaaggcggtcgctactctgaggagggaatgaagggggtgaacgcctgaatacaaactacgcacttgcgcactgtgcctcggtgcgctagtcaattcagcaacgatacccttactcgtaattgaccatcacttcactgctcaccacccgtaatccgggtggcagcgccccgcttccggcgaaaccaaacaccatgtgcagggtctcactggcgctcagatgtgccagcccgcgcgtggtgccgcttgccccctccagggaagtgcagcgctgttcgccgcacaagcgcacctgcaggccggacggggccggtctgctcagctgataacgccagttaataacgctgacctccccgccaatgtcggcgggcggcgtcagcggctgcgcccgttgccagctgccgcggttcgccagcagcggcccattggccgtggcactccaggcaccaccggccgcctgcgccatcagtggcagcatcacgaatgccatcaccagccagcgcattatttacctccgatggtggcagtcatacggatctgacggttgtcgctcagctccagattagagagcaccaccagctgtggcagattgcggcgcaggaaacgcgccagcagcgcacgcagcggatgattgaccagcagcaccggcggcgcgcccagcatctcctgacgctgtaatgccgcctgtgcctgacttaacagccgatcggccagacccggctccagtccgccaccgccctgcaacgcctgtaacagcaggcgctccagcgtggaatcgagcccgataacctgcacttcgtcattacccgggaaccactgctgagtaatcgcacggcccagcgccacacgcaccacgctggtcagctcctgcggatcgctctgcaccggcgcatgttccgccagcgtttcgataatggtgcgcatatcgcgaatcgacacccgctccaccagcaggttctgcagcaccttgtgcagggtggtcagcgagatcactcccggcaccagatcttcggtcagcttcggcatctcctgagtcacacgatccagcaactgctgcgcttcctgacggccaaacagctcgctggcgaaactggccaatcagatggttaaggtgggttgccaccacggtactggcttcaaccacggtaaagccctgaatctgtgcctgctctttcagcgcgctatcaatccagaccgccgccagtccaaaggcaggatcaacggtcgcttcgcctggcagacttccggcagccgtgcccgggttaatcgccatccagcggccaggataggcatcaccgctgccaatctccacccctttcatcaggatgcgatagcgtgccggtggcagctccatgttgtcgcggatatgcactaccggcggcaggaaaccgacatcctgagcgactttcttacggatactgcggatacgtcccagcagctcaccgttttgctgatgatcgaccatcggaatcaggcgatagcccacttccatgcccagcgtatcttccagctgcacatcggtccacgacgcttcggtggcggctggcgtatccgccgttttggcgatgccgcccgtgacttccactttcttcttcggctgtatttcgcggccgcgcagccaccaggccagacccagtaaggcggcggtgaacagcaggaagacgaagttcggcatgcccggcaccagaccgagcagaccaatcacgccggcgctcagcatcagcacgcgcggatctttgaacagctgggtgaccatctgttcgccgacatcctgatcggtggcaacgcgcgtcacgataacaccggctgcggtagagataaccagcgccgggatctgcgcgaccagaccatcaccgatggtcagcagcgtataggtctctgcggcatgacccacatccataccgtgctgcaccacgcccaccagcaggccgccgatgacgttgattaccatgatcataataccggcgacggcatcaccacgaacgaacttactggcaccgtccatcgaaccgtagaagtccgcttcctgggtcacttcggcacggcggcgtttggcgtcatcttcaccgatcagaccggcgttgaggtcggcatcgatcgccatctgcttaccgggcatcccgtccagcacaaagcgcgcgcccacttcggcgatacggccagcacctttggtgataaccataaagttgatgatgacgaggatgataaacaccacgataccgatggcgaagttaccgcccaccaggaagtgaccgaacgcttcaaccacctgtcctgccgcggcggcacccgtatgcccttccatcaggatgatacgggttgaagccacgttcagcgccagacgcagcaaggtagagaacagcagaatggtcgggaaacgccgcaaactccagggtccgctgggtgaacatcgccaccagcaggatcatgatcgacagcgcaatgttaaaggtgaacagcagatcgaggatgaacggcggtaatggcagaaccatcatcgacaggatcatcaggatcagtaccggcccggccagcacctgccactgcatatctttaaagttgcccggtaaacgtagttttgcggccaggttattagccatcgtttttgctctctcctgcaaagtccatctctgccggaaccggcaggttttttggtttggttggtatcaggccgccttcgcgcttccagcgacgcgactgccagacccacgccagcacctcggccacggcggcatagagcgcgccgggaatgtgctgaccaatttcagtatgtcggtataacgcacgcgccagcggcggtgcttccagaaccgggatgcggtgttcggcagccagttcacgaattctcagggcgatctcacctgcgcctttcgccaccactttcggcgcactcatcttcttctcgttgtactgcagtgccaccgagtagtgcgtcgggttggtgacgatgacatcggctttcggcacatccgccatcattcggcgtcgcgctgcggcgcgcatctgctgccggatgcgccctttaacgtgcgggtcaccttcctgctgcttatgctcgtcgcggatctcctgcatcgacattttcagctttttaaagtggctgtgcagctgccagaagacgtcatatccgaccatcgggatcagccccagcatcaccagcgaacagcagactgcgatcatctccatgccgtgaatcagcgcggtgacgggcgcttcgctaatcagccgcagcatctcgggccagtggctccagatgtaccaccagcccaccgagccgaccagaatagtcttaaggatgcctttaaacagttcggtccaggcctgcgccgcaaacattcgcttgaacccagccatcgggctcatcttcttcgggtcgaacttgatcgatttaccgctgaaaacgataccgcccagcagcatgggcgcggcgattgccaccagcaccagaccgcccatcaatggcagcagcgccatcagtgcctgcgtgatcaggctgccgatgtggctgacgataattttgtcatctctgaccatgccgtggtcaaaacggagtccggtggcgaccatcgccgccagccggtgcgccatcatgttgccgcccatccacaggatcatgatgccggccagcagcatcagtacggatgtgagttcgcgcgaaacgcggaatctggccctcttcacgcgctttctcaagtcggtgggccgtgggcgattctgttttgtcttcgtcgctatcttcagccacgacaaacctcggttggcaggaattctgagcataggatgccaaatctggcttaagttaaagcggagataagatggagaaaacaggcgttctttcggggatgggtctgacaatgcggaacggggccacccgaaggtgaccctgtttattataacctgcagctgtttcgcccgcccgcaggcggacgaaacctagaaccctaagctgtccagcaggtcatcaacctgatcctggttcgccaccacgcccggtgcatcggcgtgaatctgcggaccgttcagcaggctggtgccttcctgacgcttctcagcgctgacttctggcatattctccagcagcaccattaacagctggcgctcaatttcctggatcacatccatcatgcgcttgatcacctgaccggtcaggtcctggaaatcctgcgccatcatgatttcaagcagctgcttgttggtaaaggcggtatgctctggcacggcggtgaggaatgcgcgcgtatccgtcaccaactcccgcgcatcacccagttcaatcgggttctcaaaccactcatcccaacgccctttcagctgggttgccccggcttccatcttatcctgatggggttgtgctgcttcaacacagttcaacgcacggtcagcggcctgcgccgtcatctgcacaacataatccagacggtcgcgggcatcaggaatggcttcagccgcatcggctatggctttatccagccccagctcgcgcaggctgtcgcgcagcatgcgcgtcagagagccaatacgtgaaatgatgtcgtgtgccgcggcatcctcagttggtttcggaaagtcgctcatcacatccccttacatgcccagtttttcgaaaattttacccagcttttcttccagggttgccgcagtgaatggcttcacgacatatccgctggcaccggcctgggcggcggcgataatgttctctttcttcgcttccgcggtcaccatcaacaccggcagcgaactcattgccgcgtcggcacgaatggtctgcagcagctgcaggccatccatgtttggcatgttccagtcggaaatcacgaagtcgaaaccacccgctttcagtttgccgagggcatccacaccatcttccgcttcttctacgttattgaagcccagctctttcagcaggttacgcacaatacgacgcatcgtattgaagtcgtctactaccaaaaagcgcatgtttttatcagccatatctactcctgagttgtctcgcccggcgggacgggcctgttaaatacgcaatgcctgtccggcgctaattttcgccagcatgtgctggctgatgttgcttaaatccacgacttcgctcacgccgcctgtggcaatggcctcacgcggcatgccaaataccacacagctggcttcgtttctgggcgatagtccaggcgcctgcccgatgcatttccagcatcccggcggcaccgtcgttgcccatgccggtgaggatgacccccaccgcatttcgtccggcgtaagttgccaccgatttaaacagcacatccacagagggtttgtgccggttaaccggtggtccttcattcagtttcaccacatagttggcgccacttcgggccagctccatgtgcattgcgcctggcgcgatgtaggcatgacctggcagaatacgctcaccatcttcagcttctttcaccgtgatctgacacagcttgttcagacgctcggcaaaagagcgggtaaagcctggcggcatatgctgggtaatcagcagtgccgggctggtcgccggtaacggctgcagcacatggcgaatcgcctcggtccccccggtggaggagccaatcgcaatcagcttctcactactcagcagcgggcccgctttcagcgtcgccggcaccggcatcgctgcacggttgtgcagtcgggcacgggaggctgcacgaattttgtcgccaatcatctgactgtaagacagcattccttcgcgaataccgagctgtggcttggtgacaaaatccaccgctcccagctccagcgcgcgcagggtaatttcagagcctttcccggtcagcgatgaaaccatcaccaccggcattggccgtaaccgcatcagtttttccaggaaatcgaggccatccatgcgcggcatttccacatccagcgtcagcacctgcggattgaactgcttaatcaaatcgcgggcgaccagcggatcgggcgccgtagcgaccatctccatatccggatggctgttgatgatttcagtcatcaactgccgcatcagcgcagagtcatctacgcacatcacggtgattttgctcatcatctttccttcgtcagtccatagacggtttgcccgcgcagccagaactctttactgatctgactgaagttttctgagtgcccggcgaacagaatgccgcccggcttcaggagcgggacaaaccgacgcagaatcttctcctgcgtctctttatcgaaatagatcatcacgttgcgacagaaaatagcgtcgaactgacccggcagcgcccagtcattggccagcaggttaagctgcgcgtaagtgaccatattggtcagctcgggacgcgcccgcaccataccggcatgaggaccggtgccgcgcaggaagtagcgctgcatttgtgcgggtgacagcgtgcgcagctcctcctggcgataaacacccgccaccgctttttccagcacctgggtgtcgatatcgctggcatgaacctggaacttgcccggtccggtgcccagtgcttccgccagcgtcatggcgatggagtaaggctcttcgccggttgacgctgcggtactccagacgctgaagttgccctgtcgcttacgtgcatgctccgccagaatcgggaagtgatgcgcttcgcggaagaacgcggtcaggttagtggtcagggcattgataaacgcctgccactcggcactgttcggatcggactccagcagcgccaggtagcgaccgaaatcatcgatattcagcgtacgcaggcgacgaaccagacggttgtaaaccatctcacgcttgtgatcggccagtacgataccggcacgctgatagatcagctggctgatacgacgaaaatgcgtatcggagagcggtaaacgctgcaccatttgcgacagcagcgttgtcgtctcattttgatctaaaattgtcgattttttcatctctgcacctggcccgaactcaatacattatttgtctgctgcgatgcccggcggctcaatagcggccgggccacgggcgtttaaaaggtttcccagttgtcgtcgctgcgggtagcaggcgaacgaccaacggctaacggtgcatctgactggagagttttcatcgccgttgtcttgttaacggcctgagcgacaaattctttaccaatattgaacactgataccgcttgttttaagtgacttgcctgatcttcgagcgctgcagccgctgccgctgactcttcgaccagtgaggcgttctgctgggtgacgcgatccatctcggtcacggcaagccccacctggtcaatgccacggctctgctcgtctgacgctgaggcgatctcacccatgatgtcggtgacgcgggtgaccgcgctgacgatgttgctcatggtgtcaccggcgctctctaccagcaccgagccggtattaacgcggctaaccgaatcttcaatcagacctttaatctctttggcggcctgggcgctgcgctgcgccaggctgcgcacttcaccggcaacgaccgcaaaaccgcgaccctgttcaccggcacgcgccgcttcaacggccgcattcagcgccaggatgttggtctggaaggcgatgccatcaatcacactggtgatatcggcaatctttttggaactgccggcaatttctttcatggtggtgaccacgccatccaccactttgccgccctgctgcgcggtttcagaggcggtcagcgccagcttggacgcctgacgggcgttttcggcattctgcttcacggtcgcggtgagctgctccatgctggcagcggtctgctccagcgaagcggcctgctgttcggtacgcgaagagagatcgttattgccgatggagatttcgctcgcaccggtatagatggcatcagagccgtctcgaacggttcgcacggtacggaccagctcctgctgcatgtgctgcagcgaagtcagtaactccccgatttcgttacgcacgctaatctcaaccggctgggtcagatcgccccgtgcgatgtgctggatatgctcaatgctctgacgcagcggacggatcagcaccgagcgcatcacgttccacaccaggataatcatcagcaaggtcactgccagcgtggcgataacgatagtgatggagcgggtatacgcgtgctggttggcttccacaccctgctgagacagcgctttattgtgctcaagccactcgctgtaatctttctggaacttgtcctggtagctctgggtcggctgatccacaaaacctttgaaattgccggcagtgaagaagaccatcagctccgccagcgcatcgtgataggccttgtagttcgcctgtaacgcccggacgttttcggccgttttgccttcttctgacaggttatcgttgaatatctgatagctgacttcagcctgcttcagctcctcgcccgccagggcgaccagctctttcacgctggcacccgagcccgacatctgtgcatcctgcagaaaacggataccggcgcggttaagggtattgcgcgcctgaaccagcgaaacccatgaggtgcccatcgcctgttgcagagtattcaggcgttggttgtaggcaaaattctctttatctgaactgacagttttgaaaaacattccgccggaaaacagctgcagcagcgcaaacagcgccagcacacacagcaggccggagacgactcgtactcgactaaacataaacacctcattggttggcgattcgtgtgtatttatcggcggagacggggggaactttatgcatggcgacggctttacgccgccgccatgttgaaagaggaaaaaatcaggcgcgggaaattttgaaaacggagacggcctgggtcaggacgctggcctgctgctccagtgcggccgcagcggcggcagactcctcaaccagcgaggcgtttctgctgggtcacgcgatccatttcagtcacggccagaccgacctgctcgataccgcggctctgctcatcggaagccgaggcgatctcacccatgatgtcggtaacgcgggtcacggcacccacaatctcattcatggtgctgccggcgctttcaacctgcagtgaaccgctgttgacgcgtgacaccgagtcttcaatcaggcctttaatctctttcgcggcctgggcgctgcgctgggccagactgcgcacttctccggccactaccgcaaaaccgcgaccctgttcaccggcacgtgccgcttcaaccgccgcattcagcgccaggatattagtctggaaggcgatgccgtcgatcacgctgataatgtccgcgattttcttcgagctgccggcgatctctttcatggttgtgaccacgccattcacaactttaccgccctgctgcgcggtttcggaggcggtcagcgccagctgggatgcctgacgggcgttgtcagcattctgcttcaccgtggcggtaagctgctccatactggcggcggtctgctccagcgaagcggcctgctcttcggtgcgggccgacaggtcgttgttaccggcggcgatttcgctggcaccggtaaagatggcatcagagccgtcacgcacattccccaccgtcatcaccagcgactgctgcatctcatggatgcctgctgccagctggctcatctcattacgcccctcaaccacaatcggctgggtcaaatcgccggaggcaatagcgcgaatctgtgccagcagctgttgcagcggctgaatcagcacctgacgcaggccaaaccagcaggtaataatcaccgcaagcaccgcaacaccaatcgcggccagcagccacatcatctgtttaaaggctttctggttctgcgccattccctgatcggaaagctcagtctgacgcgcacgccatttgttgtaactctcctgcatcgcgacctgtttctgctcaatgttctgtttaaacatcccttccaggtcacgcgcctgcagactttttaccatcgccttcaggccgttttcgtagttagcgtaatccgcttcaagcgtgtcgcccatggtttcgtcaagacctgacgtggttggcagatggtaatagattttaaagtggcgatcggcttccgctaactgggtattggctttgttgatcagctcatcaagctgaccaccgttcatctgcgaggccatgctggtctgtaagcgcagcatgccgcggttcagcgtggtacggctgttgttcagtgaaatataggcgtcagtcatctcggtgacattgcgattggagacctgcgacagcgcaaaggactctttgtctttattgagggctgaccagaaaaggctgccagcgactaactggagcgcgccaaagatgaccaggactgcgattaaactggtcaccacttttattttttttaacatcttgttcccctgcaggttaatttaggtgcagcggctatatcggcgatgtaacaggattaattaacgctattcagcgctttcaggagagaagtggcttttgtaattatttttatcagcatgagctgctgagtttggctttacgcagaggaatcgcgaggggttgctgcgcatcccgcaggatgcgcagcgtgacatcagaaggtttcccagtgagtatcactgaccggtgccgtcagggctttgcgtggtgccagcgccgccgtagcgggtgcggcaatcggcaaatgctttgtcagcgtctgctgcaaggcgccgcgtttaattttgaagaccgacactgactgacttaaccggctggcctgatcttccagcgaagcggctgccgcagcggactcttccaccagcgaggcgttctgctgggtaacgcgatccatctcagtgaccgcctgcccgacctgatcgataccgcgactctgctcgtccgacgccgaggcgatttcacccatgatgtcggtgacgcgcgtaaccgcactgacgatatcgctcatggtttccccggcggtgccgaccagttgcgaaccgacattgacccggttcactgagtcatcgatcaaccctttgatctcttttgccgcctgggcgctgcgctgggccagattacgcacctcgcccgcgaccacggcaaaaccgcgaccctgctctccggcacgcgccgcttcaacggcggcgttaagcgccagaatattggtctggaaagcaatgccatcaatcacgctggtgatatcggcaatcttcttcgaactgccagcgatttcgctcatggttttcacgacacccgccaccacgttgccgcctttttctgcggtttctgaggcgctgagtgccagctgtgacgcctggcgggcgttttcggcgttctgtttcaccgtggcagtgagctgctccatgctggccgccgtctgctccagtgacgcagcctgctgttctgtgcgggcagaaagatcattgtttccggcagagatctcgctggcaccggtgaaaatcgcatccgagccgtcacgcacattggtcaccgtgcgcaccagtgactgctgcatgtcatgcagactggccgcgagctgagtcatctcattgcgcccttccaccacaatcggctgggttaaatcgccctgggcgatatgctggatgtgattaatgctgctgttgaggggtgtcatcacgattttgcgcaatccaaaccagcagagcacgatcacggcgaccacgacggccatgatggtgcagaggatccacatcatacggctgtaagcagaactgttctcttcaacaccaagcgtagtcaggcgattctgatcggctcgccattcacggtaaaccgtcagaaacgtactctggcttggcgccaccggggctttaccggccgcaatcagatcgtttgcctgtagcgccgtctgcaactgatccagcgcagcgccatagtcgctgtagcgctgctccagctggttgtttaactcactattctgtcccggcgtatcgggtgtctctttaaagactttgaaaaaaccggcggccgcctgctgaaagtttttgctgtcgtcaaacagcgtggcgacatcggccgttttgccttccagcttactggtggcgaaacgcagctgaatacgggtcagcagcacccggctctggttaagactcatataggcgtcgttgagcgactgcgtattttgcatcgccagctgcgacacggcgaagctttgcttgtcgtggcttaatgcggagtagaaaacagaaccggagaaggcctgtaacagcccaaacaccagcaacaccagtaacaggctggtgacaacacggattttcgttaacatgagtaaccctgaagaaagtaggtaattaaagtgactgagggattatcggcaggtgacagcgggaaattagagtgcaatgcggctttattctatgaatagaaaggaattatcgctcagtgaaactatcacgggccagccataaccggcccgtaatgattcaattacgcgctacgcaggttatccaccagcgccatctcgtcgctgctcagcagcttctcaatgtcgaccagaatcagcatgcgatcgcccagcgcacccagaccggtcaggtactcggtggacatggtcacagcgaactctggtgaaggacggatctgatcctgggtcagcgacagcacatcagagacgccgtcaaccacgataccgaccacgcgattttccagattcagcacgataaccacggtgttttcattgtactcaacatcgggctgcgcaaacttcacgcgcagatcgataatcggcacgattacgccgcgcaggttagtgacgccgcggataaattcaggggtatttgcgatacgcgttacctgatcgtaaccgcgaatttcctgaactttgaggatatcgatgccgtactcttcgtcgcccagcgtgaagaccagaaactcctgacccacagtttcgccagcgatttttgtcacggttgccattccattcatgttatttaccctttcgttatcaatcaggcggcagcgccagccacacgtttttcacggttaagtgattgcagtgctgaaacatcaacaatcagcgccacgctaccatcgccaagaatggtggcggcggagatgcccggcactttgcgatagttactttccaggttcttcaccaccacctgatgctggccaatcagctgatcgaccagtagcgcgtaacgtttgcccgcgctttgcaggattaccacgatgccctgagtggcctcggttttggcatcctgcacatcaaagacgttccacagctcgaccagtggcagatattcgccacgcacttccagcacgcactcgccaccggccagcggtttcagctcttcggcgcgcggttgcagcgactccatcaccgcattcagcggcagaataaagacttcatcggccacacgaaacggacatcccatcaaggatggccagggtcagcggcagcaggatacgaatggtggtgcctttgccctgcttcgaggcgatttcgacgtgaccgcccatctcctgaatatttcgtttcaccacgtccataccgacgccgcgtcctgaaacatccgtcacctgctctgcggtggagaagcccggtgcgaagatcagcatgccgacctcttcgtcgctcatgttctcgtgaaccggcaggcccgatgagagggctttagccagaatacgttcacggttcagaccggcaccatcatcagacacttcaatgcagatgttgccgccctgatgttccgctgaaagcgtcaggttaccggttgccactttaccggccaccagacgtttctctggcgtttcgataccgtggtcaagactgttacgcaccaggtgcgttaatggatcgatgatgcgttcaatcaggctcttatcgagttcggttgagctgcccagcagcgtcagttcgacctctttgccgagtttgctggccaggtcacgcaccagacgcgggaagcggctgaagacatattccattggcatcatacgaatcgacatcaccgattcctgcagatcgcgggcgttacgctccagctgacccatgctgttcagcaggtcgccgtgcgcgaccggatcgagttcgccggaacgctgagcgagcattgactgggtaatcaccagttcgcccaccaggttgatcagctgatcgactttctccaccgcaacacggatgctggtggattcgctcgatttggcaggggccgcgacgcgcttactttcacgcttcactgcggccaccggcagttcggtgacggtggcggtgtgaacgtcttccaccaccggttcggcctcggctgcaacagcagctggcgcgacaacggcttcgtctgctgccgggaagcggatctgtgcttcgtcgatgacgaagcagagcaccgccacgatgtcatctttaccgacgccatcaatgcagacatccagcgtagtgctgcctttctgtacgttggtcagggtgccgagattactcatctcttccagcatcagatcgacctctttctctttgagatcgatcagctgtacacgcaggccgctggtgctggccggttctgcgctggcagtggcaacactggccggaacatcaaccggcagacctttggcctctagcgccagctggcgcagcgcttcacagatatatttgaagctctccgcgttaggctcctgcgcggttttataagcatcgagctgttcctgcataatatctttggtttccaaaaacaggttgatgatgtcggtgctgagctgcatctcgccgcgacgagcaccatccagaatgttttccaggatatgagtcgtttcctgtaataccgtaaaaccaaaggttccggccccacccttaatggagtgagcggcacggaagatggcgttaagctgttccgaatctggctcctgcgggtctaagcccaacaggtgttgttccatatccgctaatagctcatcggcttcatcaaaaaacgtctggtaaaaatcgctgatgtccatactcacgggaatcacctcggctgtgagggggctgctgtattcaccgcgccgcctggtgttgcaggtgcggtaatctgttcaatggccgccggatcgctgatctggacggcatcactttctgcgttctctttttctattgccgcttcggtgtcgtggttcaacaccagcaggctgatgcggcggttaacggcgtcattaccgccacgatttttcaggcgcatggtgtcggccatacccaacacccgtaaaatttttccgctgtctaagccgcccatcaccagttcacggcgtgaggcgttagcacggtctgtcgacagttcccagttgctgtagcctttgtcaccgctggcatactgaaaatcatcggtatgtccggccaggctgatgcggttcggaatgtcgttaaggactggcgctatcgcacgcagaatgtcgcgcatatagggctcaacctcggcccgaccggtcttaaacatcgggcgattctggctgtcgataatctgaatacgcagcccctcttcaaccatgttgatgatcagatgcgggcgcagcgctttcagacgcggatccgcttcaatcagctggtcgagcttttcacgcagccggttaagacgaatctcatccagcttgcgtttctgggcgtccatatcgacgactttgttcacttcgccaatctttttggtcggatcatcaccgccgccggggatcgggctctcgctgtcgctgctgcgcgccccgccggtaatcgctaccttcagcggtgttttgaagtagtctgctatctgcaccagctcctgcgggttggcgattgagagcagccacatcaccataaaaaaggccatcatcgccgtcataaagtcggcgtaggcaatcttccacgatccgtggctgccttcatggcctttatgtttgcgctttttgatcagcacaattgggcgattgccgtgtttcatgaagcctcgtctgaagtctgtttagccgggttcttggcgttacgtacgtgctcttccagttcgctgaacgacgggcgctcggcggaatagagcgtcttacgaccaaattccaccgcaatctgcggcgcgtaaccattcaggctcgacagcaatgtcaccttaatgcactgcatcatcttggtggtttccgcacacttctgacgcagcactgacgagagtggagagacaaacccgtaggccagcaggatgcccaggaaggtgcccaccatcgcatgcgcgaccagcgcaccgagttcagcggctggacgatcggccgaagccagtgcatggaccacgcccattaccgcggcgacgataccgaatgccggaagaccatcacccactgcagcaatactttgcgctggtacgtcacactcgtgttcgtaggtctcaatctcttcatccatcaacgcttcgatttcaaaagcgttcatgttgccgctcaccatcaggcgtaaatagtcagtaataaaatccactaactgtttatcggcaagaatgcggggataattagcaaaaatttcactctggctgggatcttcaatatcacgttccagcgataacataccctgctgacgcgacttcgccatcaggcgataaagcagcgccatcaaatccatgtaaaccgctttgttgtacttggagccgcgaaataacttaggcagcgccttcagcgtttttttaatcgacttaccgttgttgccgactaaaaaagcaccggcaccggcaccgccgatcattaataattcggctggctgataaagcgcgcccagatggccacctaccagcgcatatccgcccaacacggagcctaaaacaatcaggtaacctataattatcagcacaaaaaaatccttacgtccgtaacgtgttggtggaagttaagccagagagccgcagatgttattcctgaaccgcaagcaaaaaaaaagcagcggtattaaccgctgctggatggcttccacagtgcgaacaaacttaaacggcgtgtttaacctgttcatccagcagttgtggaaacatatcggcaggttctgcagaaagtttacgtctttttactgcccgtgatggtggctggcacaggctgcaggtaaagctgccaaccggctgatgcgcatgattaataaagctgccgttgcagcttttacaatctgccagttccagcataccgctatcaacgaatcggaccagggtccaggcacgagtcagcgccaacagcgggccctcgtccgattgaggacactgttcaagatacaggcggtaagctttaatcacggcatcgacgccgctgcacaacccggttttcagcaaaaacttccaggcgttacagaacatagaagcatgaatgttctgctcccacgtcataaaccagtccgtagagaacggcagcatacctttcggtggcggactgccacgtaattctttatagagcttgatgagacgaccgcggctcagttgggtttcgctctcaagcatctgtaagcgggcacctaatgtaatgagctccatcgcgagatgaatatcacgtgcttcctgaacaatacttttctcactcatgacattgctctctttttagcaggtgcatcatctttagacgcattacgcagtaaacggctcgataataaaatgccggtgtggatttgttgtaaatcatccacgcgtgattcctgcgtcaggcgattaatggtgctgctatcggtaaaacgaaactggcaaaccagttgattggtttccgccatttttaccatctcaggcaatgttaattcagataatgcattcgccattttctcgtcaattccgaggcgaaacattgcagaagctttatcctggttaattaaacgctgcgcaagcagtaaataagacaagttgagatcgtaaatatgtttcagtacttcagaggtgcccattatttttccatcctgagagatgcgacgtaactgtatcgcagaataaatctgcggttcgagctgctgtttgttaaatcaaaagatggcaaaaaaaacttcacgtaacgttaatgtcaccgttttcgccttccatttttgtgtgggtttcagacccaccgaaggtcgaaaatccatgccattttattttcgagttctggacatcttccgtgacgtcttcttacattttttaggactattccgaaaacaacgcaaatctatatcgtctgatttcgacatacaacgacagtgatgtgaaattttagataaagtgtgacgcagatcacacttttaacgcaaatttcttcagcaaccctttaccattacttaccggctggtcattttttgagcaaaaaagtccgattttaagtccaattggtcctgagaaaggtttaatagggggtaaaagcatcgctattcgacgctttgcgcagtccggaatgaatatcgggtgttaatcgttttaacaccctatttagaaccacccaaagaaaggttatcagcatattatgctgctgcgacgtgcggttatttgcttttaaattagttacttaaggggagtatcgcagagggtgagtaatgaaatcgttaaggtttatacggcagcaggtcagatttctggcaacctgacgttaacagtggtggtggggtgtacagactctgattcccactgtaacaaggggttatataagaaagtcgaatgaattaacgaagggttatgcgttggcactatcactatcggcagcctgaagagaaacttgagtaaagaaggtaaagaaagcggcaggggctgacaggacggggatttccgggcttacctgcatttatcgggccactccgggcagccactgacgttatcagcgtagaatcgtagcaaacggtcattaacagatagcaggcgagttttctgtgacctgggccgaaaaaaaagcagcgacgccgtagaggcgccgctgctttcataaccctgagtcagaacagatatcaggcgagttttgggaaggtcgcgactttattaaccgtgttgtggtcaacgctgcgcggttcaatgcgttccaggtctttcaggaagccttcacgccaggcggtaatatcatttttacgcaataccgccatcatgtcgttgtagcgtgaaatcctttcggtacgcggcatagtaatcgccttatccagcgcggcggccacttcatcacggtcatacggattcacaatcagcgcggaggtgagctcgttagccgcacccgcaaagcgcgacagcaccagtacaccgggatcatcagggtcctgcgcagccacgtactctttcgccaccaggttcataccgtcacgcagcggcgtaaccagaccgacatcggtcagacggaagattttcatcagcagtcgacggtcaaaatgctggttaaggtagtagagcggggtccagcccagcgtaccgtatttaccgttgatgcgccctgcttcggtttccagctgatgacggatatcctgatacgcctgcacatcgccgcgcgaggtcggtgcaatctgcgagtagcgaattttgccgcgatgctgcgggaagttttccagcagcgcttcataggcaagaaaacgctcaggcagacctttggaatagtcgagacgttcgcaggcaataatattgcgtgcatcgcccagctctttcttcatggcggccatttttggtggcagcggcccttcggccatctctttaatactgtctggctcaatcccgatgggataaacctcagtcataaaggtgttgccaaaggcgcgatgttttttgtcgcccttattctgcagctgagtgagctggctgacgctgtcgaggaaggccacccgatccgattcggtctggaaacccagcaggtcatattcgcacagcatttccagcaactctttgtgcggcggcagcgcattgaatatttcaggcgtcgggaacggaatatgcaggaagaagccgatgcggttattaatgcccgcccgacgcaacgcggctgcaaacggtaaaaagtgataatcgtggatccagacaatatcatccggcttgatcagcggttttaaacgctgtgccaccgcatcgttaacgtcgcaatacccttcccaggcttcccgctggaactgaaccaggtcaaggcgataatggaatgcgggccagatgacagtgtttgagaactggcaatagtagagatcgtaatcgttctggctcagcgggaacgaggcatactcaataccttcatgttcctgaaccgtgacttcttctacctcttcgcctgtgtactcgctgatttcaccgttccagccaaaccacagtccaccggtgcttttcagtgcatcgagaataccgacggccaaaccgccagcgctggtttttgacccatcgggcatggcgacacggttagaaacaaccactaaacgactcataacctaaactccttaccgacgttgtcttgatctgatagtaataatgttctttccagccagccgtaaaccgcatcgacatcatgaagccgataatgggcttgggtggaaccttctccgactttgatcgagacgccctgccgtgcgttcacggccagaaagcccttctcatccgtcagatcgtcgccaataaagaccggcgtacgtccggcaaaagggggctgctgcataaagtcgctgattgcggcgcctttatcgatacctgccggtttaatctctaccacacatttccccggctgaagcgccagtccgggaaaacgtttcactgactgttcagccagtcgcatcacatcctgctcatgctgcatcgcctggcggtagtgaagagcgaaagccatgccttttacctccagctgggtgccaggccaggatgccatagcattctgcaattccgccctgagcgattgctccacctcgaccggcaggctgatgcgttgcagattaccctctgcatcacggcgctctgcaccatgtacgcccgcagccgggccgtaccagggagcggccagcgcatcgagttgttctataggtctgccggagaccagcgccagcgcgccctgcgagagtgcagagagctgctgcagttgcgcgatgacctgctcaggaataaataccgcttcgggacgggactgaatcgctgccagcgtgccgtcgacatcaaaaaagaaggcgtactgcccgccgcttaatgtcgggtacctggcatgggtgtctgccgcttgggtcacgttacttctcctgaaaatcgaattttaataaaacattgagttaaaacaagaatgtcctgacgcagtcaggtcagcaagcgggaaattctgataaagcggtgattgagggataaaacgcggtaacgggataggtcactctcctcaaacttgcaagcgcattgctgacaatactggctaactgagaacatcttcacagtaagtgtagtcattaacaggggttatgccagaaagatgcaggtttcatgccagccgctgcggttaagtcagcataaaagcaccattcaattctgcttcgcttctgatgttcaggccggacacgatccgctgctgactggagtcacgcacgtatcgcacccggcagagtcggccccccccaaagcttaaggctcttaaggtattcctaatattgaaagcgcattctcgtgacacttttattactctggttcctgctcacatggcgtttaccctgaagaggccgctgattagccgccttacgttgctgattctggctgcggtttacatcgcggttttccttaacgttgcctattaccgtcaggtgctggcggtgatgccgctgaacgacctgcacaccacgctggtctttttatcgatgccgctggtcgcctttagcgtgatcaatatcgtgattacgctggcctcgtttatctggctggatcggctgctggccgcgctgtttattctgctctccgcctcggcacagttctttattcacacctataacatcgtggtcgatcgctcgatgatcaccaacatgatggataccacagcctcggaatcctttgcgctgattacgccacagctgcttgtaaccctgctcacctcgggcgtgctgatgacgttgctgctgttctggccgcgaatcaaaaatcagcagtggcgtggcgtgctggcgcgactgctcagcgtattgctgtcagcggcgctgattgtgctgatcgccctgctcttttataaagattacgcttcgctgttccgtaacaaccgcgaaactggtaaaagcgctgagcccctctaacagcatcgcggcgacgctctcctggtataagcatgagcagttgcagaacgcgccgctgatgcgtatcggtgaagatgcgcacctgcagcccagccgcagcagtggcaaaccgaatctgacgattctggtgctgggcgaaacctcgcgagcgcaaaatttctcgctgggcggttatggtcgtctgaccaatcccttgctggcgaaagatgatgtgatctatttcccgcacaccacctcgtgcggaacggcgacggcagtttccgtgccctgcatgttctccaacatgccgcgcgcccactatgatgatgtgctggccgcccatcaggaggggttgctggatattattcagcgcgccgggatcagcgtgttgtggaatgagaacgatgggggctgtaaaggggcctgcgaccgcgttccgcatcaggacatgaccagcctgaacctgcccggcatgtgtattgatggtgagtgctacgacgacgtgctgttccacggtctggatgattacatcagtcagttaaaaggcaacgcggtgattgtgctgcacaccattggcagtcatggcccgacttacagccatcgctatccgccacagtttcgtcagtttgaaccgacctgcgacaccaaccagattcaggactgttcgcaacaacagttgatcaacacctatgacaatacgctggtcaatgtggatcacatcgtcgataaagccattaacgtactgcgtgcacatcaggaccgcttcaccaccagcctggtctatctgtctgaccatggtgaatccctgggtgaaaatggtgcttacctgcatggcctgccctatgctatcgcgccggacacccagaaacatgtgccgttgctgatctggctctccgatgattatcagaaacgttatgcggttaatcgcggctgtctgaataaactggcggcgacagacgatttttcacaggataatctgttttcaaccatgctgggattaaccggcaccgcgacccacgaatatgtgcctgcggatgatattttgacgtcgtgtcggagccaaccttaatgaagatactgattgttgaagatgatgccctgctgctgcagggtctgatgctggcgctggaaggggaaggctatgtctgtgatggcgttacgcgggtgcgggatgctgaagcgcatttcgccagcggcctgtatagcctggtggtgctggatcttggcctgccggatgaagatggactgcattttctgatacgactgcggcggcagaagaagatgacgccggtgctgatcctgaccgcacgcgacaccatcagcgaacgcattgccggactcgacgcaggcgcggacgactatctgatcaaaccgttctcgcttgatgagttgctggcgcggatccgcgccctgattcgccgccacgtcaatcagggcgacagtcatgtcagagtgggtgcgctggcgctggatatgacccatcgccagattacgctcagcgacgtgctgctggatctgacacccaaagagtttgcgattctgtcacggctgatgctcaaggccgggaatccggttcaccgtgaaattctctaccaggatatctataactgggagaccgagccttctactaataccctggaagtgcatatccataatctgcgcgacaaaatcggcaaaagcgctatccgcaccgtgcgcggttttggctatgcgctggtgacgcaggatggcattcgtgaggcaacatgataagacgtttcgatcatcgcagtatgcgctttcgcctcatcctgaccatcggtctgatcctgctggttttccaggtgatcagcgtggtctggctgtggcatgagagcaaagagcagattcagtttctggtggaagcgcagctgcagaagcgcaacatggacagtcacgttaagcgtgaagtgcatgaagcggtagccagcctggcggtgccaagtctggtgatgattaccctgacgctgctgctctgctatcaggcggtgaagtggattacccggccgctttatcagctgcagcgtgaactggagagtcgcagcgaagagaatcttgatcccgtcgcctgccacagtcaggttcaggagatcgatgcggtgacgcaggcgataaaccagctggtcgcgcgtctgaacagcagtctggagcgcgaacggttattcactgccgacgtggcacatgagctgcgcacgccgctggcgggattgcggctgcatctggagttaatcgaacgtaacagcgatgtcaaagttcagccgctggtgcagcgcctggatcagatgacgcacagtgtgtcgcagctgctgaatctggcgcgcgccggacagtcctttacctctggcacctatcagaaacgtggggctgattgaagatgtgatcctgccaatggaggcagagctgagtattatgctggaggcgcatcaacagacgctggtgctcgatctgccgcaggagcagtttgtgcgtggtgatgccacgctgctgaagatgttgctgcgtaacctggtcgagaacgcctatcgctacagcccggataacagcaccatcagtgtgcagctggtgttagctcctcagccgatgctggtggtggaagatcagggcccgggaattgatgagagtaaaagtggcgagctgagtaaagcgtttatccggatggacagccgctacggcggtatcggactcgggctgagcatcgtcagccgcatcgtccagttacaccggtttcagtttttcttagagaaccgccgcgaccgaagcggttgtcgtgccgtggtgaagttttaagcgctgaaccaggcggagaggaacagaacgaccgtggctgcggcaatcagcagtgcagcatattcactcatcggacgcggagcagtcacagacagggcaacaggagcagttttcatagcatcatcctcagttaaagcaggcagtatcgcgattgcatattaaggaaaccttaagctcgcgacactgccgctaaaaatgtctgcgctgccagacgccgccatcaacctcgcatttctgcccgctgacacgcctgctgcatccgcccggtgctctacacttaatggctacgttccgtttcaggagttacgccatgagccaacgcatgcacaaatatgcttttccggtcagcaaagcccgcaaataccttgaacccggaccggtgctgctgctcagttcgcagtacggagatcaacatgacatcatgacgctcggctggcacacggtgctggagttttctccgtcactggtcggctgcatgattgccggtatgaaccacagccatgagctgatccgcaacagcggtcagtgcgtgctgaacattccttctgcctcgctgattgatgaagttgtggcaatcggcaacagccacggcgacagcattgataagtttgaggcctttggcctgacgccggaacccgctcaggtggttggcgcgccgatgattgccgaatgttttgccagctttgagtgtcagctttatgacgattcgatggtcgccaactacaacctgtttatttttgagattgttaaagcgcacgttgccgagcagccggaataccccactaccctgcactacactggcgaaggccggttcagcgtgatgagcgacaaaatactggataagagcggcgattttaaaccggagatgctgatctagttgaaagcgctctgccgcgcccccattcacctctttcgacctgacaggagtaaattattatggcaatcgaatacgcagttatcgctggcggctgtttctggtgtaccgaagcggtatttaaggatgtgatcggcgtagagtcggtggaaagcggttataccggtggtgcccgtcctaatccgacttatgagcaggtctgcagcggtgcgaccggtcatgcagaagcgatccgcattggcttcgacccggagaaagtcagctttggcgatctgctggatatcagctttgtgacgcatgatccgacccagcttaaccgtcagggtaatgatattggcacccagtatcgttccgccattttcccggccaatgcagagcaggaagcggaagcacgcgccgccattgcccgcgctcaggctgaccatgatgtgccggtggtgaccaccattgagccgctgaaagagtggtatcccgctgaagcttatcatcaggattactgggaaggcgcgggccagcgcaacggctactgcatggcggtcattccaccgaaattgcagaagctgcgtaaaagtttcgctaacagagtaaagagctgattccggcatcagtcggggcagcgtctgaccagtaacgagggtgagaaacgccgccccggtttatttgctgccataaaactcacctgaccgggctcatcaggatgacgggatgtggccggtaaaacggcgggttttatgccgcagtaaatcgattcgttcagagcttaagcgaatagatcaaaagagaaaaatagtgcttgaccgttttcaaccgactccctatagtaccgccccgttgacccatcgcggtcagcgaagtaaatctggtgaggtgtccgagtggctgaaggagcacgcctggaaagtgtgtatacggcaacgtatcgagggttcgaacccctctctcaccgccatcttcaaagaagagcctgaaattttgttcaggctcttttttttgcatatttcactctgaaagagcgtgataactcccgccggggaacgaccacgttgcgcagtcgctgccccacaataagaaaacccggccggagccgggtttgggcgctacacttctactcaatcaaacgctagctatacgcgtgcagggtgcgctgacatagcgcagaacgcacacaatcttctttgccgaagcgtacaatgccaaccatctcgtcctcttcgaaacgcgccagcgcgtctgcgagaccggaaggcaccccagcgggcaagtcgcactgggtaatatcgccgttaacaatgaccgtgacgttttcgcccagtcgggtcaggaacattttcatctgcgcggcggtgacgttctgcgcctcgtccagaattaccacagcattttcgaaagtgcgaccacgcatataggcgaaacggtgcaatctctaccttggcaatttccggacgcagacaatattgcataaaggatgcgccaagacgtttaaccagaatgtcataaaccgggcggaaataaggcgcgaatttctcagaaatatcgccgggaaggaatcccagatcctcatctgcctgcagtaccgggcgcgtaacgataatcctgtcgatatccttattaatcagggcctcagccgcttttgcggcactgatccaggttttaccgcacccggcttcaccggttgcgaagatcagctgttttctctctatggcgttaagatagtgcgcctgagcttcattacgggcttcaatcggcaaccggtcacgcgtatcgcgcgccatgccaatggcatccagtccactcatatgcaccagcgaagtgaccgactcttcttcacgctgacgatgacttcttgagtcactacgaagcactcttcttgcttcacgacgcgctttgatcactgctttctgtcttcccatagtggcacctttcagttggtttcatttcctgcgtcaggccggtggcccgttgcgataacgtgaacgctttagaggtttcagttggcttccttttgagccatgacaggacaggatagtgggtatgcagcagcgcaatagcgtagctgaacaccggataaaacaggatgcgataaaacaaaagagatggttgaaggaaggaagaaataacgaggcagaattgccctcgcggtcaggcgcaatctatttactgacagtgactttccattaaagactcgacccatgcgcgaactccagtgtgatacatcaacacatccgattacgcctgtttaataaagtgcaccattttgttgggcctttgcaatagtaattttacctgctggcaaaagaattgctaatcacgtgtatgtatttcttttaaggcaaaatgtaaaatcttttaattacagtgtattagcttattttatatatgccagacaaccgctaaaactcagtttaacctcagccagcaaagcacgaaaaccgtaaaacgtgggcgaccagaacaggtacgcccacagtggttgaattttaatcaggcttccagcaacgactgcgctaaataatggctggcgtctggtacaccgggcaaaacaaaaaagtaaccgccgccaaaaggccggatatattcttccagcgcttcgccgttcaggcgccgctgcaccgtgagaaagccgcgttccagatcgtgctgatagcagacgaacagcaaccccatctccagctgtcccgatgcagagatacccgcggagtaactgtagccgcgccgcagcatcaggctgcttgccgtctctggcgtgcgggggttggcaagacggatgtgcgcatccagcgcaatcacttcgccgtccggatcacgggcgtaatccggaacgtcgcgctcatgatgcatccccagcggcgcgccacttaatttctcgcgaccaaagatagtctgttgctcgcccagcggcgtgcgatcccacatttcgacgtgaaagcggattaaccgtacagcctgatagctgccattgcgcgcccagaccggttcgtcctgatcgtcggtcacccacagcagctgattcatcagagcagggttgtgggtatccggattggcggtgccatctttgaaacccagcagattgatcggggtctcctgcccctgactgcgcgcggcatgatcggagataaagccttcgcgccgccagcgtacgccaagcaggtcaggcgtatgcttgatgatatcccgcagggcatgaatcaccgtatcctgggtgttggcacagagctgcaacagcagatcgccatgacactgactggcatccagcgaatcattgggaaagcgtgtcatcggctgcaattttttcggtttgtgcggcgccagaccaaagcgttcatcaaacagtgaattgccgaccgacacggtaatcgtcagattatcaggcgcgatagtcgccccaagaataccggaatccattggcggcaaccgcggattggtgactaccggtgccggaccgcccgtggtcaggaaggcaatacgctgggtcagcaaccggaacagacgcaccagctccgctttatcgctgctgagcagatcaaacgccaccagcatcatcgatgcctgctgtggcgtcgtgatacccgcctgatgctgaccataaaacggctgcatctgctgtcgggcctgcggcgtaaccgtccccggcgaaaagctgtcggcggcggctgcatggaacggacagccgccgcccagcgctgccgcgccacccagcagccccagccctttaagtaaccgacgacgcgcaggctgcgcgtcatcttccttgcgactcatgattaatccagacccagggtgccacgaagtaatgaaagatcttccgccagtgcggtgatcggtcctttcagcgcgttacggtcggcgctggtcagtttctcataggattcaaaaccggtttgggtgcggtacttactcaggatcgcatcgacttttttgaagttggcgtcaaccttggccagcaactgcggattggctttgcttaccatgggtcgcagcagctcaacgattttctgcgcgccatcaatgttcgcctggaagtcccacaggtcagtccggctgtagcgatcttcttcaccggaaattttgctggaagcgacctcttcaatcaggccggctgcgccgccgaccactttggctggcgggaaggccagttcgctgatgcgcacctgcaaatctttcacatctttattcagctgctcagcgtagtccgccatgcctttcgtgctgttatcagcaaacagcgctttctccagacggtggaaaccggtgaactttggatcggccgctttcttctcatagtcatcttcacgggcgtcaatgctgccgtcgagatcggagaagagctcagcaatcggctcaatgcgctcataatactgacgggtcggagcaaacagcgctttggctttttcaacgtcacccgctttaacggcgtcagtaaaggcctgggtgttgctcaccaactgtttcacctggtcggtcacataggctttgtattcggtgatcgggccttccagctgcatacgtgctgaggtgccactttttgccgcaccctcacctgcctgcacaatcagcttgccttttggattgctcagcagcccacaggtcatctcatattcgcccgcctccagattggcggtcagtttctgactgaagcccggcgcgatattctcacgctcttcaaccaccatcacgcctttgaggatctcccactccagcgctttctggctgttgtttttaatcaggaactgggtcttaccggccttgaccgttaagctcatcggctcgcactgcttgtcggtgacgcttacggtaacctgaggaaccgccgcggccgccgttgcggagatcgccagcagaggaagcagcagtgccttgcggcggaaacgcattgtcatctctctttccctatcatgttgcaggcgtaagatgcgcccgttaaatgtcaaattacacagtggccgacgcagcagaaacgcgcaggcataaagaacagaatcagcgccgggatcaggtaggcaaagtaaacggtcacttcactgacgcttggggactcctgataacccagcaccccttccagcagggtgccgaacagcgaatgggtcgataaggtattgctgagatcgaaggcgacatcctgaaagcgattccataaacccgcttcgtggaaggcgcggatggcgcccgctgccagacccgcggcgacaaacaggatgaatacgctggtccagcggaagaaatgggccatgttaagacggataccgccccagtagagcagcatgcccagcacgaccgcggttgccagacccagcaccgcgccaatcggcggcgcataaccgacatcctgggtaaacgccgccagcaggaagaacactgactccagcccttcgcgcgccacggcaagaaacaccatcagcaccagcgccagaccgccacgacctgagcgttgcagcgcctgatcgaccgcctgttcaagctcgaccctgatgttgcgggcgactttgcgcatccagaaaaccattgaggtgaggatcaccaccgcaatcagcgccacgatgccctcaaacagctcctgctctttctgcgggaactcaccggtggtggcattgatgaacagacccaggcccagacagagcccggcggcaataaacacgccagcccacatcgcgggaaaccattgggtgcgctgggtgcgtttgagatagctggctatcaggctgactatcagcgcggcttcaagcccttcgcgcagcatgatgagaaaaggaacaaacatcgccaacctcttgaatgttaagcagcgtcaataaacagtaaaataaggtaaagtgtaaacgataccgattatcattatcgctgagaaaaaaacaagttgccggtggagataatttcatctttgagtggtttatctttgtaacaaaaaagcccgcccctttcgggacgggccaggcgattaacgcctcgcttattttgtctggaactccgcctctgcagcggcaaagcgctgctgcgcttctgctgatggctcacggcccatcagcgtgaacactacaatggcgatgctggcgaaaatgaagcccgggatgatttcatacagtcccagccagccatactgtttccacaccagcacggtcagcgcaccgacgatcatgcccgccagcgcgccgttgcggttcatccgcttccagcagacaccaaacagtaccaccggaccaaacgctgcaccgaagcccgcccaggcgtagctcaccaggcccagcacgcggttttccgggttagccgccagcgcgatcgcaatcagcgccaccagcagcaccatcagacgccctacccataccagctctttctggctggcatttttacgcagtaagcctttgtagagatcttcggtcagggcgctggagcagacaagcagctgacagctcagcgttgacatcacggctgccaggatcgctgacagcagaataccggcaatccatgggttgaacaggatacgcgccagctcgataaagacccgctccgcattggcgttaacgccaaccgccagcgtcgggttgttctggaagtaggcgataccgaagaagcccaccgccacggcaccggccagacagagcaccatccaggtcataccgatacggcgagcggtacggattgaacgatgcgaatctgccgccataaagcgcgccagaatatggggctgcccgaagtagcccaggccccagccgagcagggagatcaccgcgacaaagttcagtcccttcagcatgtcgaggttttccaggctcttcgcttcaatcaccgccagcgaatcagaccagccgccgaccgcgataatcacaaacaccggcgtcaggatcagcgcaaaaatcatcaggctcgcctgaacggtatcggtccagctcaccgccaggaaaccgcccaccagcgtatagagaatggtcgccgctgcacccgcccacagagcggtctggtaactcataccaaaggtgctttcaaacagacgcgcaccggctaccacgcctgaggcgcaatagatggtgaagaacaccaggatcacaatggcggagatcacgcgcaggattttactgtggtcctcaaagcggctggtaaagaagtccggcagcgtcagggcgttgttgtgatgttcagtctggacccgcaggcgaccggccacgattttccagttcagccaggcaccgatcgtcaggccaatcgcaatccagctttcagagataccggagatgaagatcgcacccggtaagcccatcagcagccagccgctcatatcggatgcaccggcagagagtgccgtgaccacgctacccagactgcggccaccgaggatgtaatcatcaaagtttttggttgagcgataagccacaaacccgattaataccatcccaagaatataaaccaaaaaggtcaccagcaaaggtgtacttacactcatctgtctctccacttattatttgatatcccagagaaatcgccagctacccgcctgccggaacggggcaaaacgggccgattttcttcgtcagggcgtaactcatttcccagcggcgcggtatcctgccggaaaggcgttgtgcgcacaatggatttaacacaggcgttacagtgatttcactaaccgtttgtgaaaacgtgctcataggttgcactcgctcacagttatccggttgcaccgtcgtattgcctatctgaaacccgcttttcatcgggtctgacagactggcgaggatcttgcagcaatatccgtgccgcattgcgggatttaacaatcgtcgacgttaaaagggtgttaactggctcacatttaacacggttgcacaaagttgcaacttaagtgatagtgcagccaacgccgtatcgaaccactatcaaggagctctggagtcatggctacaaccaccatgggtgtaaaactggatgacgcgacacgcgagcgcatcaaactggctgcgcagcgcattgatcgcacgccacactggctgattaaacaggcgatctttaactacctgggccagctggaaaccggcgataccgtgccggagatcccgctttctgctcaggcggccgcagagtccgacgacacccagccagaggagacgcaccagccgttccttgatttcgcagagcagattttacctcagtcagtgacccgttcagcggtgaccgccgcatggcgtcgtccggagactgatgcggtgccaatgatgctggaacaggcacgtttaccggcggcgctggcagagaaaacccatcagctggcttaccagcttgccgacaagctgcggcaccagaaaggggcaaccggacgcgcgggcatggtgcagagcctgctgcaggagttctcactctcctcccatgaaggtgtggcgctgatgtgtctggctgaagcgctactgcgtattcccgacaagccaacgcgcgatgcgctgatccgcgacaagatcagcaacggcaactggcagtcacatctgggacgcagcccgtcactgtttgtcaacgcggcgacctggggcctgctgtttaccggccggcttgtctcgacccacaacgagtcgaatctctcaagctcgcttaaccgcattattggtaagggtggcgaaccgctgatccgcaaaggcgtggatatggcgatgcgtctgatgggcgagcagttcgtcaccggtgaaaccattgccgaagcgctggctaacgcccgcaagctggaagagaaaggcttccgctactcctatgacatgctgggcgaagcggccctgacggcaggcgatgccaaagcctatctgctctcttatcagcaggcgatccatgccattggtaaagcgtcgaatggtcgtggcatctatgaaggtcccggcatctctatcaagctctcagcactgcatccccgctacagccgcgcgcagtatgagcgcgtgatggaagagctctaccctattctgaaatcgctgacgctgctggcccgctcctatgacatcggcatcaacatcgatgcagaagaggcggaccggctggaactgtcgctggatatgctggagaaactctgtttcgagccagagctggaaggctggaacggcatcggtttcgtgattcaggcctacatgaaacgctgtccgtttgtgattgatgagctgatcgatctggcgcagcgcagccgccgtcgcctgatgattcgtctggtgaaaggcgcgtactgggacagcgaaatcaagcgcgcccagatggaaggcctggaaggctatccggtctacacccgcaaggtttacaccgatatctcttacctggcctgcgcccgcaaactgctggccgtgccaagcctgatctatccgcagttcgctacccataatgcccacaccctggcggcgatttatcagctggcgggcaacaactactatcccggtcagtatgagttccagtgcctgcacggcatgggcgaaccgctctatgagcaggtggtcggcaaagtggcggacggcaaacttaaccgcccctgccgtatctatgcgccggtcggtacccatgaaaccctgctggcctatctggtgcgccgcctgttagaaaacggggccaacacctcctttgttaatcgcattgctgacacctcgctgccgattgatgaactggtggccgatccggtgagcgcggtggagaagctgggtgccagcgaaggtgccattggtctgccgcatccgaaaatccccctgccgcgcgatctgtatggcgataaccgcgtcaactctgcgggtctggatatggccaacgaacaccgtcttgcctcactctccagcgccctgctgagcagcgccgcacagccctgcctggccgagccgatgatcgacggtgaagcgggtgccggcgagttgcgcgacattctgaacccggcagcgcctggcgaccgtgtaggtcaggtccgtgaagccacagagcaggaagtttctgtggcgctggatgccgcggtgaacagcgggccaatctggtttgccacaccaccgcaggagcgtgccgccattctggaacgcgccgcacagatcatggaaggccagatgcagcagctgcttggcatcctggtgcgtgaagcgggcaaaacctacaacaacgccatcgcggaagtgcgcgaagcggttgatttcctctattactacgccggaatggtgcgtgacgatttcgacaacgaaacccatcgtccgctgggcccggtggtctgcatcagtccatggaacttcccgctggcgatctttaccggtcagattgcggctgcactggcagcgggcaacagcgtgctggccaaaccggccgagcagacaccgctgattgccgcccaggcggttcagatcctgctggatgcgggtgtgccgccaggcgtgctgcaactgctgccaggtcagggtgaaaccgtcggtgcacagctgaccggtgacgtttcgggtgcgtggcgtgatgtttaccggttcaactgcggtggcgacactgctgcagcgtaatctggcgggtcgccttgaccagcacggtcgtcctgtgccgttgattgctgagaccggcgggatgaatgcgatgatcgtcgactcttccgcgctgactgagcaggtggtgatcgatatcgtcgcctctgccttcgacagtgccggacagcgctgttctgccctgcgcctgctctgcattcaggaagatgtcgccgaccataccctgaagatgctgcgtggcgcgatggcggagtgccgcatgggcaatccggaacgcttctcgaccgacatcggtccggtcattgatgccgaagcgaaagccaatatcgatcgccatattcaggcgatgcgtaataaaggcttcacggtctatcaggcggtgcaggaaaacccgcaggacagcaaagagtggaatagcggtacctttgttaaaccgacactgattgagctgggtcaggtcagcgatctggataaagagatttttggcccggtgctgcacgtggtgcgtttcacccgcaataacctgccgcagctggttgagcagatcaatgcgtccggctatggcctgacgctgggcgtacatacccgcatcgacgaaacgattgcacaggtcacggcgaacgcccgagtcggcaatctctacgtcaaccgcaatatggtgggcgcggtggtcggcgtacagccgtttggtggcgagggcttatccggtaccggtccgaaagcgggcggtccgctctatctttaccgcttgctggcgcatcgtccggatagtgcgctgcgtctgacttttgatcgtcaggatgcagaacgcccggcggacagcacgctgcgtcagtcactgctggcaccgcatctggcactcagcaactgggctaaggataagcctgaactggctgaactctgccagcactatggcgatctggcccaggcgggcgtggtccgtctgctgcctggcccgacaggcgagcgcaataccttctcactgttgccgcgtgatcaggtgctctgtctggctgataacgagcaggatgcgttaatccagctggccgcggtgaccagcgtcggcagtaaagcattgtggcaggatgatgagctgcatcgcgccctgctggcctcgctgccggatgcagtgaaagcgcgcatcacgctggcgcgtgacccgttagcagcagagtttgatgcagtgatctatcacggcgatgccgatcagctgcgtaccctgtgtgaacagattgccgcacgtgaaggcgcgattgtgtcggtgcagggctttgcccgcggcgagaccaatctgctgctggagcgtctgctgattgagcgttcgctgagtgtgaataccgctgcggcaggcggtaatgcgagcctgatgaccatagggtaagggcgttcgcagggattgttcgctgcgcgaacgggctatgagaaggtttcgttcgcctggtaagccaggtagtttcagattcgcctctgcaggcgaccgacaagggggcgccagtcgccgcgcccccttgaccccgggctccggcctgcttcaccgccgcttcgcggttccttcgctacttcaggatttctcacggaccagcgggacgcgccatccctggcgcgaacccgcctcttcgcgacatccctgtcgctcgtcctgaaatccctcatccgctcagcggtttctgacggcctccccaccccctcgctgttatcttttctttttatgttgggttcgctgtcgctgtaactttgggaattgcctctgacttttggctcagcagaccgaatgttattcaacctacccgctgttatctcttcttgttatgtcgggaactttatcgctgtggtttttttgggattgcctctgaatttttgctcagcagaccgaatgttattcaacccacccgctgttatctcttcttgttatgtcgggtactttatcgctgtggttttttgggattgcctctgacttttggctcagcagaccgaatgttattcaacctacccgctgttatctcttcttgttatgtcgggtactttatcgctgtgggtttttgggattgtctttgctatcgggtcggcagacagagtggcattcgatcctaaccgctgttatctcgttttcaggtcactaagagtgttgcggtgagattccggaattgatactggctttcggatcaccagacaacgctgcactaaagaaaacacaaagaaatcaccggcaggggtttaccagaggcgtccggagcgctgaggaacaaccagaggcaaggatgagccgacaggacgtcggcgaaaggacggtacgagccagggatggcgagtccggacggtccgtcggccgcagggcgtgacgaaggcaccccgcacagcggggcgcgcaggcagccggacgccgggattgttaaggggcgggcgtccgccccttgacgcgtccgcctgcacaggcaacctgaaactccccatcgcctggcgggcgtaaccctctcagcgctaacgcgcggctaagtgaactaagacgccccatcgccttgcaggcgaaaccgctcagtgcaagcccgctgcaaagcgaaaccttatgaatctttccacgctttcagcggcctgaacccagccagtccgggtgacaaacccaccggcaggggtttaccagaggcgtccgaagcgctaaggaacaaccggaggccaggatgagccgacaggacgtcggcgaaaggacggtacgagccagggatggcgagtccggacggtccgtcggccgcagggcgtgacgaaggcaccccgcacagcggggcgcgcaggcagccggacgccgggattgttaaggggcgggcgtccgccccttgacgcgtccgcctgctcgggcaacctgaaactcctcatcgcctggcgggcgaaacccgctcagtgctaacgcgcggctaagtgacatgaaactccccatcgcctggcgggcgaaacccgctcagtgcaagctcgctgcaaagcgtaacttacccaccgctcgcgccgccaggcgcccttttcattaacgtcgggaacacaaacagcgactgcccgactccgcgattggtcagcgaccagatggccactgaacagagcgagcaaagccccacaatggccaccggatagaaacaggcccagagaaacgaaaaccacacctgctcgaacagatgatgccgctgcgcgaacagaatcgcagacataccaaagaactcgataaaaatacggtggatgacgtaaatctgcagcgtattgcggccaacccagttgagataacgcatgctgaagtgctgattcagccagcgacaggccgcgatactgaataacaccgccagtacacacaggaacagacttttatccagaccgaatagcacatgaatcccggcggcggctgccagaagcgcccaaggcatcagattctccctccgccattcactcaggcgcagcatcgtctggctccagaatgcccctagcaggaagaacacaaaatattgggccaggctctgtggtccccagaacgggatcactttttctgccgccagataattcagcagaatcgccaccgccaccagggccagcttatattgacggaaaactttggcacagaggaaatagagtcccagcccatacagataccacgaggtactcatggccataaaggtcagcttgagaaactcaaatagcgaacccgcataggcggcattaaggttctgcgaaatacgctggccggtaatttcagtggagataccgataattgaccaccactgaataaacccccacagaatatagagataaaaaagattggtgatgcgactggtaaatacctgcttccagggccggttcagaatgccattggtcgccagcaatcccgagacgaagaaaaaggcgggcatacgcagcggcgacagtaccgtattaaactgtatccatatttcggcggggatccatccggcagagagatatttcatcgtcccttcaaagccgggtaaaactgtgtggtacaggaccaccagtaatatgcaggcgcccttcagggtatcgacccacaatatctgatctgacttagtctggttcattcaatgactcctgctgtgtaggtcagaatgctggaaagtaaaagcgaggaaatcagtattgcttttatgattatccggcaattattcgccattgaaccggtgatgaatgtagcgaaactcttaaaagccgctgagtggccctgttaccacagttatttactcatcagaacgtttccttacacttattaatatcgacgcaacacactaattagcagtgccgcagcctgtttaaaggataatgttgcttcataattcagaaaatataattaagagaaagtggcaacgggaaaagccaatatatccccgatgaaaagaaaagatttgtcagatgtgccaaaaggtttaacagcagcagagttatttatgatactgcgcctgttaataacgtgaccatagccatttgcagcttaaaaaatgagggttttaaacaggttaaaactgccttcctgggaaggcagtgtggattactgattcagaaatttatcaaggaactgacgggtgcgcggctgctgagggttactgaacaacgctttcgcttcgccctgctccacaatccgcccctgatccataaaaatggcgcggtcagccacatcgcgggcaaagctcatctcatgcgtgacgatgaccatggtgcgtttctcttcggccagcgcgcgaatggtgctgagcacctcgcccaccagctccggatccagcgccgaggtcggttcatcaaacaggatcacttccggccgcatcgccagcgcacgcgcaatcgccacgcgctgttgctgcccgcccgacagacggcgcggatagctctcttctttgccgtgcagcccgaccttctccagcagcgtgcgggcgcgggttaccgcatccgctttcgcttcgcctttgacgataaccggcccttcaataatgttctccatcactgaacgatgcggaaacagattgaagttctgaaagacaaacccgacctgctgacgcagacgacgcacctgctctttctgcttactctgtgccagcgccgcatcaacggtaatctctccaacgcggatggtgccgctatccggcacttccagcagattgatactgcgcagcagcgtggttttacctgatccgctggggccgataatggccaccacttcaccggcggccacatcaaggtcgatgtcgtgcagcaccgtctggccgttaaaagacttcaccagctttctgacttcgatggcgctcatttcgactccgaatcctgacgattaacatgctgttccagccggttctgcaacgcagataacaccgttgccatcacccagtagatcagcgaggctgccagatacatggtaaagacttccagcgtgcgtgaggtgatcaactgcgcctgacggaacagctccggcacctgaatggtcgccgccagcgaggtatctttcaccaggctgataaagctgttgcccagcgggggcagcgcggtgcgggctgcctgtggcaggatcacccggcgcagggtttgccagcgcgtcatgccgatacttgccgccgcttcccactgcccgcgctcaatcgatgaaatcgcgccacgcagtgactctgaggcataggctgcggtattcagggaaagaccaatcatcgcggaggggatcggatccagttcaatgccaaactgcggcaggccgtaatagatcataaacagctgggcgatcagcggcgtgccacgaaagatcgagacatagatccgcgccagccagcgaaccggccagaagcgcgaaagacgcatcagcgccagaataaagcccagcagcaggccaaagagcatgccgccgatgctgagctgcagcgtaaacagcgcgccttttaataaaaaaggtgctgaatccagcaccagttgaagactttcctgcattatttcgtcacgtccgcgccaaaccatttctgagacagcttgctcagcgagccatctttctgcatgtcagcaatggcctggtcgatcgctttcagcaggtcgtcgttgcctttacgtaccgccacgcccgattcctgacgggagaaacgcatcgcccgcgaccgccatggtatcgcccgttttcttcaccagatccagcgcggccagacggtcaaccagaatggcattcagacggccagagcgcagatcctgatatttcgtcgggtcatcatcataggtacggatgtccacgcccttcacattctcacgcagccactgctcgtagttggtgcccagaccgacgcccacttttttaccggccaggtccgcaggtttggtgatggtgttcgcattggctttcatggtcagcgcctgaatgccggagaccgtgtatggcgtggagaagtcatatttcttcttacgctcatcagagatggtgacctggttgatgaccacatcgatgcgcttcgcgtcgagagaggccagcatgccgtcccacttggtcggtttcaggctcgccttgacgcccatgtgctgtgccagctgttccgcgaattccacttcaaagccggtcagcttgcccttttcatcctggaagctgaatggcggataggtgccttccagacccaccagcagcgtgccgcgctctttaattttgttgagcagattttccgctgcaaaggttttaacgttgacgccagcaatcagcgccacggccatgacgcccatcatcatctgacgacctgcacgagaaaaggacatattcaccccattattgacagtattgtgtgtgtgttcttataagggcagcacggcttgtcgctgccagtccagaaggataaccaacggagtataaactgttttattcgcttgtctcagaccgaaggatgataagcaaataacgccggtgcgccgcccgtgtgaataaacagcaacggaccttcacggcggaaacgattctggctgacgccatccagcagtccggccattgccttgccggtgtagaccgggtccagcaggatcccttccagccgcgccagcagtttcaccgcagccatgccttcatcattgggttcaccgtagcgcggcgcaaagtagtcatcccacagggtaatcggtgccttagcctgcacttccagcgtctccgccagcgactgacgcagccgctccaccagcggcaactgcgcctcaacctggcgtgaaacggtgacgcccaccagctcggcctccggcagcagatgctccagacccaccgccagtccggcatgggtaccggcactgcccgaggccacgaccacggcggcgaaatcgaccacgccttcgctctgatgagcaatctcctgcgcgcactctacatagcctagtgcacccagcgcatttgagccgccgaccggcacgatgtaaggacgataaccctgggcttccagacgcgtggcctgttcagccagctgttccgcagggttattcagcgcatccaccataaccacttcagcgtccatcagatccagcaacagtcggttgccgttgctcaggtagttttctgcgtgggtgccaatcgggttttccagcaatgccacgcacttcaggccaagccgggccgcgactgccgccgtctgacgcacatgattggactggatagcgcccgcggtcagcagcacatcggcgccttcacgcagcgcgtccgccgccagaaattccagcttgcgcagcttattgccgcccatcgccaccggcgtgaaatcatcgcgtttgatgaaaatatcgcggcccagatagtcagagagccgaggcagatgttctaacggcgtgggtgcacccagcagttcaagacgtgggaattggtgtaacagatgtaaagacaatgctgcctccgttcgggcattcaatttatccttacagtgttgcagaagatgcgaaaaggatcaccctgattcaggtgtcagcagatgcggtgagacagatgcgtagtgaaagttgcaggagaaagaagcgccgtgctcccccttcccttttacccggatggcgggcaaaaggggaacgtgccgcaggcacgcgggggagcaatcggtgcagatcagggttaaccctgctgccagcctaagaactgatcgtacttgcgcagcgcgatgcggtaattgttattaccggcatcgggcagatcgctttccagacactgatgccagctatttccctgaagcctgtcggccgggaaatttctggctttcagcatctcatccagacgacgcagccgcaccacatattcacgaattgtgctggggctcatctctgtctgttcaaacagatactgtttaaacgccattatgtcgaagtaattaggatgggtattacaaaaaatatcactgcaaaaacgacaaagcgcggtcagttcgggctgaagtttcagccacagctgctcatcaatcatctggtccatccgagcgatggcctctttattgatgatctggccacgaaaaacgagcgccattcgatctaataccttgccacagtgtgaacagttgctctggctgtgtttatagtctttaagataacgacttaacggtctggccttggtcttggctcccattactgagtccccggttttttataattttgaatcgccaggaaactgatactgctagcgcgctcccgcaagtcgggcacgcaggcgtttaatcgcctgactgtgcagctggctgacacgggattcacccacatcaagcaccgccccaatctctttcaggttcagttcttcctggtagtacagtgtcagcaccatcttttcacgatcgggtaacgcttcgatcgcttcaatgacgcgctcacgcagactcccttcaagcaactgatgaagcggattagcctcttcatggccttccgtcaccagctccgcgctgtcgccgtgctcttcccgatactcgtcgtaggagaaaagttgactgttgttggtgtccagcaggatctgccggtactcctccatggaaacattcagctgctgcgccacttcctgctcagaggcagaacgccccagcgactgttccactctgtgcattgctccggccacctcgcgtgcattacgacgcacactgcgcggtgcccagtcccgactacgaagctcgtcgagcatggcgccacgaatacgctgcacggcataggtggtaaaggctgtaccctggagcgcgtcataacgctctacggcatttaacagccctatcccacccgcctgcagcaagtcgtcaagctcaacactggccggcaggcgaacctgcagacgcaacgcttcatggcgcaccagcggcacgtagcgctgccagagcgaatgcttgtccatcacgccttcggcggtatagaaatcgttcacgttgactaccctgcgttaatgaagttatcggcatgattatccaattctgtagcgttttcgattggctgaataggcggggtaaaacgaggctatttcatttttgttacctcagagtgcagatccttctgcactcttcagtgaagattaacgacgggcgcgcagccgttgccgggtggcgggcggcactgccgcccacaggctgcagatgcgaccttccagttcctgataccagggcgccagatgctgctgcgcctcctcgccaggatgcaccagaatctcgcccgattcaccatcaatgctaatcagtcggttaataaacagccgctgcaaatcactgcgtaaaaacaggccgttatcgatgctgttatctgccagtacaccgtcatccccttcctgcgtgtcgatatggcaggcttccacccagggccagttatgccgttcggtcagctcggtaccggtcatcacacaggcgccgtagcgggctttgacaccggcgctgaattccgcctggctggcgcgctgcagcacccgggctttaacacgacgcccgacctcagttcccggcatcaccgccgccggaactttgtgctgcggcgtactcagcaccacgatgaactgaatgcgctgcgactgcggaaaacagggatctgcctgtggattgaaaagctgccagtaagcgtcttcatcatcctgatgcatcagcaccagtttgtagccgcgactgttcagcagattctgtgccgtggcggattggggatcgatcatcgcgaagacctggctgctgcccatcaccttccacaggttgtcgcgcttttcgctatcgctgcgacggaaatagaggaaggaaagattctgcttaaggtagtgctcaaagcgacgcaggtaatttttacgttcgttgtcatgggagatgaacagcagatcctccagcgggctgttgctctcttcctgcgcgaacaccgcgcggattttcagcgtgcgcagcccggttgacggactcagcaaggctcgcgccgtcagctctttatcatcagggtattgcagagcataacgccgggcgatctcttcaaaggtcagccgctcacccggtaacaggtcataattgaagcgcatagacactccacaaagttaaaatcaaaaatgatgttgttctgtgaggagttatcggcagtctggaggggaactgtaacgggctggggggattgcctggcattgagagacaggcagcctgcaaggttgtggtcaggaaaccggtttgaaggaagcgggtgttaaattgcgttgcattgcctggcgctgctggcataaaaataagccagcactccagccgcaattctttcagcaattagctaattcccgcccgtagctatcagggacaaatgggcgatgccgatgatacgaaactgcatcgcctcagatcatttaagcagataaatcagcgacaaatcgtcattgaccttgaccttatcaatctcggccagaaacgccatcaccgattgtggcgtatgttttgttattgagtggtagctgtaaatgatattaataatatcctcttcactgacggttccgaccaactcaacattggccgcaatcagtgatttaagcaggaaccattctgccgtcagaagatataagctcagtaacgggctgcgattttcgttattagggaagaaatcatcataaatgcggtactgaatatagttattcattatccatggccgttcagcaagccagggcataacctgcttctgccagacgttgtccagccggatcattggctgactgacgtcatcggttttggccccttcggcctgaatgtaaatcagcttattaacgtagtgattcagggtaggaaaggcgcgcttatcggccatggtgctgaaccagctttgcaatctcaacagtaaagaccattgcaggttatagtcaggtttaacctgatcaagctgcagcctgatttcaccctgtgtcaggttgttgagtacatcagaaaaatgatgctccatctggaccagccagtcttcttcagggcttactctttccgcgcccagcagaaagctggccagcgcgtaaaacccttcatcaagatgaatgccgctgaatttaatgatgttaagacacatcagattcagcaatttcttttgctgatcgagatctttagctttattgccataaggttgttgcctgatgctctccgcgaacagcatcgcgtcaggtgaggctaataattgccgggtcgcctccggacaggagagcgccaacgttttttgctgttcatatttaaaggtgttcgccgctcggggataggtcgcacaggtgttgctcagtgcggcagcacccagccgggaatgcactttgcacaggcgattttcatccataaatgcacagttgccagaagcattaagcttcatagttccccaactggcaaagcttttgcgggtggttgtgatgttttcaactgccagcgttttgatttcaatcagcgaggattttaaatagcgattgaccgtgggcttatccaggtggatatcccagcccttacagcagtgatcgcgacactcactgccaatacatttgaaggcgctgacaaagagcggttccacgacagtaatatttttcattatttacctgctcaacaaaggcatttaaaaaagagtcttactgtgagaataaaggaacgcggggagattgattggcagagaaacagggcaaaaacaggctaatcgcaggcataaaaaaaccccgccgaagcggggtttgtcttttataagttgggtgattagccctgcagcagagacagaacctgctgtggaacctggttagctttagccaacactgagttaccagcctgctgtacgatctgcgctttagacatgtttgaaacttcagttgcgtagtcagcatcctgaatacgagactgtgctgcagacaggttagtcgtggtgttgttcaggttagtcacggctgagttcagacggttctgaatcgcacccagtgaagaacggaacttatcaacgctggcaatcgcttcgtccagctttttcagtggatcagaagttgaacctgaggtcacgttagacaggctcatgttagccgtatccagtgtgaacgcagcggtatcgccaccagcagttgttactgctgccttcgcatcaactgcaacgtagaagtcctggtttgcaccgttagcaatgtcaaaaccgttcgctttgaggctgttggtttctgcatcgctggctgatttcacgttaactttagcgaacaggttaccgttgtcatctttatacactttgtctgcagtaacagtgacgtttgcgttagcaacacccagacgagtcgccaggctgttagcagtaccttctgcaacggttgctttagatacgttactggtagaaaccgtagacgctctggaagtcagcagccgctgcaacggtaggtgtaccctgtggaccattcacgttgaaagtgttcagtttcagcgtagaagagtcaattttcttcaggtcgatggtgatagtttcgccatcgttagcgccaacctgaattttcattgagccatctttagccagcacgttcacgccgttgaactgagtctgaccagatacgcggtcgatttcgctcagacgggatttaatttcgtcctggattgaagatttgtcagaagctgagttggtaccgcttgaagcctgtacagtcagttcacgaacacgctgtaagttgttgttgatttctgacagcgcgccttcagtagtctgcgcagcagagataccgtcgttggcgttacgagcagcctgagtcaggcccttgatgttagaggtgaaacggttggcaattgcctgaccagcagcgtcatctttcgcgctgttgatacgtaaaccagaagacagacgctccattgaagtagacagagctgactggttcttgttgatattgttctgagtgatcagcgagaggctgttggtattaatgacttgggccatgatgaattttcctgttaatcaagtctttcggttaaggtgtgggcttcaacccgccggcttcagcgccgtcaaagttgttatcgtccgccgtttaacaacctttagaatttttttagtaccaggcgaatttttctgcttcaacctgtcacgtttaaagttatcgccacccgcccgaacttctttaggcttaattcattaattttctagccgctgaattacccttctctatagtgcttatttacctcattaccctaaggcaaataaccttaaactttccttattcaaggccgataacccaggtatcaattttctgtcgaccttataaaggaattaatatggctagtataagcaacctcggtgtgggttccggcctgccactcagtaccatgcttgacagtttgaccaccgctgaaaaagcttcactcaaacctatttctactcagcagacagcttatacggccaagctcagtgcttacgcctccctgaaaagttcactgacaactttccaggctgctaataccaagctgaacagtgctgacctgtttaccgctacgactgcggccagtagctccacagcgttcagcgcgaccacttctggcagcaccgtagccggtaaatatgccattaacgtctcgcagctggcacaggcgcaggttctgacctcaggcgtacagagtagtaacaccgccgcgctgggcgacagctccgtggccagccgcagcatcgcgattaccttaaaagatggcaccagcaaaagcatcacgctctccagcgatcagacctcgctgaccggcatgcgtgacgccatcaacggcgccaatgccggcgtcaccgccagtattattaaggtgtcagacggcagtttccgactctctatgagcgccaataaaaccggcagtgataatgccgtggcgaccattgccgtcaccggtgacagcacgctgcaggggattgtgggctttgacgcatccgccagcagcaacgtgatgacccagagcgtcgctgcgcagaatgccaaactgacggtcaacaatgttgcgattgaaaacagcagcaatcagattagcgatgcgctggaagggattactttaaatctgaccgcgaagacagttggcgatgagacgctgacgattaccaaagacacctcaaaagcctccagcgccatcagtgcctgggtggatgcctacaatacgttgctggatcagttcaataccctgaccaaattcaccaaagtggataccaacagcgatgcacaggactccagtaatggtgccctgctgggtgacagtacgttacggacgattgagacgcagctgaaaagcatgctcactaattcgcagagcacatctacctttaaatcactgagtcagattggtgtcaccaccgatcccaccaccggttcattaaaactggattcgaccaagctgagcagcgcactggataaagatgctgcgggcgtgaaagcaatgatcgtaggtgacggtaaaaccggtatcgccgctaaaatcgacagcaagctgactgactggctggctactaaagggattattcagtccgccaccgatggcgtgagtaaaacactgaataggttaaccaccctctataacaccaccagcgatcgtattgatgccgatatcgcacgctataaaacgcaatttactcagctggatatggccatcagtaaactcaactcgaccagcacctatctgacgcagcagttcgacacgtccgattcgtctaaaaaataacaggagtgaccatgtacagcgctacaggcaccaaagcctatgcaaaaattggcgtagaaagcgccgtgatgagcgccagccagcagcagctggttgtgatgctgttcgacggtgcactgagcgcgttaatccgcgcccgcctgtttatgcaggatggcaatattgcaggcaaaggcaactctatctccaaagcgatcaatattatcgaagcgggcctgaaagagggcctgactgaaaaccgtggtgatgagctggcagacaatctgctggatctttacaactacatgacgcgtcgtctgttgcatgccaacctgaacaatgatgttgcagcagtcgaggaggtcgaaggcctgctgcgcaacattgctgacgcgtggaaagaagtagttcaacctaacctgattcaggacgccgtttaatgactactgcaccgcatctgattaccgtttaccaacagttactcgatctcagccagggaatgctgcgtcatgcagcacaaggcgaatgggatgaattgatcagcagggagatggagtatgtcagtgcggtgcagaacttagcccaatcgacagaagccgtgtcgccgtcggcacagactcaggagcagttacgtccggtgctgcgccgtattctcgataacgaatgtgaagtgaaacgtctgctgcaggcgcggatggatgagctggcctcactggtgggtcagaacagtcgccagaaatcggtgatgtccgcttatagcaatcaaggcggcgttgttatggtgccgcacgaaaccctctcctgatcccctgctctgtcacgccgccagatttatttttctgcgcggcgtctcttttttgccgcttactccatacttgattttcatcatcccctggagtgtggtacatgcaaaacccaacgttattacagtttttccattggtattacccggatggcagcaaactgtggccggaagtcgccgatcgtgcggcctggctcagcgaaataggtatcaccatggcgtggttgccaccgtgctacaaaggggattcggggggctattctgtcggttacgacagctacgatctgtttgacctgggtgaatttgatcagaaagggggtgttgccaccaaatatggcgacaaacagcagttactggcggcaacagaagccctgcgcagtcacaacgttggggtgctgctggatgtggtgctgaaccacaaaatgggtgccgacgaaaaagagacgatcagcgttaaccgcgttaatcccgataaccgcgatgaaatctacgacgaggtggtcgagtgcgaggcctggacgaaatttacgtttccggcacgcgccggggaatattcgaaatttgtctgggaccacaaatgctttagcggcgtagaccacatcgaaaatccggacgaaaacggcgtattcaaaatcatcaatgactacaccgccgaaggctggaacgaccaggttgataacgaactgggtaatttcgactatctgatgggtgccaacatcgatttccgcaacaatgcggtcagggaagagctcaaatactgggcgcgctgggtgatggaacaggtgccctgcaccggctttcgtctcgatgcggtaaaacatatcccggcctggttctacaaagagtggatcgatcatattcaggaggttgctgaagagccgatgtttatcgtcgcagaatactggtcgtttgaaacggagaagctgcaggagtatgtgcatcaggtggaaggcaaaaccatgctgtttgatgcgccactgcacatgaacttccaccaggcctcaaccgcgggcagcggctacgacatgagccagatctttgctaactcgctggtggtcgctgatccatggcatgccgtgacgatcgtggctaaccacgacacccagccgctgcagtcgctggaagcaccggtagaagcctggtttaaaccgctggcctatgcgctgatcctgttgcgtgagcagggtgtgcctaccatcttctatcccgacctgttcggcgcgacctatgaagatgaaggcggcgacggcgagaagcacaaaattgagatgccggtgatccctgaactggaaggattgatccgggcgcgccagcagtatggctggggcgtgcagaccgactattttgatcacccaaactgcgtggccttcagccgcagcggtaccgaaacacagccaggctgtgtggtgatcatgtcgaacggcgatgccggtgagaaaagcgtgccgatgggtgaaggttttgccggtaaggtctggcgcgatcatctggggaatcgggaagagaccattactgccgacgagcacggcacggcggtctttgtctgtaacggtggcagtgtcagcgtctgggtggttgctgaatagatcgctccctgaaaagctaaaccgccccggcagacagaagcgtgaagtgcgctctgcccgtcggggcggttttgttatgggtcggctgttacgacttcgcgttgttttctgtaatcggtgtgcgcagcagctgcggttcgatgttctgaattaccgcggctttcggctgcttcgccacttcttccagcgcctgctgacactcaacggtcggacgcgccactttacgcagggtcatcctgtcatagctcagttcgccattctctactaccagcggcatcacccgcatctgacgcgttacgttgacataatcgccgcttaaccgggtcagtttgcccggcttcgcaatcacccgcatccactgacggcagtccagcgtgctgccatccgcattgatgatcacactggctatcgccttgtcgctgatcaggctgctctgtgggccaacagtttgccaggttccctgcagatcagcgggcgccggcgtttgcaccgcattttcataatcgttgatttgtgcacagccactcagtgccagcgcggcaatcagcatccactttttcatgtttaatccctaagatcccatcaatggcggctacgttataatttttccaccgcgttgcgcaaggtatctgggtgttcaaacaccacgcagaccctgattgcgccagaatttaacccgcagcgagctccacggtcaggtttttgaccggcagatcagaggctgaactgatgcaaactccggcctttgtcacgcctgacaagcggaagacaacccgctacactgacgcgctgcaacagactttcaggaatatgaatatgaaaacgccagaagcctactatgcccaggcgcgcgagatgttttttaccgcgcatcccgactttcagtctgcacttgatgaattaacggagagcgatgcccgtgcggctaacctgtcactgcgacagctgcgcgaatggcatgccgaacgcatctatgcggcctttttgcggcagaagaatctggatggaatgatcttttctattcagctcgctgagccggataaagcggtggcggctgaagctatcgagacctatctcaaatctcatgctgagtcgctggggatgagctgggaagagttttgcattaaaaacgagctctaatcagggccgcgctgaagttgtatattgcaaacacctccaaccagttccggcactgcagataaaattgtactaactgggggaaagtgtataacttcggcgtgcgactcaggtcgtgattgacctttaacgaatagtgctgatgcactgcctctgcaggtattgtcccaattccacctccagaggcgaatttttttatccgcccctacccttcaccttccgtcgctttaccctttacttcaacataactcgctaccgccagcagacgattaatatgcgtcagtagcagatccacatcagactgcaaaaactcggtcgaagattgcgaagcggtaacaatggcatcctgcaccgtttctgaaatagtcagcgagttgtcctgtttcgcctgcaccagcagcgccgcaaccagcagcgactgcgcttcaagttgcgccgtcaactcttttgcatcgacgtccatctttgccagttttagcagaatatcaattaccagttgtcgcatcgcggacctcctaaaagtaagccgccattatgtcgcgatgcgtgcgcattttgctagtcgaagattgaggtttatgcgagataaaaatttacacgaaatcagacgtgctgccttgctactgtttttatttacagtattatatgtcagcgattttgccctgaatggattgccatcatgtttgttgagttgatttatgacaagcgcaacgttgccggtttaccgggtgcccgcgagatgattcgtgaggagctggaaaagcgggtgcatcgggtgtttcctgacattgaagttaaggtcaagccgatggaacgtaacgcgattgatactgatttgagtaagaaacgataaagcgacggttgcgcggattgttgaagagatgttcgacgaagcggaaatgtggctggtggccgattaatcccttaacggccaccacatcagttagcgggagatgacttagctctcctgctcgctgtgattaacttcaatctcgatgtcctgaatcgcggcatccagatcttccagcagtttaccctgcttattcagcaacgcatcgattcggtcggcgttggtcttgtctttatactcacccgcatcaaacgctaaccattggctggaaagggtttcggtgttggtctgagcatagtgacgcatctcttttagctgagaagtcacgtcacgcagatattcagttttggtcttggtttctgttgaatcgctcatgctaaatttccttctggtcatctatccaaagtgagtaggcttagcggttcatcaaccggccaatcagcgggcctgcattcaggtacaaaatgttgcccggatatttaaaactagtcgataatagcgaagccgcattaagaataatcggaagttatggtttatgaccggatttcacggctggcacctcactctcagtgacgacctctttgacttttatgaccgttttgtcggctatgcgatccggtattgcatccagcttatgctgtattgctgcaacctgatcggtcagcagctccactctgtcatcacgccgcgccgcaattaagcggtaatccgcccgaatctcctcgacccgcttgtttgcggtgttactgacgtagagaaaaatgatcgtcatcaggatgcaaatcatcgaacagctcagcaatacgcagccgaggataactttgcgccggtaagacataggtgccttagtgctattaatcgtggccatcactgcgatcctccagagttgagataagccgatcaatctcattacgaaatttatcgttctgatcggtttcggtcattgccagtaaaatccctaccgcattcttgattaaccgaagatcggtttcgagtgtggagatacgccgcagattcctgtcgtgccgttcgcgtaattcatcgttctcctcccgtatcagcaggttgctctctttcagcaacaccacctgctctttgtagctggtaataatttcgccgccggctcgattactggttacgattgacgcgattcccgccaataacggtttccagaacagtgctgctgcccccccgcccagaactaacgcacccatactggtaatcagactactttccatgccacacccctttgtacggtaaggtctctggaacttactgcgtgctgcttagccacgtcccccgcatgaaatttaagattgcttaaataccaggcttaagtatacttaagtcactctcaaccaaaaagtcaagcttatgaaaaacgaaacgctgggtgaccgcatccgactccgacgtaaatcgctgcagttaacgcagaagcaattggcgcaacaggtaaaagtgtcccatgtggcgatttcgcaatgggaaaaagaggagacgctgccgcgcggtgagaacctgctgcggctcgccgaagcgctgggctgcgcaccggcttttctgatagatggggatggtcctgttttcagcgaaagcgcctggagtggtttgcaccagatcccactgcttgcacagcgcgacgtgccgcgatggctgagcgaggccggttccgtccggcatgaactgctgatgcacaacgacatggcgctttcacagcagagctttgccttccgggtagaagaacaggcgatgacgcccgcgattctgcggaatgatgtggtgatcatcgatcccacgcagtcacctcagcccggcgactgcgtgctggcattgcagcagcaggtcgtgctgctacgcacctggcgtcagcgcggcagtgaaaatggcgtcatgcagtttgaactggcaccggtcaatatcaacttccctgagctgcaatccagccgggacagcctgaagctgattggtacgctggtggaaactgcgacgctaccgccagccataaaaaaacccgccgtgcgcgggttcacttttcatcgtacaacggtgctgagtttatagccggccaactacagggcatcggtcaattgatctaccaccactttgccctgcagatcggtctgcataatgcggtaattgacgggccatgagcggcgggtactgagtttatcgaacagggttacgccgccttttttaacaccctggctatttacaataatccattcggtgacctcttcctgaccacgatttttcaggctcagcgagcgttgttcgattaactgatcttcagcttcaatctttaaatagtctcttaacataatttctatctcctggtaacgcaggacactatatgccttttgctaatcctttcaatcgaatttatttatcgatgtattcatcgacgggaatgtgacctgccgcaagcgacatgacagatttgtccattactgcatcagggattaccggttagcatgaacctgctgtacacacccaaacatcgaataatgacgtgttcagtatgagagaaactccgattagcccgcctctggcgggcttttttttcttctttaatccaccgcgcatgcgggatgttagtgctggtctaaacttaagagactggaataaaaggagagagttatgtttaaacacaatacgaatgaagaacgtaagaaagaaggtgatgtcagcaaaagcctgccggaagccgcgccaaacgctggtaatgcatacgaggaagatgatcatcccgctactgatgcgccgaaagatcatggcgaagtgccgcgcaaaaacgatgacagccaggatgacaaaaaagatccttacaaagcaagctgatgtgcgagaggcgcgcccgctgggcgcgctggtcagcgttaagatttaatgagatcggcaagctggtgctgattttcaaccagccaggctggaaaatgttcggatgtcaccggcactatctccatccttcgcggacggttccagatatcaatattgttctcaacgcagcgccgtatatgatccggattgttaaattcggggcagttacgttcggtatgagaaatcgaagacattttttcactgatgcgctcatcgctcattacccaggaaaaatgccaccctgcattcttaacggtttttgtccggaaatttagccacttccagcgccaccagttctcgcgtatcggtgtaccacgacgcttaacattgcgaagcaattccggttgccccataaaaaagtctcgcagcgttttacatgtcaccattttcgccagtgtggcacagcgcggtgtgccgtcgtcatttaaaacccggacattaaatttaaaattgaaatattgctgatgcagcgtcgtgcaaagatgttgatgactgaatgcttttatcgcttcaggtcggggaatttcatcgacgtctgacacaataacaatatcattatcctgcgcaccggccagcccttgcataatctgattacgtgcagtggcttcattttcccagggatctgtctcccccgcattaaccagagaactattcgatttaaaggcttcctgataaaatctgggcgcaatatcgttaacaatataaataattttatcgcggaaacgatcgaacttctcaatatcaaaatgaagtttttcccggcgttttccggtaaaggtatagcgcgattccacaatgacaaaccggtcaacaacatgctcaagcgtgttcagacgcatctcaagcaagatatcttcatcgtagtacaaaaaacagtcataaatcataatattcagaggcacttaagtagtaaggattttcatcaggacacctcaacatgcgtaacacaacagaggtataacgccttttactgggtcgttttttagtgaacctgatgtgtgtgtaatgtactgcgtaaaactatccatgtttataataaactggctaacaaaggctgcaggcaatgattttcggacatccacctcaaagcagactaacgatatgatgagcaaccattcagagtgatatttacctgacaacggttaacaccagcagacagcatgagtcacctgatgcgggctactgagttcctgtccgttgcttacatcataatgcgttgcgcagaatgttacatatagtccgtaacgccagcaatattaagcgcagatttttgattaaaatgagcgatacgatcaatatccggatattattggtcaacaaaataactatgatggtttagttaatgaagaagatcattattgccctgagcataagtctgatgggcggatgcgtagatatgggacgggttggattacacccgacaacaaaaaccgcttatttcgacgctcatccttttcaggttgaatcctgccttaacgtagcggcacaggatcaaagactctatctggagcaggatgaacctctgccggatggcacgaagcgatataaccttgagcaggataatgaaaccgtggcctgggttgaaattgcaaagttcagccatcatcagatcagtgcgacattttactatgatccaaaagcatcagatatcagcacagcagtttcagggatgatcgcgcggtgcaaaacatcgagttagaggcatcgtcgccatgtgcgtgatgcagaatggatgatcaggagttggcatacgttgtcaggccagccagagcacaagcgcttgcctgacaacctttcgcactcttctactcaaaggtttttatcacgctcgcttccgggctatgccatgttcaggagtgcgcagccgaagctcagcctatttagccggttcgcaatcgtaggcacctcgtatgcggatctgactctggctggtgcggacgatttcagctcttaacagccctttgccctgacggtttcgtcagctccatatccaccatccccggcgctttgctgtttttcaccagcagtttgaccgtcacgttgtcgtagtcgcccttctctttcgcaaaggtgactttctgcgtttttgcgcgttctccattcaccgagaaccagccgctcttgtcaggtttaagatagaacggcccgcactgcgtggcagcaaaggctggagccgataagctgattaacgatgcgataaggataagtttttttagcattgggctggcgtcctgctgatgggtgatgaggggtcgggtcgtctgcaccgaagagtgagttccctgctgcacggctcgtaataaagagcagtatagtcaatgacacctgcattatcgccaggaaagggtcatagactcagcaaagtgatcggccttgatgctggcaatccaccgccctaatcgctaccacgcaggcgtgccttgctcaatggaatcagctcactaaacctgcatattcataatttcactttgaatatttagcatatcaggttgctgtgcattgaagcgtggttttacagagacataccgcaagtcacaaactgccgtcatggtggttttgaggtgattggcggtatttttttgtgctacatgtgtgctacggttaaatcgtcggccgcagcggttcatagacggacacgacctcggccgtcactttcctcagcacgataattccttccatgccctctccgttccatgccctctccgtcgatcgtctcgccgtctcaggtgatgatgcctgtagtgaacaatctgcccagttgcgggaactcacctatatggaatgcgattttgtctcccggcgctggcttaagtgatttgtcagccagcgagaacccgtcaggtgtctcgattagcaacatgttgttccggtgaggcatcagcacgtcgttgaggtcgatgcgccgctctatttagtccaacgcaggtgatggaaatcccatatctacctcacatatcccatgttgcgtaacgaccaggttttattctcacttccctctgtgaccagttcgaagaagaagttctagtagtaccttatccaccggttgcactcctgcagcgtccacacgtgattcacgtcatccagccgcttctggaatgccgctgttgtgacaatctgccgccccttgctgtccttcgttatcgctccaacgaaggtcgcatgtatgtcactctctctcgccataacaaatccttccttgacaaatactgtatgaataaacagtaacatcgatcggtatgtttgatcaagcagacgagttctcagatttgtaagcatttgaggaataagagttttacacaggtaggggcaacgaaaaggttctaatctcaaatcttgcaaacctatcctcgaagaaataagcgccatgcactcctctttcgagaatatttcaaagtaaacaatacattaacccaatttttattaaaaaaaattagtagggttgcacgacaaaattaatattttttagtaaaatttcttcaaaatcacattaaggaaagcatgaaatgcattatcgtgggttaaaaatagctttggtagtaccatgccataatgaagaaacaactatttttcaagtagttactgactttaaaaaacacatgcctgagattgagccttatgtttttgataactgctctactgataaaaccaaagaagaagccttaaaagccggggcaacgctaatctctgtgtatgaaaaaggtaaaggcaacgttgtaagaagaatgttcgctgacgttaacgcagatgtctatgtaatggtcgatggtgatgccacatacgatgcatcctcagtccataaattagtcgataagttaattgatgataaccttgacatggtagttggttgtcgaaaagttgtgtctgataaaaaagttaaagcataccggttaggccatgagtttggtaataagatgctaacaagcagtgttacatctattttcggcggtaagtttacagatatgctttcagggtatagagcatttactcgaagatatgcaaaatcttttccagcattatctcaaggctttgaaactgagactgaacttactgttcatgcccttgaattaagaatgccctatggtgaagtttcaactttatatggagaaaggccagagggttcagtaagtaaactttcaacttataaagacggattaagaattttaaaaactattataaagcttttcatgcgagaaaaacctttgtatttctttagcattttgaccgtattactttcaacaacatcaattattcttgctataccgattttctccgactattttcttaccggattagtacccagattaccaacagccgttctatctgcaatgctcatgcttgccgggctaatgacattatcctgcggtcttattttagataacattaacgttgctcgtcatgagagccggagactttcatatttactcattaccaactcattaagctaaaatatgagcaaggtcataactgaaataataaaatttggtgctgtaggggtatcaggctttttagtcgatactttttttgtactgctattgaaatcatatgctggcgcatatggtgcccgaattatttctttctcattcgcagtaattaccacttggttacttaatcgcaatatcacattcaaaaaagctaatagaagtgatgggctcatcactgagtttctccaaatatgcagtaagtatgtgtataggtgggtcagctaacttgatatgttacagcttaataatatcttcaagaccgcatactacagagaatattatattcgccaccgcaataggtagcattgccggattggtttttaactttacattatctaaaatatttatttttaaggaaaaatagcgtgcgagtaagaactggggtcataattttcctggcatctatgttacttttttcatgggttttaactgtgaagcccccttttagctcacctgatgaagggttccatctgagccgggcagacggtattctccaaggatattttatacttaagccaatatctccagatggttcatccggcgcaaaagttgatatatcattagataaaatggctaatctcttcaattcaacattgagtgcaacacaccttggagatctcaatgattcattagaagaaatgaaaaatcttaagtggagccatgcttatttagctaaagggatgccgaacgttagtttttatactcccagcgtttacctgccacaggctctcggcttttacattagcaaagccttagatctcaacctttactcatcatatttatttactaatgtagtaacttttgcagcatgtttaataatactaattcttgcctattatatttaccccataccattattaacccttgtttttttaacaatcccaatgtctgtctttcagttgatgtcaccaactattgatggccttagtatggcatttactgttctagccatgtcatgctttatgaggcttctttttgacaaagagataaaaaactacaacgggcttgctctcttaatgtcgatttgtatattttcagcagctggtagtcgcgcaaacttgttattaatgtcattaatgcctttgtggcttttttataaaaacaggaaactttcaaatcttttatttctggcactatgtttagttaccaccctctcatggaccacatataatcttttgaatgtacacgacgctggcatgggtcgacatcctggttatagcaatactgagttagtcattttttacctgaaaaatcctttaatcttctttaaaacattcttcaatactataactgacgtcaatacattaatattctatttaacatctatgataggtgtgctaggttggcttgatgcgccaatttctaaaacttctttttctttattttttgttataattttgactgcattagtaatctccgtaatgtcatttagaaagtcgaatgacaaagcaacatcgtattttattttcatcttatcagcactttcattattattgatttttcccgccttacttgctcaatggaactcattccctaccgagaagatagttggtgtccaaggaaggtattttatcatacctgcacttatatttggttattgctttcacacttatgaaaggatgaatctggaaaaattactagtattgtcatcaattttagttgcatcaacttacacagttcattcagcaatcagcaatcattatattcaccctaaatttacatttgaaacaatcaattctcctgacgaattgaaaaactcaagacccataaatattttggggagctcacagcccccttatgccctttcagtgcctaatgggaacattagcagtatgctcatctattttggaaattataataacaaagctaaaggcacggtaaatcttaaggtttgcagcgtagagaaatgccaagaaacttttgttaacacacacaaacagcaggataactctttttatgagtttaacctaccgcagggtttaaaggtagagaatagaaaaatcacattaaaatttaatttttttgaagatgacaattcatcccccctagctttgtgggaatatagcccaacaaacgaaaataactcattttctccacgaattaaaataaattatatcaactaaaagtccgggcggcatgtccgcccttatctccgtctaccctccctgttttaaagtctcatttttactttctcagaagactttcacattattagcttattaacaggcccttttggaagaacatctcgaccagatgcttcagcaatataggctctcagagctttgcgataagcagtcaattcagcttttgactttgccaccgccgcttccgttaactcgccgctatagtcctcatcttcaattcgctggttgagagcggtgatctgggctgacgcgtgattgtattccgactgcgcaatattgaggtttttctgtgcctgctcttccggggtgatttcaactaccggagcagtaaatacccagctaccttttttgtccttctctgcagtaaagcttgggccgacctgatcctcctcttttatctcgtaagtttcatactcagggaaaaggtcaccttctccgttccacaggactgcatttactacaacgccgtctttaatcaatgcgtaagatgaaactgacattatgcatactcccagataatgacaatgccatcagcacccgcgccacctttgtagccggttaatgcattgttaggtccgccaactgcgccgcctccaccagaacctaatccattggcatcgtttccgactgagttgttatttgcccgactgaaaccacctttaccgaaaaacgaatctccgcctttaccaacaaagtttgatccggtactaagagatacgccgtgttcagaactccctccgggggtgttaacgatgttcccgcccgttgcgttaccacccagaacacccgtacaggtgaacggcggtattgactgctcttggccgtaaccgccgctgccacccttacataaaataaggctgcctattgaggagtcgcctcctacgctacccgatgcgggtaatccactattcgatttgccctcgtacctactgtaataagttgtccgtcaatctgatctactgatagttttgattttgcataaccacctgcactaccgccggtagccagggaaacggttgatgaccctgaatacccagtgttgcctcccgaaccacctgcggcgtgaacctcggaaataacatttatcgtacctggcgtttttttataaatggcactggttttaaaaatctgtacattgatcagccgtccgggtccgaccaccgtgttcatggcggcgagcagctgcgccctgttagatttggtaagcgtcaggcccccgcctcaataaccgcagctatttattcctgaactgaatcaaaaaaatctgcattcagcgcagtaggcagttcaccggcctgaggattaccgccggtaaagccatttttacccgcgccaaatttatccacctgcgcggtagatgtgtcaatacgatgcatttttactccgggtaactgaaaataacgtaggtatgtgacagtgcctggttgttaagtatgcattcagcgatagtgtctccccacgttctaagactgtccgtgcagttactgatggccgtcattggggttatctgcgtggaagcaggcatgtttacctgccaatagtaccgccactcatcgctgtaaagtgagtcagtacaaacagacaggcaggtaaactggcttttgttgtagcgagtaatggtgacgccggtgtaacccaacgcctcaagctgggccaggtagaatgcctcattaataccgccagccagattaagctttgcatccagccgctgccgccgctgctgaagcgtccgaacacctgcaggtgcgcagctgtcaggcagtccactgatgttctcatagcgatcaatcaactccgtcactgagtgcgggtccgtttccagcatcagtgcatcaccgcgaccatgtacctctgccagtgacggtgccagcccggttagcagcaggtcttcactgtcccacgcagggccgcgtggcagcagtgcgcccagcatccggcgatactgcgccgttaattccatgagatagtccccaccacacccacctcgcctttaccgatggtgatatcagctgcaggactgaccagcgtgtggctgtactcgccggttgcgatgctgatggcctcactgatgcgtgacggcttcagcacgttctcaggaccgccatcgcgcagcatcattgagcggagctcagtctcaacggcatagcgcacagttgcggtgtccgggttgagtcgaatctggaagttaaccgtgtgctgcgtaggtgcgaaaacataaatgtctgcaccggctaccggggccagtggttcaatataggctttgacggcggccaccgtggcggcatccgggatcggattaatcaggtcgctgttcgccaccatgataccgactgttccccgcccgctccagtgacggtatgtccaggcgcgggtaatgcctgccacttctttagcccacacctcataatcgccgtctaccgcattaagacagggacgtttgattacaggagtgagttcccagactcaccactatttaagaaccaggctggatcgtcaaagtcggtagctatcagggagattgctgatttgtggctgaagctcaaaaagcctgactgggccaatagctcttatgtcacgacagaaacgtcgcgccagggtgacgctggatatcatcggcaacggaaaggacatccggtcgatcatgcagaaggacctactcaacctacgcattgaacttcttaatggcagctacttcacgggcaggaagatgaatatagaaaagaaagggaggacagcggccacggttaactccagcatggcagacctgaaagcgatcttcgcctttgctcatggcaacgggtatatagaagcgaacccgatgacgggcatcaagcctctgaagaagtcgaataagcggccggacccgataacacgcgaggagtaccctcgcctcatcgcagcctgctcaacgcgtcagacggcaaatatgtggtcactcgccatcctgacgggattacgtcacggagagatatgtgcgctggcctgggaagatatggaccttgaagcgaaaaagctgacagtcagccgcaaccttacaccacagggtctattcacgccgccgaagacagaagcgggaaaccgtgtcatatgtctgatagatgcagccgttgatattctgcgtgaccagcgagagttgacgcgaatgtatccacagacctctttcacttttcataccagggagtatggcgagcgaattgaggagcagaaaactttcgtgttcaatcccagcgtgaacgcagtcaatggcagatcgggagcatattactcaacagagtcaatcggacagatatggaccggcgcactgaggcgtgcaggcctgcgtcaccggaaagcatatcagtcccgtcatacgttcgcgtgctgggctctttcagcaggcgcaaacccgaactacgttgcatcgcaaatgggtcactccgatgcgcagatggtgtaccgggtttatggcgcctggatgtcagagaacaatactgaccagctatcactcatcaacacgaaaatgagcgatcttgtgctacatacgtgctccactaaagtgacagtgtgataaaccttaacagcttcagacagttacccgcctaaacctgcatattcataatttcactatacgccgacaccagcttgttcctgacctgaatacccatctgcattgagatggacgatttctgcagatcgaccatcacgtcattaagcgcgatacccggtttccccatctcaaaatcctgcgcctgggtgcgggcggtggtctgcgtctcgctgatcttatccagcgccgctttcatagtcgcaccaaaatcgatctgattaggggcttcactactgcggttgctggcctgcagtgaggtcgcctgtagctgctgcagtacgccatcaattgcctgaatggacatgaacgataccttattaaagaggatgacatttttgatgtgagcaaaagttagcacgttgtcaatgagacaaagccgctaaatgacatcaaaaaccctaccttatccaggcatcgaattttgcttatcacctaataatgcctggcattgaagtggaaattttatctacgcaggtcagggagtctgttttgccatctcaacttacccggtcaattacgtcaggcaggaaacggtcatgaatgcgagtacagccgccacaacagaacaagaaaagaaaggcttcggtgacctgctcgctcgcctgcgcgcaaatccgcgtattcctttaatcgtcgctgccgccgccgttgtagcgatagtgatcgcgatggtgctctgggcaaagcagcccagctatagcgtcctttataacaaccttacagatgaagatggcggtgccatcgtcacgcagctgacgcagatgaacatcccttatcgcttcgccgaaaatggcggcgcgctgatggtgccggaagcgaacgtgcatgagctgcgtctgcgtctggctcagcagggtctgccgaaaggcggctcggtgggttttgagctgctggataaagagaagttcggtatcagccagttcagcgagcaggttaactaccagcgcgcgctggaaggcgaactggctcgtaccatcgaatcactcggtccggttaaaagcgcccgtgttcatctggcgatgccaaaaccaaccttatttgtgcgtgagcagaaagcgccatccgcctctgttaccttaaccctgcagcctggccgtgcgctggatgaaggccagattcaggccatcgcccacatggtctcaagcagcgtcgccggtttaccgccgggcaacgtcaccgtggtcgatcagaccggtcgcctgctgacccgctctgactccgccggtcgcgacctgaatgatgcacagctcaagtatgcctctgaagttgaagctcgctaccagcaacgtatcgaagcgatcctgaatccgattctcggtcagggcaatgtgcatgcgcaggttaccgcgcagattaacttcgacaccgccgagcagaccgacgagaaatatcagcctaacgctaacccgtcgaactcagcgattcgttcgcgtcagaccagcaccagcgaccagtcaggcagcccttatccgggcggcgtgccgggcgcgctctctaaccagcctgcgccagcaaacactgcgccggtgacgacgccgaacaataatgccgccaatggccagaacgccaatggtcagaatgctaacggtcagaacaacgcggcgaataacgctaaccagaccaccagcaccgcagcggccagtgccggaccgaccaactcgcgtcgtgacgacacggtgaactacgagctggatcgcaccattcgtcataccaaggtcaacgttggtgacgtaaagcgcctgtcggtggcggtcgtggtgaacttccgtgcagatgataaaggcaaagcggttgcgctgaacgaacagcagctgaagcagattgaagatctgacccgcgaagcgatgggctactcccagaaaccgtggcgacagcatcaacgtggtgaactcgcagttcaacaccactgaaccagtgaccaccgatctgcccttctggcaacagcagtcgttctttgatcagctgatgaacgccggtaagtggctgttgattgccctggtcgctttcatcctctaccgcaaactggttcgtccgcacctggttcgcaagcaggccgcagagaaagccgccgcggaagccgttgccgctcgtgcgactgagcaaccggaagaagaagcctttaatgtgcagctcagcaaagatgagctggatcaggaacgtaagtctaacaaccgcatgagcgcagaagtgatgagtcaacgcatccgcgacatgtcagaaaacgatccgcgcgttgtagcgctggtaattcgcgaatggatgagtaaagagctatgagtctgaccggaaccgaaaaaagcgccatcctgatgatgaccattggcgaagagcgcgccgcggaagttttcaaacacctgaaccagcgtgaggtccagcacctgagcggcgcgatggccaacatgcgtcaggtgtcgcataaacagctgactgaagtgttgcgtgagttcgaagcggatgctgagcagttcgcggcgctgagcctgaactccaacgaatacctgcgttcggtgctgacccgggcactgggcgaagagcgcgcctccagcctgctggaggacattctcgaaacgcgcgacaccaccagcggcatggaaacgctcaactttatggagccgcaggctgctgccgaccttattcgcgacgagcatccacagatcatcgccaccatcctggtccacctcaagcgtgcccaggccgccgatattgtggcgctgttcgacgaacgtctgcgtcacgacgtgatgctgcgtatcgccactttcggtggtgtccagccagccgcgctggccgaactgacagaagtactgaacggcctgctggatggcaccaacctcaagcgtgcgaagatgggcggcgtgagaaccgcagccgagatcatcaacctgatgaaaacgcagcaggaagaggcggttatcgaagccgtacgcgacttcgatggcgaactggcgcagaaaattatcgacgagatgttcctgttcgaaaacctggtggcagtggacgaccgcagcatccagcgtcttttgcaggaagtggagtccgagcagttgctggttgcactgaaaggtgccgaacagccactgcgcgagaagttcctcaaaaacatgtcagcccgtgcggcggatatcctgcgcgacgatctggccaaccgtggcccggtgcgtatgtccgcagtggaaaacgaacagaaagcgatcctgctggtggtacgccgcctggccgagtcaggcgagatggtgattggtggtggcgaggaaacttatgtctgatgcattttctgcgcgcccctggcagctgtggcagcccacggatttaggccgtttcgatgagcctgctgaaccggagctgcagccagaaatttacgaagctgaagatggcgttgatgagcagcaacagcagctcgaacgcctgcagcagcagatgcgcaaagaggcacagggccagggttacaacgaaggctatcagcagggtgtgaccgaaggccagaaagccggctacgacgccggttttcagcagggtctggccgatgcccagcagcagcaggcgccccttcaggcgcgtatgcagcagctggtaaccgagttccagaacacgcttgaatcgctggacagcgtgattgcggcccgtctgatgcaactggcgctggaagcggcacgttcggtgattggtcaggcgaccacggtggatggcaccgccctgctgcgccagattcaggggttactgcagcaggaaccgatgttcagcggcaaaccgcaactgcgcgttcacccggatgacttacaacgtattgagcagaccctggggccgacgctggatctgcacggctggcggctgatcgctgacagcaccctgcatcctggcggctgcaaactcagcgccgaagatggcgacctggatgccagcgtcgcaacgcgctggcaggaactctgccgtcttgccgcaccgggagaactgtaatgaccactcgtctgaatcgctggctcggctcgctcgacgcctttgagaaacgcatcgcccaggtgcagccggtgcgccgttatggccgtctgacccgcgccaccggcctggtgctggaagcgaccggcttacagctgccgctgggtgcgacctgcgtaatcgaacgcaacgatggcaaaaccatcagtgaaatcgaaagcgaagtggtgggattcaacggtcagaagctgctgatgatgccactggaagaagtggacggcattttaccgggtgcgcgggtctatgcgcgccagaacggagagaacccgcaggcgggcaaacagatgatgctggggccggaactgctgggccgcgtactcgatggcagcgggcgaccgctggacggcctgccgtctccggataccggttatcgcgcgccgctgaacaccccgccgtttaacccgctacagcgtacgccgatcaccgacgtgctggataccggcgtgcgggcgatcaacgccctgctgacggtcggtcgcggacagcgtatgggcctgttcgccggttcgggcgtgggtaaaagcgtgctgcttggcatgatggcgcgttacaccaaagcggacgtcatcgtcgtcggtctgattggcgaacgtggccgcgaagtaaaagattttatcgagaacattctcggcgctgaaggccgcgcccgttcggtggtgatcgccgccccggccgatgtttcgccgctgctgcgtatgcagggtgccgcttacgccacgcgtatcgcagaagattttcgcgaccgcggccagcatgtgttgctgattatggactccctgacccgctacgccatggcgcagcgtgagatcgcgctggcgattggtgagccgccggccaccaaaggctatccgccttccgtattcgccaaactgccagcgctggttgagcgtgccggtaacggcatcgacggcggcggctcaatcaccgccttctataccgtcctgaccgaaggcgacgatcagcaggacccgatcgccgactccgcgcgcgccattctcgacggccacattgtgctgtcgcgtcggctgggcgaagcgggtcactatccggccattgatatagaagcctcgatcagccgtgcgatgacctcgctgatcgatgagaaccactatgcgcgagtgcgccagtttaagcagttgctctccagcttccagcgtaaccgcgatctggtcagcgtcggtgcttatgccgcgggcagtgatccgatgcttgataaagcgatcacgctctatccgcagatggaagccttcctgcaacagggcatctttgagcgcagtgattacgacgacgccagcctgcatctgcatgcgctgtttggctagtcacacgaattaacgcgaggtaacggcaatgaaaactgcaaatgccatcgatacgctgcgcgacttagcggagcaggatctcgaacgcgctgccatctatttaggcgatatgcgtcgcggccagcacgccgcgaacgagcagctgacgatgctgctcgactatcaggacgaatatcgcaacaagctcaacgatgacatgtcgtcgggcattgccagcacccgctggaccaactatcaccagtttattcagacgctggaaaaagcgattgagcagcaccgcaaccagcttaataactggaatcagcggctggaacaggcgctgatcaactggcgtgacaaacagcaacggctgaacgcctatcagacgctgattacgcgcgcagcggaaaatgcattacgacaggaaaaccgtctcgatcagaaacggatggacgaatttgcccaacgggccgcatcgaggagaggtgaatgattacgctgccaaacattgctatgaaagcgacggtaaaaaccgacgcagaaccctcagtctcaactgaccttgctgcgggtgccgatgccctgccgcaggactttctgaccgcactgggaaaccagttactcggcctggctaaacagcagggaaaagcggcgcaatccgctgacgtcaaagcagaaattgccgatgacgcccgcccgaaagccccgctgaatgccctgatggcagcactggaaaatcctgctgcgctgaccgctctgtttaagccggaaaatattaaaggtgggtcaaaatcagccgatgataaagacaagccggacgttgcacccttaagcgccagcgatatgcagaatatgcaggcgctgttcgccatgttaccgggtgtagcggctgttacagccaccacgtcgaccccggtcagcagtgaagcgggcgagatgatcgcccagaccgataccggccggaaaagccagagctcgctgatgcaactgctgaacagcgcgcagcagagccacgcaccgggcgaagatgaaaagtctgacgccagaagcgacgtacagagcaaacctgccgtcaccactgccgccagccagagtaacaacacggcgcagagtgcgaccagtagcggcctgacgctcgacagcagtttccagcaggcgctgagcaacatggttaagcaggatgatcaggctgcgattaaagccagcgccagcgataacgcggtcaacgctacgccaatcgccaccgccagcagcctgcccgcgccggtgaccgcctccgcgaccaccagcacaccgtcaacgccgatgctgaactcacagctgggcagcgacgagtggcagcaggcgctgagtcagcagattgtgatgttcagtcgcaacggccagcagaacgcggaattgcgtttacatccggaagaccttggcgctatccagatcagcctgaaactggataacgaccaggcacaaattaatctggtttccagccatagccacgtcagagcagcactggaagccgcgataccgcagctgcgcagcgcgctggcagagagcggtatcaacctgggcgagagtcaggtgagcagtgacagttccgcgcagggtcagcaattccagcagcagcaggaggcgcgccgcgatggacaacatggccgcttctccctcacccaggacagtgacaccgacattacgccgatcgccgttcccgccgcccttcaggctcgcgttagcggcaacagcgccgtcgacactttcgcctgacagcggcaaacgctgaaggtaagcgtaaaacccgcgtcttttctacccattggtttgacttaagacgcggataatctgtctcgtgagccgagaggcttgcccataattcacaggaagtaactgcaccatgtctgataacgcgaaagcaaaaaaaggcagcaaacgtaaactcttaataccagtgttgctcattttgacgctggccgcttgcagcgtggcaggctatgcagtctggcgaatgatgaataaacatgagggcgataagcctgaggtggcgaaagttgaaccgcctcccgctccggtcttttttgcacttgatacatttacggttaacctggtcaatcccgacaacgatcccgaccgcgtgctttacgtaggctttaccctgcgtctggccgatgaggatacccggcgtcggatgaacgactatctgcctgaggtgcgcagccgtttgctgctgctgctctcgcgtcagagcgctacggcgctggcgacagagcaaggaaagcaggcgcttgttgaacaagtcaaacaggcgctgacacccccgctggtaaaaggtcaacctccgcaggctgtaaacgatgtgctgtttactgccttcattttgaggtgaatcaatgggcgatagcattctctcccaggctgaaattgacgcccttttaaacggcgacagcggcagtgcggaagaagaaaagaaacaaaacggaccggaaggcgatattcgtccttacgatccgaacacccagcgccgtgtggttcgcgagcgtttgcaggcgctggagattattaatgagcgttttgcccgtagtttccgtatggcgctgtttaacctgctgcgccgtagcccggatatcagcgtcggggcgatcaagattcagccgtaccacgagtttgcacgcaatctgccggtgccaaccaacctgaacctgatccacctgaagccgctgcgcggcaccgcgctggtagtgttctcaccgagcctggtgtttatcgctgtcgacaacctgtttggtggcgacggacgttttccgactaaagtcgaaggccgtgagtttacccataccgagcagcgcgttattcgccgcatgctgaagctggcgctggatggttacagcgacgcatggaaggccatttatccactggacgtcgagtatgtacgttcagagatgcaggtaaagttcaccaacatcaccacttcaccgaacgacatcgtggttaacacgccgttccaggtggagattggtaacctggtgggtgagtttaatatctgtatcccgttttcaatgattgaaccgctgcgcgagctgctggtgaatccaccgctcgaaaactcacgtcaggaagataaccactggcgcgacaacctggtcaaacaggtgcagcactctgagctggaactgatcgcgcactttgccgaaacctcactgcgtctgtcacggattttgcagttgaaacccggtgatgtgctgccgattgagaagccggaacgcattatcgcccatgtcgatagcgtcccggtcttaaccagccaatatggcacgatgaatggtcaatacgcgctccgtgtcgaacacctgattaacccgattttgaattcgctgaacgaggaaacagccccatgactgacagtaataaaccgtctgacgatatctctgcggacgatctgtgggctgaagcgatgaatgagcaggtcggcagcggcagtgcgccgcagaccgacgaagtctttaaatcattcgacagcggcaacgtcgctggatcgctgcaggatatcgatctgattatggatatcccggtgaaactcaccgtggaactgggtcgcaccaaaatgaccatcaaagagctgctgcgtctggcgcagggttcagtggtggctctggatggcctggcgggtgagccgctggatatcctgatcaacggttatctgattgctcagggtgaagtggtagtggtgaacgacaaatatggcgtgcgcatcactgacatcatcaccccatctgaacgtatgcgtcgtctgagtcgctaaagagtcacattatgaatagccagaatcaaacgctgcaaccggctgcaccgcacgctcaggcgatctcgaccggctccatgctggcccaggtcagcagcgtgttagccgtgattatcttattgattctggcctgcgcctggctggcacgccgtgtcggcttcgcgccgaaaaaggtcagcagccaggagcttaaactcacagccagcgtctcagtgggccagcgcgagcgggtggtgattgtcgataccgccgatgcgcgtctggtgctgggcgtcaccgcgcagcagattacccatctgcatactttgccgccgggtgaaccggtctctgtgacgccggttaacagtgcgccacaggattttcgtcagctgttacagaacctggttaaacgtcccggaaaaccacaatgatgcgtcgactgcttcctttattgccactgttgttactggcaccggttgcccatgcccagctgccgggtctggtgagtcactcgctgccgaatggcggtcagagctggtcactgccggtacagacgctggtctttatcactgcgctgacctttattccggccgtgctgctgatgatgaccagcttcacccgtatcatcattgtgtttggtttactgcgtaacgccctgggcacgccctctgcgccgcctaaccaggtgctgctcggactgtcgctgtttctgaccttctttattatggcgccgaccttcgacaagatttatcaggatgcttatctgccgttcagccaggacaagatcagcatggaagtggcgattgataaaggtgcccagccgctgcgcgagtttatgctgcgtcagacccgtgaagcggatttagccctgtttgcccgtctggcgaatactgccccgattgccggtcctgaagcggtgccaatgcgtattctgctgcccgcctatgttaccagcgagctgaagacggctttccagattggctttaccgtctttatcccgttcctgatcatcgacctggtggttgccagcgtgctgatggcgctggggatgatgatggtcccgccagcgtccatcgcgctgccgtttaaactgatgctgtttgttctggtcgatggctggcaactgctggtcggttcactggcgcaaagcttctactcctgatcccccttttcttaccggagcaacacatgacacccgaatcagtaatggtaatgggacaggaagcgatgcgcgtcgccctgatgctggccgccccgctgctgctggccgcactggtcagcggtttgctgatcagcctgatccaggccgcgacccaggtcaacgaacagaccttatcctttattcctaagattctggcggttgccactaccggtatcattgccggcccgtggatgctgaatctgctgctggactatatccgcaccgtctttaccaacctgccttacatcatcggctgatgattactctcgacagcagccagctggttcaatgggtcagccagttcttctggcctctggtacgcatcatggcgctattcgccaccgcaccgatcctcaatgaacgatccgtcagcaaacgtgtcaaaatcggtctggcggtaatgatcacctggctgctgatgccgctgttacctgcggtcaatgtcaccctgttttcccctgaaggcttcctgctactgattcagcagatgctgattggtattgcactcggcttcaccatgcagttcgcttttgctgccgtgcgccttgccggggaagtgattggtttacagatgggcatctcattcgccacctttttcgatcctggcagccgtcttaacatgccggtgctggcccgttttctcgacatgctggcgatgttgctgttcctgacctttaacggacacctgtggctgatctcgctgctggcggacagttttcatacgctgccgattggcggtcagccgctaaatgccaatgcatttatggcgctggtgaaatctggcggattaattttccttaatggcatgatgttagcgctgcccttaatcgtattgttactcatggtaaatctggtactgggtttgttaaaccgtgtttcaccacagttatcaatcttcgcaattggcttcccgattaccttatcagtcggaattttaaccatcagcttgctgatgcctctgctagccccgttctgtgagcatttgttcggtgaagtatttgatttactcgccgtgttcctgacagaactatcccgtccctgaacattaagtttctaactatctttgcataacgatacttaagtatcgcaaaaccatccgtgcattttcctaaccatgttttccagaatgcaactaaggaaattctgataaacgtgcggagagtctgaaaataattcttattaaaccgggcttcgcgtattttagtggggtggttcacaggagcggtcagactgtgaatgtgcaggcaaaatcgacaagacactgaatttacaagaaaaaaatctttaggtgatttttcttgttaaaaaatgttttttccggcattgtcatcgcacgctgagacatcacactttcgtaaaacaaatgtttttgagaattgtcctatcagaaaactccgcgttttcaaggatagtgacctggctcccaaaaaaatgagtcttacttaacctccgacatttcactggcaatccccgccatggccggagaatgtgtgacgtcatggcagcacaaattttttgcagaacgggtcagggatgaagacttttatgggcggttgcctgttgccaaactgcacgagcagaataaaaaagtacctaagaaatctctctcgtaccgcaacgcgtattcatcgttgatttaaacggataacaaattggtgagggtcgctattatgccaactattattatggattcctgcaactacacacgcctgggattatcagactacatgtcttcaaaaggagttaagaagaaaaatatctcttctgtctccgatattgagcaactacagcaaaaatgtgagcaattaaaccctggagtcgtctttattaacgaagattgcttcattcatgaatctgattccagtgaacgtatccgcaccattattacgcagcatcctgatacgctgttctttatattcatggcgattagcaatatccattttgaggaatatctctacgttcgtaagaacctgattattacatcaaaatcgatgaagacatcgaccctggattccttactcagcacctatttgcagaagaagcttaaccagtctgcgcgtatctcttcgggcatggatgtacatccattaacgctgagccagactgagtcaaacatgctgaagatgtggatgtcaggtcatgataccatccagatctcagataaaatgcaaattaaggccaaaacggtatcgtcacacaaaggtaatattaaacgcaaaatcaaaacccataataagcaggttatttatcatgtggtgcgtttaacggataatgtgacttcaggtatttacgttaatatccgctgatcataacatctgaagaaccggcctctctggccggtttttttttgcccggaattgcgatccaggtctcactcttactgctaagcctttacgctcttttgccgatgttatgccttataacaacagcctcaagagagcaaggatatgaacactgcacgagataataatggacagaaaagcgcaggcatctggcagaatctccgcctggtgccgctgtttagcctgatcttcggcggcattttgctgctgttcgcactctgtattggtgtcgccagttactttctgatttccggcaatcactccctcgatgatgccacggacgaaattcaggttcgtatgggcctctctaacagttcaaaccacctgcgtaccgcgcgcctgaccattattcaggccggtgccgccgcgcgtattggtgaaatggacgagtttcgcgccaatattgccgccgccgaaaaacggatccagcaggcaaaagatggcttcgcgatttatcaggcacgtgaagttaagacgcccgcggatatggaactggatgccacgctgcaggctcgcttcaacgattacattaccaaaggcctgataccgatgattgaatccggtaaacagggcagctttgagggcatcattgctcaggagaccgatgtaacccgcaagctggatgacgactataacgcggtgttgctgaaggcgatcaagatccgaactgatcgcgccaatgccattaccgcccaggccgatcaacagtcgcgcatcggctttatctccatggccgtggcattcagtgccgccctggtgctggtgctgttgacctttgtcttcctgcgccgcgtggtgattagtccgctgcgtcagtcggtgctgcgtatcgaacgcattgcgcagggtgatctgacctccgctcccctgccccatggccgcagcgagattggtacgctcatccataacctgcaactgatgcagcaggcgctggtaaccaccgttggtacggtgcgtgaaggcgccgtcgcgatttatcagggctccagcgaaatttcagccggcaacaccgatctctcttcacgcaccgagcagcaggctgcggcactggagcagaccgcagccagcatggaacagcttaccgctacggtgaagcagaaacgccgagaatgcgcatcacgccagccagctggccgcggatgcctcgggcaaagcgcgcagcggtggcgagctggtaaacagcgtcgtgaaaaccatgaccaatatttccggcagctcgaaaaaaatcgctgagatcaccaacgtcattaacagtattgcgtttcagaccaacatcctggcgctgaatgcggcagtagaagcggcgcgtgccggtgagcagggtcgtggctttgcggtggtggccagcgaagtgcgtaatctggcccagcgcagtgcgcaggcggcgaaagagattgaatcgctgattgctgagtccgtcacgctgatcaatgacggttcgcatcaggttggcgcagccggtagcaccatgggtgagattgtcgaagccgtacgacgcgttaccgatattatgtcggagattgcggcggcgtcagacgagcagagccgtggtattcagcaggtgagccaggcggtcaccgaaatggataacgtcacccagcagaacgcctcgctggtggaagaagcctccgctgcagcggcctcgctggaagatcaggcgggtaaactgacgcaggcggtcgcggcattccgcctgcaggatgcccctgcaaccacaggtgtggctgctcgcgtctcttcacccttaaagacaccggctctggccccccgtccggcgctggcaggcggcagcgataactgggaaaccttctgaagtcataccggtaaacgtcagcggctgatgtcagccgcgtaatctccgacagcaaaaagccgcctttccggcaaacggaaaggcggcttttttattgcgcgtcaggctcaggcttcgtggtaaggctcgacgaaaatgccatccggctggtgggtctcgttaaaaaaccagatgcccagcggataatcttccagcgccaccaggaacatggtgccttcattaaacggctccatagccagaatggtgccaacacgacgcgggccgccatcggttttgacgctgacgcggtcatttaccttcatttcggttctccagattattgactgagtacagtctaaacgaagaaccgtggtgatgcagcgcgttagcggcgggcaatgacccagacggcgtggatgataccggggatataaccacagagtgtcagcaggatgttcagccagaaggcgccgccaaaaccaacctgcataaacacgcccagtggtggcagcagaatagcgataataattcgtaagatgtccataaccattcctttaggtattgataaaaatcagctttatcgttaactatagctgaatctgctctgtttagtcgaaaagtcaggtaaatctgagtaaggagaaatttttgcaattccttaacatttcaccgcaagacttcttacgcgtcagacctttaaactcttctcactgcaccaccccataggtgcagccaacctgaaagtaacaaggattttgcccgcgcagcgcgggcttttttttgcctgcgatctcttcgctcccgcctttctgccctgcgttctatactgattactctgtttgctctcaggagtcagaaaatgacagacgaaaaacagcacggcgatgctcagccatccgatctgcagattgatgtcgaaggtttactggcggcgattcaggccagaaacgtcgggagaggtacgggagtatatggagcaggatcagacgccacggctggaattagaaggccgggttttacactcctatagcgaactggcggaggcgtttgaaattgatatttgtgattatcgcgcctatgaagcgaaccgctgaaatcgatttcaaaaaaaaacccggcgggaaggccgggtaaaaaatcaattcgttacaccagggaattcttaacacctctgtagattaccctttcccgactccgaaacaagcatcagatatgcacgtttctgcaaccgatcaggtaattatggagcgactgttaccaaaaacattgcgcccgccagtcacttagccctgcacacttcttgcatacccacttttactgcggtttcgttttaagaattatcctggatttccagccagcgtggcaggaaaaaaagtgtgagccatattcaactataatattgaaaaatcgccgctttagccgcgaatgtgatgaaaggagcccgtaaatgcccgatctccaccagccgttaatgataattaccgatctggatggttcgttactcgaccatcatacctatcgctgggatgcggccaccgaatggctcaccacgctaaagcagtacgctgttccgctggtgatctgttccagtaaaacggcagccgagattattccgctgcaaaaaaggcttggcatcagcggttcaccgtttattgctgaaaacggtgccgtggtgcaaacgcacgatcagcaccgtatccgcctgcccgataacaccctgacctatgatgctatctgccagcggctggctgccttgaaaacagcgtaccgttttaccggctttcatgacttctctgatccggaagtggccgcaatgaccggcctgagtgaggcggatgcagaactgtcgcgtcagcgcgatgcgtcagaagtgattgtctggcgcgacagtgacgaggcgtttgaccagttccatgacgcactgcgtgcagagggcctggcgctgacccagggcgggcgtttctggcatgtgatgcctgcgggcagcggcaagggcgaagccctgagctggctgctggcgcattcacccggtgaggcacgcgtgaccatcggactgggtgacggccctaacgatgcgccgatgctggatgcggttgattatgccgtcgtgattaagggctacagtaaaacaccggtgacactcagccgctccgatcagcagcagatctatcacacggctcaccatggcccagagggctggcgtgaaggacttgactattttttgactcaacctcaataagctgcccacgggcattaaaaggatgatgcgatgagtgacttttatcagaatggcgtaatcaccaactttcacaacctcacccaccgtagcgtggagtcgctggaaaaagagatggtacgctttgcccgcaaacgcaaaatggggctgatcctgccatcgctgttttccgaacttgaaggcccggcgctgacgaaaattgtcgatgagctggctaaagtgccctatctggatgaaattgtgattgggctggatcgtgccgaccgcgaccagttcctgtttgcccgcgagtttttctcccgtctgccgcaacggcatcgcattctgtggaacgatggcccgcgtctgaaggcgattgatgccgagctggataaagagggtctgtcacccaccaatcccggcaaaggtcgcaacgtctggttctgcaccggctatacgctggcgtcagaccgtaccagctgtgtggcactgcatgactgcgatatcgtcacctatgagcgcggaatgctggcacgcctgctctacccggtggcgaaacccggcgtttcagtatgagttctgtaaggggttctatgcgcgcgtcgcggacggcaagcttaatggccgcgtgggacgtctgctggtgggtccgctgctgcgatcgctgcagaaagtttatggccattcagaatacctggaatatctgtcgagcttccgctatccgctctccggggagttcgccatgcggacgcatgtgctgaacgggattaaaatccccggcgactgggggctggagattggcgtgctgtcagagatttaccgtaactacaccacccgccagtcgtgtcaggttgagattgccgataactacgatcacaagcatcagccgctggctgaagatgatggcaccggcggtctgaagcgcatgagcagcgatatcgtccagtcactgctgcgtaagctggccaccatgggtgtgccgctgaccagcgactcgttccgggtgctgaaagcaacctattatcgtaatgcgctggatatgatggagacctataaccacgaggcggcgatgaacgggctgaagtttgatcagcatgtggaagaggcagcggtagagatgtttacccagtcgattctggaagcgggtcaggcgtttattgagcgtcctaacgataagccgtttataccgagctggagtcgcgtccagtcagccttcccggatgtgctgcagcggatctatcaggcggttgaagaagataacgacggtaacgtctgaaaacagggcggcacagggagtgtgccgggccagaaaaagcagaaaccgggcctggcgggtcgcagaacccacaggcctgatgctgtcagcccgccagttgctgcgcgggattcaaagcgcagagttcatcgctgcgaaaggcttcgctgcgcacggcatagccatcataccagcggcactccaccatgccactcgcgtagccggtcaccaccatcgtctgcccctcttccttatgctgcacttcttcactgattgcgaaaaccatgatgcgctccttttattaacctgagtgttattaacctgagtgattattttctttatagcaggcgaataacgttcctgcctgttaaggcacgcaaaaaaagggcaaattcggaattaatcagctggatatgcggaaaataaaaaaagcggataaaaaaacttatccgctttgatgaagtattgacgctgacgtcagattttacagccttcgcaatcggcttcgtcgccgagatcatccggcacttcgctggcttttttctctgctttcgcttcagcctgctccagctgtgcgtcgatatcaaattcaaacatgtcgtcgttcatcgtcattctcctgaccgtaaatcacagtgcgctttataccgattttccgcgcactctggcaataaggttgaccactaacagcacgatcgacccaatgataaagccgagcaccagattggcaccgttgctgagcagcatggcgatccagccgctgaagccactgctcacttcctcgatcagatgatgcagcggtgcgatgccgtgtaccacaataccgccgccgaccaggaacatggcgatggtgccgaccaccgagaggatcttcatcagccagggcgcggcagccagcagcacgctacccaacccctgcgcaaggcgggacggtttttcacgcagccagaatccgaagtcatcaatttttacgatggccgccacgatgccgtaaacgcctaccgtaaccagaattgcgatgcccgccaggataatcacctggttgagcagcggcgattccgacacgatgcctaaggtaatcgcgacaatttcggctgacagaatgaaatcggtgcgcaccgcgcctttgatcttcttcttctcaaactctgccgcattctgattcgccagcgaatcgagtcgctgctgacgcgcttccggtgatttgctctgcttgtcatgctgcaggctgtgcatcaccttctcaacgccttcgtagcagagataggcaccgccaatcatcagcagcggcgtaatcagccagggcgcaaacgcggagataatcagcgccagtggcaccaggatcagtttattaagaaatgatcctttggcaacgccccatactacaggcagctcacggttggctttcacgccgctgacctgctgcgcattcagcgacagatcgtcgcccagtacgccagcggtctttttggccgccactttccccatgacggaaatatcgtccagaagtgttgcaatatcatcaagtaaagtcagtaaactggttcccgccaaaatcttatccttagtctggttcgttatgttgacaacatgggcagcgctcaatttccgtaacggtcatctcggcgatgccctcacaatcccactctacccgcaccgtctcgcctgctgctccttcagcatgcagatatttgctgaccgggctttcggtcatgccggtgatctcctccgtggcgacaagcctgtcgccgcagtaaacccgcgcggtcgctttggtattcaccatccgctcgtcacgaatctggtaaaggcgttttaccgtcagttttatgctgctcatttcaggctcctggccacggagaaagcgcagatctaaccaattatgtctgtgattagcaatcggcgttgtaatgatgaatgccctgatggtcgatttcggcactctccggcatcgccagcagccactcctccagccgctccagcagatcctgatccgtcaggcgcagtttgccacgtagcgcacactcccagatgatcagcactttccagccgctctcctgcagctgtcgcacataacgccggtcacgttcaacgttgctgttgatttttccggtccagaattctgtgcgcgtcgccggcagtttaaacagatagcagtgatgacgatgccagaagcagccatgaacaaaaataattgcctgatgttctgtcagaacgaaatccggccgacccggcaggtttttatcctgcacgcggaagctgaagccccgatctttcagcagcagcgcaatacgttgctcaatggccgtatcctgagcgcgaatggcacgcatatttttgctgcgtatttcgctggagtgaacatcagccataacctctccttttttgctggtccttcaactttagcctgcgccacgaaaagcgaaagccgccgcccgatgacttcacacagtgtgccgcaaaaacagaacattccggggggctgacacagggcacatccaggcaatttcctcacagcgtctggagtgatagcataggcaccttactgttaaggaaaaacgcatgcatcccgccgccctcgctgaaccactctctgctgcactttcatctgctgatgcgtctgaactctttcagcaggtgctggcaatctattcggttcgtgatctcacggcccgcctgcagcaggcaggattttcctgctggacgccggcactcctgaaccggattcgtcagggtaaaagtgccctgccaccgctgtgtgaggcggaactgtcgctgttacaggggctgctgccattccgtcccgcccattatgataatcctgaatttcgttttatcgatctctttgccggtattggcggcattcgtaaggggttcgaggcgatcggcggcaagtgcgtattcaccagtgaatggaataaagaggcggtccgcacttacaaagccaaccactacagcgatccgctggagcatcacttcaataccgatatccgtcaggtcacccagccggaaggtctgaccgacgatgaagcgatataccgcgcgattgatgcggcaatccccgatcatcaggtgctgctggccggttttccctgccagcccttttcgctggcgggcgtcagcaagaaaaatgcgctgggccgtgcacatggctttgagtgtcaggtgcagggcacgctgtttttcgatgtggcccgtatcctggctgccaagaagccgccgtttctttgtgctggagaatgtgaaaaacctcaagagtcatgacaagggccgcaccttcgccattatcatggagacgctggatgagctggggtatgacgttgcggatgcgggtgccagcagcccggatgccaaagtgatcgatgcgcgtcacttcctgccgcagcatcgcgaacgcattgtgctggtgggtattcgccgtgatctgaaaaagcaggattttacactgcgcgatatccgacgtttttacccggcgcaggtacccagcctgcagagcctgctggagagtgcgccggatgacaaatatatcctgtcaccggtactgtggcgctatctctaccagtacgcgaaaaaacataaagccaaaggcaatggctttggctttggcctcaacgatccgcgtaatcccgactgctgcgtgcgtacgctgtcagcacgttactacaaagatggctcagagattctgatcgatcgcggctgggacagtgcgctgggcgaagcggagtttcaggatgccgataacatggcacgtcggccacgccgcctttccccgcgcgagtgcgcccgtctgatgggctttgatgtgccaggacgcgagccgttccgcattccggtttcggacacccaggcttataagcagtttggtaactcggtggtggtgcctgtgtttgcagcggtggctcagctattactgccgcatattcgtcagttaaagtcgtaagcactgtgaaatgaaaaaaacccgtctggcgacgggtttctgttttatttcttcttcttgctctgcttcttcagcagcagccgaatctgcttcagctctgttgcacttagtgcatcggtcttcacgtcagcggcactggatccctcagtcccctcttcagtgatgtcctgattatcaatcgccggatgtggatgcgtttccagactggcctgcagacgttgcacaatctcctggctcatcgaaatctgattttccagcgccacctgtttaatcgtttctttcagctcaggatcaattttaattgttaaattaacagtttcagtcatcgggcagctcctttttgttattgctacacgctaccggatgaccgtttcgattaacatactgtcataaaaatttaatattcgatttgcaaaggtgtgaagtcccgcagcacaccctcatccattcccaccagattgccctgcagctcggcataaagcttcgccatatagcgtaccaggaaatctgcgttatgctcagccagcatgcggccggtttcagtgtgcatggtttccggcagacgcagcagcttcttctggaaatgatccagcgtccacttaacatcattcagctcgcgatctttacccagcgggtcctggctgtcgaataatggccgattcagcgcaccagcggtgtagaagacccgcgccagcccgatcgcgcccagcgactccagccgatcagcatcctgtacaattttagcttccagcgtctgaggcggtatgccggcgctgaaactgtgggttttaacggcatgcatcacggcatcaatcttttcagccgggaaatcgagaaaatcctgctgcagaatgcgctgggtttccgtcgcggcataggttgaggcgagatggcgttccggatggttcttcggcaggttcaccacatcgtgaaaatagcaggcggtcagcaccaccagcggatcagcggatgtaccgttcattattcgctgtgcgctcatccagacacgccgcagatgggcgatatcgtgcgcgccgtcgtcgtggatccagtttcgcctgaaaccagctttcatagcgagattgccagagtgtgagtgacataatctatctccctgtagtgatcgacagcagtttttctgtcgcgatcagtgcgcaaacggcaagccatcatagcgactggctaatgacactttttttacagtgcagttgaaaagagcagcgctgccagcgattccgggcagaaaaatgagatctggatcatctgtatagcatctctgttacacaataaccgcaatttcggctgttttcagtctttcctcagtgaattgctgctaagaaaattagtttaacaggcgtaatgtttggttcgatcttaaccaacttcctgcctcatgctcagcgtttttttgtcacgcgattaagtgtaaaactgcacgttatgacaggtgaaaaagtctgaaaaggttcctatttttacggttataacgtactgtatccgggctattcgtcgctttttgccagttgcgtgataagctttggtgcgctttttgcattttgctggtttttaactactaaagtgacaattatacagtgacagtcagcctacaaattattaagcaaaatgatttaaagcttttatgataactctcagatgtgaagcaaatggacttttacagcagtaaccgggttctactaataaaaagaggtaatccatgaaagaacggccgattcttttttccgaacagcgtgttcgtgccctgttggttggccagcaaacgcaaacccggcgcattatgaaaactcaggctttcggtccgggacaggatcatcacgagggcgtacacgctttcgatgtgagtgctaatcatctgcatggttataaaatgatgtcgatgacggacatcagctatcagtgtccttacggtaaaccgggtgacgtgctctgggtgcgtgaaacctggcgtggcccgatggtacccgagcagtatctggccgattatgaacgcgacccgacgcccttccgccagccagaatattgccagtatcgtgcagacagcaacgagctgggccagcatgcactgagcacgccggaagcagaacagtttggctggcaaaccgccattcatatgccgcgctgggccagccgcatcaatctggagattaccggcgtgcgcgccgagaaaattcaggacatcagtgaagatgacattatggcggaaggcgtgcagaccgattcgcacttcctcaacaacttcttcaccatgaacgtcaattctgaatcgcccaaagaggcgtaccgtaaagcctgggaaaaacagtatggtgcgaccagctgggaagtgaatccctgggtgtgggtgattgaatttcatcgtattgagcgcaactgacgccccggccccacgctttgcgggctgaatcacagacaacgaccgtgctaacgggttgaatagacggcccttagccctgtcgccagatgaacagtgccagcatggtgttttcgatgctggcatttttatgtctggcgcgtcaggatagcgaaatagtccggttttctgtgcgggagttgcgatgtttaaatggccctggaaaacgcataacgacgccaccctggccgcgctgccatggcagcatgggctggcgcagccgatattcagccagctggatgaggctgaacagcaggcgctggttgagctggcgcagcgctttctgcagcagaaaaagctggtgccgctcgacggtgttcagctggatgaattgcgcagtgtgcggatcgccctgctgttctgcctgcccgtgctgaaactgggcctggagtggctggacggtttccacgatgtgttgatctatcccgagccgttcgaggtggacgatcagtggcaggatgacgatgggctggttcacagcgcgcctgcggttcacgccggacagagctggacgcaggggccggtcgtcctcaactggctcgatattcaggactcgttcgatctctccggctttaatctggtgatccacgaagttgcgcacaagctggatgcccgcggcagcggttacaccagcggtattccggtcatgtcgctgcgtgacgtcgccctttgggagaaggacttgcgtgccgcgatggcggagatagagagtgaagttgaactggtgggtgaacaggccgccacgatagatccctacgccgccagcgatcccgctgagtgcttcgccgtgctctctgaatatttctttacggctccggttctgctggccgaacgctttcccgccatgtaccagcatctgcgccagttttaccagcaggatcccctggccagaatcgccgctgacactgcgcaaactgcttaaatcacgatcgctttgcgttaaagctagccagttgaatgataatgtattttttgctgttgacaccttagagcgacgccgttaatattcgcctcgttcacacgattcctctgtagttcagtcggtagaacggcggactgttaatccgtatgtcactggttcgagtccagtcagaggagccagattagaaaaacccgctcagggaaacctgagcgggttttttgcttttcagcgatcccagtattctcttcctgtctgactgttcatctcagctcgtctgcggctgctattaccgagaccaccgttaagtctggatcaacgcatgctgtatggcgcaaccctgtcatggtgttatgacgagctggctttaaataaaaaaccagccgggcaatatttgcgccagctggctcatactaatgacgaattatcactcaggaatggtcagtacctgacccggtgcaattttatccgggctgctgagaaggtttttattcgcctcaaagattttcatgtattgggatgcatcattgtaaaactgcctggcgatggcgctgagcgtgtcgcctgatttaaccgtatatgtacgattacttcctgcggcggttacagacttatcatcaacatttttatccacagcatgtaacaactcatcgcctatatttttaatattatccagaatgctcatatttactcccctatcgtttctgatacgtttagtttaataaagaaaacaggattgccaggcaaatactgctcggcgtacgatacacctgcttctaattcatgggttaaaccactgctaaacgttgctgtaattaatataaaaacagaggatattaatgatgggtatattgtcatgggttgtattcggattacttgccggcattatcgccagatgtattatgccaggcaaagaacatatgggcattttcatgaccattattctgggtattatcggtgcactgattggcggtgtagtcagtaccgctctgggttttggcaaggtcgatggcttcaatatttacagcattgctattgccaccgtgggttcaattattgtgctgtttgtcattcataaaatcagagcgtgtaaacagtcttaatagattacgttaaaggggataacagaatgagtttactggaaacagtactggccatgtgcggcctgaataatcagaccagccaggaagtcaaaggtgtgctggagtgggttgagcagcaaggcggtttacatactatcgtgagtcatctgcagagcggcgagtacagtgaggtggttaactcctggctgggtgatgagcagaaacgttgcgctgagcagcgacctggtgcagaagatgattaactctgaggcgattgagcagttggctgcgcggatgggcatcaacaccagcgatgcactgaatcttctggcaaaatatctgccgcagctggtggataaagcgtcaacggcgggcgtcgtggataaaaaagccgatcttaccggactggttagtcagttaatgcactaagcatgacgtaattgaaagataaaagcctgctgcgaaagtatgaggcttttatcttttagatttttgaccagcattgtaaggaaataattagccaaatggtttgagctgttaatgttaagttggttaaggatgtgtaactaaataatttacaaatgaagcatcaccatgatggctgaaacttcatattagcaatatgcgccagagatatccggggtgtaatgacttgatgaccattttggtcatttattgtaggctttattagccagaaacgctaaatctattattaacttagccaattcagccaccaatatatttaggcgcagcatttaaccaggatatcaaagcctcatcaaaaaatttgaaattcactcgagagtaaattcaaattctttttcgctcccttttccctggtacctatctttagttttctcaaatagataaacaataacatcaaaagtggatcccaatttttttcgggaaatggaagatttcttccaatttatacacacaccgcaagcaataccggagcttaacatatcccaaagagcatcagtgttattaccataatactcaccaaaatctaaagccttagctattacacgatggaaatcgcgttctgaatccacttcatcaccttcaattatgacattacgatacatatagcacccttattacatccatttcccaattgatgtcgccgtttcataatggtctgtagtgatatacagtaacccatctttagaatataacaagcgtgtacctgcttgccttgctctgggataacagaggcaataagaatagcccgatcaccgaggcgggaagatgggctttaaaaacttacaagtagagaaacccgtcataagtcgggatcttacattgagttaataatgttacaagatggtaataatctttcgatttcacccttatctttttcatgaataaaaacctctagttgatgccactcatcatcaacccaatctaagaacgaattttttaatacctttaagtatatacacgcagatcagagtctggaatgtctgttattgactcgttaacgatccttactttattttcactaatccaatccagatctcgtaaacaatcagatagggtgttccagtttaaaccaaaatatcctggaaaccaaagtaattaataaagtgatcttagtaactcgtcagtatcagcgatggctagatccaccctagctcaaaacgccttaccatcttcataacatacagattcatcaaagaatttaaattcactcatcacatcatcacctgatttttatgaacgtcttataatgatcattcgtataataagcctcaccattttgcccaacgatgattcgctgaggtcctggccctggtatatccggagttggatgaacatattctttatagtatccattaggttgcttgggcaagccagatattcctgtcgtgcgattaggatagtttctgaatactgaaaaattatttttatgtggatactttccgccactagtaattcgattaggtgtagttttaaataaaaatcctaagtaaatatccccctaatacatctacattattattaatatttattaaaaatagcagactcttgatttgtattgaatgtttttgtcgatcctttactactgccagcaacaatgccgcttgctcccatcacattcctttcatcatccataacaccaggctttattgcatttaatgcaatgaattatgccgggcgattgccatgttaatagctgcaactcaacataatcacttcccagaatattatttcctattacattgtttaattgctaataaatacaattacccaagttatatacgccagtcttgatagccaaagaaaaatcgagccaaaggataggtctgactttgtcaaaaaaaccttaatgaaataaaatggtttttcatcatcagttaatccttggtgaaaatactttccatagagagcaaggagaagaaatgaaagacctccggacaaattagatatcaacaataagttatcggcctcccttctatattcagctatcgctgccgccatatatccaagaacaagaaaaaccaatgcgcaatttgataaaaaatctcgtttaaaaaacatataattgaaatagagcaaggaatccttacctaccttagcgccaccaagattcctataaacaaaaataaaaaaacacccaccccataaaaataaaaaaaacaataacataaatgatgacgtatttaaaacaatatcatttgaaatcatagtgatatatttccttagtagagtcaccgttcagatctattttttcgtcatgagaaccagtggcagaacctgtaaaaccaatacttggtccaatagaaaaggaaataccaattccatcttttccgccagacattcctacagaaccgggaccaaaacctatgctagttgaataatcacgatttaaggctccaaacaatcctgggaaatatgggccaaagtcaataccgatcgaagctccagccttaataccaaattctttagtgtatcctgaagaaatagataagtaatcattattaatctcagatcctcctttcaaagcaagtcccacaccacctgaaacctcaacttttccattaggtttaaccttatactcagtaccccaggaaggcccttcgccaacagcaatacgattcagccctgcctgtttctgctccggcgtcagaccattaacttccgcatactggttccaggattttactgccgcaccgtagctgttcatccccgtaccaaagctcagcgcattattctcaaccgcattcttaccggcaaccgccccctgaatcccaccttcaacagaaccagaagccactcccgccgacagctgcgcagccagctggccgagtgcgctgacaacctgtttttgttcctgcgtcagtttcgctggcctgcttgccgggatacattgagttgaggatagctctggccatcagttcgccacccgcagcaccggctgcacccgctgttgcgttgttgcccgccagctgcgccagtacggcacccgcaaccgcgtgcgccatggtgttagccaggacgttagcctgctcctgtccgtcgacaactttgctggtagcttgcttaattttattggcgatatatggcgccatcccaccggttgcggctgcaccgaggttacctgcgccaaggccacccagcacgcccgtcacggctgcgatagaaaagctgccgatcaggcctgatttttttcctcgcgctgatgcacttcaggaagaagggataagtgaaatactgctcggaaaaaataatccgttttacagaggtgcctcgcagtttattatccggcttgcagcgagtttatgcagcagaaggtgtatatttaaacaggttaaaacggaacaggaagagcgtaataagcgatttttagcgcgactgaagcgggcggcaacccgcagcagccgctgaccacaactaactatacgggagttaattatggctgacatgcatcataagtcaggaacccgcacggtcacaaccgccgcgcattattacaaagttggataccggcctaataggggccagccgaacccgctgccacagctgaccattaaaggccgctggctggagccgctgggctttaccactggccagcgaatcgaggtgatcaccgagccgggtcagttgattattcgcatcgctcccgccatggagggaaacgcatgaacattacctttacctctgagccgatcccggaattgatactggcaggcggcgcgttggttgtattaggatttaccagcagcaccccgttacaactgacgcttcagcagcacactctggatcactacacccaccgatgcggccacctgggtataactgtgtgagatcagccagaaccggcaagatataggagcggattggatatggcagaaacggtgaggtgattatttgcagcgactgacttacagagtccgacattgccagcgctgaatcactggtagtgaccgccgcacccggtgtactccggttgcagcagcgggaagtgatgattttagggcttagatgcagtaaccccggccattcgtcggggttactaattttagtaccttaggcctgatctaacagtcaccaccattttggataattattaaacgctgcatagattgcagactttgcatcgtccgttaacttttctctgctttttgatactgtagtatatccatgcagatcttctttagcgcatgaccattcaagccatcctaaaactggatttaaaatcaactcaaaacatccattcatatctttaagatgagctatatcaccattccgcacattgtcgataaattcatcaaagcattgacattcaatccatgcattagagctgacattcaagctataactaaatttatccacttgaatttccaggttaaattttaatgatggaatatgttcatcaagttctattacgtccaacatgatattgatcggacttgtaatctctatatccacttaatttgctcctagataacgagcgtgaatgactgttggcaactcaccagcagcgcggaggtttgatttccagttgccagccatcgactgttatacgcccatatgacataccgtccttagtcgcggtatctaacgcagcttgaaaaattctgagttctgtctgactggcaagtcttactgcttctggcgttatttgttaaggctttagatgcagcatattctgccatgtgttctgtagcattcccatgtacccacactttttgaccgttaggcagtgtcatttcaaaagatttcggtatgacagaaccaggataaacaggttgggttccttttatagaatcaaatacagcatcagttttacctatatcagcagcaatagactcagccttaccaacaaatccatcaggtaatttcttcccgggcaggaacagccccgccaacattccacctgttgcctccagtgcaagctggttaccttgagcagcttccttcacctgcccagcaacagctccccaggtttcactcttcatcagagctttcagcgtatctgccgcagcctgatttttactcgccagatcgctcaatgcctggatacagtagctatcacccattgcgcaggtggtaagcgccattgctgcatcagcaccgtaatctgccccatctaataccgcatcaccagtatccgccgccgcaccgataatgctgttaacgatagcagagagtttaccttcgccaagcttgtttcctgacctgatccttcatatttccagcagtctgcttaacagactcccgggctttgtcaccggacagcgagttattctccgcctctatctggcccgcagaagccccactacccaccccagcgctgccatcaaccgcaccgcccgctgctgcgcctgccagcgttacaatgttggcaatcagcatcttgtcatcggctgacagttccgataccactttaccgaacaacaggtgactgagcttgtcgttatagctgagcatcacggcagtcggttcgtacctatctaaaagtgatacctaaagtaaatcagatgaatattttttcaaactcgcaattatttcacttatctctttttttggaatggtaatatcctcaaggttcggtttttctatgtccacccaggttcttccgttgtctccgttaactaactccgttattttacccccaataaccctcactgaactttcatttgcaatagcaaaaaaatatgcccctgattcgttaatgattgtagtagacgcgcaaaaatcaaacacttgctcaggatattcatcatcatgtgtcgattctggatatgtcagtttaaataaggcattaaaagcttcagttgtagtggccttgaagatctcatcattgcatggaaaagaaagaagagcatttttttcatcaataacatcataaacatcaacagataatgttgatgttctgatatcttctggatacatatgtccatttataaaaaaataaaaaaaaccatttttataggattgactccattgaggaatacactctatccagatagcaaaccgataaggatcaccgaaaatcatatttatctccatttcccaggtaacccaaattcttttttaacagcgttgggtatatcgctttttttgattaggactgatgcatcccccgtgctccctgaccaatgccacgaaccatcatttgtattcgtaaactgatgtacattgccattctcgtccaatgcatacctttcttaccattctctactgaattactaaacaactgaatagagtttgtaggttcggttccagcgtttctattataaccggcttgcccaggcgtatgtttaccattcgattgataaactagcccattttcagctctggttgggataggaacaggcatcgcgcttcctttatttttcccgattcccgctgctatccctgccggctggtttccaactgcctgagccagagagtttatagcaagctgcttagcttctggcgagtcccccgacgttaatgcattgtgaatagcagccaaccgacccgcttccaactgaatcgaagcacccagaaggattgatatttcgtactattcaaacgtgtttaagttgccatgaaggcgggattgttcctttcgctcatttacgcaattgtcataatctgcaaggggcaacgatcagtgcgaggcgtcagcgggtttgaacgtcagcacgggtggcaaccaatgccagcacattgcggatcctgccatgatcatttactggtgacccacgtgtttgggtgtcggggtgtcgctctgatcaaggcgttttggagggccgccataaagcggtactgaaaaaaaatcttgtctgaaagtaataagcgcaggacatacaaccccggctcaaaagccggggggttaatcaatttaatactgaatatcagtttgattgaccattattttactcagggttaacatcataacgtgcatcctgaataatgtaaggttctgcgacatcttcccatacaaccttcgccatgttttgccattcagtcgggttttgctgctttgcaatataatccctgattagcttaacagcccggttaaagtcagccttatctaactcaacaaacgaataaaatttcagatactcgccttcttctgactttattatttcatgcagcttgggatggttgggtaaaaaaacaccatccagcaggtcgccaaaagcatcccaatagctactatgtataaacgcagaggtaagtctactctcaggtttttcgatagtttcatctctacgaaaaaaaatacttgctcccataccaattacctcatgatgataattttatcttgctgtgctttaggcaatgtttttatataattcataaaaacattttgattggcagacgttagcactctaaaatcgacaggaacaaagtcagctttttgcaagtgttcctgaatgactttttgcccatttcctgaaatcatgtttttttcataaaatttgtttaatccgtctatttctttctgtgacagcctgtctgtcgtatacatagcatcgacggatttacctttattgggacccgacgtaatcacaaagtcaggtgttttatcagtaatcatccctggtggtggcgtataacgctccattgtaccaagaacaggctctaattgtgccgcggatgcggcttctgccggttttagtttaccgttgccccccacatccggtgtgttaagtcggccatgcccttcaagtgatgtgacattaacatttacttcgtaaataccatctgtattcttaaccagcttttctgtttttcccagtacagcaccgaactccggcactttcttaccaggtgaaaatatgctcgccaatattccgccagtcgcttccagcgcggcctgattgccaccagacgcctgtttgagcgtgtcggctactgctgaccaggtttcactcttcatcagcgctttcactacatcggctgctgcctgatttttacctgccagatcgcttaaagccttattacaataaccatctccgacagcacatgacgccagtgccatcgctccatccgcaacataatctgttctacctaatgcagcatcaccagtatcagcgacagcattgataatactgttcgcgatagccgatgtagtgccgtcacccagcttatcgcgaacctgtttcttccaccattccgcactttcttttactgactgacgggctttatcaccgctcagcgagttattctcaaccgcatttttacccgcaattgcgccgctcgtcgccgcagcactgctgttgcccaccatgccgcccgccagtcctgccgccagcgtgccgagcaggctcagctgctcgcggtcttcctgccccagcgccgctatcttttccggggtatctgcaccccagtacttctctgcgatgtagcgggtggcaagctcgccgctgaaggcacctgccgcacccgctgccgcactcccgcccgacatctgcgcagaaactgcaccccacacggcatgggccatggcattggttgccacatcaacgttgccggaagcgtcagtcgtttccttcttaatcagctgagctgcccacggattaaggccacctgcgaccgcctgacctgcattgccggtcaccagccccgtcagaatactgccgaccgtctgtgcgaccttctgagatgtactgccaataccccactgcttcatctccgcctgatactctggcgaatcacgcattttctccagccactctccccgctttttttccgttgctccggcgggcagcgtctcggcgtttcttcgcactctgcgccttctcaagccctttgatatcgcccatggtcgtgacgatatttgtcatctggccgctgatttcaccggctaactgagccgtctgaagccgcttctgctctttctctttgtcaaagatcgcactgatgctgtcgttggcatgttctgtgtcacggctgaggtctgccacatcctgcttctggttgacccggtcgcgaatgatcacggtgccgtttgccaccgccgactgcgtggtgccttcggcatggccgttgttgttcaggcccgacagcagcgtgctggcggcattggacgccacgctggacagcatctgcgcacccatgccgccaccgctggacagcgcgatgctgccgccgctgtggctgaccctgtagtccgccgcattgccgatatcggtgaagccgagcgtaccggtatccagacggttgtctgccgcatcgccctggctggcaatcactgcaccgttcagctgggtatgattgccaacggtgatgtcaaagccgccgttaccggcatagataccgctctgctcctgcacgctgtcaaagttgctgtgcattttgtcctggttgacgctggcatagccggacaccgacattgagccaaaggtaaagctgccgcccgcgccgtagctggtctgttttgaatcgtaacgttcgctgtcctgctggctggtgatggtcagatcccggcccacatcggccgttacctgattaccgctgacctgcgcgccgttgagcgtggtatctcttccactgttcaggcttaccctgccgccgctgtccagggtggtctcagaccagcgcgtaccgttgccgctctccttacctttggcgccgttaacgctggcaaaaatgctgatacccgcgctgccctgtccggcaccaaaactgatgcccacgccgccgccgctgctgctgtttttaccgctgctttcctgagtgttggccgccccgctcagcacaatgtccctggcagcattgaggctgctgtcacctgcggctttcagctggctgccggcgataagaatgtcgccgctgtgctcgccacggcccttaccggcagaggtaatggagaggttcttaccggcattgagcgtggatccggtgacgctgtcggacgcctgatgctgctgcgattttgatttctgtgtggtcagggaaaggctgacgcccaggccgttgttgggatcggcgctcgcttccgccagttgcccgcccagcacggcctgcacgcctgaaagcgcggctttggtagcctgcagggcagcaaggcgaccgtcactctcttttttcgatgtctgcgccgccgcaaccgcgttattaatggcttcacccaccaccccggagagcgccagtgtcagcccgctcttcttctgctcaaacagttcatcatgagtccgtttatcatgacccggatcgatgatcacgctgtcgccggtaatggcgagatcgcgccccgccaccagatctgagccgctgacatgagcctgtccgcccgcaataatgctgacattaccgcccgtactgcccacggtgctggcactctggctctgggtggtgcccttgtcacgtaagtcatggaccgatttactgctgcctacagtgatgccgatgccaccggttcccatcaggccgcttttcttagtttccgtgaaacgccaggttgagtccgtgttggtcgcagcaacgatatccacgttgttaccggccctgagcgctaccgtgccatcgcctacgacctgagaaccctggacaagtaaattgttgcccgcattaagcgtgacattatcgccgctcagtaaggtgccattttcacgggtgtcactgtcttcgctgatggtatgcgtggtctttttactcaaaaatccttttttggttttggtctcttctttgtaggcataatcgctttcagtggcggtggtcaggttgatgtcgcgtccggcacccactgcgatattaccgctggccgtaacctgagccgcttcactgttaacatcctgacccgctttaaccgtcgtactcccgccactggcaatttcagtgccctgctggcgtaccgactcattaatctcaaccttcttgccggatttgtagctattgccagaaccggtttcagccgccagcagattgacgtcacgtcccgccagcaaggtcacgtctttgtctgcggcgatgcctgccgcctggctattgagatcgcgtccggcctgaagtgctaaatcgcctccactggtcagcgtcgtgcgatccagcccggttgaatgggtttcacgtttacccttcacatcattctggctggtcgtcgcgctgttgagattaagatcgttaccggctgccagcgccgcgtttttaccggcgctgatgttgctggcggtaacagtcagatcgtggcccgcctgcatcgccatattgccgcctgcggcgatctggctgccgactgtggtgacggtggttgtgctggttgggtcaactttttgccagcggtttccgaagccggattgcgcgctgccagtgacgttctggttcccggtgatagcaatatcattccaggcgttcagcagcagatcgccacccgctttgaggttagcaccggtgacggtaatatcgttgcccgccttaaggctcagagaatccagtgacgtgatgctcgccgttggcccgctcagagtttcggtataggatttcttcgcacccttaccgttgtctgcatccagatgccagagctgtgatgtggtcaggttgttgatgtcaccgttaacactctccagtgccacctttttaccgctgatagtcgcgctgacgttgttgatatcattcagtgcgctaagttgcagatcgccacctgcatggagcagaccggcgttgaggttactgagcgtgttctgactgtcgatagtcagatcgtttttagccatcacgctactaccggtattggtgatgttcccgcctttcagcgtcacgttgttaccggcaattacgctgccatcgcgcatctccacatcttttgtcgacagatagagcttcggcaccatcaccgtttcaccgttgatggtggtggcttcccaccagaccatactcttgtctaaagaggcgagttgcccggcagagagtgagacaccaaactccagtcccagcgactgctgcgcagccgcagcgttgtccatcagatagcgcatctgggcgagatcggatcccaggccattgatgtagcgattaccggtctgatttagtaccgcattactgacgtagcgggtatcaaacgccgcatcaccgagaaaacgataatcataatctggcttcaggttcaggcggctcagcatgtatgaggagccgaggaaggcgttctcgtctgtgtattgaggccgcgtttcctgtaaaggcgtggtggcaggctgtttgcccagttttgcgttcagctcgccgaaacaggctctgatcaagctgacccaggccattaagtttggggttaacggtaatcagatagcggctattggtgttcgacgcaacaaagtagccattttcaccagaaggtaatggataggcgctgatatcaacctcagcgaccttatagttatgcagcgacgcaggatcctgagcagcattcgtcaggttaatggctttacccagcgctgcgttgtttttacccgcagttgcatattgcgtcagcggtgcgctgccctgtgatgcggtctccagcgcacctgcgctattgacctgctgcaaggcattctggagctgatcgcgccattgcggggtattgattgcggctttgtcggcggttgccagttgctgatgggactgcgcgcctgcggtgcctgcagcagttaagctgcgtaaagcgggggccgaaagggtattgccgctccagccggcattcgctgtggtgttggtgttactgatatcgccgctgaagttagctgagacattgcctccggcctgaataaccgaccggtatagctctcccggtgtgaaactcgtcccttgatcggaaagtttatatgtaactgctcttacttttggttcattaacgcctctgattgatgcattgacgataacagaggaggtaacagaattgtatgttgtgctcttataaggttttgaaaaatcgaacagacgcccttcatacttataagtcaaatatgaagtttgtgtcccagcctgccaggattgattgttaagttggtttccagagagagatatatctctctgcgccagaacattactggcctgattatcaaacgaacctgcccttatattgatatcacgtccagcggctatacgagctgcaccaccattacttatcacgtttatagtggtgcttgataataaaatattccttatagctgcttcttttgttggtgcatatgtatatgttgtttgtgctggagtacaacgctccccattacctttcccatatgaaatacaatctttgtcacggtgataaagaaacgccccatattcacctggttttaaatcagagattaaaacacttatttgaggtttggctgaacccgccgggcttgaagaattattagtttgagaaacactcaacccatcccttgtattcagcaaatgtcccgtattaatcgtgatatcgccgttctgcgtttcgatggtgccggagttattaatcacctcgccgttggcgttccctgccgcgtctccctgaagccacatactgccgcctgccagcatatcggcacgctggttgcggatgctgttggcaaaaagagagagattgccggccgcatagagcagcgcgttattgacgatgctgcccggtgcgctgagggtcagattgcccaacgtacccgtaaaaccatcaacagtgatatcgctgcggctggctaagttaatattcccgccgccctgcagactgccattcccgttcatggtgatacggttgccgctgaacgcactgtcacccgaaccggtagtgagctgaccattattagtgagatcgccgcctgcgctcagcgtcagcacgccgccctgcatcgtgccctggttgtctatcgcaccattactgctgacggagagtcgcccgcccgcagccagcacatcgcgaccggtaaaaccattcgcgatctccagcgtggcatcacccagcgccacaacctgaccggtctgatcaaagccattgctgtgaaccagcaaattgccgccactgaacaggcgcccactgctttgctgattaacctgagcgcccatcacgctcagtcggttgttacccagcagcgtgccgctgttgtttacctgctgataattaacctcaaggttgccgccctgggctgtgccctggttgctgaagccattgccggtcagcgtgccctgaccgtcggccagcagcgtaccgttattgctggcattagtcgcattgaggatgagttgagacgcctgtaaccagccgttgttattcagctgcggcgtattcaatgtctgcgcgccacccgagagccaccggccatcgttttgcgttaaaccggttaatgtcgcgacaccgttgccattgccctgaatcaggccatagttgaacagttttctggcccggtcagcgtcagggcgttttgcgtgatcatggcgccattgccgccgttggtgatgcgtccaccagcattgaccagcaggctgttgtcaccctgtaagcgcccgttgttatcaaccgcgcccgtggtgatctgcaggtcgccgccctgcacgcgtccggcattattgagcgaggaggactgaagcgtcagcctgcctgcgctgagcagcgttttatcctgctgctgggtcagtgcaccgttaaggccaaccgtcagcgcgtcgacaccggtgacggcgccgttattgtttaacgtgtcgccccgtagcgtcaggtttctggcaatccattcaccctgattggtcagcgtcagtgcctgcagtgccgcagtgccattcgctgagatcttactgccagcgcccgcatcaaggcgatccgccagaatcagttgtagcgcatccgcactctgaatcgcgccattattggtcagttgccgggcattcagcaggatctgctgtccctgccagttgccgttattcacaacgtccccgccgttgatgttcagcgtgccctgcgtcagcagcgatccgccctgattattgatcagctgacgtgatggcgcggccagcactctgagcagcattcgcccggccacctgtggcgcagcggcaaacgtcaatgcctgcagaccaatcaggctgccctgattaatgacgctggcgggtgaaatggtcagggttttgccctgcaccgatccgctgttattcagcgcggcaccgttcagcaccatcgccccttcactgagcagtgagccgctgttgttcagcgtgttcgccgtaacctgtgcagtgttctgactcatcaacgagccggtgttatgcagttcattgctgatgctggcgttcagatctttactgcccagcagcgatccctgatgcagccagttgtcagcgttaaccgttgcctgctcgccctgcagcgttccctgggtgttgagctgacctgcggtcagcgtcagtgttccgccgctcagcattttgccaccagcagattgcgtgacgttatcggcctgagcagtcagcgccgtgttgccctgtaacagaccgtcgttgttcaggctggtgccctgcaaccccaggcggtccgccattattttgccgctgttgcgcagcgtggtggcattcaggtcgctattgccctggctgatcagcgtgccgctgttgatcagatcgctggcgatgttaccgcgcaaagcgctgatgccattgaggctgccgcgattgtcgagagaatccagcgtgacgtcgagttgctggccctgccagctgccatcattgatcgcgctaccgcccttgatgatcagtcgatcgccgctcagcagttgcccattgttgtggttgagggtctgagcaaatccgagatccagtagcgtgtcgccctgaagcagcccgctgttttccagcgtattaccgctggcgctgagttgctgtgcagcaatctggccgctgttactgagcgtttgggcatgcatgtcggcctgctggccggtcacgatctgtcccgtgctgctgttattcagcgtatcggcaatctgaaggtcgaggtcatcgctcagcaggcgtccgctgttgttgagacggttgccgttgactgaaagcgcaccgttaacctgcagcagcccgtcgttatccagttggtctaacgtcagcgtcagcggtcctcctgcgattaactggccgccctggaggttgtggagttgctgatgctccagcgttaaggtgctattgccctgcagcagaccgccgttactgagcactggcgcatgcaggctgaggttatccgccgccagtgtgcctttgttatcgatctccccagcttgtaaattcatctgctgctggctgatcagacttccgctgttatccagcacacccccgacctgggctgtcagtgcttttccggcgcgaacagtgccactgtttctgcaacgccttcgcgtttaacgccatctgatcggcctgcattgcgccgcggttattcagtgaagtgatgttgccattcagggtgccgtcactcagcaactgcccgccctgctgattatccagctggtcgccttccagcgtaatctgctgattgccctgaatcaggccactgttaatcaggtcgccccgcagcgtcagcgcctgggcaatcagccagccgctgttgtcagtgtgattcgcttttagcgcgatgccctgttgtcccagaatcttgccgctattgaccagcgtgtcgctttgcaggtcggcgtcggcttcactgagggcattgccgctgttttgccagcggtcagcattcagtgtcagctgtttgccctgcatcagtccgctgttgtccagcgtctgctgttgcacattcagctggcctgcgctgagcagcgtgccgctgttggttaacccgctgccctgcaacgataatgccttgtcgccctggagtgttccgctgttattgatctggctgacatcgctattcagcgttgcggcggcgatgatgccctgattagtcagtacatcgccgtgcagctggagtgggtcactggccagcagtttgccacccagctgattatccagatgcccgtaccgggcgctgaggctggcagcgttgatttccccgctgttgttcagctggtcgccgctgacaaccaatgttttgccgctggtgatcaatccgctgttattaagctgtggcaaatcgagcgcaaaatcgttgtcggagctgatcgtccccgcagcaaggttatccagctgtccggcatgtaaagagagctgataagagccctgaagcaggccgccgttactgatttgcccggtggtcagcgtcagattcggtgcggttaatgagcccatgttacgcagttgtgcactgttcaggatgagtgcgttctgactgctgatggccccctgattttccagcctgccacgagcggtcagttgcgcgtcaccgcgtgcagtgatggagccgttttgttgcagcgtatcgctgttaatcacggcatcgccatgacttaccatctcgccactgttattcagggtcggggcatcgatttgcagacgctgactgaccagattgccgctgttgctgaaggtgtccgcaacactgaatagtgtgttgccctgtgcggagaagatcccgtcctgattcagacgattagccgtaatcgtggcatcacccatactgatcagtttgccgctgttatcaagagtgccgctttgaatgttcaggctgctgccgctgatttcatcgcggttagtcagctgtccgctaacagccaaagtgtttttaccctgagccagcagcttaccgtttctgttgcagagtgttagtgcgaacctgcacgtcaccattactggccaggctgccacggttagcgatctgtgcagcctgaatatcgagtgtttttgcggcggcgagctgaccggcattgtccagctgagaggtggcagagagttgcagcgcgtctaccgcactaccgctgctgctgttatcaacactcaggttagcaccgctgagacgcacattctggcctgctttaacgctgctgcctttaagcgtgatactgccctgactgttgagatccagcgaggcgtcgctgcccagcgaggccccatttaaggcaatatcctgctgcgctgtcagtgcgacgttaccacccgctttatgttcgccttgcagggtgatgctgctgccttttgcagtcagggtgccgctggtcaggctattgttgatgcttaaccgaccctgcgcatccagcaccatatcgccctgacgggcattaagattgccgagattgacgccaacgccgttttcgctggagaccagatggatgcggtttgcgtacatgccgcccagcgcgccggtatctacggcaaccgatggcgcagcaccttcgcccgtgatgggtgtcacgctgccatcagcaccgacccggtttgcgcccagcgtcacattaagatctttggcatggatgcccgcgttgatttcggttgcgcgcgcaatgatcgagacagcatcagcctggctgccatccagtcctttaccctcaatgctgattgcgcctttcgtcacttccagcgattgcagattgccctgcgcatcaagctgcggtttaccggtggtcagcgtaacgttgggcgtattgataaagccgcagccgttacaggtaatgccataagggttagcgaccatcacgttggccgctttgcccgctacttcggtatagccctgcagctgtgaacggttggcacccaccacctcattaataatggcccgggcttcctgcccagctttgaggttcgggttgttctggacaagtccacccagctgggtctgcgtcaaccggccggttgcgttgttcaggatcagcccttcctggcccacgttgtaattctgatactggttatgcgacaggcccgccgcattcggcgtcgcgatattaatgaccggcacgccattcccggcagcatcgacttttgttcctggtgtgacgggcgctatcgccgcagaaaaggcgggcagcagtggctgaaacgcgatcagcgagcagatcagatagctcagcagacgacgcggcagtgaaagctttaattgatcatccataatcggggcctttgtttaaaaaacgagtccaacacgcgcgtaaacgctgaggcgatcgggcgcaagataattggggtagctgacagggatacccagcgacagctgagtggagacatgcgcgttacgggtgccaagtcccagcgaactgccccacagcgtgcctgctgcgtagcggtcctgtttgtcgctctggagccacccgccgtccagcgccagggtggtgctgacctcgccgattacaggcagggtaaacagcgagtaattcagttcgttacgcagatagccgccaacatcgccggacaggtattgctccttgtagccgcgaaccgagttctcgccaccaatcgtcagacgttcgctgccatagaggcgatccggcgaccactgagcgtaaaagctgctgagccaccacattttctgagtgactggccgctgatagctgctgctgacgctccatttgcggaattcagctttcggaaaatcgtcgcttttacccttgtcgctttccgcatcaaaccacggcatcccgcggctcagcatcgggttcagggtggccaccccacctgcaattttttgcgtatggttaaaaccgatctgcagactggtcagtttgcgactactgctttgaagcagggtctcattcagccagttatggctgacataatggttcagcccaacctgaaggccggttttgatttgcccgttgcggaacagcacccacgagccgctgaggcggttagagatgttgtcgccgttgctataccagtcgaaactattggcgttaaagcggctgtgatagttgctccagctatagctgtaatccagcagcccatagccataaggcacgctgacgcccgcctggaaattttgcgcatcgcgccagtcgctgaaagcgctgctgcgaccaccgctgacaaaccagcgatcggcaacacccagcaggtcattacccaccagcgagccggaaagctgaccaatgccggtgcttcgctggccgctattgtccatattcagccccagcgtcagaggaaactcgggtgtgctggtcaggttgacaatggaatagcccggctgagtcgatgggatgatttcaatctgaaccggcgtagtacgaagccggtttatctgctccataccctgttcaatgtcacgtaaatttaaaatacgacctgcacgggtcgggaacgccatgttcagctgacgtgcactggcaccctgcaaatgaatcgcctcaagctttccttccagtacggtgatatttaacgtcccgtgggaaagattctgttctgtcaggaaggcccggctggtgatatagccgcgctggacataccactctgaaatggcgcgtaccagctgattaatacgatccagactcaggcactgattgatatagggagcgacaagtctcttctgtgtatcaggcgtgattaagctcgcctgttgcagtgaaatctggttgatttcaaaacaggggccgctggctggcgccgactcggttttttgcagctcaacctgatgcgcctgtgttaatgcgtcacgctgctgctgatcctgctgcaaccgctgctgctgctggttttgaataacgtcaagatcacccggcgtgaccggtgcagccatgacattgctgataaacaaactggctccgaaaaccagccacttccctgtttcaggcattttcatcgaaggattaacaacgcttattgtaagttttgtgtaagcacaggcgtgcagattaccaccttaacaatcggaagttccttattgacttaaaataatgatgtggttttacaaaaagtaaaattagcggtgataaaacgttttttaagccaaatttgtaatgacttagccactttctttgtgcagagctcatttacgagtgttaagggaatggatgttaagacgtgcactgatgaatatagatccgcgccggattactcattcatataacggcgctggggtattaagtgggataaaaaataatgatgttgctgcttttcgtggtgaagcctgctggctgaaatgactagtgcactacagatgcaaaaaggcccgcaacgtagcgggcctttaaccagacaacacacaacaaccattatttttcatggtagcgatgcactgccggataatattccagtccatacagctggctcagcggcagcagcagttccacgttaatatcatgcacacgttcactcgccacagggccgctcagcagctgttcaaaccaggctatcagtttctgtttcatctcaggctctccgcatcagttgatgccctgagtaaacccgcttacacgcccgatcagaaccaaaaatttctgcgctgcttatgccggaaatggcataagcagcccccatctgtttagccagtgccatacgccagcggctcaaaacggttactgcgttatcagcgtcacccagttcgcgcctttaccagccggggcttcagcaacccgtttgagttcgccgctggcgggctcgatagcgtaactgccaatcaccgcgctcttctccccgctgacgataagccatttaccctgcgcatcaatcgcaatactgcgcggctgtttttcaaccagccagctgccgataagtgttaactcacccgactgcttatcgacccggtagccgctgacggtgctggaggtgcgctcggtgacatagataaaatgtccgtcaggcgtgattttgatgtctgctgcccagatacgcggcgtgggatcgctgtagcccgccgggcgctgctcgccatgctgcaggttatatttcttcgcaaccgcattcggccaggttttcagctccgtcagcgacccatccgccgcgcgacggaaactgcgtaatggtgccgctcatctccgcgaggttatagaggaagcgattgtcgggcgaaatcaccgaatgtcgtgcgccgctgttcttctcgccctgaacaaaaccggttcccagcggcgttatcgcgccgttatcggcaaaggcatattgcagcacgcgatctgcgccaaggttgccgacgtagagggaatgattgctgacgtcggtgatcaccgaatgggcatgcggcccggttttcacctcgcctgtcacctgtggtgtcacaatccctttgtcatcaatccggttgctggtgacgatatcgctgtcataggaggccgccagcagatagcgcccacttctgtcggtggtgatccacggaaagctggctgcaaccggcgtcaccgccagtttctgcaagtcaccgtgcggacccgagacgcgccagctgatgatcgaataaggcggactccgcagcgcaccatagagccgtttaccatccgggctggccgccagcggcataatctttttaccggcaggcgtatcgccacgccattgcaggctgccattcgcctcgctgagctgatagcgggaaacggtgccggattcagcattggagacatagacaaaggttgtcgcccataacggggcgctacacagcagcggcaggagtgccagcgccgttttcagacggatcatagggtcaccttgataagtagtgtctgcatcattgcgcagcaggcattacgctaaccctgtccggggaggctggctttgtgcaactgtctgaaattcggttcgaaagtctggagatgtgacggagatgttatttttaatggtgctgaaagaggtaagacgcctttccccacggcgggtgaaaggcgttaacaacgcgctaaccggttttcgcgatcatttttcgatagcggttgagccacttgccgctgttaagtcgccaccagaagaagatgccacgcaccgtccagtcgaggaacatccccagccagacaccggtcacgcccatccccagttcaataccgagcaggtagccgaccaccacgcgggcgccccacatgctgaacatcgacacatacatggtgtaacgcgcatcgcgtgcgcccttgagtccggcaggtagcacccaggaagcggcccataacggcataaacagcgcgttaagccagatcagctgcttcgtcacgttaattacttccgggtcgctggtataaaaccgtgccagcaacccggccagcggcaccgtcagcagggccatcacggtcaggcagaccgtcgccagccagaagacgtgccgcacctggcgttccgcctggaacacctgattcctgcccagacgggtaccggtgataatcgttgaagccgaaacccagcgcattgcctggcaggttgatcagtgaggcgatagaaaaagcgataaaattaccggcaatctcgctggtgcccattccggcaacaaacacctgtgtcagtagtttgccgccgttgaacagcaccgactcgatactggcaggcacgcctattcctaaaacttccatcagaatgctgctgttccagcgccggaaatagctcgacagcgtaattttcagtgaggcgttaaagccgatcatcagcacgtaaatcaccgcgatcgccccgatatagcgggtgatggtcagtccgagcccggcaccgataaaccctaaaccgtcccacgagaagcagccataaatcagcacgctactgatgatgatgttgaggatgttcatgccgccgttaatcagcatcggaattttggtattacctgcaccgcgcagcgccccgctgccaatcagggtgatggcggcggccggatagctccaggcggaagtctgcagatagctcagcgccagcgctttgacttttggatcggcggcaccggcaatcgcatcgacgatcagatggccccagaactcaatggcgatcaccagcacaaaggcgagtatcgtcatcatggccagcgactgacgcgtggcggcacgggcgcgcttgccgttgcgttttgccaggctgaacgccaccaccaccgtggtaccgagatcgatggcagcaaagaacgagatgatcaccatgttgaagctgtcggccaggccgacgcccgccattgcctctttacccagccagctgaccaggaaggtgctcagtacgcccatcaatagcacacaggcgttctcgaaaaagataggcactgctaatggcgatatctcacgccagtagagcgtgcgatacgaacggcgtttcgggtaccacgccgtgcgcttgatcgcctgcatcactgctacgccgggattttgcaaaggattaccaaatcagaagagactggacaggagttctaatgatgatagtgggtagagaaatatgcaaagtctttccggtgcaaattaatcatggttacaaactttttaatgccgccacggcacaatctgcctcactgccccgcccgctgtagcaaacctgattatttccctgacgttatgatcggttggccatgctttgctgctggcgctttttccgccctctcctcatcggtaacgcattcaaacgtggcggatcaccccttctgatcgtaaagattttcttactggatttcagtgcagcgaatcctcatttaaaacagcactgctcagaattcccgcttcgctggcgcaaaaaaacggcgatcacagattcttcaccaatctccgcaacaaacccgctaagcttggggcaaattgcggaaaaaaatggaaggagaaaccatgccgacactacggaaaaacctgaccagccagcaggcgctggatgaactcgaacgcctgtacgatggcgccgtcgatgcgctgcgcgaggcgattaaagcctttaccgaaaacggcacgctgcccgatgccaccgctcgggcgcagggactatttgtttacccggagctgcgcatcacctggcgcggcgacggtccgcagcagaaccgcacgcgtgcctggggacgcttcacccacaccggcagttacagcaccaccatcacccgcccggcattgctgcgccactatatttcggaacagcttcagatgctggagaaggagtatcagctggagatcgacgtggggccctccagccaggagatcccctatccttacgtgatcgacggttccgacctgtcactggatcgcaccatgagcgccggtattgcgcgccacttcccgaccactgagctgtcacagattggcgatgagaccgccgatggcctgttccatgccgatgcaaaatcccctctgtcgcacttcgacgcgctgcgaaccgacttctcgctggcccgcctgcgtcactacaccggcaccagcgtagagcacttccagccgtttgtgctgttcaccaactacacccgttatgttgatgagtttgtgcgctgggcgatcgagcaggtgcgcgatcccagtaccccttacgacagcctggcctgcgcgggcgatgtggtgctgaccgccgacaccgctgacagtgagtcgatgctctcggatctggcgtggaagaagcaccagatgcccgcctggcatctcacctccccaaatcgtcgcggtattacgctgattaacattggtgttggcccgtcgaatgccaaaaccatctgcgatcatctggcggtgatgcgtccacatgcgtggctgatgattggtcactgtggcggtctgcgcgagagccagcggatcggtgattatgtgctggcccatgcctatctgcgcgacgatcacgtgctggacagcgtgctgccgcctgatatcccggtacccagcattgccgaagtgcagcgcgcgctgtatgacgccaccaaatcggtgagcggcatgccaggcgaagaggtgaagcagcggttgcgtaccggcaccgtggtgaccacggacgatcgcaactgggaactgcgctactccgcttcggcactgcgctttaacctgagccgtgcggtggcggtcgatatggaaagcgccactattgccgcacagggttatcgtttccgggtgccatacggcacgctgctgtgcgtttcagacaagccgttgcacggtgagattaagctgcccggtcaggcgaaccgtttctatgaaggggcgatttcggagcatctgcagattggtattcacgcggttgagttgctgcgcgccgagggcgataagctgcattcgcgtaagttgcgtacctttaatgagccgcctttcaggtaagcgtttaaccgcctgatgcggggaataaggccggtactgctgacaggcagtaccggcctcttgctttggaatttacccaacgcgcatgtcagtgccgggataatttatactttaaaggtctctacaatcagcctgagagactgcgcttgctcagagagagactgagaagcacttgatgattcttctaccagagcagagttattttgcgtcaccccatccatctggctgactgcaatactcacctgagaaatcccctgcatctgttcagccgacgacaacgcaatagcatccatggattcagccagttcatccactaaatgcacgactttgagaatactcaaacccgtatcactggcaacagtgacgccgcattcaacctgtccgacagcctgctctattaacgctttaatatcttttgcggcagtcgcactacgctgtgcaagcgttctgacttcagacgcgacgacagcaaagccccttcccgtctctcccgctcgtgccgcttcaacggctgcgttcagggcaagaatattagtctggaatgcgatgctttcgatgacggcagtgatatctctgactttagacgcgctttttgaaatatcactcatcgtatctgacattcgtttgacgtccgtttcccctcgttttgcaatcgaggcggtatctctcgctgagttggctgtgtccctggcagttttgctgttattttgtaccgtagcggtgagctgttccatactcgcagccgtttcctgcaaggcagcggcctgctgttcagtgcgggatgcaagctcattgtttccttcagaaatctcattcgcagaaagggcgactgaagaagagcctgatttaatctctgaaacgatatcccgtaaccgaaacctgcatgctgtttaaagaggccatgagactgagagtgtcatttttcttcaagctaaccggtgtggtcagatccccattagtgatcgcattagcaagtttccgcgctgtactcggttcatcgccaagctcgctcatgagtttacgaataagatagatgctggtgcccgtgccgaacaaaatagccgcaactaaaagcgtcaccaggatgatgtaggctctttcggtatttttcgcgttttgaataactgagtcatccgactgctttgccaggatttcactcatcagggtaagaccttcaagcagcggaacctgtgcgggcctgactttttccaacagatacttaacggtgatatcactgtttttagccagtgccagcggaacggtgttactgaaggcatccagagcatttttctcgctgtcactgatcttcgcaaaggctttatattcttccgtatcgccagactggctgatcatcgtattcagttgatccctgctggctgcaaatttagccttcagtttaaccagacgatcagactgctcctggataagagcctgatctgaaaagagtgataaattcctgacggttatcgccatatcgcgctgcgccagggtaagttcattgattaattttgtttttttcatatcaccctgaacaactgactcaagcgtgcttttagcctgatataaagagtgaatagcgacaacgatacatatggagaaaaagatgattaacgtgccaaatccggaaccgaggcgcgtagagattttcattaacattccttgaaggggggcggcgatatagatctatcggcatctctttttttaacttcaatgaatatttatcacataaataatattaaccataattaatggcaccgctgcaaagcattacaaaaactcataaatttgtcaggcttcgatgatttccagttcaaccagaaatcgttttttgtgcgttataaacaatcagaacccttatgcttaccgttgtcttaacttattactgcgttacgctacactggtttgcatgtcataaaaatttcatttaacccttgtaggcgcggcttttaaggctgctacaacctggatgcttttcgcatgcaaaaaataccgcaataaaaatcaggaatacataaattataattataaataacgtcaggaacttctgtagatcactttaaacgcgggccggtttctgtgacgtctcgcaggatatgaatgctttattagttcgatgaatatggcagaacagaccggcataaggatgcttcagcccggccgtagcaatccagccttcaggcagaaaacgcgctgagtgcgttgatgagcgtgcccgtctgcacgatagccctggtctgatatgcatcacgaataaaatctccatcatcagcccttgatacgaacggatagcccgggcaatcgcagagagaaataggtttgcctgactcgcgcatcagctgcagtaacagatgaaattaaaagccgtaacataactgaagtatattgcagacgaaatataaaaacatacacagcaacaaaaatcatcattattgagcttgtcactccataattgctgtgcaatataaataacagccaactggagagctatttcttaaaattagtgccacatactggcaatgtattcccgcctttcacataaaaatcaaataaaggacgcataaagaaaccccaaaatggaggaagagtgacaagaattatttgaggaaaattaacatacctttggcagcgcagataataaatttaattactcacttaaagaggattcattgtgaaagttaaaaatatgactgtgttagcgagtatggttttattctactccgctcagggtatggccaggcaatttgatatcagtgcagcaaacattgacgtcaatacctctaaatcttccttcattcttactggtgcgggaggtgccggcggcgcaggtggcgcggggggtgcaggaggagcgttaggcgggcaaggtggtgccggaggtgttggcggcgccggaggtgctggcggaagtgatggtaatggcgccgctaacgccagccagaatggtaataattccaataatgataacggcagtaaaaacggcaacggttctgatcagggtaataacagtaataacggcaccgggaatgctaacgggagtggtgacggtaacggaaatgatgcaggcaacggcggtggtaatggaggaggtgatggtggcggtgatggtggcggtgatggcggcggtgatggcggcggtgatggcggcggtgatggcggcggagactgatagtctggcgtccattaactaaaaagctcctgtttgtaaccgttatagcaggagcattatcactgttagcacaggaacagcacatgaaacttaccagaagttacccattatttttagccaccgtactgacagtggcatttccgttttactccctggctcagactgccagcgacatgaatacttcatcctcaaatacctccctccagccctcagcaggtaaagacggacaacaaggcaatggtgaaaacggaggcgcgggaggcaaaggaggcgttccgggagaaggtactaacggaggaaaaggaggtaatggcggcaatggcggcaatagtggcaatagtaggagtgccgataatcccgatacatcaagtaaaagcggtgcgggcggcgcaggcggtgcgggtggcgcaggcagtgcgggcggtgcaggcggtgcaggcggtgcaggcggtgcgggtggcgcaggcagtgcgggcggtgcgggcggtgcgggcggtgcgggtggtgcaggcggtgcgggcggtgcgggtggtaacggagggaccggtggagaaagttttctgaaaaggattttcaaatgaaaacaatcactttgttagcttcgctaatcatcattccgtatgcgcatgctgagtacaaaacggatatgttgagttcacaccataatgtcattctcattgatgccgctgcaggttctgatggcggaccgggtcagaacggcggtgccggggccaatggcggtccgggtgaaaatggaggacgagggggaaacgggggtatcggcggaaatggagggccaggaggaaatggtggtgccggagccaatggcggtgatggcggaaatggcggcctgggaggaagcggtggaaatggcgggaacggaggtgctggacagaatggccaggccggaggcaatggcgggaatggaggaaacggcagtatggggggagatggcggaaacggtggaaatggaggggatggcaacaatggtagtgctggtggcgcaggggggaacggagggaatggtggcagcacgggaggtgacggcggtgcgggaggtaacggtggtgacgggggagatggcggcgactaaattcaaccacgccttaatatctcttctctcctggcagccggcttataaaacaggcctgaacagcaattatcacgggttaattcacagctaaaacaggcattttaataactctgatttagcgtaagaaaactttccgttagctccgtcagctcaacattaaaatcagcttacctgaattaactaaaacgctcagagatcctgtcaacgctgagtatgtgtgaaactcctctttttttaccatcagggaaatgcaacctggagttggcgtacagtggagccccggatttttgatagccatgatgtgagaaataatggaattaaatacaccgctgaaatggagtaacgagtaacaacaaacgccacaagtgaaatgcttttataatttaaccgcacaaacgagaacagccgcgaataacaacagctccgccatattcgctctattgcaatgtttcgcagtgtatcagacaccgcctgccccatagcctggccgacgaaacccgctcagtgttaacgcgcggctaagtgatctgaaactcccatacgtctggcgggcgaaacccgctcagtgctaacgcgcggctaaatgacctgaaactctcctcgcctggcgggcgaaatccgctcagtgtcagcctgctaaaagcgaaaccttatgaatctttccccgctttcagcggcctgagcccagccagtccgggtgacacacccaccggcagggggtttgccagaggcgtccggagcgctgaggaacaaccggaagccgggagccgacaggacgtcggcgaaaggacggcacgagccagggatggcgagtccggacggtccgtcggccgcagggcgtgacgaaggcaccccgcacagcggggcgcgcaggcagccggacgccgggattgttaaggggcgggcgtccgccccttgacgcgtccgcctgcacaggcaacctgaaactcctcatcgcctggtgggcgaaatccgctcagtgtcagcctgctacaaagcgaaaccttatgaatctttccccgctttcagcggcctgagcccagccagtccgggtgacaaacccaccggcaggggtttgccagaggcgtccgcagcgctgaggaacaaccagaggcaaggatgagccgacaggacgtcggcgaaaggacggcacgagccagggatggcgagtccggacggtccgtcggccgcagggcgtgacgaaggcaccccgctacgcggggcgcgcaggcagccggacgccgggattgttaaggggcgggcgtccgccccttaacgcgtccgcctgcacaggcaacctgaaactccccatcgcctggcgggcgtaaccctctcagcgctaacgcgcggctaagtgatctaaaacgctccatcgcctgggcaggcgtaacctgctcatagccagcccgctgctaagcgaccttccctgccgccaggcaacaactaagcactcaaccatcccagcttaatcacaaacaggatcgacaggataaccagcgccgcattcacctctttcgcacgtccgctcagcaacttcaccagcgtccaggtaataaaaccaaacgcgatgccgttggcgatcgaataggtcagcggcatggtcagcgcggtcacggtgaccggcgcggcggtggtgatatctttccagtcaatctctgccaggcccgatgccatcagcaccgctacaaacagcaacgctggcgcggtggcataaaccggaacactggaggccagcggcgagaaaaacagggccagcaggaacagcacggcgaccacaatcgcggtcaggccggtacggccaccggcactcacgcccgccgccgattccacataactggtagtggtcgaggtgccgagcagcgaaccaaacagcgcagccgcactgtcagcaatcagcgcacggcccatcttcggcacgttaccctgctcatccgccagaccggcgcgtttggtcacacccagcagcgtgcccgtgttatcaaacacgtcaacaaacaggaaggcaaaaatcacgctgatcaggccgacgttaaacgcgccggcaatatccagctgcataaaggtcggtgcaatcgacggcggtgcagagaagaccccggcaaagggcgacagaccaatgcccatggagataaaggtcaccagcagaataccgatcagcactgcgcccgtaacccgacgtgcttccagtaccacaataaccacaaagccgagcatcgccagcagcggacccggtttagtcagatcgccaatgcccaccagcgtcgccgggttatcgaccacaatgcccgccccttccagcgcaatcagcgccagaaaaagcccgataccggcaccaatcccggcgcgcagcggcagcggaatactggcaataatccattcacgaatcttaaatagcgacatcgcgaagaaaatcaccgccgagagaaacaccgcgcccagcgcaatctgccacgtatagcccatgtgcagcacaacggtgtaggtgaagaaggcgtttcagtcccatacccggcgccagcgcaatcggatagttggcgatcagccccatcagcacgcagccaatcgccgcagccagacaggtggcaacaaataccgcgcccttgtccatgccggtcgcgcccagaatgcttgggttcacaaacagaatataagccatcgccaggaaggtggtgatcccggcgataatctcagtacgaaccgtcgtgttatgcgctttgagtttgaatagtttttctaacatcatcatctctcgatacaggagacatcagtctcacttgccaaaggggtttgcatgctgattattctgtttccgggacattgatgccggccgctgcatacttgcgtgccagaatcgcctgaaatccctgacttacccactgcccaaagcaattgccatgccatctcccgacgcaatcgattacctggcggagccgggtacgcctaagagaattccgaaccaaaacgaggcgcgattatggtgcaatgcaccgatgccgcgcaatcgttttcctgcggcaaacagcgagccccgaaaaactctgcgccagcgcacgcttccgcactctcacaggcgaagctggtcacgtttcagcacgctgcctcagcaagcttttctggcctgtgtagactcctgaattaactctttcgtaacattgaggccgcgcaatgaagccagcaattttggtggtggatgatgatcctgcagtctgcgacgtcttgcaggatgcgttaagtgaacatctgttaacggtctatcgttgccatcagggacgcgaggcgctatcgatgctcagcgagcaccctgagatctcgctggtgatgctggatatgatgctgcccgataccaacgggctactggtgttgcagcagcttcagcgtcagcgacccgaagtgctggtgattatgctgaccggtatgggttctgaagcggagatggtggtgggccttgagatgggcgcagatgactacatcgccaaaccctttaatccacgcgtggtagtagcgagaacccgggcggccctgcgtcgcagcggacgcattgcccaggcagaccctgaacaggagggctggcgttttggcggctggcaactggatgatggccgctgccagctgtttaatccgcagcgcgagctggtgccgctgacccagggggaatatagcctgttacgcgcgctggttcgccacgcccgaaaagtgctaacccgcgatcagttgctggagctgacccacagcgaaagtctcgacgtgtttgatcgcaccatcgacgtgctgatcatgcggttgcgccgtaaaatcgaaaccaacccgcaccagcccgacctgatccgcaccattcgcggactcggttatgtcttttcggccgatgtggtgaaacccgattcgacaacgcgtgccagtcagattgcctgattacgcctgccgcgatcaggatagccagtgcgcgtaatcattacatagcagccagcgcggcgcttcatcctcctccagtgggttgaaacgagccagcggcgtcagaaacacattgtcgttttcatcatcgttggtcatcgacacctcgcccaccagcacgtcgccgaagccactttcaccccagaaactgtgccagatgcccgcctccagcgtcacgctttcacccggtgagagccgcagctgtgaaccggcggcatgggtctggcgcaggccatccagcgacaccgccaccagcgagtcagccagcccgtcaccgtcgcggttatgcagttcgacaatcagattcccgccgccgcgattaatgatgtcttccatcttgtgcggatggtagtgcatgggcgtctgctgcccttcccgcacgtgcattattttctcggcgtagggtttatgccacggctgcccgcctggtgaaccgttgcgcagagtaaacagcgtcagcccggtctgcagaaaatcagctgcgccaaaactggtgagatcccagcccagccgcaacgccagaatctcctgcgcgacctcacgatcctgagcccgccactggctcacatcgaaatcggcccacggcggcagatgcacatcctgctgtcggaaaaactcgcgcgtatgttgcaggtaataattaacctctgaacgttgcatggtggcctcctgagagcggcaccctaaaggtgccgcactaaagcttatttcaccgtccagccctggtagctgccgatattattacgatcgatcagtttcaccgggatcagcaccggtttgtccggtgccggtttgccctgcaggatgtcataaccaatctcgaccgctttggcggccatgacctgcgggtcctgcgcaggcgtcgcgacgaacagtgaattcttgcgcttcagcgcctcttcaccgtccggcgagccatcgacgccaacgataaagaactcactgcgctgcgcctgtttcgccgctaagtctgcgccaatcgctgtcgggtcattgatggcaaacaccgcatcaatttttggattggcagaaagcagaccggtcatgacttccagtccgccttcacgactgcctttggcgttctggttgtaagagagcagcttgatgtcaggatgggttttcagctcggtcatgcagccttcaacgcggttctgcaccgcagagacagggggtccgttgatgatcaccacgttgcctttgttcttcagccggtcagcaatatatttacaggccatcgcgcccgcctcggtgttatcggaggtgatggtcgcattcgcgccatcggccgccacgtcgaccgccaccacgacgataccggcatcacgcgcccgcttcaccgccggggcgatccctttggagtcggcggcgttgagaataatcatgtcgactttggccgcaataaagttatcaatctggcccacctgctgaccgagatcgtagccgctggagaccagcgtcacattcaccttatcgcccgccagctgacgtgccttcatctcagcgcctttggtgatctgcacgaagaaggggtttgccagatcgccgaccgttacgccgatagatttgagttcttttgcctgagccaggccggtactgaacagcgtcgccgccagcagcccggttacaatcggattaaaacgcatagaccttctcctgctgttttcaaggtgccaaccacttaatggcgttttttaggtggcggaggtgaaatggcacatccgcccttataagactcaactcacatgatgacgggtacggtatttatcgatcagaaccgcgatgatgatgaccgcgcccttgatcaccagctgccagaaataggagacccccatcagcgtcatgccgttattcagcgtggcgataatcagtgcgccaatcagggtgccggtgatggtgccgatgccgccgacaaagctggtgccgccgaggatcactgccgcaatcgcatccagctcatagccaaccccgaggttgccgttggcgctgtatagccgcgaggcactcatcagtccgcccagccccgacagcaggccgctcatgccgtagacaaacagcagcaccattccgaccttgatcccggtgagacgcgccgcctggatattgccgccgaccgcgtagatatggacgcccagcgtggtgcggcgcaggatgaaccagcagatggcgatcaccgcaaaggcaatcacaatcagccacggcaccggcccgagatagccgttgccgatccactcaaagttaatatcggagttgattactgtggtgccatccgccagcaggtaagcggctccgcgcagcgcggtgtaggtgccaagcgtgacgataaagggcggcaacccggcccaggcgaccaggatgccgttgaacagccccatcaccaggcctgcgcccagcgccatcggaatggtcatggaagccagcatcggatccagcgacgctaccagcgcaaccaccgcggtggtccccagcattgaccccaccgacaggtcgatgccgccggtaagaatcacaaaggtcatgcccgccgccagcacgatgttaatcgacgcctgacgagtgatgttgagcaggtttgcttcggtgaagaagttcggcgtgacgaaaccaaataccgccacgatcaggatcaaaatcggcaggatacccaccgtttgcagcagatcgcccatcagggcgcgtttcagcgtcggtgctttggtgcgagccagttgtgtcatggtggtctccttagatttcgcctgctgacgcgctatgcgcaccggttgccagcgtcataatattttcctgactgatgtggctgccctccagctcaccgacgatggtgccttcgtgcatcacgtaaacgcggtcgctcatcccgaccacttccggcagtttcgctggatatcatcagaatcgccacgccctgccgcgccatctcctgcatcatccggtagatctcgcttttcgccccgacatcgacgccgcgcgtcggttcatcgaggatcagaatgcgcgggccaatcgccacccagcgtgaaatcagcagcttctgctggttaccgcccgacagaccgcccgcccggacctgagcgtgaggaacacgaatattgagtgaagcgatcgcctcactggcgatggtttgccctttgcggcggttcagcatcccgtaactggcgtcacgttccagcgtcgccatcacgatgttctcctgcgccgccatctccagaaacagtccctgctctttgcggttttcggtgaggaaaccgatgccgcgtgcaattgcatcgcgcggtgaatggatggtgaccttttcaccatcgatccagatctcgccctctttcggcttgtgcacgccaaaaaccagctgtgccagctcgctgcggcctgcgcccaccagaccggccagcccgacaatctctccggcccgcacttcaagactgctgggatgcactttgccgccgtcggtaaggtgattgaccgccagccggatatcgcccagcgggatagcacggtctttgttaaacaggtcgctgagtggccgtccgaccatcatccgtaccagttcgcttgcgttaagctggtcacgggtcaggctgcccacatactccccgtcgcgcagcacgctgacgcgatcggacagctcatacacctccgccatgcggtggctgatatagatgatcgccatgccttcgctgcgcagccgtttgatcagcgcgaacagctgttcggtttcgcggttggagagcgcggcggtcggctcatccatcaccagaatgcggctgttgcgctgcagcgcgcgggcgatctccacctgctgctgctcggcgatgctcagacggctgaccagatcccaggcgctgaactgcgcgccgagccggtcaatgacccgctgcgcctcttcggccatctgccgccgcttcaccagcccgccgggcgcgatttcgctgccgagaaaaatgttctccgccaccgtcaggttaggtgccaggttgatctcctgataaatcagggtgatcccggcggccagtgcctctttcggccctttcagcgcccagggcttgccttcaattaaaatttccccgctgctggcggtataggcaccggccagaatcttcatcagtgtgcttttacctgcaccgttctcccccatcagcgcgtggacctcaccgggataaaccgtgagatcaacgcccttcagggcataaaagctgccgaagcgccgggtaattccccgcatttccagtatcggtgtggctgtcatcgcctcgctcctgcggactgtggatagccgtcagtaaagcaacgtcagataaacggaaaatgtcagcgcccgttcatatttgtcataaacgcccgcctgcacgctcctatactcggcccatcgttgcagtgaataagaggtcgtgggatgcagcgcacttatccgtggcaggccggggcacgtggacgcctgttgctgttcaatctgctggtggtgtcggtcacgctgatggtgagcgtggtggcgatcttcggctttcgtcatgccggggcgattcaggagcaggcacaggcgcagaccctggccgacatgaacggcagcctggcgctggcgcgggataccgccaacgtggcgacagcggcagtgcggctgtcacaggtggtgggcgcgctggagtatcagagcgaatcacagcggctgcagcagaatcagcaggcgttgcagcagtcgctgagcctgctggccagtgcgccgctggcggcgcgtcagccggagcgcattgcccggatccgtgcccgcagcctgatgctggaacagacgattaacagcctgctgctgaccggccaccagcgtcatctgcagcgcaacaacatgctgagcgacctgtggcagacgcagattctgctcagccatatcgaccagctggtgcagcgggaacagcggacgctgccggatgccgcactgcgggagcaaaccgaacggctgatcaccatcgcgatccgcacaccctcgcccatcgccgtcatcgaacagctccagcaggtgatggtacagtggcgcaacgtgccgctgaccggcgtgaccggcgaaaacgtgcagcgactgctggctacccagcagcgcctgctgccgctggcagaggcgctggagcagagcgacctggcgatcgcctatgccacctaccggattaaagcgctggtggcgatgctgaatgaagatatcagcgcctcggtgcagcaggtggcgttacagagtgaggcgcgcaccctggcgacccaccgtgagctggattccatcatcggctttatcgcgctgtttgcgctgctggcgctggcgatcaccggctatgccggtatctacatctaccgcaatctcgggtcgagcctgacggcgattgccggggccatgacgcggctggcgcagggcgagcagaaacgtcagcgtgccagggctgcaacgccgcgacgagctgggcgagctggcgcgggcatttaacgtctttgcgcgtaataccgcctcgctggctcacacctcacggctgctgaaagagaagagtaatcagctggaatccacctttctggcgatgcgcgacggctttgcgctgtttgataacaacggtcagctggtggtgtggaacgcccagtatgcggagctgctcggcatcgcgccgcatgaactgcatcgcggcgttccctggcagcaactgctggcaccgctggcggtggatctgcacgatcccggtgaaccgcaggagatccggctggccgatggtcgtacgctggagctgcgcttcagtccaatcccgcggcgcggcatggtcaataccgtgctggaccggacctcgcgtaaaacgctggaggaggcgctgcagcacagccagaaaatgaaggcggtcggccagctgaccggcggactggcacacgactttaacaatctgctggcggtgattatcggcagtctggcactgaccgaaggccagctgacacccggcccgctggccagccggattgatcgggcgcggcaggcggccgaccgcgctgcccaactgacccagcggctgctggcgttctcacgcaagcaggctctctatccccgtgcggtgtcggtggtgacgctggtggataaccttcaggggctgctgcagcactcgctgctgcccggtcagcagctgattattgatgcgcagcgtcccggctggcccgcctggattgatgccagccagctggaaaatgcgctgatgaatctggtggtgaatgcccgcgatgcgatgcatcagcaaagcggtgaaatccggctgcgcatctggaatcagcgtcgtctggagggggatgaaaagcgtgacagggtcacaatcgaggtgatagaccacggctgcggcatgtcggccggggttcgtgagcaggtgtttgagccttttttcaccaccaaagctaccggcagcggcagcgggctgggcctgtcgatggtctatggttttgtacggcagtcaggcggccagatcgaactggaaaccgcgccaggccagggcaccacggtgcggctgctgttgccacgcgcgccggaagccgccgtcgccgcagtgatcgccccgccatcgcctgtgcacattgagacggacattgcggcggccagtaaccggctggtgctggtgctggatgatgaaccggcggtgcgccagacgctctgtgagcatctgcatcagctgggttatctgacgctggagtgtggtgacggtgaagaggcgctggcgctgctgcgccagacacctgatatcgacctgctgatcagcgacctgatgctgcccggcgagattaacggcgcggaggtgatccgccaggcgcagcagaactggccgcagctggcgacgctgctcatcagcggtcaggacctgcgccatcagccggtgacgctgccgctgtgcgaacggctggcgaagccctggcagcaggcacagctggtgcaggcgttacagcgggcctggcagcgcagcgaacggcttaatcgcgcgcagcaggctgccacaacggcaccggcttcccactgatgtagcgcttgcgcaggcggctggagatcatatccatcaccatcactaccaccagcagaatcagcgtcagaaacatcaccacatcccagttccacaggcgcatattctcagcgtaaaccagaccgacgcccccggcgccgacaaagcccaacaccgccgctgagcgggtattggactctatctggtaaaggctcagcgccaaaaactgcgggaatgactgggtgaagatgccgaagcggtgtttctgcaggctgttggcgccgacggcgcccagtccgcgacccggtgaacgctccaccgcttcgtgcccttcggcgtagagtttgccgagcagaccgacatcctgcaggataatcgccagcaccccggccagcggccccatgccgaccgcccggacgaagatcagcccccagatcgccatgtcgatgccgcgcaacacgtcaaacagacggcgcatcagaaacgccagcggtttcgcggttcggctgtgcatcacgttgcgcgccgccagaaatgacagcggcagcgccagcagcgaggcagtcagcgtaccggcaaagacaatccctaaggtgatgccgacctgcgacagatagtagccaaacggccagttcaggaagtcgtgccagacaaacatccgcaggaaatagcgccccagctgctggcagcccatcagcaaacgcgaccactccagaccaaacaccgaaaagaaaaagaggtaatagagcagcaccgccagtgtcatcagcgccaggcgacgcagatagcgcggctgtgcggcgaagagttcacgatgctgctgcttcattagcgcgatatcgggaacggtgcttatcatgtcctgtctcctgtcacacggcgacgaagctggccggagagcgtatccagcagcgacaccacaatcaggatcagcagcagagtaatactgacctgatcgtagcggtccagtttgatgttggtcatcagctcctggccgatgccgcccgccccgaccagcccaaggatggttgaggagcggaagttaatctccagccgcataaagctataggagagaaagaccggcttgacctgtggccagaaggcgaagcgcatccgctgcagcttgctggctccgcaggccgccaggccgcgcaccggcttatccgacgccgactcaatcgcctcgtaaaacagcttggtcaggctgcccacggtgtgcagcgccagcgccagaaaaccggggatcgccccgatgccaaaggccatcacaaacatcaccgcccacgccagctctggcatggtgcgcaggaaggcgacaaaggcgcgaatcgtcatccgcacgctgaccggcgtctgagtgttgtcggcggcgaaaaaggccagcaccgcggccagtgccaccgccaccagcgtcgaagccagcgccagttgtagtgtttcccagatcagcggcagctggatcggcagacggtagccccagtaagccagcgagccttcggtcttgccgtctgcaaacagcagcggcagatgcagcaccggcaggatttcgtgcaggtagtcaaagaagtgcggcagcgactgccagacggtgagcagattaaattctgccaccctgcccgccgccaggtagagtgccaccagcagcagtgaccagagcagcgtgtctcgtttctgctggcggcggatgcgttggtagtagtgttcgaattcggtcaaaggggatctccggcgctaaagcagcgggacgcaggcgagtttgctgcgtcccgctttccccgcctgagcggagaagataagaagtagctggatttagccgcggctgcctttcatcaggtcgcgcttcatatcgatgatgttctgataatcggcaaccgtcgcctgaccgatatgctgctcgccgcccaccgctttcacgaagcaggcgtgatcttccttatccagctttttaatcgccgacaccactttcgctttaaagtcagcgggcagcttgttgctgaccagcaccggaccgttggggatcagcggtgactgccagataatgcggatctgcttcatcagatcaggatggtccatgcggatcagacggccaaacgcgccagaggtatagccgctgttgtagtcaccgaccagtgaggtccaggtcactgcgccatcaaactggttattcagcacgcccagaatgtcctgctcatggccgccggagaaggtgacgctggagaaggtgttgttatatttgtcatccactgagccgccgaacatcttcttaaatgcctggttcggcatcaggaagccggacgtcgagtcgggatcggccataccgaaagatttccctttcaggtcttccagttttttgtacgggctgtccgctttaacgatcaccaccgagtggtagccgcgtgactgatctttgtcatccaccacaatgccaaccacatccaccgctttcgggtcctgaatgtagaccgacgcaaacgaggctggcgacatgctcagcaccatatcaatcttgccacccagcagaccctgaatcacgccagagtagtcggaggcgttgcgcatctgggtatccacacccagctctttatcaaagaaggtcttcacacactgattatcgccaatctgctgggtggcgttttctgaccgcccagaatccccagattaagctgtttcggcgcatccgctgcgctgacaccaaacgccattacactggtcaggagtgctaaagaagtcagtttcattcggggttgttctcttgctgtggaagttaatggatttggttaagttcatcgccgtacagctggtgcagcaggctgtcggtcagtcctgaaggatggccgtcaaacagcaccacgccgcgctgaatgccaatcaccctggtgcagtagcttttcaccagctcaatcgagtgcaggttgaccatcacgctgatgccctgctcgctgacctgacgcagcacatccatgatgcgcttggtatttttgggatcgagtgacgccaccggctcatcggccagcaggattttggggttctgcatcagggcacggcagatcgccacacgctgcatctgaccgccagagaggttttccgcccgctgcagcgcctgcggcagcatgttcatccactgcagcagttcgatggcgtgcgcccggtcattgtcggagaagattttaaagaaggatttcaacgtaccggtctggctcagacggcccagcagcacgttggtcagcacgtcgaggcgtggcaccagacagaaatcctgaaagatcatgccgcactggctgcgccattcgcgcagctggcggctgttgagcgtaaccacgttacgatccgcttcgccatgatgcagactgataatcgcgccggaagtcgcttcaatcgtgccgttgagcatgtgcagcagggtcgatttacccgcgccagagcggccaatcaccgccaccagctcaccggcgtgcaggtcgaaactgacctgatccagcacctgagtgtcgccgtaggctttgctcaatttctgcaccgacaacactttttgtccgctgaggctggccggtggcaggtcgttgtcgaccaccgttttcagaagtgcctgtgccatggtgttctccgtcatcgctgattgcgttctgcgggttattaaggcgtgacgcgatgaacacgagatgacagtcagatgatcaaaccgtgacaggccagtgcgcgccgcacagcaatgtctggccatcacgggcaggctgcacaccgtccggcaacgggttctcagctaaccagttatccatctcatgactgagatgggtgagccaggtctgacgcggctggagcatctctgctatcgccagcgcctgggtcacatcattatggttacgcggttctgcttgcggcggatcgttgcagtcaatcaccagctgatccagcggctgaccgcgcaggaagtcggcggtgtcgggtggcaacccgcaggtatcacacagccaggcgagccgggtgccgtgccagtcgaacagatagccatgcgtcattttcgagtgttgcaacggcagcggcgtgacctgcagttctccaaaggcgtgcgctacaaacggcgttaaggcgggacggaaatcgagcaggccaggatgtttatagagatcgtcacagcctcgcggatcgggtggaccccagaccggaatcggcgcgcccactccccagcgcagtgcaaacagcccctgcacatgatccatgtggtagtgggtcagcagaatgcgtgtcagcgtgccgggcgggaagcgcgatgccagcagcggcagaccggcatccagcaggatgcgctcgcggccaaactcaatcagcgcgctgcagggcgcacgcgcgtagccactattgagctgcgcccgctgacaggcgcgacagtcgcagcccggcagcggtgcggcagtgaccccgccagtacccagaaaagtgagtttcattgatgcgcctccagtatctgacgcagcaggcacacggtatccgccagcgcgccgtcgttgttgaggataaggcagccatcgggctgtggctgtgcggcgcgcgccagccgccgggcgatctccgcctcatcttcccgtccgcgctggcgcagccgcgctgccagcacggcgggtgtgacctgcagacagaccggcagcagctgcgagccgaaacgggcctgcgcctgcgccagatgcagccgcgaaccattcaccaccacattctgcccgcgcagcagccactgctccgtctcacagccaatgccatagctgaaaccgtgcgcctgccagctcaccgcgaacagccccagcgcggcgcggcgggcaaactccgcctcggtcagcgccacatggttttcaccgcccgcgtcggcggcgcgggtaatgtagcgatgggcgatcagcagccgtggcggaggtgccgcccgcagcgcatccagcaagctgtctttacccgaacccgaaggaccggtgagccagatcagccgcgccatcagtacacctgccggcctttgctccagacgtgccgcacgtgcgggtagccgtgtgcggtatgcgccagcaccagatcggcgcggcagccttcggcgattaccccgcgatcttcgagccctaaggcgcgcgccgggttacaggtgaccagcgcgatcgcctgcgccatgccgaggctgttgcgctcatcatctgccagccggaacgctgcatccagcaggctcgccggatagtaatcggaggagagaatattcagcaggccgtgtgacgccagctcccaggcagcgacgttgccggagtgcgagccgccgcgcacgatgttaggcgcgcccatcagcacctgcatattgcgataacgcgaggcgcgtgccgcctccagcgtggtaggaaactccgcgatgcggctgcccgcggcatgagactcttcaacgtgcgccgcggtggcatcatcgtggctggcaatggcgatgccatgttcccggcagagtccggcaatcgcctgacgattgggctgtgaccatgctgctgccagggtgagctggtcatgctcgaactgatccatctccgcgtcgttgagctgatatttgccctgataatattcgcgatacttcgtcagggacgcgtactgacgctggcccggtgaatggtccatcagcgacaccagcgccagctccggcgtgcccatcagcgcttcaaacagcggcgcagtggtgggatgcggcagttcacagcgcagatgcaacagatgctcggcccggttcagtcctttgcggttgctgtcgcggatggcgtcgatcatcttgctgaggttatccagccggtgcccgccgtcgcgcacatccccgacgccaatcgcatccagcaccgtggtaatgccgctggagaccatcagcgcatcgtggctgctcatcgccgagtgtgccggccagtccactttcggacgcggcgtgaaaaacttatcgaggttatcggtgtgcagctccaccagacccggcatcagccaggcgccctcaccgtccagcgcgcccggctgctggctggtggtttcgctgaagctgctgatgcgctcgtcgcgaaactccagcgatccggtcaccacttcgttttccagcaccagtctgacgttattgatgatcatgcctgcgctcctgtctcgatcgggtgcatcaggtgcagccggtcagctacccgctcgcgcaccgcccgatcgtgaaaaataccgacgatggcggcaccacgggcgcgcgcctgttcaattaagctcactaccgcctcgctgtttacactgtcgagcgaggcggtgggttcatccagcagcagcaccggatagtcggcgataaagccgcgggcgatattcacgcgctgctgctctccgccagagaaagtggacggggccagcgaccagagacgctgcggcacgttgagccgggtcagcagttcggcggcacgtgcttcacagaaggcgcgctcgacgccgcgctccagcagcggctgcatcacaatctccagcgtcggcacgcgcgggatcacccgcagaaactggctgacccagcccagcgtgtcgcggcgcagggcgataatctggcgcgccgatgcctgcgccatgtcgatccactcgccctgatgcgcgacccgaatgtggccgctgtcgggctgatagttgccgtaaagcgcgcgcagcagtgtggatttaccgctgccggagtgaccgtgcagcaccacgcattcgccctcgcctgccgtcaggctggcgttgtgcagcaccggcagcgccgcgccgttctggttatgcagcacaaaggttttacacaaattctctacccgcaggcgcggagtgatagttgtcatttaattgagcaccgaagagaccagcagttgagtgtaaggatgatgaggatcgtccagcacgcggtcagtcagaccgctctccaccacccgcccctgcttcatcaccagcaggcgatgcgccagcagtcgcgccacgccgagatcgtgggtgacaatcaccaccgccagattcagttcgcgcaccagcgtccgcagcagatccagcagtcgcgcctgcaccgacacatccagcccgccggtcggctcatccataaacatcaactgcggctgcgtcaccaggttccgggcgatctgcagacgctgctgcatgccgccggaaaaggtggtgggcaaatcgtcgatgcgaccggcgtcaatctccaccgcctgcagccagcggctcgcctcggcgcggatatcgccatagtggcgctgtccggtcgccatcagccgtttcgccgatattgccgcccgcgctgacctgcgaacgcagcccgtccatcggatgctgatgcaccacgccccattcggtgcgcagcaggcgacggcgatcgctttcactcatctgatagaggtcgcgattctgatagaggatgctgccctgctgcggcgtcagacgcgccgacaggctctgcagcagcgtggttttaccggagccggactcgccgacaatgcccagcacttcgccgggaaagagatcaaaactgacctgctcaaaccctttgcccggcgcataaagatgggtgagctggttcaccgcaagcagcggctgttcactgtgcatgttgctgttcctgctgctgatggcaaaagtcggtgtcggagcagacaaacatccgcgttccctgatcgtccatcaccacctcatcgagatagctgtggcgcgatccgcacagcgcgcagggttcatcccactgctgcacggtgaacggatgatcgtcgaagtccaggctttccacacgggtgtaaggcggcaaggcgtagatgcgcttttcacgcccggcaccaaacagctgcagcgcgggcatcatgtgcatctttgggttgtcgaatttgggaatgggcgaaggatccatcacgtagcgatcgttgacccggaccggataggcgtaagtcgtcgcgatgtggccgtagcgggcaatatcttcatacagcttcacctgcatgatgccgtactcctccagcgcatgcatggtgcgggtttcggtttcgcgcggctcgataaagcgcagcggctccgggatcggaacctggaaaatgaggatctgatcctcttccagcggcgtttccgggatgcggtgccgggtctggatcagggtggcatcggcggtgcgctcggtggtggcagcattgctgactcgcttaaagaactggcggatcgacaccgcattggtggtgtcatctgcgccctgatcgatcaccttcagcacatcctgatcgccaatcacgctggcggtgatctggatgccgccggtgccccagccgtagggcatcggcatctcacgtccggcgaacggcacctgatagccggggatcgccaccgctttcaggatggcgcggcggatggtgcgtttggtctgctcatcgagatagccgttgttatagccggtgagttcagccatgggtgcgctcctgataatcgtgctgcagctgtttcagcagttccagttccgcctggaaatcgacgtagtgcggcagcttgagatgcgagacaaagcctgcggcttccacgttatcggcgtgcgacagcacaaactcttcgtcctgcgccgggctggtaacacgctcatgctgttcgcggctttgcagcgcccggtccaccagcgccatcgccatcgctttgcgttcggcgcggccaaacaccagcccataaccccgggtaaagtgcggcgccgtgtcgtcgctgtgggcaacgccgttgaccatttcacactccgtcagtagcagttcaccgatctccagctcaaaacccagctcttcgggacagatactgacgctgagagtgccagtgcggatctcgccggcaaacggatgggtgcggccatagccgcgctgggtcgagtagcccagcgccagcagaaagccttcgtcgccacgcaccagctgttgcagccgcgcggcgcgtgaggcgggaaagctcatcggctcgcgagtgatatcgacaggctcgctgccgtcatccatctcggcggcggccagcccttcatcgctcatcatgctgaacatgtgcgggcactggtcaggcaccgaacgatcgtcacgcggcgcggcgggcgtttcgccattggccagcagggtgaagtcgagcagacggtggctgtagtcgtaagttggtcccagcacctggccgcccggcagatctttatagaccgccgagatgcggcgttcgatgcgcatcgcaccggtcgccagtggcgtgctctccgccaggcgtggcagcgtggtgcgaaaggcgcgcaacagaaagatcgcctcgaccagatcgccgctggcctgtttaatcgccagcgccgccagttcgggatcgtaaatcccgccttcggtcatcacccgatccaccgccagtcccagctgctgcgccacctgatcgcagccgagttcggctaccgctctatcgccgcgccgcagatcggcctgcaactgatgggcgttcgcaatggctttttcgcccccttttaccgcgacatacatcagcacacctccacaacggtggtgcgcggcacggccatgatcgcttcgccacaggtgaagatcagatccacgccctgtggaaacggatgcagacgggtgcgcagatattccagcacgctttcgggcagctgtggcgcgatggcgcgggtttcgcgcaggccagggccggagaggcgcagcgtcaggccgccattcagtgacggcacttcgataatcagcgtggtgcttttttccggtgacatgttgtcacccgctgcgaactgcgtcggatcgggctgcgccgccgcatggctcagggcgaatggtgcatcctgctgcgtggtgatcggcgcaccggtatggaagcgcagattgttgcgcagctgttcgttgtcgatttccgcatccagccagaccgggctttcctgatcgaccagcgtcagcagcagcgccgtggccgccggtgacagtgcgccccagccctgttgcagcggcagcgagaccatcacgcccggttcgctcatcgctttcagaatgcggcgaaacgcgcgctgcgcatccgccaccggatggttaaaacttgccagtaaagtcatcagttatctccgcgaaccagcgtaaagaaatccactttgctgctggcgatctcgcgggcgcgcagctgtcgctgctcatcgcgccacgccgccagcggggtaataatcttctcttccagcagttgccgggtttccggctgctgtaaaagcgcatccagcagggcacagcgttcggcatgggctttgtcgcgccctaacaggtagctgtaacccagagtgccgtcgctgagctgcaccaccgcgcgcgtcaccgtggcatcgcccatcacaaagcgtttgccggtggcccccatccgcgcctgcaaccgtgtcagcccgatctctgccggacggatcagggtaaaggcgggctggaggttaagcgcctgccagtgcgtctcaagcaaggcggcgctgctgtgcgccagcaccgacagccagcgctggcgatccgtttgctgttccattagtgctccagagtcagttcaatcatgtcgccgcgcgtcaggctgacggagtattccgccaccgcgccatcactggttttgttcagggtccgcacgcagagcagcggcgaatgcagcgcgatgtcgagctgccggcactctttggcctgcgcccggcgggtgctgatgcgggtctgggtgcgtaccagctgcttgccggtgtgctcaaccaagaagtcgtgcagcgatccgctgttaaattgctgaagttgtggccaccagctgaggtcggcgaggaaatggttaatcaggcagagcggcacgccgttggcgcgacgcagggtacgcagatgaatgacgttgtcgccctctttcacgcccagcgcattggcaacgtcgttgctggccggacgcagcaccgccagcagccgttcgctggtgggatgactgccctgctccagcaggttctggctgaatcgcgcctgagcatgcagcggatagtcataagggcgcatcaaaaccaggatgccgacgccgtgacggcgctgcagcagccctttgtgcaccagctcatccaccgcccgacgcagcgtgtggcgattcacctcatagtgatcggccagctgttgctcggaaggaagatagtcgccgcagcggtagcgctctttcagcgcctgctccagttgtgcggcaacagcctgatagacagtggtcggatgtctggataactccatcacgatgaaatcctcacgggttacagagtgggaacgcagtgaaaagacgctgcgggatggtgttagcttgaggggatcagatgacagaaaccgtgacgcgggggtgaaggagaggtgaatgtggtggctggaaaatgaggagtgcttgtcagggtgagtgactggcaggaaaccgccgggcatggggtgatagcccccgcttcagcggtcattttctctgccgggccgggagtcaatcaatcaaaagaacgtcattccctgataaggctgagcaaggcaggctctgatacggctctcaagatcgccatcatggatctcaagcctgtggccatcggggtccagaaagtagaaggagttcccctcgcttttattgcgcttccactctgtcacacccgccgctctcaatcgctcaacgaacgcatcaaattcgtcaccagcaatagtgaatgcatagtgtgtgtaatcatttccagcagagacggtatccacagagagacagagccagagttcacccagcgaaagataagcgccgtgatcccatgccgctttgggggtgaatcccagggtctccgtataaaaattcaggctactggccaggttgctaactgcgagggtgaggtgattgagtccggtcagcatgtaaaactctttatcagaatgcagaaaaatttaatttacaggaatcagatttctttgcacacaaagagaattaacagccgtttgtatatcagccgaatctctgccggacccaccccggaaagaggaaactgaagccggcaatacagccgggaccggcgcgcgatgagcagataatgaagaccgggcttgcacgaaatgaacgacgggcttcatggtgtacactggaacgaactaacgttgcgcttaggagagaatatgtacggaccgaatcccgccaatccccatccaatggaaggcttcccacaggtttgttttatcaaaaatacggtgaaaaaccccaacatcataatcggggattttacttattatgatgatcctgaagactcagaaaacttcgagcgcaatgtcctttatcacttcccctttattggtgacaaactgatcatgggtaaattctgcgcgatagccagaggcgttcagttcatcatgaacggggcaaaccataacatggcgggtttctccacttttccgttttacattttcggaaacggatgggaaacagcccagcctcaggccggcgatctgccctataaaggcgatacggtgattggtaatgatgtatggatgggttatcaggcgctgattatgccaggcgttaaaattggcaacggcgcgatcatttcttcacgtttctgttgtgacgtcggatgtcccggcctattcgattgtgggtggcaacccggccagagttatcaggcagcgttttaccgatgaaaccatatcccgactagagaagctggcctggtgggactggccggtagaaaagattacccaaaacttaccggcaattatctccgcagaccttgaagcactgccagatgaatagccgggcagaagtggaataaacactgcccgctgctggcaaagggtggcggtcatccgatacgggttcgcataatttcgcgcagattgatgtatcaatgtgtctgctttaccactggagcgcgggttaaaacaggagtcgttatgctctacatcttaagtggccttccgggttgcggcaaaagcactatcgctaaaatgctatctgaaaaattgaaagcggtgtatttacgcgtagatacgatcgaacaggctctgcgtaatagttcagcaactttcagggatattggccctgaaggctatttcatcctttatgagcttgcgcgggacaatctcagactgggatcacctgttgtcactgactcggtgaatgatcttaacctggtgcgcgatagttttcgtgatatcgcactatcatcaggtgttccctttctggagatagaaatcctctgttctgatcccgaacagcatcgtgcccgtgtagagaacagaatctcagatattcctggcttaaaagtgcctgactggcaagccgttgtggatcgtgtttatgaaccgtggagcagagaacatctgaagctggatacggctgaattatcgcctgctgagtgtgttgaagaaatccttaaagctagaacttagtactgggtttgtttgagccggacaattgattgtaaggagtgctttaagctcacattaagtattggcccgctttcaggaatttaaagcaagcaaaaggtatcgtcacacttttctttcaagtcgctgattgtctgaaagaaagaagcaagtactaaggtttatagtttcttatcgctctattcgtcataatcaattgcactacagttagttctaaataagttgttattgttatatgattcaattgaaaaacttacgataaaattaaatggataaatatgaaagcgtggtcttttaaatcagtaggtctggatgatctccgttactttggcaataacggttactatgatgactcaactggcctttaccgatatgacaattttgttccaaatcataagcaagtaaaagaaggcgacattgtcattattacagacagaaaaactgttcttggtatatcgattatagataacttgtcatcagcaccatatattaaaatccgcaaccgttgcccacaagaaaattgtaatccacaaaagattaactttcggaaaaataaaaagccggaatggcgttgcagcaatggacatgtttttagcgagcctaaagaagaaggtatatcagcgaatgaatttaaagctgagtatcagaaaaattacagatcacttaactctatatccatgacggatttaatatctcatacaccccgctataacgttcaaagttcaattcaggagattgatttagagtgggcaacgcacctgtttggtagcatcatccaattagatcccactgaagcagatattgaagaaattccacttgatgcagatgaccagcggaaagctgttttacggcaaattaagcaaaggcgtgggcaaaaagcttttcgcgacactctgatatctcaattagccaaatgtgcagtaagtggctgtgaaatcattgatatacttgaagccgcacatatcaccgcatacaaaaatgatacacacaaccatgttagtaatggactattattacgttgtgacatgcatactctttacgacctggacctatttgcaatagatcctaaatcattcattatttactttgctccacaggtccaagataaagagtacacaaagcatcatggaaaaaagctaaatgtaacgtataagattaatcaaggagctcttgttgaaaggtggaaaagatttactgaaaagtataatttaactgaattaaatccgcttaataccaccgcttctgcatagaatccactcacctccttgactcttagaaaataactgggcggcggccatcaggatgctcacatgctctcaaaaccgctgcccccaacctctaaaaaaccctattctgccgtccctttccccaccttctcacccccactatccgtcagtgacgctctcacctgcggcaggctttccgggtaattctgctgaataaactcaatcatcttttcacgcacgtaacagcgtaaatcaaaggcgatcggggagtttctgcgcggtcatcagcatcctgatggtcatggttttctcggtggtgtcggtcacctgcagcacagaggtttcctgatcccaaagcttggtttcgctcagcaccttttcaaaatgcttgcgcagcggctccagcggcatggagtaatccacgtaaaggaacaccgagcctaagatctgggcgttattgcgcgtccagttctgaaacggattttcggtaaagtaggtgatcggcaacaccagccgacgcaaatcccagatgcgcaccaccacataggtcaggttgatctcctcaatccagccccactccttttctaccactaccgcatcatcaattttaataggctgggtaaaggcgatctgaataccggcgaacagattgaccagcgacttttgcagcgcaaaaccaataatgataccggcgacacccgcaccggccagaatggtggtgccgaatttccggacaccagggaagctgagcagaatcagcgaaacacagaacagaaccaggatgacaataaccacttttttgacatagataatctgcgtgcggattttacgcgcacgaaggttattggaaatattaatgtcatagcggatataaagcatatcctgcgccacgttggtcagccggattaagaccgagcaaaatgacataataataaagacattgatgatattggtaattaaagagagagattccggttgaaaatcgatgtaattaacgccgacattaatcattaataacggaataaaaaagaacatcgagccgctaagatgcttctcaagggatttgaacagctttctgtcacgaatctgccagtagcggatgaaccggagcaggataaggcgggccagaaatcccagcacaaaagagagcgagacgagtaatacaacaggcacccatgacgggaaaccagataactcaccgaataacaatggcattattttcccttatagtaagctgacaacctcaggctgtcagataagtgacaaactcagtaaccgttgtcttcacggctatccgttcgtaacacaatcagcgcacatgagtatgaaccatcgcggcgaagttaacaggaaatgcacggtgatgcgtccagagaggctgtcgcgcgccagccttatggctactgctacagaggccgaatgttggccctcacgtcaccgtccagccagctaaccccattaaaatatctgatacaacacggccactttttcactccccattatttagcctgccctggccatccggcaacaaaaacgttgccagaatcactaagcgtaacgctttgcgtggacgttcttgtgcaatctgctaatttttaagctgttcccctgctgctgagaaaaacaacaatatgattaacacccttaaactttcctctgattttcgtcgcagtttcctgcgtgaagtcctggtgccgctggtcgctatcttattgctgacgtttgtaggtgcaggcgctgcgctctttgttggtacctcactcaccaatacggaggcccgccatcagcagcaacggatgattgaagcctctttttcacagagtctgaatgagcatctgcgccagctgcgtagcctgtcgcgctggggaccctttgagcagcatctggcagagggcaacagcagcaggtggctggatgagaacattgggctgtggctgtatgagatgttcggccatcaactgattctggtgctggaccagcaaaatcaaatcgtcagagtctggcgcgaaggccagccggtctccgcccctgaagatgacccgctgattggtgaggtgctgcaaagcacgctggtcaacgatccggcacgccaggataacgccgattatgcccgcgtgacaaaccgggccgccgcgctggcagtaggtaacatccagcgggagagcaatgccctgccgcgtttccggctggtaagcctgaaatttcttgatgacggctatctggcgggcctggcggaacgcaatcagctgcagggactgcacttctccgacggcacgccgcaggcggggaccggtgcacgctatctgttgatcgcgcaggcgggcgaggcggttggctatctgaactggatcccctcccgtcccggtgcgcagatgctgcgcaccatcgggccatctaccgggctggcggtactggcgatatccctgctgtgcctttatatggtgcggcgactctggaactcgtcggtgaacctctcgcaatccatgctcaggctcggcgcgtcagaggcccaggcacagcatctggcgtttcatgatgtgctgaccggcctgccgaaccgcgcactggtcgaagaccgcttaacccaggcgctggctctggcgacgcgccacgatcaacgcgtggcgctgctgctcatcgacctcgaccgctttaaaaccatcaacgatacccacggtcatcacgccggagatgaactgatcatcgcggtcgcacagcgcctgagccgtatcgtgcgggccagcgatacggtaggacgcatcggcggtgatgaatttatcgtggtaatgccggacgtcgataatatcggccaggtacatagcctggcgcagcgcattatcgatgaactgagtgagccttttacgctgtttggcagcgatatctggagtggcgccagtatcggactggcgctggcacccaaagatggggttgatcggctggagctgatgcgcaaagcggatattgcgctgtatgaggccaaaagcggcgggcgcggcacgtatcgacagtttgaacgggcgatggatgagtcggtacggacccgacagaccatcgctgccgacctgcgtacggcgctacataaccgtcaggggctggaggtgtggtatcagccgctgatggatattggcggccagcagatggtgggcatcgaagcgctgctgcgctggcaccatccgacgcgcggcctgattgcgcccggcgaatttatcgcgattgccgaagagaccggcctgattattccgctgggcgaatgggtgctggctgaagcctgcgtcactcagcagcgttttcccgagctgctggtggcggtcaacgtctcgccggtgcagttccgctctaccggctttgttgagcgggtgatggcgattgtcagccagaacggcggcgatccgaagcgcctggaactggagatcaccgaaggggtgttaatcgaagatgaacgtgaagcacgcgccattattgtggagttgcgtgacgcaggcttccggattgcgctggatgactttggcaccggttactccagcctgaactatctcagcaactttccggtggataaaatcaaaatcgatcgctcattcacccagtcgctgggcgtggcggaaaattcagtggcgattgttgaatcggtggtgaagctgggtcacgccatgggtctgatggtgacagcagaaggcgtcgagacgccagggcagatgtctgcgctggcagatgcgggctgtaatcagctgcagggctatctgttcagtcaggcggtgcccgccgatcagctctcagcactgatgaaaacgattgcgccagacaacgcgcagcatgagtgatactgatgtggaaagcctgagcgcagctctgtgcccaggctttccggctgcgtgatgcatctgagatcagaagatcaacatcacccttcacccgttgttgcgggaaattaaacccccaggctatccagcagcgcggcagaatgggcgaccgcgccaaagatgccgccctgcatatggatcatgctcagcgccgcctcatgatgacgctgctcggtcgcagcacaacaatcagacagcaccaggcactcaaagccgcgatcgttagcttcgcgcagcgtggtgtggacgcagacgtcggtggtaataccggtgaggatcagatttcggatgccgcgactgcgcaatatcagctccagatcggtggcataaaacgatcccttacccggcttatcaatcaccacttcacccggcagcggtgccagctccgggataatctcccagcccggttcaccgcgcaccagaatacggccgcacggtccctcatccccgatcccggcgttcattcgccgcgagcgccagcgtttgttggcgggcaaatcactgagatcgggccggtgcccttcgcgggtatgaataaccggaaactgccgggcgcgcatcgccgccagcacctgctgcaacggtgcgatgggcgcgcgggtcagactcacgtcatagcccatgctgtcgacataaccgcccacgccacagaagtcggtctgcatatcaatcacgatcagcgcggtgtcagccggcgtaaaagtgccgtcaaacggccagccgtagggggttgaattaacgctgtagtcgggcattgctgttctccattaccgggcgcggcatgcgcattctgctgatcacgctgtagctgatggcggcggttaccagaccaataaccgcttcaccaaattgagggaaagcgacgtgggcaatcaccgcacacaggctgccaatcgcccaggcggcaaacgcagtaccccgaaaacgctgcgccggacgctgctcgctgatgcgcgccataaaaattaaatccacgatcatcaccgcaccaaacggcggcaccacaatgccgagcaggctgagccactccaggaagtaagaccagacgcccgccagcgccagcacgccgccaatggcacccaggatcagcgtccagagccgcattttgctgctgaacagatgactgaagcccaccgccccgttatagaggcagtgtgtgcaaaccgatccgagattgataaagacaaacaggcaggccactaccgacaaaaaggcgctgtgccccatcagcatcggcaggaagttgccgccattggtcagcggatcaaccgcggcgcccacggccacaatcactacaccaaacagataggagatgacgttagccaccggaaaggcagagaaacgcggcgatcaccgccgaacggccattctttgaccagcgggtaaagtcagcggtcatggtgccggagtcagcaaaaccggctaccaccatggtgacggcggtgcccatactcattgcaccggctgcgctggcgctgcccttccactgcgtcaccacggagaagtcgtgctgcttgctaatcagccacagcgccaccattcccagcaccacaaacagcggcgcggcgatcatccccagcaccgacagcgcccgcacgcccaggaacgtgatgccggtatagaggatcatggcaaaggccgtcaccgccagcgcattccagccaaaggtctgattaatgaccgtgccggtaaggccggtctggaaggcataccagccgatcaccaccgtcgagagaaaacccgagaccaggatgtagcctttgctgccaaaggtgcgtctggcctgcagggcgaaattcattccgctgttaccggcgtaccagctcagcgcgccgacataggcgaacagcaccaggtttcccagcagaatggcgatcagcgcaggccagaaccccagatgccaggtgatgatgccgccaaacagcgcattggtgaggatcatcggaaatccaaaccagacggccgagacggagcgggtagaatgacggtgcgacagcggtaccggctgatgttcaaactcctgctccagcgcaggcgtagtagacgttttcattgggcgattccgggttgaaggtgattccacggctgaatgcgctcgaaagcggcactggcagccagcactaaggcatcatcaagatgacgtccgacaatctgcagaccgacgggcaagccgctggcagtaaaaccggcgggaacggacgcggcgggctgaccggtgaagttgaaggggtagcagaacgagagccagtgatcgctgcggaccatgcggccatcaatgatctccggtccctgcatccccagcggaaacggcggcaccgccagcgtcggggtaatcagcaggtcaaagcgctgcataaagcgccacaggctgttgctgaccgctttgcgggtggtgatggcatcggtgaagttttccgcccgccagtcgcgctgcagcatggcgaccaggtgcggcgacatctcgctgccctgctccgccagcatccggcgcataccggtgagatcgctctccatcgccaccagcgcgccaaaggccgccgacggatcagggaagcccggataggccagttccagttcagcaccgatttcagcggcaaaacgctgcaccgccgcgctgaccactgcccgcacttccgggtcaacggccacatagccaaaatccgcgctgaaggcgatgcgcagtttgcctggcagatggtgtggcgcacccagccagtcgacatcgctgcagggaatcgagtggcgatcgcgcatatccggtccggccatcagcgacatcatcagcgcggcatcgcgcacgctgcgcgtcatcggaccgatgtgctccagtgactcccagctcgacacgccggggtagcgttcatcacggcagccgggccagagcggcacccggcccatcgacgccttgaagccgaaaataccgcagtgcgccgccggaatgcgtaccgacccgccgccgtcgctgcccagtgcaatcgggcaaagccgcgccgctaccgccgcacccgaaccggcgctggaccctcctggcgtcatgctcaaatcccagggattgcgcggcgacggaaacagcggattgtgcccgaccccgctgtagccaaactccggtgcggtggttttgccaagcagaatggcgtcggcggccagcaaccgttccaccgtgatgtcatcatcttccggcacgaaatctttgtacgccgccgaaccggaggtggttctgacgtttgcggtgcagattaaatccttcaccgccagcggtacccccgccagcgcgcccagtgtttcaccgcgtgcccgtcgggcatccacggctctggcctgtgccattgccagttcaggcgtcggggtacaaaaagcctgtatcgccggtttcccgctgttccatccgtgccagcgccgccccggtcagctcataagccgacacgtccccgctgcgaatcagagcggccatcgtggtggcatcttcgtctaataaggagtcaaacatgggttacctcgccaaaagtgtacctgtcagctagtgcatgaagcgtgccagttagcggtgaatcatccggtctgaaacggggatgccagatggaatacgggctgggatacaagatcgaattcttatgatgccaggtgcaggcggctgtttatttttccagcacgatgatggcgcagggctgcgcgataagggggcgtaatagctgaatggtttgcgggctggtttacaaaacgatgtcggttatcagcaacagcggccgatatgctggaatgaataaccacatttttaccagggccgtttgaccggtctgagcaggcactaaaaaatcacggcttaaagattcacatgcagcctgcagggatgataagtgcgcattgaagaagatatttatctcgaaaactacgaaatcagacgaaaaagattcatttatgatcgtcaggtttatcacagctacgtgtttgttgtcggtaatgagacttacaccgtcatcgttggcgaccggatagatgaacagacctttaaccgcatcggataccggatgccacccggtatcgcctttccggttaacgggctggctgaagtctgttttgacgtgttcgatggtctggagtgcctgggcgatttccgccatatcagctttgcaggattaggcagtgctgtcgttttcaaaagcgtactcctggcgttaatggcacaccatgaaagcttctttataggcggttttgtttttcaggctgcatcaggagagatcgttgaccgcaatcgcccgacaccccttgaggagatctacgatgctttgcttgggttaaaaaatgaactacgctacaatcgccggacagggttgccaaagaaagcgccgcaacctttaatcccggactgtttccgggcttataaagtagtgactacagggagagcttgctatgtcgttttacaataaacacgatgaaacaacccctttggctccggtcgaaaccaggtataaggagttaagggcactattgattgctgaatggctggtcagacccgatctgcccgccattaaagcccagttagctcagaggaaaaaacgctcgtcgtctgccctgttacgccgcaagttgaaagagctgaatgcgcgcgaaatgcagaaagctaagatcagcgcttaacgcttaaaggcccgataacgggcctttcctatttttatcagcttctggctcactcgcagacggctttccgccacccgcaactcacctctactccggaaaatccgtctccaccgacgtctgtttccacgcttcgatctcagccagccgctctttgagcttgctggttacggcatcatggccccaggcgcccattaccagatggcgtggcgggttatcatgctcagtgatggcaatcatcgccgtggcggcccgcgccggatcgcccttctgcgtgccgctgtattcggcggtggctttcatccgtgcggctgcagtctctgcatagtctggcagcgtgctcggtgtctgatgcagggagcgtcccgcccagtcggtgcggaacggacctggctcgacacaggtaacgcgaatgcccagcggtcccgcttccagcgccagcgaatctgaccagccttccaccgcatgtttgctggcagagtagtagcctgagctggcaaaaccaattaagcctgccaccgaggtaatgttgatgacgtggccgctgcgcgcctttctcatcgcgggcagcacggcgcgggtcagggcaaacaggccaaagacgttggcatcaaactgcgcgcggatttcgctttccacaccctcttccaccgagctctgatagccgtaaccggcgttgttgaccagcacatcaatggtgccgaacgtgtcgagtgccgttttgacggcctggtcgatgctcgcctggtgggtcacatccagcgctactgccagcgcgttgtcgtgtccctcaaccagatcggcaatggaagaggtatcacgtgccgtcacgacgaccttaaaaccacgcgcgatgatctgctgcgccagttcacgaccaaatccggtcgaacatcccgatattaaccagacagggctggagtgagcagtcatggtaagactcccgttgatgatgatgaagtgactggagacccggacgcgagtgcatccgggatttaaggttagcgaggcgcgaccgccccacttagcccttaatgctttttattgaacagctggctggcggtgtcgctgatgatctgtgccgcaccgcgatcgcctttcaccatcgacgccataaaggctttcgcctgtttaaaggtgatgtgcggcggtaacggggcaacttccggatcggttttcacctccagcaataccgggcgatcggcgctgagcgcacgctgccatgccgccgccagatcgtcaggattatcgacaaaaataccgaccattcccagcgactgcgcaaactcagcatatttcacatccggcagttgctgcgaggcgtcaaagcggggattcccctccatgacccgctgctcccaggtgacctgattgagatcctggttgttgaacacgcagacgatcaggcgtggatcggcccactgctgccagtatttctggatggtgatcagctccgccatattgttcatctgcatcgcaccatcacccaccagcgccactaccggtttatcgggatgggcaaattttgcggcaatcgcataaggcaccgccgcgcccatacaggccaggccaccggagagcgaggcgcgttgaccctgcttaacccgatagtcgcgggcgaaccagttggcacaggaaccggagtccgaggtgacaatggcgttatccggcagttgtggcgacatctcccacaccacccgctgcgggttgaccggattagcgggtgccatggcgcgctcttccatcagcgtccaccagtcgcgtacctgaagcgcaatatcttcctgccagctgcgatcctctttgtgctccagcagcggcagcagggcgcgcagggtttcagccgcatcgccatgcagattcacttcgctgggatagcgcaggccgagcatggcgggatcgatgtctatctgcaccgcacgcgccttgccctcttcaggcaggaaactccgtccacgggaagccactgccgatcatcagcagggtgtcgcagttctgcattaaatcggatgagggcttcgtgcccagcaggccaatcgaaccggtcacaaacggcgcatcgtccggcagcacatctttgcccagcagcgcttttgccacgcccgcacccagcacattcgcgacctgtaccacctcgacggcggcgttacgtgcgcctgcgccaatcagaatcgccacttttttaccggcattaagtacctcagcggcgcgttgcagatccgcttcataagggatcactttaggacgctgatagccgctgccggaatgggtaaaaccgtgcagatgctgcggcggctgccactcttcatcctgaatatctttagggatgatgatcaccgccacgccgttttgcgctttggcgatgcgcacgccccggtcgagcagatggcgcacctgggtcgaagtcgaagcttcctgaacgaagttggcaacgtccgagaagatgcgatccaggttcatctcctgctgataactggagccgcgcgcggtcgcttccgcctgtccggcaatcgccagcaccggggcatgatccattttggcgtcatagagtcctgtcagcagatgggtcgcgcccggcccgccggtagagaggcagacgcccagctcaccggtgaatttggcgtgtccggccgccataaaggccgccatctcttcgtggcgtacctgaataaattcgatgccgtcgcctttggcgttagcacgctgaatggcgcccagcaccccgttgataccatctcccggatagccgtagatgcgtgtgacgccccactctttcaggcgctggacaaaaaaatcactggttttcatgctcatcgtcgcgtttccccttgtagtccatgcagacttaaagcgtagtagacgatgggcaatcgccgttaattgttcgccattgccgggtatcgttgacgcaaatcactgaatatttgtgccatatccgccgtttcgcctatctctgccaccacccggaatacctgggttttcaggaagtgacgccagctcaccggcgcgcttgccagaaaggcggtcagtaactgataacgctgtggcgtccagagcgtttcgaagcgactccgtgcttcgccgtgctcaaaatggtgcgcagcctgctgcggcatcgtggcgcgcaggcgctccgttgctgcccgatccacgtggtgatcaaccaccaccacgccatactgcgtccttgctgccgcgacgctgagataaccgcagcgcacatcctgcatcaccgcatcggcatcgcgctgtgtcggcaggccataaccgcccgcgccgggtccgcgcacttcgaccacgtcacccggcaggcagtggatcacatcagtgttaccgtgattgatgacctcaccgtcgcgccgggtacggaagtaagagagcgccccactctggccgccgacgacacccgccgaggcaaacaccgatcggttacggttgcgcgcggtaatggtggtattgggcgagaaaacctcaaatgccatttcggtggctaaaccgccgcgatagcgaccggctccggcgctgtcctgggccagtccgtagcgatgaaagcggattggcacttccgcttcgttgatctcaatcggggtgtttttcagaaaggctgaaagaccgccggagccgtcaggcccatcgtgacgcggcgtgccgcccgcgccgccgcccaccggacccagcgaggcgaccacactgcgattctgcgtctgggtacgaatgttcatgattgagttgccgcccggtgaattcgcgggcaaacgctccggcatcgccagcgagaagacgccgatagtggcaatctgcgacagtgcacaggtcagcgagcgcatccctaccgctgcgggcgcttcacagttcatgaccgtgccaggcggcaggattgccctagtgggtcgcagcgtaccggcgttaagcagcagtgaacggtccagcgtagagagcgcataggtaacacccaccagcgccagcggatgccgctcacgtccgccagtcggcatattcagcgacgaggccagctgcggatcgctgccggtgtagtccagctccagttgatcgccctgcacccgcagagtaatggcgatacggcagggataaccgccctcgccatcttcatcggcgtagtcggcatagaagtattccccgtcgggaatggttttgataatgctgcgcgcctgcgcttcggcgtaatcgagaatgccctcaatgccctgcaaaaaatcggcgatgccaaagcgggcaataatgtcgtggattttacgctcgccgacgttcaccgacgccagctgggctttgaaatcgccccagttctgatccggcacccgcacattgagccgcatgatgctggcgacctcttcgttgagctgaccctgccgcatgatcttcagcggcgggatgcgaatcccctcctgcacgatgtcggtcagcgagcgcgacagcgaggcaggcaccgcgccgccgacgtcggtgttatgaatgtggcccaccacgaagcagacaatttcaccctggtggaacaccggtttccagatgtggatatcgggcgagtgggtcgccacgttgccggcgtaagcgtcgttggtaatgcagatgtcgccgtcagcgtactcttcaatcagtgccagcaccggcgcatagtcgatgccgctgtaccagggggcgccgaagctgcgcggcgaggcaaacgccaggccgctgcggctgacaatctggcaggagaaatcttccgtctctttaacaaaggtggagtgcgctgtgcgcatcagcgtaaaggccatcgcatcggcagcggcggcgcagtagttcgccaggatctgtaagttacgtccatcaatcgccatgttatgcctcgttcgccgtgatcagcagattaccgaatgaatcgaccgtgacgcccatgccgggcggcacgcaggtggtgcagtcatcctgggcgatgatgaccgggccactgagctgatgtccggcacgcagcactgaacgcagcactaaatcaacctgatgccagccgccgtcgatccacgccctggtctgtttcagtaccggcaccggttccgtggccggagccagtgggttaatcaccggtttcggcgtcggtgaggcaatcaccagccgcaggttgatcaactgcaccggcgcctgcgggtcacagtgaccaaacagctgctggtgctggcgatcaaaggcgtcatgcagcgcagtgaaatccgcctgcgccagccagttcgcctccagcggtacgtcgatctcaaacgactgaccgcgatagcgcatatccgcgctgaactgcaggctgtaaggcatatcgctgccgtgctcctgggccagccagccacaggcgcgctgctgtaatgcttcggcttcactggccagggtgtcggccagggcgggcgtcagatcgccgtagagcgtgcggataaagtcgttacgaatgtccgccaccagcccgcccagcgcggacagcacgcccggcgtcggcggcacaatcacccctttcatattcagttcgcgggccagaaagcagcccatcatcggacccgctccgccaaaggcgaggaaccagaattcacgcggatcgagaccaaagcgcgacagcagcccgctggtgtcgctgtacatgctggagatcgccagctggatggcggtttctgccgtttcctgcaccgtgacgccaagcgcatccgccagcggctgccaggccgcacaggcggcgtccacatcaacagtgacggcgttataacccagcgcgccatggcccatcatgccgcaggcggcgaacgcatcggtggcggtgggttgcgtgccgccgcgctggaagcagaccgggccaggcagcgatccggcactgtccgggcccatctgcagcacgccctgaccatcgatccacgccagcgagccgccgccctgacccaccgaagtgacggcgacagaaggaataaagatcgggaaatccccgatgatttcgccgttgccctgtgccactttgccgtcgatgatcaccgccacgtcggcgctggtgccaccgatatccaggctgaggattttttcaaaaccacaggcgctggcgagatagctggcaccaatcaccccggatgcggtgccggagagcaccatctgcacgcattcgcgtttcgcctgatcgacgcccatcaccccgccgttggatttggtgatgcgcggcggcggcctgacgccgagccgttgcagcgcctgctcaaaggattccaggtagtggatcaccatcggctgcacgtaggcattaatggtggcggtaatggtgcgttcatattcacggatgatcggccagatgtcagcggaacaggaggtcagcagctcgggtgccacctcgtcgataatcgccttcaccgccgcttcattgtgccggttgcgatagctgtgcagcagcgacaccacaatgccctgacagcctgccgcgcgtgcctgagcgattgcgtcgagcacgctctggcgatcaggcgcgtgcagcacgttgccgtgcgcgtcactgcgttcacggatggcaaacacccgatcgcgggtgatcagcggagcaggacgccgggagaaaaggtcgtggatatgcgggattttaagccgggccagctccaggacatcgcagaagccctccgtggcgaacagcgccagccgcacgccgcgccgctggatcaccgcgttaatgcctaccgtggtgccgtgggtgaagtaaccaatctcagcgggatcaatgccctgatgctgctgaaactgcgccagtccggtaacgatttcgctgcctggctgatccggtcgcgacaggactttcagggtgtgaatctggttcgtttgctgatcgagcacggcgaaatcggtaaaggatccaccaatatccacgccaacgcggtatcgcatatcggggtaactccagtgtcaggaagggggaaattccatcagcgcctcgggatgttgcaccacacgccagccgagccgctgatagacctgatgggcatcctgggttgagagcatccagcgatgcaccgtttgcagctccgggtgttcacggacgcaggttgccagccagctgcccagcccgtgaccgcgccagttttcatcaatcattacgtcacacagccagccaaaccgggtgtagtcagtaatcagtcgggcaaagccaatctggctctgctggtgatagaggccaaacggcagcgaaccggcaatcgcccgcacggttttggccagcggctggcctttggcccagtaggatttctccgccagctggatgtggatccacgccaggtcgagccgctggcggctggtggagacagtgaacgcctcgcgctgccactgctggtcagcaatctgcaatgagtccatgacaactccttgtatcggttgaaaacagtgtaaaagggttcgcccgacggttgaggctgtagcgcgctacagaaccggctgttgcgactgaattttgcgtcatgaagaaattttatgctgagggggcatctggcacattaacgggagaagtgaagcggatgggcgaacaaaagtgcggctggggtgaatcaggaaagagtaagcagaaacaaggcaggtgacggccctctctccaccggtaaacatggcgagggcgacgcctggccgcccgctacacgccgaaactccaccgaattgtgcttgccgatcagcgatcgcaacggcacgctgcttttcatgatcggggatttgatcacgatatagctgaagtacttatcgatgccgatctgagcgtcgagcatcttctcaatcacttcctggtaatgttcaatgctgcgggtaataaagcgcagcaaatagtcatagccgccggtaatcagatggcactccatcagctcatcgacgtcgcgcatcgcactttcaaatttcataaagtcttcgcggcgatggcctgacagggtgacttcggtaaagaccgtcaccgaatcggtaatgcgggtgagattaatgtgcgcttcataaccggtgataaaaccggcctgttccagacgtttgacccgttgcagacagggactgggcgaaaggcctacggcgtcggcgaggttaacgttgctgatacggccatctttctggagttgcaccaggatgttgatgtcgatgcggtcgagtttcattaagccgttcatagcacccccctcattgtcagagcctgtcccgccaggcgtcattgttgcaggcagtctggagacggacagcgcggaacaaccggcgcgtacatggcgtacgtgaggattgtaagcactgaccaggttcagactgacaaatgaaatagcctgatgggatagacgcttaattaaatgtgcagaacctcccgaaggtatatcacgctttaccgtaaacgcgccagcgcttcgcagtggttataccagcgggagattttcaaattactttaacaatatcaatgaggaatcgcactttaccccaaccggcctgtggcgcgggccagcgcaatatcgaagatatgcagcgcctcttccagctgtgagtcggtagtgaccagcggcgccaggaaacggatggtgttgcgatgcaggccgcatttgatcagcagcaatccctcctggcaggcgctgtcgaggatcttctgggttaaggccgcatccgggcgaccggtttcgaaatcgaggatctccaccgcctgcataaagcctacgccgcggacgtcaccgatgcaggcatatttatccgccagctgccgcagtcgtgcattgagttgctcaccaagctggcaggagcgctgcaacaggttttcctgctcaaacagatccagtaccgccagcgccgccgcacaggccagtgcgttgccgccataagtaccgcctaacccgccaggcgtcggtgcatccatgatctccgcacgccccaccacaccggaaatcggcagaccgccgcccaggcttttcgccagcgtgactaaatcgggtttgatacccagttgctggaaggcgaacatcgtgccggtacgcccgaagccggactggatttcatcacaaatcagcagaataccgtgctggctggtgatgcgacgcagcgcctgcataaatgccgggccagcgggcaggaagccgccgtcaccctgaaccggctcaatgataatcgccgcgacccgctccggcaggatctgcaccgcaaacagctgatccagcgctttcaggcagtccgcttcagtaataccgtgcagcgggttcgggaagggcagacggtaaatatcgccggggaacgggccaaaattctgtttgtaaggcgcggacatgccggtcagagtgatacccagcagggtgcggccatgaaacgcaccatcaaaagcgataatgccagagcgctgggtgtgtgagcgggcaatcttcaccgcattttccaccgcttcggcgccgctggtaaagaagacgcttttgtacgcctcatcgccgcccaccagtttgttcagccgctgcgccagctcgatgtagcccggataggccaccacctgaaagcaggcatgagacaccagaccgagctggcgggtcaccgcattgaccaccgccgggtgattgtggccgacattcagcaccccgatgccgccgacaaagtcgagatagcgattgccctccacgtcccacacttcactgcctctggcgcgttcgatcaccagcggatgggcggtaactacgccgcgcggcacgttctgctcgcgtgcatccagtaacaggctgttatcggagtatgcttgctgctctgccatgacattctgcattttaaaccctcatccacgtaacgtttcggttggctcaagtatcgcaacccgctggtttgtcacgctgccgtaattcctcagacagcggcatttcctgtcaaaatcctgcggcattcagcagggaaatttctctgccagcgcctgacgaatcagcgtgacaaaaacgttaacgccatgcgggatcagcgcatcgttgaagtcgtatgcagcatgatgcagcggcttgcagggtgccgaccccagccacagataggcaccgggccgcgcctgcagcataaaagcaaaatcttctgaggtaagtgcgggctggggcgcggcctcagccgtaatgcccgcctgcgtcagcgcctgcaggcaaaactgcgcttcagcattactgttcagggtcgccgggtagtagcgcagatagctgacctctgcgtgcaaaccgtgggcggcggtgatgtgctccgccatctgacgcagtcgtgcttcaatcgtcgcctgcgctgccgggctgaaagtgcgcaccgtgccggtgatgttcgcctccgccgggatcatgttgtgcgaaaagccgccctgcatccgggtgacggtgagcagcgccgtttcgcacggatccagggcgcgcgagaccagagtattcagctgcaccaccagctcgctggtcgccagcagagtatcgcgcgtcagatgcggctgcgcggcatgaccgcctccgcccagtacccggatatcaaaacggtcagccgctgccatgatcgcgccagggcgggtctgtacctggccgagcggcagttcaggccagttgtggatggcgtagaccgcctcacagggaaaacggctgaagaggccatcgtcaatcatcgcctttgcgcccgccagcccctcttcggcgggctggaagataaagcagacgctgccatcaaagctgacgtcgcgcgccagtttttctgcggctcccagcagcatcacggtgtgaccatcgtggccgcaggcgtggctcacctgctccgcgcggctttgccagtcggtgccgctctgatcctgcatcggcagcgcatccatatcagcccgcaggccaatcatgcattcactgctgccctttttcagtatcccgaccacgccggttttaccgatgccgcgatgcacctcaatgcccagctgttgcagaaagttcgccacgatgtcgctggtgcgctgctcctgaaagcccagttccgggtgcgcatgcaggtcgcggcgcaatgccaccagatgttccatcttaatatcctcgcgaacgatcaatctcaccgtacagcggctcgccacgctgatggcgccgcaggttttccagcagtgccgcaatggcgctctcattctgcgtctggctggcgatgtggggtgtgagccagatggcgggatggtgccagaagggatgacccgccggtaacggctccgggtcggtcacatctatcacggcggcacggagctgaccgctctccagcgcctgcagcagatcgtcctgattcagctgggggccgcgcccggcctgcaccagcgccgcaccctgtggtagctgattaaacagggttcggttaagcaaaccctgtgtggtgtcagtcagcggcagcaggcagaccagaatctcgctgtgcgccagaaacgccccgagctgatcgtcaccgtgccagcagcggacgccgggaatctggcgcggtgtgcggctccagccagcgcagtcaaagcccagcgccaccagctgttgcagtgcggcctggcccagttcgcccagccccatgacgcctacccgacgctgcgcggcaggtaataccgcgtgtgccagccactgctgctggcgttgctgatgaaaatagcgcggcatgtcgcgatgcaggccgagtaccgcgaaggtgacatactccaccatgccctgggtcaggcctggctcgatcatcctgatcaccggcaggtcgggcggcagcgcgccaaggtcaaactgatcggccccggcacccacggagaacaacagtttcagccgggggaaaagcactgtgatgtcagccggtggctgccaggcgaccagcgcctcaacctgctctggatcgccggtctcaggccagatatgcagctgaatgtcaggcgcatgcgctgccagccagcgctgccagatccggccacgttccggctccgatttatagacgatatgcatcaggccatcgcctgcgtcatcagtccaaacgcctgcatgccctgcggtgtccagggcgtgccgcgcaccatagtcgcaggcgcatcgacctgagggatgcccaggctctgtagccaggcggccatcggcagcgcggcatcggtgtcgatgcgcaggaattccccctgcagcgactgcatcagcgaggcgaccagcgcctgggctaccgcgaagtctcccgcgatgatcgggcctatcgcccagccgtgaccaaagcggcgcaggctggcgaagccctgaatttgctgatggtcatcctgcaacagcaccgtctggcagtcgcgcagcaggtggtcgaacagtgccggacgatgcataccgtgcgcctgctgatccagcgtcaccagtgtggcgtgatcggccagtgttgccggacgcagctgcagtcccgccgggatcacgacgtcaggaagggtggtcactgcgcgggtctggtgctggcgaatttcaccgcaactgacaaacccgagtttttcatacaaacctttgcccatttcggtggcgtgcagacgcacattacagtcgggtaatttttccagttgcgccagcatcagctgtttgcccaggccacgcccctgctgctggttatcgacgatcaccagccccagcgtggcggcgcgctcgccccagcgccagagcaccgcgctcgcaatcagcttgccctgctcttcaatcaccgtgccctcgcccagctgcagcgccagctgccagtcttcacgtcgatggggccatttcagtgcctgcgttaaggtgaaacaggggtcgagatcgtccggcgtcattgcgcgtattttcaggctcattgcaggtctccttacatcatgcctggtgtttcaagtccgctgccgtcaaccagacggctgtagcgataaggggtgggatcaacgactggcgtggcttcggtcgccagatcggctgccagtcgtccggcacccggtccgataccgaagccgtgggcgctgtagcccgccgagagcaccagccccggcaatttcgccacggtggagatcaccggaatcgcgtccggggtgctgtcaatcatgccgccccacgactgtgccagtcgcaggttcgccagcgccggatattcacgccgcatcgccgccagcccctcttccacgatcgttgcatcggctgccggatcgagaatgcgcatgcgctcaaacggcgactcgcggtcaaatgcccagccacccatcgcttccgggccattgaagaacggcgacaggccaagattcagggtgagattcttgcggcgacttttaaaggtcggatagaactggcgggcatagcgcagcccctgcgcgccaggttccagacgcccgcgaccagagactgagacggtgtaactgccgtccatttgtggccgacaggcaaagccaggtgtgtagagtggcatggcaatcgcctgctcaatgggctgcgtgcggaaggcggtgccaatcacgttgcccagcggcagatcgataccgtgacgacggcaaaacatggaggtccaggccccggcggcacagatcacccggctggttttgatcaggccgcgctcggtccagacgccgctgacccgtccggcggcgatatccagcccgcgcaccgcgcattgctgaaacagcagcgccccttttttcagcgcgcccgccaccagcccgggcgcggccagccgaggttcggcgtgaccgtcggtaggcgctgagagaccgccccgccagcttgtggtgctgccgggcgtcatcgctttggcctgctccgccgtgaggatcgaactgcgcacgccatagccttttgccatctggatccacttatcccaggccgcgatgtccgactcttcctgcgtggcgtaaaccagcccgctgcggcggaaacccagctcttcgccggtttcatcgttaagctcaccccagcgttgcagcgcataaataatcagcggcaattcacgttcatcacggttctgctggcgacaccagccccagttacggctcgactgctccgctcctaccaggcctttttcgattagcacgaccttcagtccctgcttcgccagctcccaggtggcggcggctccggcgataccagcgccaatcaccactacatcggcggaatcgggaaaattcgcactgtcctgtacataacgaatcggtgcaggcataacaagactacctctgttgtcagtatctgatcagcgcagagcgatatcaccgctgtgtgctgacccgcgccgcccgcgcattacatcagtgctgtgcaggcggattaatcagggtgcccgttgcttcaggcaactcactctgcttttaaaatctcttcatgctcatccagccagccctgacgcagctccggcaccgcgcgtttcagccgctcgaaatacaactcgctggtcggcttgtcgtagtcgctgcgcgccagctgggtgacgatacgaccgctcttcatcactacgatttcatcacataccgcgcgtaccgcatgcatgtcgtggctgatgaagatcaccgagagtcccagtttcgcggcgcagttcgctgattaagtcgaggacggcagcggcaaccaccgtatccagcgccgaggtcacttcatcacacagaatcagatccggctcagccgccagcgcgcgcgccagattgacgcgctgcttctgcccgccggagagcgcccagggacgccgccacagcacactgcgcggaagctgcaccagatccagcagctgataaagccgctgctgtcgggccgcaccgctcagaccgtgaaacagcgtcagcggacgcgacagtatgcgttcaacgctgtgggccgggttcagcgcggtgtctgccatctggaatacatattgaatgcggcgcagctcgttgtcaggccgtttttgcatatcgcccgagatgtagtgaccgttgaacagaatatgaccgtggcttggagcgttgagtccggcaatagcgtgcgccagggtggttttgcctgagcctgactcaccaatgatgccaatcgcctgccctttccacagcctgagattgatatcttccagaatgcgtattttcgggtagccatcgctgccacgcggaccataacctgcgctgaggtcgcgcacctcaagcagcggctgaatatcggcggcaaccgggcaccagttgctgggccgctctttctgccgcgccgcctccatcagtaagcgggtgtactccgcctgcggtgcgccgatcagatgcgcggtgctgccatactccgccattttgccgcgcagtagcaccagtatccggtctgccatctgcgccaccacggctaaatcgtgactgacgtaaatcgccgtgacgccgcgctgcaccaccacgcggcgaaacgccttcagcacttccacctgcgtggtcacatccagcgcggtagtaggttcatcaaggattaccacgtcaggatcgccaatcagcgccatcgccgtcatcagacgctgtaactgaccgcccgacacctggtgcgggaagcggtcgccaatggtctcggggttgggcagcgccagttcgcggaacagctcaatcgctttggcttttgccgctttgcgggtcagggtgccgtggataaccaccggctcaatcacctggtcgaggatcttcatgcccggattaaacgacgctgccgcgctctgggcgatataggcgactttgttgccacgaaaggcgcgcagctgccccggcgtcaggctgttaacgtcggtgccggcaacgtgaatgttgccgtcggcgatgcggcagccgctgcgggcgtaacccatcagcgccatcgcgatagtggttttacctgagccggattcgccaatcagcgccagcacttcgcccttctgcacggtaaagtgaatgtcggaaaccaggtcgatctcttcgccgcgatcggtctgcgcagtgacgcgcagtttatccaccgaaatcaccggcatggcggtatgtggtgtcacgttcatgctccctccttcgccagcgtcatcggacgcatcgcctgcaggctgtcaataaacaggttggcgccaatggtcaggctggcaatcgccagcgcgggcatcagcaccgcaggcgagccgtcaaacagcccctgcatattttcacgcaccagcgtgccccagtcggcgtagggcggctgaacacccagaccgaggaagctcaggccgcttagcagcagcacgatgtagacaaagcgcagaccaaagtcagtcagcatcgggtgcaccatattgggcaggatatcgtgaatggcgatataccagcggctttcgccccgcagccgtgacgcccggacgtagtccatgctgcgcagcgagctggccatggcaaacgcgatacgaaatgcgcccggccagtaggtgaagaccgccgtgaggatcagcatcggcagtgaggagccaaataccgcgactatcatcagcgacagcactttgcccggcagtaccagcagcgcgtcgttgacgcggcccagtacctcctccagccagcgccccgccaccgctgccagcagcgccagcagcgtgccgatcaggctggccagcagcgccgcactcagcgccagaccaatggagaacttcgcgccatagagaatgcggctcagcatgtcgcgcccaaggtagtcggtgcccagcaggttatcggacgtcaggccgcccatcagcgggccgccgccgatgtcatcaatgctgtgcggggccagcggggtgccgaataccgccatcagcagccagaacagcgatattatcagacccagccgtcccgaccaggagagcgactgtaagaaacgccagggcaacgagagaatattcatgcgcttctccatttcgggttaaaggcgatagtcagaatgtctgccgccagcagcaggaccagatagcaggcggcgaaacagcatcacgcagagctgcaccaccggcaggtcgcggttactgaccgcatccaccagttggctggcgagaccgggatagctgaagatggtttcgatgatgattaccccgccaaacagataggagaggctgagtgaaatggcattggcgatggggccgaccgcgttaggcagtgcgtgacgcagcaccgctctcagcggtgaaacccctttcagcagcgccatctccagataagggctgtcgagctggttgataatggctgcccgcgtcatacgtgccatctgcgccaccagcacgcagcagagggtcagcaccggcagcgcgtaggctttgaggtaactcagcaggtcgctatccgggctgccgaacgacatcgctgacacccagtgcagcttgacggcaaaaatcagtaccgccaccgtcgccaccagaaactccggcacggcaaccgtcgccatggtgccgatgaccagcgcccgatcgagccgggaaccgcgattcatcgccgcaataatgccgataatcagtgccagcggcacgcagatcagcgtggtgatacccgccagttcaaaggtggcgggaatgcgctgcgccaccagctgcgagaccggcaaatggctggcaaacgaggtgccaaagtcgccctgcaccatgcctgtcagccagtggaagtagcgcatcagcaaaggctgatcgagacccagctgctgccgtaacgccgccaccgtttccggcgtggcgttctggccgaggatcatctgcgctgcgtcgcccggcagcaggctggtgatgaaaaacaccaccgccgagacgataagcaaagtcaggatgccggcaccaattcgccgggcaatcaggaacagcatgtatcggttcatcggcgtactccttcctcaaataacgtatcaggcgctcagccacgcaaattcatggaagcgatagcccatcatcatgcctgacggccaggcctccacccctttgacctttttgttgtagccatctgtggagctgataaaggtcgggataagggtgccgcagtggtcataaatcaacttctgcatgtcgccatacatctgcttgcgtttcgcctgatcgcgctcaccgcgtgccgcgaccaccagttgatcaaactgaggatttttccagcccgattcgttattcggtgcggtagagagataaaactgtgagaagagcatgtcgagcgtcggacgcgggtttatcgagccatatcccaccggatctttcatccagtgcgaagaccagtaaccgtcatacggcacacgtcgcactttgatgttcagccctgccccgcgcgccatctgctggatcatctgaccgccttcatttgccccttcgatattcggcgtggtgatgatctccaccgtggagcccgccatgcccgcttttttgatgtggaacttcgctttttcaatgtccagcgcacgcggtttgagatcggcgttatagagcggatgccacggcggcaccggggtgtcattactgacgtcgccgtaaccctgcagcaccgttttcaccagcatttcacgtggctgcagatatttcatcgccagcacgaaatcttcgttgttacccggcttcacatcggtgcggataatcaggttggtgtacatgcccgatttactctccagcacgccaaattcgctgctggctttgatgcgcttgcagtcggcagcggtcagcgtggagaccatctgcagatcgcccgacatcagggcattaacgcgcgctgcgccgtcggtgacgccaatcagctctacctcatccagatgtggcagaccaggtttgtagtagttggggtttttggtgccgatggtgcgcgtacccggcataaatgttttgcagacaaacggaccggtgccgatgcctttgctgaaatctttggtgccgtccggcacgatcagaaacggcggtgtcgccagcatataagggacgtcgaagttagcgctgctcagctccagctgcacctcgttatcattgaccgcgctgaaggttttaaactgatcggccagcttaaaggcgatagaggcgatggccggatctttgtgacggctgagcgagtagatgacatctttggcggtcagcggtttgccatcatggaaagtgacccccttacgcagtttgatatgccaggtaatgccgtcgctggattccagcgattcggccagcgccggttgcgccatcaggtttttatccagctcggtcaggccgctgtagaacatgaactggcgggtgtaatccgcactgttgttacttttggccggatccagtgtatcggtggccgaggcattcgacatcgccgcccgcagtttaccgcccctgaccggcttgtcatccgccagtgccgctcctgaaaaagtgatcaggccgctgctcatcaccgcaccggctgagagcattttcatcagactgcgacgtgaaagtgagccttctgtgatcatgcgcgtcagtgccggatttaccgcatcagcgtcgttattatcaaatttactcatctctgtaccctcaatagtcaggcgaaccggggatcatgttctggcggtgctgataacctggcggtcagcacccgacgggacgttatgaaaggcgatcctttgctttgtaatagagtcctgcgagcggtaaaaaccatggcttgccgtgatagccgggcagcgcgggccatgtgtcgcgctgccagggattttcagtgcgcttttcagccagcagactggccatgacgcgtcccatccacaccgacatctgggtaccgtgaccgctgtagcccagcgaatagaagaggccatcctgttcacccgcgtgcggcagacggtcggcggtcatatcaaccataccgccccagcagtaatccacctgcgactggccaagctgtggcagcatctgcgtcatcgcccggcgcaggatctcgccgctacgcgaatctgacgtcgggttgctgacggcaaaccgcgcccgcccgccaaacaccaaacggcgatcggccgtggtacggaagtagttgccgatattcagtgaggtgacgtaggtgcgatcgtttggcagcacctggcgcagcagcgccgggtcgagcgcctccgtcaccacgataaagctgccaaccggcacaatgcggcgctgaaaccagggaaaagggccgacgttggagcagccggtcgccatcagcactttgtccgccagaatggtgccctgcgcggtctctacccgatgctgataacccttcaggcgtgctaacttcgtcacggcgtggtgcgggaaaatcttcgcgccgctgcgggcggcggcctcagccagcccgacgccgaacttgcccatgtgcatctgaccgccccgtttctgcagcaggccgccgtggaagttatcgctggcgatctcgtcgcgtaccgccgttttgtcgagcagttcgatctccgggtcaacggtgcggcgcatcagttcatacgcttcctgcagcccggccacatgcgacgctttgctggcgagcttgagtttgccgcacagccggaagtcgcagtcgatcgcttcatcctggatcagttgctggacatagctcaccgcctcatcaaacgcccggtagaagcggctggcctgctccagaccctggctcgccaccagcgaggcgaagttctgcgccacaccggtgttgcagtggccgccgttgcgcgccgaggcctgactcatcacgtcgccactctccagcagcacaacgctgatgccgctgcgcgccagattcagggccgctgagatgccggtgaagccaccgccaatcaccaccacgtccgcctgtgcgggcagcggttcgcgtgcggcaccggtaaaggccggagcggtggcctgccagaacgattccagtttcatggggtgttcctcagagtccgacgacgccaggcaggccgccgatatcgttgatttcggtgtactggtaatacggattcgccggttcatgaccgcgattgacccagactttgtttttgatgccgagatcgtgggcagtcatcaggtcatagcggaagctggaggagacgtgcaggatctcctccgggccgcagccgagcttatccagcatgtactcgaagcccttcatctgtggtttgtaggcccccgtctcttctgccgtgatagccatatagattggcgcgcccagacgcggttcgtgatgcgggatcaggtctttcatcgagttggtcagcagcaccagcggaaactccttagccacctttgccagcccggcgggcacgtcgggatgcggaccccagctggcgcagtcggtgtagataaagtcgctgtcggctttgtcccaacggacgccccactttttgcaggtgcgctgcagggcattactcaccacgtcgtaatagggtttccacgcgccgagtacctcatccagccggtaactggaaaagtcggtagtaaaggcgtgcattgcgtccgggtcgacgcggtcgctgaaacagcgctgcgcggcacccgccatatcgaagcgaatcagcgtgccgtaacagtcaaacgtgatgaatttcggtttaaacagtgccatgtaacaccctcgtcattgtcagttgcgcttagaaatcgatgagtacactcttctggcgctggcaggcctgaaacgcctggcggcctaaatctttaccaatgccggagccgagaaagccaccggtcggaatgatgaagtcgccggaacgcccatagcggttgatccagacggtgcccgcgtcgatggcgcgcattgcccgcagcgcgcgcggcagactcagggtgtgaacaccggcgcagaggccataagtgtcatgggcggccatcgccagtccctgctcttcatcatcaaacgtctgcaccgtcagcaccggaccaaaaatctcctgctggactgccgggttatcctgcgccacttgactcagcagcgtgggctgccagaaccagccgtcgtcggtgtcggcaaaacgctcaccgcccaccagtacttctgcgccctgcgcttttgccgcttcaataaccgagcagactttgttgccctgtcgttcgtcgatcagcggcgcgtagcggctgccctcctgccaggtgacgcccggtttaacctcccggcaaagttgagccagccgctcaaccagcggatcggcaatgttgcgctgcacaataagacgggtgcccgccacgcaggcctgaccgccgttggcggtgaagccgcgcagaatccgctgggccagcacctcaaggtcacccgcgtcatcaaacaccagttgcggacttttgccgcccagctccagcgtcaccggcttcatgccgttttgcgcggcatcgctcatgatgcgcgcgccggtcagggtcgagccggtaaacgagactttgcgcaccagcggatgttttaccagcgcgctgccggtcaccgcgccactgccttgtacaatgttcagcacgcccgccggtaagcccgcctgaatggccagttcggccatgcgcacggtagaaaacggggtcagttcagagggtttaagcaccaccgcattgcccgccgccagcgccggtccgcatttccacgacgccatcgacagcgggaaattccacggggtaatcgcggcgataacgccataaggttcggcaattagcatgcccaggctgctgtcgcgggtgggaaagagatccccgctgtatttgtcagcgcattcggcatagaagcgaatcgcttcggcggtaaaaggaatttcgtgcagcaccacgtcattgatcggccgggtggagcccagcgcctccagctgtgccagcagcgcgtcctgctcaatcagatcggcccagcggcgcagtacccgtccgcgtttcgcgcggcggacaaccggaccagccgctgcttttcagcgcctgatgcgccacagtcacggcacgatcgacatcctgcggcgtggcgtcctgcagcgtggcataaaccctgccatccgagggacgtttaacctcaaaggatgcgccctggctctggcagtgctggccgccaatataatggccagtcgggagagaaactttttctgggtcgaaacttaacatggaagaattccttatttgttacacccatcagttgctggtttattagcgtttaaaactgccggtttctgcgctgttaataagctaatgcagaaagtatgccagccgggcaaaaaataaaaatgcgtttaaaacagtgcaaaaaaattttctgccgtattggcgggggattttttgcggaattgccgaacaattaaacagatgatttacttcacaaaatttatgcgccctgctggtgcaacctgcacggaaattgcaccaaagcggatattgctgataaggctgctcattccggtacgcatgacccgccgatttaacgacccgcttcacatccctgataaattctttaatttttcagaacaattatttgacgccggtaagtttttacggagcctcaggcaaaaaaaggccagccggattatccggctggccttttttcatttttagttacagactgccaatgtgaaatgttttctgttccagatattcatcaattccatagcgggaaccttcccggccaataccggagagtttcacgccgccaaacggcgcgacctccagggaaatagcgccggtattaaagccgaccatgccaaactccagcgcctccgctacccgccatgcgcgccggatgttctcggtaaagaaataggcacccaggccgtagggcgtgtcatttgccatcgcgatcgcctcctcttcatcgtcgaagataaacagcggcgcgaccggaccaaacgtctcttcatgggcgatgcgcatggcggcggtgacctcaccgagcaccgtcggctgcacaaaggtcccgttgccctggctgatgccgccggtcagcagcgttgcaccctgactgagggcatcgtcgatatgaccgttcactttctctaccgcgcggctattgatcaaagggccaatagtgctgtcgggcgcaaaaccatcgcccactttcagagtggcgaccgcctccagcaatcgggcggtgaaacgcggatagatacttcgctgcaccaggatgcggttagcgcagacgcaggtctgcccggcgttgcggaacttgctgagcatgacccccgcgacggcaatctcaatatcggcatcatcaaacacgatcaggggcgcgttgccacccagctccagactcaggcgcttgatgctgtcggcgctctgttgcatcagcaactgtccgatgcgggttgaaccggtaaaggagattttacgtaccgtgcggctttcagtcagcgtcgcgccaatctccttgggcaggccggtcagcacctgcagcacgccggacgggaagcccgcgcgctctgccagtaccgccagtgccagcgccgacagcggtgttaactcggaaggtttaacaataatcgggcatccggcggccagcgcgggcgccaccttgcgggtgatcatcgcaatcgggaagttccacggcgtgattgcggcggcaacgcctaccggctgtttcagcaccaggatgcgccggtcctcgctgggcgcgggaatggtgtcgccatagattcggcgtgcctcttccgcgaaccatttcacgaagctggctccatagagcacttcgcctctggcttccgccagcggtttgccctgctcggcggtcatgataatcgccaggtcgtcagcgtgttcaataatcagttgatgccacttttccagcagcgcggcacggctggcattggtggttttgccccagctgatgcgcaccgtttccgcataagctatcgcctgcccggtttctgcccgacccagtgccggaatcgtcgccagggtttcgcccgtggcgggatcggtaaccggcagcgtggcgccctgatgcgcatcctgccagcgtccattaaacagcgcctgctggcgcagcagatcgctatcgttaagttgtagtcgcgacatatcatccccttgtggtcagctgattccactttatcgcgccgggtcagcgcaggatgttgttgtgcggggtgagaaaggtcgataggggagattttcgcaatgatttgaaattttatgccgtgcggaaacaggcgcgcatccgggtggatgcgccgtgtgcttaaatctggaagtcgataaccggttcgtcgtcattgctgtaggagagcgcctgacgcttgatctcttccagcgacaggttggcgttgcagagttccaggaactgccagacgtagttgcgttgcagctggccgcgcttgaggccgagccatacggtgctggcatcgaacagatgcgtggcatcgaggcgtaccagctcttcactctcttcagtttcacacgcctgatcggccagtatccccacgcctaaaccgagtttgacgtaggttttcaccacatcggagtcctgagcgctgagcacgatatctggttttaaaccggccgtctggaacgcacggtcaacccgcgaacgtccggtgataccctgccggtaggtgatcagcggatagcggctgagcgtgctcagtgaaaccggctgattctgcaccagttcatgccctttcggcaccagtaaggcgtgatgccagctgaaccaggggaacgccgccaggctgctgttgttgaccagtaattcactggcgatgccaatgtccgcctcacccgccagcagcatggtgacaatttcctgcggcgaaccctgattaagttcaagccggacgttgggatagagctgacgaaatgctttgatgactttcggcaggctgtagcgcgcctgagtatgggtagtggctatggtcaggatgccactggtttcattggtaaagacatcggccagacgtcgcactttgcccgcttcatccaggatacgctcagcgatggtcagcagcgctttgcccggttcggtcatccccaacaggcgcttgccgcgacggataaagatctcaaccccgagttcatcttccaggtcacgaatgtgccgacttactcccgactgggaggtaaacagcgtattagcgacttccgttaagttaaactcacagcgggccgcctcgcggatgattttaagctgctggaaattcacggtatttacctccctttacataatctgattatctgatggtaagaactattattgataaccggaaatactaaaaaattcggatttatgactttagggaataacggggtgggtttgggggggcagagaggtttgagatgggcggccggacttcagaatttgactgaaacccggcctgggggagaggctattttacagaaggcgatagattacgcattctggcgctctctgctttcatctcttcatagcttgcttccaggatccacagacaggtcgcaccctggtcagttgccagtagcgccagacgggtttgttgataaaaatcctctataaaggctgtaggttgctcagccggaacgctgcagacaatgtctgtacctgccatatggggccaggatctggcgtcaataacccggagcgtctccagcacgcccggggtattctttgctaacgccgaggcaagggcatcttccatccgggttgcctgctgaacatcagccgtagctgccagttggggcacttttgcaagccaggcttgctctcctgacgctatgcccttcagcgaattttcccagtcggatgtattcgctccagcccagaccgcgaagggcagaaggccaatcaatatcagatatttcatcggaccacctccagcgtcccgccttcacgcagcacgcgtcgccgggttgcaagtgacataatgatgcagccttctgaggcgaagcccgctggcttattgaccctttcgccatgaatgcgaaatgccgaacggccaaaagactctccggaagtctgcaccagaataatggtcaggggtccttttgatgtggagtgccctgcaattctgtacgttccctgaggaaggggccccatccctcttacatgctggcgatcgggattatttttgttagtcagactacctgagtagccggcctcaataaattcactgttgtggtataagtgacccgtgctttgctcatatgtccatgtcatcgttatattcctttatgctgtcactcgatcattccagctgtccgagtggacgatatttccgtctgcatatcgccaggtaattttttcgtaaatcagctctacagtttccagatgatcccgcgcctcaccatagcgggatttaacgtcatacatcatcgggcccacacagataacggttacgccttccatcaaagtattgaaatattccacctcctgccccgcgtcatttatccggtaaaatcttatttccgctgagcaaagcttttgacctgaggtcacagccctgtaaaggcagggactggacttatcgatctctttatcaaaactgtaagaagcgtgttcgcggacagcggttgttttacccgtcacgttgtctgtggagagcatgacgccgtgattcaggccgaggacttcaatagcgccttcacgacctgccacgtcgactgatccgacaataatgttgttaccgtcatctttaagccagagataagctggaatagccatcgttttaaactccattttaaaaagagaaagccagcctgttttctgctgacaggcccactgctttcacagcctgattaaactatcttccggcaaacatcagatcaattttcatacagcgtgaaatcaacctgattgaagttttattgtttcagatatagagatcgcggaataacccggtatcagagaaaaaaaacgtgcccaaaagctattcagaataatttaaaagtcgcatcagcaattcttcacgccaacatggatttatcattcgtgctatgaagttcacattgtgtcgaaatggaaagatagaacctcttcctgtccagccagtaaacagctctgtgcagcaaataaatacagaaattacagacgaaggtttaccagaggcgtccgcagcgctgaggaacaaccggaggcaaggatgagccgacaggacgtcggcgaaagggcggtacgagccagggatggcgagtccggacggtccgtcggccgcagggcgtgacgaaggcaccccgcacagcggggcgcgcaggcagccggacgccgggattgttaaggggcgggcgtccgccccttgacgcgtccgcctgctcaggcaacctgaaactcccgaacgcctggcgggcgtaacccgctcagtgctaacgcggggctaagtgatctaaaactcccatatgtttggcgggcgtaaactgctcagcgctaacgcgcggctaagtgacctgaaactcccatacgcctggcgggcgtaacccgctcagtgcaacccgctgcaaagcgaaaccggctggttgccagcccgctgcaagcgccctcttaactcactaacatcaactcccgctcctcactcagcggcttattcagcagcgacagcagaatgttcttcactgcctgcgctgaaggtgacagcggcaaccgggcggagacgttcagtgacagcggcagactcaatgacgggctgttaatgcgtgacatccaggcatcggtggatcccaccagcgaaacgggcggcggactcaggtaatacggtcacgcccatgccgctggaaatggctgcggtcagggttgaaatcgattcgatctcaccgatgatgcgtgcactcagacgacgcagcgaaaaggcctcatcgacccgcttgcgcactgcgctgtaatcgcgcggtaagaacagactcatctgcgccacatcggccagatcgacgctggctcccgggtaatcggtggcgcctaccagaaacagatcctctttcatcagcggcatgctggtgatcccggcagtgggtgcacgatcgtacagcaccgccatatccagctgaccgttcatcactttctcattcagcacgctgccgctattttcgtgcagataaaccagcacttccggaaattgatcgcgaacggtctgtaacagcggcatggtcagcgatgaagcagccgtacccggggccagcccaatcgatacctgtccactcagtacctgaccagcgttaattaccgcagtctgggcctgctcacactggcgcagaatggtgcgcgcatgaccatagagaatcttacccgcctcagttggcgtaacgccgcgcttggtacgaatcaacaactgctgatccagttcattttccagcgtcgcgacctgctgactgagtgcaggctgggcgatgtgcaacacttctgctgcctgcgtcagactgccgatatcgacgattttcacaaagtacttcagtcgtcttaaattcatcttgcctccgtcactcaccccgaatagcgaaatgggtctgatcccatcgccctgataacagagattttgcaagatgcaggccaggtttaaaaaactcaggccatcaagcagccagatttttcctaacggcccggaaaataagcgtttctgattacctcttatgggttaataaggatcaggaatggctgagaagagagagtaaagccgtcaggcgcactgtgacagtgcagacgctgcgagtcagacgtgcagaaaagtgatgacaggctgtacagtttgagtgcagtggaaacgcattgcacctgatgaagtcttgcagcgcctgaacagaggcgtgaaaaacagggagtgaatgtaaccgctatcagcgggatttcttatcgctggcgaatgccggatgataaaaagcaaccgttgccctctcccgcatccggaagaaggcaacgcctgctgattaacgttttttgcggttacggtgcatgtcgatagagacggcggccacaataatcatccctttgatgatgtcctgaatgtacgcatcaacaccgacgaaggtgaatccgcttttaatcaggccaaggatcactgcgccaattaatgttccggtgatacggcccacgccacccatcaggctgctgccaccgataacggctgcagcaatggcatccagctcgtacgacatccccatgctcgactgaccgctgctgacgcgcgccgccagtactacacccgccaggccagagagcgcgcctgcaatggtgtagacgataatcagatacttattaacgttgataccggagactttcgccgaggtcatgttgccgccgatggcgtaaacatatttaccgtagcgggtatgcttcagggcgatatggaacagcagcgccaccaccaggaaaatcactaccggcatggcaccctgtccgattgaggtgaagccatcggaaaggaagctgatcggattgccctgggtgtaatactgcgccagaccacgcgccgacaccatcatgcccagcgtggcaatgaagggcggaataccggtgcgggtaatcagcacaccattgaccacgcccgccagcaaaccgacgccgataccggccgcgatagggatcaccgcaggcatattcaccagcgacggatacattggcgacaggctgtcagaggtctgcgccaggctcgcggccaccactgccgccagggcgataacggatccggaggagagatcgataccggtggtgatgatgacctgggtcacgccgacggcgataatcccgataatcgccacctgcaatacaatcaggatcagacggttggtgttgagcaggaaagactggtcacgcacgtaccagccgaacatttcaaaaattaacgcaatccccaccatcaccacgaaaatgccggtatctttcggcaatttatgacgcaggctggcaaaaaaagagggttgctgcggggctgccggggtggcagtagctttcatattgctcatagtggtctcgcgcctcactcggatgccaacgacagaatggtttcctgatcggcttcttctttatcgaggatgccggttatacgcccgccgtgcatgaccattacccggtcgctcatgccaagaatttccggcagttcagaggagaccatgatgatagccacgccacggttggcaagttcactgattaagcggtaaatctccgctttcgcgccgacgtcaatgccgcgcgtcggttcgtccagaatcagaatcttcggttgcgccagcagccagcgggcaatcaggactttctgctgattaccgccgctgaggttattgatgatttgatccatggtcggcgttttgatgttgagacgacggatttgatccatgcagtcctgcgccatcttcacatggctgacaaacccgcttttgccgctgtactccggcatgttaacgatgctcatgttctccattaccgatagcaccagaaacaggccggactttttacggtcttcggtgaggaacgccatgcccttttcaatcgcggttgagggtgagtcgatcgtcaccggcacgccatcaatcaggatctcgccgctgtcgaagttctccatgccgaacaagctctccatcacctcgctgcgacccgcacccaccagtccggcgacgccgaggatctccccccggcgcacactgaaactgacgtcggtgaaacgatctttgcaggtgagattgcgcaccgtcagcacctcttcaccaattgcgctgttgaatttcgggaacagctgggtcagttcgcgtcccaccatctgggtaatcagcgactgacgggtatatttcgacgtctgatcgctggcgatccagttgccgtcacggaagatactgacttcgtcggtgatggtgaaaatttcatccatcttatggctgatgtagatgatcgctttgccctgctcccgcaggtcacgaatgatggtaaacagatgcgccacttcggtttctgtcagcgcggaggtgggctcatccatgatcacgatgtctgaatcccatgaaactgctttggcaatctcaaccatctgctgcgacgcgatgctaagctcgcccaccatccgatcggctttcagacggatattgaggcggttgagcagttcctgcgtcatctgattaagccgggcgtgatcgacaaagccaaatctcatcggctcgcgacccagccagatattctcggcgacggtcatgtaaggcaccaggttgagttcctggtggatcattgaaatgccggaacgcaacgcgtccatggtgtcctgaaactgcaccggctcccctttaattttgatggtcccctgatcgggacgatacatcccgatcaggcacttcattaaagtggatttgcccgcgccattttcgcccatcaaggcatgtaccgttcccggacgcacccgcaacgacacgttgtcgagggctttaacgccggggaagaacttgctgatgccttcggcttcaagcgcaaaagcgttcatacatcacctccgtacagctgggtcaggaacgactatttcaggttacgcttggtaaactgttccatgttttctttagtaatcaactggtaggggatattgatgactttctgaactttctcgccattcaccagtttgattgccgtctgcaccgcaccttcaccctggccctgcgcatcctggaataccgtggcgaccatcttgccctgcttcagcatctgcagcgcatcgggtgtgccatcgacgccagcgatcaggattttgtccgggtttttacccagtgcctgcagcgcaccgatcgccatttcatcgttgttagaagcgatggcattgatctcatcaccggcagtcatccagttactgactacgtctaccgcatcgttacgggtaaatttggcggtctgtttctgaacaattttgatgccagggaatttagccgcaacctcttccacacctttggtacggtcacgggtcgcttcattcgccaggtcacccatcaggatggcaacattgcctttgccgttcatcgctttagccagcgcttccatctgtaagcgtccggccagttccgaatctgacccgacataggccattttgccggtcagctcagcctgtggacggcggttgacaaagatcagtgggatacccgctttgctcgcctggtccataatcggttttaccgcattggtatcgaccgggttgacgatcagcgcatcaaccccctgaccgataaagttctgaacctgctgcagctgctgtgaaacgtcgccttttgcatcctcaacctgccctttaacgccatctttctgcatctctttctgcattgaggtacgcagaatggtgaggaagttgtcatcaaacagcgccatggagacgccaactgagatatcttttgccataaccgcggcaggtaacatgcaggctaacagtgaggcgacaatcgtttttttaatgttcatagggacccttcttatttgttaacttgctcagcggctgtgaccgcgaatgaaaaatatcttttacattcacccagcctgtctggcgtttgtttcgggaaatttgaggtaagacttcaggttctgactatttttgtgatcgaccactccttttcacaatcacttgatctgcaaacagttaacttcaaaatagcgtttcactttcagacgataatgacgaccgtgatgataagcagtttatttattccatataatcacgttttgaaatttttatcataaaagcactgaaacggttgttttaacatcggcaaacaacaaaactttgacatgcctctaacatctgcggagaaatgcccgcaaagtgagatcctgttggcagtttgaaaatccagcagaatcgggtaaaaatcgccaatccgctgcttttacgagcatctgaacgcaattcggtaaacagggctttgacaagcgggatctgcgccgctaatattcgccccgttcaagcgattcctctgtagttcagtcggtagaacggcggactgttaatccgtatgtcactggttcgagtccagtcagaggagccagaattagaaaagcccgctcagggaaacctgagcgggctttttgcatttatgttttcggtcacggcggcatgacatccccgcctgaatggcttacacctcaaacccgtagtgcgagccgtccggcagttccaccaccagccgcagcttaccccctgccgcatcgatatagcgcttgagcgtggagagcttcaggtcgcggcccggcttctccatgcccgccacggtaggctgtgtaatgcccagcgcctttgccatttcgacctgtgttttctgcactttctcgcgcagctcggcaaggtgaatgttgagcaggatatccgtcgccatcgcttgtgcgtcggcaacgacttccggtttttcatccgcaataagctgttcaagcgttctgcccatatggttactcctcatctttaaaactattcagccagtgtgtaaattcccgatcggcaaccggaagcatctcctgataaaaacgcttttcattgcccaccttatttccggcacaaagcacaatcgccgtttcggtttgggtcaaaagcaaagaaagcccttatcggatcgccgcgactctgaatacgcagctctttcatgttgatataaacagagccttttagcgtatccgcgtatggcctggacaaccccggccctttttcgcgcaacaccattaatgctgccagtacgcaggcgcgatcgctctcattaagcaaggtaaaccagcgatcaaacctctccgtcgttttaatcatccacacgggatctccttattaatataggtcaaatactatataggtgtaaagcgataatcgagtgtgatgcagggggatttcagatgcctgtgcttttagtgcaaagtgagagaagcgttcagccgggtcagtgatgaatccacacaaccttcatcgttttgcgagctgtaccggattggttatggggtgagatgatgtgaggcgttgttatcaataagaaagcccgctcaggcttccctgagcgggctttcactttgttcgcatcgcttccctgccaatgcagagtgacgcttttagcgcgtgattacggcagcgcgatacgggcaatctcgtcagtgcctttggtggaggaatctttgttgaattccgccttaagcgtgacatagagcgtgttgttgtccgggccaatcagcaggctgtttgggttcttgtcaaacgaccagctgtttttcaccgcgtaggtggtggcatccagttgcagcactttcttcgattcgcgctggctgatgtaaagctcattgcgtttagcgttgaacttgatgcccatcgcatcgccttcgatgcgcttgatcactttgccggtgcgctcatcaaagatcagcgtggctttgcctttggagtcgtcagtaacaaacaggcgaccggtagcaggatcttccgccatgttcaggaacagatactctttgccatcgcctgcggtccagcgcttctcgattttatggctgcgtggattgatcaccagaatttcacccgagccgttagccgcataaatgcgctcagtcagcggggaatagatgataccggtgacccatttcccggcgtttttaatctcggttttcagcttaaaggttcgggtatctacgacggagatatagcccggtttcggctacgcgaccgacataaagctcgttgccgtgccacaggacttcacgcgcacccgccggatagccctctttactgatcttgcccgggaacaccagacgctgcagcactttgccactctgggcatccactttggagatcgcgccatccagtgagttggtggtgtagaacacctgaccgttttcatcgatagcggtaccgaagtttttcatgtcggtatgcgtttcgcctttggtcgtcagcgtggccggatcgagacgatagatcatgccgccgttcacatccttaaacgcctgcgcgctggcgacaaacaacgcttttgacgcaggggagtaagccatttcgtacagaccatcacccagagcgcgttgtgtcactgcggtattaaccggttttggggcttcagcggcaggcgcatcggcttttttagctggtgcctgacacgctgtcaggctaaaggcagcggcaactgccatggcaacagcggctttgcgcgggcttaacgatttcatgctgaactccgtcaggaaataaagaatgagaatcatacgcattaacagccagtaatcaaatgacgatgctgctatccagacctgtccggtcattttacccgcgttaaaccgcttaactgccccgtgaaattccacctgaatgccctttttctgctttcaaatctgataaacaccagcaactaaaaggctttaaattttcctatcacattgaattataaataattaacataaagttacactttcgattgaatcctttgaagaatatataaagcaaatgattatcattggcgttctcataaatggctgagcgtctttctccagaagatgagtggataaaaaataacaaccaaagacacaacggtttaactcaataccaatttttaatggaaaattttatggctcgtagtggcagggaatcaggtttcagaaacagctttagcgtctcattactgacactggcgatacacgccctcttccaccccgcccaggcggcggaggagacatcgcaggatatggtggtcagcgccacgcctgacgaaaccagtgacagcggtaagcagaattacgcggtgcagaccacccgcgcgggcaccaaattaatgctgacaccgcgagatgtgcctcagtcactcagcgtggtgacgcagcagcgaatgcaggatcaggatctgcaatcggttaatgatgtgctgaccaacgccaccggtatctccaccaatcttatcgacagtgaacgctccgagtactattcacgcggcttcaaagtcagcaacttcactttcgatggcattccgacctcggttaacgatacatggaattacggcgacgcggcgtccgacacggcaatctatgaccgtattgaaatcgtgcgcggtgcgaccggcctgatgaccggagcgggcagcccttcggcctcgatcaatatggtgcgtaaacatgctgacagcaaaaccgcgaccggcacgctgagtgccagctatggcagctggaacaagcagcgctacgtggcggatctctctgccccgcttaacagcgatggcagcctgcgcggccgtgtggtgaccggttataccgatcaggagagctggctggatcgctatcaaaaaaccaaaaaattcatctatggcgtgattgatgcggaccttaccgagaagacgacgctgtcactgggctacgactatgaagatgacaacaccggcaatccaacctggggtggcctgccgatgttttacagtaacaacgccacgacacattacgaccgcagcctgaattcatcagctaactgggcgcgttacaacactaattcgcgcaaagtctttgcggatatcgaccataacttcgataacggctggaatattcatattaatggcacgcacgccgagaataccttcagcgataagctgctctatgtgatgggcaatcccgatcaggagagcggtgaaggcactaccggttacggcagtatggatcgcggcaagcgtaaaatggattcaatcgatggctttgccagcggcccgtttgaactgctgggtcgtcagcacctgttgatggccggagcaagctacagccgccagcataatgccgcctacagtcaggatggattcagcgatgcggaggcgggtgaaatcactgccgccgatatggggattttcaataatagctggaccggtaacgtagcggagccggagtggcagggctggtatctcaacgctgatgacactgttcgtcagaaatcggtctatagcgctgcacgtctgtcgctggccgatccgctgtcgctgattattggcgctcgctatacccagtggagcacccatggcagcagcgaagagatgactaaaaataacaccacgccttatgcagggctggtgtatgacattaatgacacctggtccgcctatggcagctacaccgccattttcctgccgcagacttatcgcgatactcacggcagttacctctcaccggtgacaggtaaaagttacgagaccggtctgaaatccgcctggaaacgatggcctgctgaccgccagcgtagcaattttccgcatcgagcaggataacgttggacaggcaattgatggtgtttatctgagcggcaatgagcaggcctatgacgccgccaaaggtgcagtgagtaaaggtgccgagttcgagctgaatggcgcactgaccgataatctgcagctgacctttggcgcaacccgctatgtggcacgcgatacaagtggccggttcaacagctatcagccgcaaacctcattcaagcttttcacccgttatcagttagccgcgatccccgagctcaccgttggtggcggaattaactggcagaaccgggtgtttaaagatgtgaccaatgccagcggcgacagcgtacgggtatatcagggcagctacccgctggcctcgttgtttgcccgctatcaggtgaataagcaggttgccgtacaggccaacgtcgataatctctttgaccgtgaatattacagctatatgaacagctacgtttacggtgagccacgtaacgtgaatgtcagcgtttcttatcagttctgataatggtgagctgagaggccagacagcccgcgattgcgggctgtatagtgtgctgatttaacaggcaggatgcgtgtcagggctgtccttccatattccagcgcgctgatcccatcacatcgaaaacatgctggtcggtgaaagccggaaatctggcgcgttttgccgccactttgagcgcgttgcaataatctttatcgccccctttgataataaaattatccagggtgccatcaattttgaaatccagatgggcattacagcgtttccccttccaggcgtgcggctctgatagtgcagcatccagcgctttttttatgccagatgcctgctgaccatagatatcgttgtccccgacttttcctgaacggttatagctgcaggtttcgagtgcgctttttttaatgcattcgtgtggagtgagaggcgcgcaaccggctaacagggcacagcagaaaatgggaatgatctttttcatggataagtccttttaggtgaaaagggaacggcgtcctgctccctggttattctgatatcaggctaagctaaacccctgcaaagtgaatcaacacagggttattttcccgttttttttcgccagaagagagagaaagcaatcgctgttaatacgccaatcaggggcatcgtggccgcgcccgccagaaagttgtgctggtcgatgcgtttgtccctgcggatatccgcgaagcgtgcgagtgcctgtttttcatctgaggcacgaacttcctcaaactgttttttataaccctgctctgtcagatcgaaagctcgtgttacgtccgatctttcaagtgcaacagtgtatttgcctttggtatagaacctgtattctgacattcagcgatctcacatcccagaggatagatttgcactatatcgggtatgaatgggtttgcagaacgcttttggaaaatagtgcggcacaatacaggctccagcctccctgctgagttaaccgcatctccttttccagcaaactgcatgcagtattgcggtaatatttcccgtgatgaccgtggctgttaactctcttcggttatcactttaagccccagattctcccgcagcgtggcaaactcatactcatcgcgaaacagtccgcgacggcgcagttccgggatcaccagctccacaaacagatccagctgttccggcataatggctggcatgatgttaaagccgtccgcgccgccctgctccagccactgctggaagtcgtcggcgatatcttcagcggtaccgacaatcacgcggtgtccgcgtgaaccggcggcgacggcggccagctcacgcagcgtcagattctcgcgctttgccatatcggtcatcagcttaacgcggctctgattaccttcgcccagcggaacctccggtaccgggccatccagtggatattggctgagatccatactgaaccgcagtgagagctgacgaagcccgttctcaatatccaccagcgtattcagctttttccacagcgccttcgcctcctcacgcgtgcggccaataatcggcatgacaccgggcatgatcacgacatgatccgggttacgcccggcggcaatgacctgctccttttgagtgcgatagaacgcttgcgcttcctccagactggcggaggcggtaaagatcacttccgctgtctcagccgccagcttctgaccatcagcagaagaacctgcttcgataatcaccggacgtccctgtggcgaacgcgtgatgttcagggggccttgtacctgaaaatgctcgccctgatggttgatcggtttgatcttctcatcaacaaaatagtccccggtcgctttgtcgggctgtactgcccccgcttcccagccccgccacaatttgtctgccacctcaaggaactcccgcgcacgggcatagcgggaagcgtggtcgggcatatcgctgcggctgaagttacgtgcaacgtcagtggaaaacgaggtcacgacgttccacgcggcccggccacggctgatgtgatccagtgacgagaaactgcgcgccagcgtaaagggatcgctgaaggtggtagaggcggttgcagccaggccaatacgtctggtgttgaccgccagcgccgccagcatcgtcagcggttcaaggcgtgccatggtcgacggcagacgatacatgctggttgccagtgcatcacccacaaaaaacaggtcgaacttacccgcttcggcttttttagccagcgtgatcagccagtcgatatcagtgggatcgcccagctgttccgtcagacgccagccgctcacgtgctgacccaccggttgaacaaacaggccgagccgcaggcgacgtgatggagtgaaatgattcatgaacgattcctggtctgtaaggtgtaaaggcgcgccgcagcgcgcgcttaaaaaagggtgtccgtcgccagcagcgcctgctccagcgcgcgggcggagacgctaaacggcagccgttctgcgcaagcctgggggaatttaatctgctgcgcgaggttgcgcagcgcgctatggcgatcgccgcgtaacaccggcagcttcagcggcatatcgtagtgacgcagcagcgcaaggagttctgcatccgcgacaccgtcatgttccatcagcgactgcaccagcaggctgaagccgactttctcaccgtgcagccagtgatgcagctccggcaggtgcgtcagtcgattgtgaatggcgtgcgcaaagcccggcgtcggcagcaggtcgcgcacactgttcgccagcccggcgagcacgatagtggcatcaatgactctgaccagttcaggcgtgacccgctgctgctggcaggccaggatcgcggcgtctccctgctgccgaaaagtgtccagcgcctgccgcgcggtcatcaccttaagatccaaagccagatcatcagggttgtgctgctgataaggccggaattcataatatttggccagcgcatccacaatacccgctttcaggtagcgcacgtcgctccgggcgattacttcactgtccaccagcaccagctccggcattttccccagcggctggctgcgcagatggccgccttgctcgttatagatgatggcaatcggtgaccaggccgcgcaggttgccgcctgggtcgcaaagttaaccagcgtgaccgtcggcaactggctggcagcggctttagccgcatccagcacgcgtccacccccaatcgccagcagcagttctgcgccctgctgttcggtatggtgttttaagctggcgatggcctgttcggtacattcgccctctaaatagtcgagctgccagcggatgccattttcttcaagactctggcttaattccggattaaccgcctgccacgcctgaggagaggtaaaaatacgaatatgggtggcatagggtttaataaactgaccggcgcggatgcgcaggcccgcctcatgcgcataggctcgcggagatgtaatggctaacacagcagcatcctgattatataaaatagaaaaagacttttattacaatgagttaatagtgtctcatggaatttaatttcttttctgaatactacgacaaataacaatttaagcaatcaaaaaccggccatttcatattcacaaatccgcattaggttagttatttttcacacatagcgacccggcttttactgttaatctctcattctggctgaatgaattaactgcctgcctggcagttttccgggaaatattatgcaactcgattttcgtcaggtcagagaagatgaggtagatgtttatctggcactgatgcatgccgcctatgcacccgttaaagcactgggcattaaatttgatgccgccacggctgaccgcgctacagcattacgccatctgcagaatcatggtgtgtatgcgctctacatgcgtaaccagatggtttcatcagtgaccgttcgctatccctgggggccgctgcccggcccgtttgggctgccgcatatcggctggtttggcgcgcatcccgactatcccggccaccattttggtcgccaggttcaggatcggttagagcaggaaatcctgatcgatcagttgcatgcccctgcggtctcgctgggcaccgccacccatcacccctggctgaaagagatgtatctgaaacgtggcttccagccgatgcatacccgcgatctcggtaaaggtcacatcaccctctatatgaaaaaagtactggacccggcggcacatgatgcctggctgagccgccagacagcagcagaaggaaacccgctatgagcagcgataatcccgcatcactgggcgaacagccgatcgcgtttcgccacgaactacaccgttttccggagcgaccgcaatgaacctgagcgtaatgctggctgaacatatcctttatggtcagccggatgagtcagcgcaccagcacgcgcgtgaaggtgtgcgggacttcctggcggtgagctggccggtgttacagggcgaggtgccggatagcggcttaccggcactgcgcacaatctaccgcgacggcagcgtgcgctcgcaggcgctgctgctgggctatgccggacatgcgctggactacgatgattttcatgccgattttcgcggtcaccccagcgtagtgatcctgcccgccctgctcgcctggcagcaatatcagccaaagcgcctgaaccgttttctggatgcttacgtcacaggtgtggaaatggctggtcgtctgggactggctgtcagccagcaacattacgcgctgggctatcacaacacggcaacgctgggcaccctggcagcggcggcggcactggcgcgtttgctggcgctggagagtgatgcaaccgcgaccctgctggggatcgctgccacccaggccagcgggctacgcgcgcagtttggttcggcggtgaaaccactgcacgctggttttgccgcagaaacgtgcggtgtcagcggctctgctgacactggccggaatagatggccgtcaggcgggtgtgattgaggcttttctggcagccagcagttcgggtcaggcgcagccggagaaattgctggaaaactggggccgcccctggcggattagcgcgcccggactggagttcaaacctttcccaacctgcgcaggcacccacagcgcagcggaagcggcacaaatgctgcgccagcagtggctggcagccggcaaacctcttgatgcgctgctgagccagattgtcgatatcaccgtcgccttcccgccaggcggtgacatcgccgcttccatatccgttccgacgcacggcattgaagcgcgtttcagcctggaatatgtgattgctgcgatgctgatctacggcgatctgcgtttgcaggatttcgccgaaggcgatctcaatcatcagattatgccgctggccgcccgcgtccgtcgtactcccgataacagcgcgccgcccgatgcgattaatcccgccctgcgcttccatgacgtcacgctgacgctgagtgatagcacaaagctgcatcagcgccgcacgcgccagcagtcactggcagagagtgtggatgtaaacaggaaactgcagctggcgctgaaggcgtcatcgcccgatctgctggcagccagtgagctgcgttcaacggcagatttgcaggcgctgggccgcgcagtgctgagcgccctgtaaccgactcataacgggggaataaaggcctgcaccggcgtaacttccccggcaaatttacgcacctgcaccaccgtaatctgcccgctacatccctgcgccagagatgacgtcccgatatccagcgtcagcacattgggattaccgtgacgacaaagcggacgggcggcagtggcgtcgaccggatcgtaccaggcaccggttggcagctgtaccacgccaggcataaccgtgtcggtgagacgtgcgctggcgagcacatggccccgatcgttataaagctcaatgatgtcgccatccgcgatagcccgggctgcggcatcctcgctgttgaggctacagacttcgcgcccgccacgcttgccactctgactgaaatcaccaaaatcgagctgactgtgcaggcgcgtcgcgggctgattggcaatcagccagaatgggtagtcggcgctgggtttttgctggggttcacgccataccggatggccgggacagttgtcataaccaaagctggcgatagtggcggagaagatctcaattttgccgcctgctgtgggcagcggtgcagcatcagggtcagcgcgaaacgcattgatcatccgtccaccatccttcacctgcggcaacgccaggatgccctgctgccagaactgattgaaatccggtgtctgcacctgatgcgccgccagtttttcctgtagctgatggtaaagatgctgcaaccagcctcgcgcatcgcgcccttcgctaaacgcttcctcccggccaagttgccgggccagatcacggaaaatcgtgtaatcgtccctggcttcggcgtaaggctgtgccactggctgcatggcgattaaatggcgatcggtcggcgcaccgccgatatcctctcgctccagggtcatggtggcgggcaggacgatatcagcatgacgcgcactggcggtccagacgctctcatgcacgatgaacgtatccagctggcaaaacgcctgacgcagccgggccagatcctgatggtggtgaaacggattgccgcccgcccagtaagccagccggatatgaggataagtaagctgacggccattgtagtcaaacctggtgccgggattgagcagcatatcggcaatacgggctaccggaataaagcggtcgataccatttttaccctgcgacagggacggaaaactgaccagattgtgatgtttgccataatggcccagcgcacccagtgcataggtatagccgccgccgggcagcccgggctgtccgagtgccgccgccagcaccaggccaagccacaccggttgttcgccatgctcggcgcgttgtaaggcatgggcgaccgtaaccagtacgcgcttgccgtgcagctgtcgggcgaactgcctgatcaggtcgctgctgacgccacagatcgcggccgcccacggcgcgtcacgcaccacgccatcctcttcaccccggatgtaggccaccatctgaggccagccgacacagtagcgcgccagaaatgcctcatcggttaacccttcggtgattaataccgccagcaggccgagtataaacgccgcatccgttccgggtcgcagcgccagccactcaccctgtgcttcctctggcaaatcgcttttcagtgggcttaccgagataaaacgggtgccgcgctgtgccgcacgctgcataaaaccgcgctcggtatgctcactcaggccgccgctggccacctgggcatttttcagcgccagcccgccaaacgccagcaccacctcgctgtgaccggcaatctcttcccagctcacgccacgccgggcgacttcattcatgtcgcccacaatatgcggcagcaaaaccgatgccgcgccggagctatagctgttaactgagcgaacatagccgcccagcgtggtgttcaggaaacggtgcacctgactttgggcgtgatggaaacggcctgcgcttgaccagccgtaagatccgccaaaaatccccgccgggccgtaagcttcaccgacccgcttaagctcctgtgcaacccgatgactggcttcctcccagctaaccgcgacatattcatctgccccgcgacgccgatccgggccaggcccgttttccagccagccacgccgtatcatcggccgtgcgacgcgtgccgggtgattaagtgaatgacggaagttttgcaacagcggactggggtcgggatcgcccccgaacggctcaataagcagttgatcgccgctgcgctcagcgtgaaaagcgccccagtgggcgctgtgcattaccggtttttgcgtcatcctgcttcctggttatcacaaaagaaacggtgctcagagcaccgttgcgataaagtttctgacgcgtccgttgtccggatcgtcgagtacctgctgcgtcgggccagccgctacaattttgccgctctccataaagacgatgttatcggcgacctcgcgggcaaatccgatttcatgggtgacaaccaccatggtgataccggaatgcgccagctgtttaatgacctgcagcacttcccccaccagttcagggtcaagcgccgaggtcggttcatcaaacagcataacgccaggatccatcgccagtgcgcgggcaatcgcaacgcgctgctgctgaccaccggaaaggttttgcggccactcatcttcgcgaccagacagccccacctgtttcagcagcgccagtgctttgctggtcgcctgatggcgactctgctttttcacccgcatcggcgcatccgtgatgttctgcaacacggtacggtgcgggaacaggttaaattgctgaaacaccatgccgatttccgcccgctggcgtgcaatggcactgctgttgagttcgtgcagcgcctggcctttttgtcggtatcccaccatctggccgccgatacggatggtgccaccatccagcttctcaaggtgattaatgcagcgcagcagcgtggatttaccggagccggatggccccagaatcaccgtgaccgacccggcaggtatatccaggttaacgtcgtcgaggatggttacgccagagaagcgcttggtgaccctgcgcagtgcaattgcttcagccattgctcacactcctttgcgttttcggcagcgaaaagcgcggcaacgacggccagaggctgcgcttttcacgccgcgtgacaccgcggccaaaataacgctccacgtaatactggcccaccgacagcactgaggtcatcagcagataccacagggtggcgaccagcagcagcgggatcacttcataggtgcgctgatagataatctgcgccgaaaacagcacatcctgcagagaaatcactgacaccactgccgtggttttcaactggccaatgatctcgttacccgctggcggcataatggcgcgcatcgcctgcggtaaaacggtatgacggaaaatctgagccgggcgatatccaagcgcgcgtgccgcttcaatctgcccattacccacgctctggatacccgcgcgcacaatttctgcggcataggcggactgatgcatgaccagcgcgatcactgccgcactaaacgggctaaccagcgcgttggactgagcactccagatctcacctaaaccgggaatcgacagcgctattctgggatagagcgccgcgatgttgtaccagagaaacagctgcaccagcatcggcacgccacggaaaaaccaggtgtaggcccagctcaccgcaaccagaaccggatttgatgagagacgcatcagcgccagcaccgtgccgaaggcaaagcccagcaccactgaaatggcggtgagctgcagcgtcattaacaccccctgcagaatggagggcgcagtgaagttttctgcgatgatcccccactcaaagcgcggattgttaatcatcgaatgtgccatcgccaccacgcacaacagcaccaccagcgcactcagccagcgtccgtagtagcgtttactgacgattttcagatcgtcagtgtggttctgaatctcactcatttaaaaatctcttcgttgcgtcgggcttcggtcacagcaccaaatccgattccccagttatcgaggattttccggtagctgccatctttgattaaggagttcagcgcggcctgcacggcaggttcaagcggagaagcttttgggaaagcgacagagaccggtgcatcgttaacggtgatttcgccgctcatggtcagcggtttgattaccttaacctgccacagcagcccctcatagggacccaggaacagcggtacgcgaccgctgaccaccgcctgcacgccagccggacgatccgggaatatcgctaccttgatgggctgcttacctgcagcctcacaggctttactggcttcttccagccgcgtaacctgggtggtaccggaaccggcgccgacctctttgccgcagacgtcactgagtgatttaaacggggcgatactggcgtcttttcgggaaataattcccagcaggctggcgttgtagtagccgacaaagtcgatctgtttcaggcgggtcggtgtggcgttgatgttcgacagcgccacatcgtaacgtccggttttcagaccgggaatgatgttgtcgaagccgcccgtgtcgcgccactctaccgcgatacccagacgttcacccaccgcattcatgatgtcgatttcgcgaccggccagcgtcttattatcttctttataaaaggtagttggcggcgtattcgggtttgttcctgccacaatgtagccacgcttgaggatatccgcaggaatcagcgttttcagcgccggatcggctttaacatgtatgctgctgtcagcaggcactgagggttctgccgcaaagctgacggatgcgttgagcacgagtgtgaaaagggtcattctttttatcaatttcaccggaacctttctcctgatatttaaaatgttcccccagagggaaaagcgatcgtgacctgttgtcagcgctgaaagaaagccagataagcggcgggctccagagcttttatcatcctcgtaacgttctgttgtcattctcagtgaagaccggcggcgatcacaaatgctaaaaccgggaatattttgctggaatatggcaatggcgcgcgttgcgaggctgttgaacaggcgctggcatcctgtgaccgaagagatgagcagtttggtaaggattggcgaggcgagaaaacgtcatactgcggttaattaattggcacagccaggctctgatgattaataaaaatataatttcattgataagtatttattgaaaaatcatccctctgcgcctgaccgattcttttatccgggacttatttgatcaaaatcaataactatttattcaggtaatgtaaagactgcagcaggcacgggaatcataattttaatcaaaattatcaatacattacacgaagtaaatcaaagattagcaggcagatagtttcccttgagaataatgaaagcctcattaatcagatcattgagtaagcataaataatattaaagattagtctggcgctgacgataagaagattatctttgaattatttaacagcctcttctctgcttctgatatctcactaaaggtgaaccttatgggccttgctcaacgcatctccgatattaaaattgggaaaaaactgggcgtcggttttatcgtcgtcattgctgcctccctcgccattacttttatcgctttcgattgttttcgcagtattaaagacaactccgcccggcgcacgattaccgtggagatggtaaacacgttaagcaaggcacgccttaaccgcaccctctaccagtacaccaaagatcccaaatttgccacgcagaacgttcaggccctgaaggagttagatgccctttataaacggctggatggattcaaatgggatgagatgggccagcagaaagtcgcgctgatggggcagttacttaacgattatcagaatcagcgccagacattcgtgacggctgcgcaggcgacaagcagcgcctttgatgccattaaaccgggtgccctgattgcgcttgcgcatcagtttgaatcactcgatatggctctgacacccgatgcggcgctgccggtcatgcacctggccgcagcgctgtttgatgcggccaatgttgaaaaagcgtttctcgataagccgtctgaggccagcagagaggcgattcttgaagaatacaccgctatcaacaccctgagcgagcaactggatattttcgcccagccgaatattaatgacgtaacgcgaaatgtgctcagcactctgacgcagcaacgccaggctttaacgcgctatgtcgatgcgacagagaaagaaaagagcgaatcggcgggcctgaccaccaccgcagagcggctcaatgcggtggtctccgatacctttgcctatcagtcccagctatcctctgaatttatcaaacaggcggagtggcgcattgcttttgccgcgctgatttgtgtggtgctgagtctgctgattgcctggcggatcacccgcaacattacgctgccattgaaagagacgctgaacgcagcgcaacgtattgccagcggtgatttaacaacctcactgaaaaccacacgtggtgatgagttaggtcagctgatgcaggcggtagatgcaatgaacatcagcctgcagaatatcatcaccaacgtgcgtgatggcgtcagcagcgtggcgcgtgcctcggcggaaatcgcggcaggtaataccgatctttcatcccgcacagaacagcagtctgccgcagtggttcagaccgcggccagcatggaagagctctcttcaacggtgaaacagaatgcggagaacgctcaccatgcgagtcagctagcgacagacgcgtcagtgaatgccggacgtggtggcgagattatccgtgacgttatcgaaaccatgaacaacatcagccagagttcgggcaaaatcggcgagatcattcacgtcatcaacagcatctctttccagaccaatattctggcccttaacgccgccgtcgaagcggcacgagccggagagcagggtcgcggatttgcggtggttgccggtgaagtcagaaatctggcccagcgcagttcactggccgccaaagagattgaaacgctgatacgcgagtcacttgatcgggttcatgatggttctgagtttgtggaacgcgccggtaccaccatggatgacatcgtccgctctgtcagtcaggttaaagacattatgggtgaaattgctgccgcctctgacgagcaaaaccgcggcatttctcagatcgccacggcaatggccgagatggataccacgacgcaacagaaacgccgcgctggttgaagagtcctccgccgcagccagctcactggaatctcaggcagatgaactggaaaaaacagtggccgtattccgtctctctcccggacagagcagtgtcagccggggcgcacctgccctgtcgccgcgtttagtgcccgctgtgcccgttaatgcatcagcagactcaagctgggaaagcttttaacggttagcgaagcgttaattctgtctgaccgtaaatagagccagccttaattgattgaggctggctgaaataacagccctcttcagacaaataagtgatttgattaatcagaagataataagccgcaacggttaacgcgggaatgacagggtcaggcgagcatccggaaactgagggaaggtcatattatcggccatgacagttgaaacaagctggctcgtgcctgatgattccggtttatattccggctggctttgaaatgagggtagataagaatcgcgatcggtctgtacagaaagtgatggagagagagttgtcgtccctgacagcttctccggccggtctacgctttcgcgcaaccgatgaggtcatccgcttcgtcgttttccggccggagccggactacgtccattggcatcagttccgttactgctagttcagctcttcgttcaggcttgcaagcgtctgcaggtacggcacctgctgttgagcaatcgccggtgactcaaaactactcagccagcttctggcttcggcgattttcgtcagccgatccgcgttgctttcagatttcgccatataacccagttgggtaaagagtgttgcgatactgatttctttttcacccagggcaaggcttagtgccgcttcgccaataatgacgtggcctttctcgtcgttttgaaataacacagaaaatcctccattagatacgaattgatgacaacctcaccagagactgtagtcgtaaaagagagaactgcccgaatttatcactaaaaatcgcgcaacttgctgaacaaatgttcttaatgttttttttccggattgttctgtttgtctctgccgcccttcctgtcagacttgcttttaaattcacgatgggatgtcaccatgaaactttccattctccttacgctgctggctgcgacggtctgctccgtttttgctgcccatggcaaatttgaaacgcagcaggctggccagtcactcttcacgcaaagcggggaaacgatcagcgaagaataatggctgcgcgcagcatcgtcagtgaccggccaatcggttatgatccgttgccatttacctgccggttgcccgatgtctgccattatcgatacgtttatcgccccgccctgctttgatgagataaccctcctctttcaggacgaccatctgctggtgatcaataaacccagcggcttgctgagcctgtcaggcaaaaatccgcaaaacctcgattcggtgcatcatcggctggtgaagctttttcctggctgcacgctggttcatcggctcgattttggcacctccgggctgatggtcgtcgcacgcagcaaaacgattaacgcggcactctgccagcaattcagccagcgcagcgtgcgtaaaacttatcaggcgctgctgtgcgggcaccttgccgatgacgaaggcgttattgatgccgcgatagcgaaagatccggcgcagtttccccggatggtgatttgcccgatccaggggaaacctgcgcgctcacgctaccgggtcatagaaacgcggttattatcaggaaaaaaagggaaagggattgccggtcacgcgggttgaactgatgccggaaaccgggcgcacccatcagctgcgcattcactgtcagcagctggggcacccgattctgggctgtgatctctacggcgggcttttgctgcctggcgcagatcaggcagagagactgatgctgcacgccagcggattgacgtttgttcatcctgtcagcggcagcacgctgcaactctctgccgacagcccgttctgaatgcgtcagcgcgctgttaccacatcaaatcatcgggcactttgaaatcagcataaggatcatcttcgtcctgtgcttcttcgcttaatgcactgtttaatacgatggcactggcatcacgctgcgcaattttatccgctacgctggcggggatgatagcgtactggctctcgccattattgtcagccgccaggcgggcaatggcgagacgcccattgatcagctgagtctgcgtcagcttatccaccataatctttttgatcaggttattgtcggtgaaattgaagctgatgttgcctcttgccacgtcaattttgttcatttcgatcagctgtttgacctgcgctttgtactctttagacagcacagccagcttctgctgctcgttcagctgcttatcccgctcaagctgcgcttttttgttatcttccaccgccgctctggcttcgcgtgcctgaaccctggatttcttcgctgtccgctgaaccttgtccatttttttgctggatactaatcccgctttcagcatctgctcttgcaaggtgagttttgtcattgtcgtctctgaacctgtgaaataatgtccgggattatacctgtaatcatccgggctgtaccaggttgccgcacctgccacgcccgcgattgcgggcagcctctcaacactgtgctaacattccccggtcaaaatcaccttattgagcaccatgtcagagctaacaaaacgtaaaaatgaccctgaagggctgaaaaaacgcatcatcgcaggcgcactgaaaaccttcgcggagtttggtatgcagggtgccaggctggagcagattgctgagcatgcgcaaaccactaaacgcatggtggtctatcactttggcagtaaagagcagctttatatccacgtgctggagcaggtttatcagcagatacgtcagcatgaaaccggcctgaacctggcggcgatggagccggaaactggccatgacccgcctggtggaagccagttttgattaccatgtcgagcatcccgattttatccggctggtctgcagtgagaacctgttgcgcgggcgctacatcacccagtcgccgcagattaaagcccttaatcgcagcgcgctggatttgctggatgacattctggcacgcggtcagcaacagggcgtgttcactgccgatgtgcagaccatcgatgtccatcgcctgatcagcagtatctgcgttcatcacgtctcaaaccgctacaccttcaacgcccttttcagcccggacaacagcgaagcagagagtatccgccgcaatcgtcagctggctgtaaccgcaacgttacgctatatccgcaaataattgcccgcaggccgggctgcgcttagccatagtctacgcttactgatacttgtcactaaaatgcaataataaggaatgctgttgtgagcagagatgcacgcctctatccgcttcgtcagacccatgttgaacccgatgatgatgcgctgtggaactgggcgcagaacgcgcaaatcggcagccgtcaccaggttcagcgtcccgccagtgaagcggaattacagagacttatccgggagtcacacggccagattcgggtgatcggcagcaagctgtcgcctggtcgtatgctgcatgtcagtgatgacgatgtgctgctcgatctcagcgccctgagcggccagcttgccagtgatgaacagagcgtgacctttggtggcgcgaccccgcttgagcaggtctatcgcagcctgaccgaaatgaaccgcatgctggcttcatcgccaggcgtgattgcgattcagacactggcgggcgcgatggcgaccggaacgcacggccagggattgcagcagagttcgattgccgacgaagcgctggcaatcagaatggtgctggccgatggcagcgtgcgcgaatttgttcgtggcgacgctgacttcccggcagcgcaggtctcactgggcgcactaggcattgttaccgcggtaaccctgcgtacccagccgtttagcatcttcacctgccacaaatatgccgtctctgccgatacccttgaagaggatctgctgcgctggaacaacgactatccgctgagcaaagcctggtggtttgtcgatgacaacctgatgcacgtctggaacgcccatgaggcgagtgacgaagagcgtcagcgctacgaagcgcagggtcgtcaggtggtggaacatgagggcgatgttgacgaaagcctcaacgacaccatcgaccagacgctggcgcatatgcaccgcgatacgcagattgagggcaaagggggaaaacagtttcgcaccgtcacccgttttcgtgatttcaccgatgttaccggtgacatttaccagctcttctgccgcggcattgcggtgccgcagatcaatgtggaaatcggcgtgccgctggcaaaaaccccggccatcattcgccgcatcaagcagtggtatgccgagaaccgtccgcatatgcactacccgattatcctgcgctgcaccggtgcatcatcggcctggctcagtccggccgctgaccagccaacctgctttttcggcttcgtggtctattacgccgacgatggttcgctgtcacaggaaggcctgcacttcctgactgaagtggaaaaactgctggccgaagagggcggacgcccgcactggggcaaatattacgatgaagaacgctacaactggcgtgagatctatccgcagtgggacgccttccgcgccctgcgcagccagctcgacccacagggccgactgggtaacgactacatcacgccactttttgactgattgaggaaagttatgtttgcctgggtaacgctgttaactcaacccgattatctggtgggcgtgaaagcgctgcaccgttcgctgcaacagagccacagccagtggccgctggtggtgatgaccacgccggcgatttcagcgtctgactgtcagattttgcaggatgagggctgtgtgattaaaccggtcgaccccctctatccgcgcgatgatctggatcagcactatgcatcggcgcagttcggcgaagtctggaccaagctgcgcgcctggcagctcaccgattatgagcgcgtcgtgtttctggatgccgatatgctggtccttcaaaacatggatgagctttttaccctggatctgggcgataacccgctcgccgcctgtcacgcctgccgctgtaatcccaaccagattgcctcttatccggcagagtggcagcctgagcagtgccactatacctggcaggcgcgcggtgaaaaggcgccagagagtgtggatctttacctgaacggcggttttctggtgctgaagcccgataatgcgatgttcgacgcactggaaaagcgtattgtcgccattgatgatctcagtaactatcccttctccgagcaggatctgctgaacgaagtgtttgccgatcgctggaagccgctctcttacatctacaatgccttgaaaacgctgccgtttcagcacagcggtctctggcacgatgaagaggtgaagaacctgcactatattctggcaaaaccgtggaaacgcgatctcggccagcccgagagtcagcgcgatcgcttttatgcgctggataagttgtggtgggaaaaaagcggtctgatctgatcggctatgggcgggaagccaacgtttcccgccctgcccgccagtgttaatcaacacatcggcaataccctctatccctctgattctgcctatacctcaatccagcggcgttgcactgctgagtcagcaatcgcttccagcaccttctgaacctgcaatccctctgcaaaatcgggccacatgcggtcgcccgctgcgatgccgttgatcaggtcgcgaatctccaccgttttctgatcgttaaagccgatgccgtgtccggcagaaacacagaaatttgcgtagtcagggtgcgctggtccggtcagaatagttttaaatccctgacgcccggccggtttcgtcatgcagataaagctccagctccgccatgcgctcctgggtgtagcgcagtgtgcctttggtgccggtgacaacgtaagtcagtcccatctttgcgccacaggcgatgcgtgaggtttcaatcacgccgtgcgcaccgttatggaagcgaagcagcgcgctggcctgatcttcgttttcgaccggtaactgccgcgaaggctctttcgggtcaggccttgaggcgatcaccgtcatcatgtcgccgctgacctcagcaatgtcaccaaccaggtagtgcgccatattaacgatatgcgccgccagatcgcccagcgcaccgagacctgccagcgctttctgacagtgccagtcgagcggcgtttccggtctggcgagataatcctcgttatgggtgccgtagaaatgcaccacgtcgcctatctcaccattggcaatgatctctttcgccagctggctggtagggtttttcatatagttgaagcctaccagcgttttaacccctgccgcatcggctgccgccaccatctcctgcgcatccgccacgcttaatgacagcggcttttctgaataaacgtgtttgccatggcgtatcgcctccagcgccatctctttatgcaggaagttgggggcgcagatatccacgacatcaatcgccgggtcgctgaccagcgcgcgccagtcacccgtcgagcgcgcgaaaccaaaggtcgccgcctgacgggcggccagctcggggttcacttcagccagcatctcccgcacgatttcgcctttcagcgcaaatacggtgggagcctgcgcatatgcaatcgcgtggcagcgtccgatatagccgctgccaatcatgccgattctgactttgttcatttcaactccagagattcagttcagggttgaaatggaatctacgtttcgtttttattgctgacaaagccagaatccacactttgtgatgcccgtaaaaaactatccggttaaatcacgcgcctggccgcctgacaagggctatacagcgccataacacctcataaatacctcagttttacacgtgccgttttgccggatgagtcagccgcacaggccgctctttcagtgcttaaaacgccatagtggcgactatttcagcagtcgcgctgatttatgaaaaagagctttgacatggcccggcgtggccgttactatgcgccccgttcaaacgattcctctgtagttcagtcggtagaacggcggactgttaatccgtatgtcactggttcgagtccagtcagaggagccaaattagaaaagcctgcttaggaaactaagcgggctttttgcttttcatacttctgataaaattttgcgtcttactcagtctgtttcctcttcaaattccccgttcttttcgttagtgcctgatacttagacattcggtgccgccctcacttaaaggttcatttctgacccctacatctcatactctttttaacaaatgcattaatagtgacttaaagtgtcataaatgacctttcatccgcatatttcacagtctggctgtaagctgagaagatgatgccggtaaatagttcaaaaatgacccttttagtactatagtcggaccatatcgtttcaaaaacgtactgaaattgcagaaaaggtcaaaaatgaaccttgatgagattaaatcttcgctactaagcctttctgagtcagatcggcaaaaggtattggcggggttagctttgagtagagaaaccacaacagaagcaataaatgcggacaaaccggacacccgatcggagctgagtgatctgacgtttccgacactgccacaactactggccaatgaactcaaacgacaaaacatcacctatgaagagatggcgattcagattggtgtatcactctcaacatttaaacgactgattgctaaaccatcttctgcaaaggcaataaatcttcacgccttgcttaaagaactgggtataaaagtatggctcgaaaaatagaggtgtggctttacaacacgctggcaggaacgctgagtgaagggcaaagcggttatactttctgctacctgcccacttatgtcggctgtgcgatatctctcagcatgccggtaagacctgagccctatttaagtgaagagctacatcccttctttaaaggtttagcgccggaaggctggttgcgaaaacgctattctgaaattcaaaaaattgatgataaagatctgttcggcttactgatggaaaatggcaacgatttgcttggggcagtcgtctttaaagagataacatcatgaattcagaacgctgcctgatcacattaaaacggcttaaagaatctgagctaaaaaccggctactcaacaaaaggcatccggcatctgctgggtagtctgaatgtggctcttagcctgccgtttacgcgcagtcagtttattcaggaactccctgaacgtcagaaaggcatgagcatttcaggctatcaacccaaactgtcgcttcgcctggaaaagggagaactggtggtcgtcagcaatgatggcacctatatcctgaaaccctctccggaagaatatccacacctggcagaaaacgagcatgccactatgtgcgttatgcagcgtctgaaatttgacgtacccccgttcgggctgatgccattcagacacgatgaaaatcggccagaagaactggcgtttgtcattaaaaggtatgaccggacagcgtcagataacacgagattacatcaggaacagctggatggcgcgatgggtctcggcgataaatatggcaggattgataatcataaagccatcagttatgagaaagccgctaaattcctgaataccagagtgaacagcagcttaaagagtaaacgtgacctctttttgcgcatcgtgtatgcctatgtgctgggaaacaatgattttcatctgcgcaatatcgggattatcctgcctccgcagggttcaccctggctggccccggtttatgactttatcagcgttgtgccctaccctgcagcgtttggagagtatttagctttgcccctgctggaacgtgaagaaaatgatgcaggaaacgcaccggggatgaattcagagtacggagaatatctgggtgcagactttatcctgcttgcccagggtatggatattaatccgacactggcacgaaaatggctttccgaggtggtgagtcatcatcagcttattatcgatacttataatgaaagtcatatgcctgaatcgcagcgggaagccgtacttgactacgtggccagaagaatcacgttactggcagtgaccaaaatttaaatgatgccattaacctgttgtacctgggttgtaaaaggatagttaagcggtcgaataactcacctgctctcataaaaaaacccgctaatatcagcgggtttcaggttttacaacgtcaacagcaatcagagttcaaaccgatccagattcatcactttggtccaggcggcaacaaagtctttgacgaatttttcacgggcgtcgctgctggcgtagacttccgccgaggcgcgtaacaccgcattggagccaaacaccagatcggcgcgcgtggcggtgaaacgggtttcgccagtgacgcgatcccgtccaataaatttctcattggtcgaatcggcggctttccactcggtgcgcatatccagcagattcacgaagaagtctgtgttcagcgtccctgtgtggtgcgtgaagatgccgtgctggctgccatcaaagttagcacccagcgcacgcattccgccaaccagcaccgttaactccggcacggtcagagtcagctgctgcgctttatcgatcagcagattttcggtggtggttttgccgaagccagtaccgtagttacggaaaccatctgcacgcggtttcagcagatcgaatgactcgatatcagtctgatcctgacgcgcatcaacacggcccggagtaaatggcacctcaatttcaacgccagctgctttcgccgcctgctcaacgccgaccacacccgccagcacgatcacatctgccagtgaagccttgtgcgcttcacgctgcaccgcttccagcgttggcagcacgcgtgctgcgacggcattgacatcccactcacgctgcggcagcaacgccaggcgggcaccgttggcaccaccacgtttgtcgccgccacggaaggttgatgccgaagcccaggcaaccgaaaccagctcgctgacgctgaggccggttgcagcgattttctctttcagctgcgcgatatccgccacggttggatgataaaccggtgcaggcagcggatcctgccagatcagatcttcctgcgggacttcaggtccgatgtagcgcgcttttggccccatatcacggtgagtcagtttaaaccaggcacgggcaaaggcttcgttgaacgcctgcggatcgttgtggaaacgacgcgaaatcttttcaaactccgggtcaaatcgcagcgtcagatcggtcaccagcatggtcggcttgtgtttcttcgcggcgtcaaacgcatccgggataatatccggggcatcagctgccacgaaactggatggcaccggccgggctgcgcgtctgaacccactcatatttgaacaggttctcgaagaagtagttactccactgggttggcgtctgagaccagattacttccagaccggaggtaatcgcatctgcgccaacgcccgtgccgtggctgttgacccagcccaggccctgcgcctcaatcggtgcagtttccggatcgacaccgacgtggctggccggtgcggcaccgtgggttttacccagcgtatgtccaccagcaatcaatgccacgatctcttcgtcgttcatgcccatgttgccgaaagtggcgcgaatagccggggccgcagaggcaggatcgccgctgtgttccggaccttccgggttcacgtagatcagacccatttcggtagcgcccagtggcgactgcgccagggattccgggtgacggtgttccagccaggcggcttcttcgccccagttcacatccatatccggttcccagacatcttcacgtccggcaccaaagccaaaggtacggaatccggagttttccagcgcgacgttgcccgccagaatgtagaggtcggcccaggagatcttctgaccatacttctgtttaaccggccacagtaagcggcgcgctttatccagactgacgttgtctggccaggagtttaggggtgcgaagcgttgctgaccacgacctgaaccaccgcgtccgtccacggagcgataggttccggcgctgtgccaggccatacgaataaacaggccgatgtagctgccccagtcagcgggccaccaggcttgtgactcggtgagcaaccctttgatgtcagctttcagcgccgagtaatctaatttggcaaattctttacggtaatcgaaggattcatcaagcgggttcgaacgggatgagtgctgattcagcaggtcaacccggagttgattaggccaccagtcgcggttggttgttccgccgcccggcgcctgattttcctgagaaggcttaccagcatgaaaaggacatttgccctcgggcgcttcgcgatcggcttcgacaataggctttgcatcttttgcatcttcatcaatggaattgctcatggtcacacctcttttttgtattttcatcgctactctatagaggattttcaggatcgcacacctgtctcatcctatctgtttgatagcttttacctttttatacaccttcttcaaaagcttaaaacaatgaattgacggttgctgccaggctgcagagagcagcgaagcggcaaccgtcaccctgagactattccgacagcgccggtttcacaactgccgttttgctgcccggcaggcggatgcggaaccagatagcgtacattgcgggcaggaaaaccagcgtgatcagggtgccgcccagcgtgccaccaatcagggtataggccagcgttccccagaacaccgagtgggtcagtggaataaacgccagaatcgccgccattgccgtcagcagcaccggacgggcacgctgcactgtcgcttcgaccactgcatcaaagggtgccagaccctcctgttcattgtggtggatctgccctatcagaatcagcgtgttacgcatcaggatgcccgacagggcaatcagcccgaccagtgcattaataccaaaaggctgactgaacagcagcagcgtcggcacgacgccaatcagcccgaggggcgcagtcagaaagaccatgatcatcgccgacagagaacgcacctgcagaatgatgatcagcagagtgatcgcaatcatgatcgggaacagcggggccatcgcctgggtcgctttaccggactcctctattgaaccggccagttcaatgcggtagcccgcgggcagcgtcgcgatgatcggttgcagggctttgttcagcgccgtcgagacgtcaggcggctccagggaatcggcgatatcaccccgaacggtgatggtcggcgtgcggtcgcgccgccgcagcacgggatcttccattttcacctgcacatcaccaatctgcgataaggggatacgctgaccggcggcgcccaccagcgtgaagtcggcgattttagccggatcgagccgggtttctccggccgcacgccctatcacctggaccgcgcggatatcttcccgcacggtagtgacaggcacgcccgacagcagaaactgtaattgccgggcgacgtcactggatgtcagccccacagcctgcagccggttctgatccagtgaaaaatgcagcgtcggcacgggggcgccccagtcggtgttcaccgtcctcatcatcgggctggcccgcaggaccgcttccacccgatcggcaatcgcgcgcaggcgggccggatcgggccccatcacccgccacgccaccggataaggggagtatgggccaaacaccagctgcgtcacacgaacctgcgcttcaggcaccagaccgctggcaatggcggcgcgcagctgcgttttcagtgcctcacgcgcgtcctgactgtcggtcagtactaccagcttagcaaaggccggatcgggcagttttccggtgccatcgccagataaaaacgcggtggcccctgaccaatataggtggtgacgatttttgcctgctgctgctgtttaagccaggtctcaaccttttcagccgctgcgcgggtctgttctatggcgctgccgtaggggagctgaacttcaaccagcacttcaggccggtctgaggtcgggaaaaactgttttttcaccagcgccataccgagcacagcggcgataaacagggcaatcaccacgcctgccacccagcctttacgggcaatcacgcgggtcagcaggcggcgaaagcggttgtagtggcgggtgttgtagatcgctgcgtggccgccttctaccgttttgatggctggcagcagctttacgccaagataaggggtgaacaccaccgcgacgatccaggaggcgatcaacgcgatgccgactatccagaacatattgctggtgtactcgcccgccgtggactgcgcaaacccattgggcataaacccgacggccgtaaccagggtgccggccagcatgggtgccgccgtatgactccaggcataggcagaggccttgatgcggtcgtagccctcctccattttcactaccatcatctcaatggcgataatggcgtcgtccaccagcaggcccagcgccagaatcagcgaacccagcgtgatgcggtcaaagtttttgccggaagcctccatcaccacaaacaccaccgccagggtgagcggcaccgcagccgcgaccactaccccgacacgccagcccatgctgacaaagcagaccaccatcaccaccagcaacgccacgacgaacttaaccataaattcatcaaccgccgagcggatattgacggactgatcggtgacctgagtcagtgagagccccagcggcatcgcctggttgatgcgggcggtttcagccgccagtgccttgccgagttccagaccgttccagccttcacgcattacgatacccagcagcagcgccggttcgccctgattgcgcaccataaaggtggcgggatcttcgtaaccccgggtcaccgtagccacgtccgccagcttcaggcttctcccctgcgccacaatcggcgtctcacggattttttccagtttatcgaacgcgccatccagccgtataaagacctgcggcccctgcgtatcaatcgatcccgctggcgtcaggacattctgatcgttcagcgcagcaaaaattgcctgcggggtgatgccgagtgtcgccagtcgatcgtgtgaaaacgacacatagatgcattcactctgctcaccgatgatattgacctttttcacgccaggcagatgcagcagtcgctgacgcagtgattccgcttcacgaaccagcaggcgctgcggctccccttttgccttcagcgccagcagtgcaaaggtcacgtcggagaactcgtcgttgatcatcggcccgatgaccccggcaggcagatttctgctctcatcacccagcttcttacgcgcctggtaaaactcctcctgaacctgggaaggcggcgttttgtcctgcagggataacatagtgaaagccagaccggggcgcgtgtacgtctcgctacggtcataccacctcagctcctgcagacgcttttccagcggctcggccacctgatcctgcatctcctgagccgtcgcacccggccaggcggagataatcgtcatctgttttacggtgaacggtggatcttctgcccgtcccagtttcgaaaaaggacaagacgcccgccacggtaatcaggatgatcagaaacagcgtaatagcgcgctcgcgcacggccagcgctgacagattaaagcgtccctggctcatggctggctcccggcaacggcagcgtcatcggggcgcacgcgctccccctgctgcaacagatgcgcgcccagcaccactatctgatcgccagcattaagctgacccgtgacggtggccgcctcgtcacttatcgacaccaccgtcaccggccgccaggcaacggtagcgggctggccggtaatatcccagacgcctggccctttaccggcatcgtagatcgccgccagcggaacctgcagcagcggttgcgacggtttattcggcagcgtgattgtgacggtggctcccagcggtgcgctggccagtgcgccctccagcacatatctcgcctcaaaggtgcgcgtcatcggatcggccacatcagccagttgacgcagccgggcagaaaccggcgcactgtccgcaccatacagcgttgcctttgcctcacttcccactgccgggcgcagggtctctggcaactgaacacttgcctcgcgctgtccggctctggccagtctgatgacggcctcaccggcactcacaacctgacccggctccgccagcgttgccatcaccacgccatcgtcatcagccaggagcagcgcatatccgctggcgttacctgcaacgctggcctgcgcctgggcggctttcagctcagcctgagcggtggccgcagcggcccgaatctggtcgtatgccgacgcagaaactgccccggttgccaccagagtgcggtaacgcgcctgatcggcgctggcctgtctgacgcgtgcctgcgcggcggcaacggcctgctgctgagcctgggcctgcagccggagatctgccgggtcgagccgcatcagcggctgaccgcgcttcacccgctggccgctatccaccagccgttcgaggatttttcctgagacccgaaagccgaggtcgctctgaacccgggcaaccacgacgccactaaacgcacggctgccatcggtggcgctgatgacctttgtgaccctgaccagcggcggctgcgtgcgcggatcgtctttgggtgaattatcccggcaacccgccagcgccagtggcagcagacaaacaaccagaatggcaggattgaacctgagcatagattaccttcaacagtaagcaggagagtgccgccattctcttatcatgtgaccaatactgtcaatagtcacaaattgcgtaaaggcattgtccgttcatacaggttatgaaaacacgttaaaccaggaaaatgcgttgatgaagggttcagacccaccctgagcagaggaaacaccccattctgcaacaagtgacgaaataaatcatgagtcacaaaatctgcatattccgtacactggaaacagagtgacgaaaaggctctgtcagggcctggaatggctcgtcagagagaagttcagagaggataaagcagaaaaagcgcggagtgatgacgcgcgtttacagcagaatcaccgcaggcgctttgtcatctgcgcctgcggtggatctcacagcgccctgctcttcagggcgctctgtcacttaacgccagccgagtttccggggcgacatacttcaggattgcctcaatcacatgggcgttgtaggcgacaccaagctggttaggcacggtgagcagcagggtgtcggcttcggcaatcgcctcatcctgcgcaagctgcttaattaacgcctctggctctgcggcatagctgcggccaaagatagcgcgggttttctcatcgagaaagcccacggaatcctggtcgttaccgctgcggccaaagtacgcgcggtccatatcattcaccagcgcaaagatgctgcgactgaccgagacgcgtggcgcatgctgatgccccgctgctttccaggcctcacggtaggcgcggatctgttttgcctgctgaatgtggaacggctcgccggtctcatcatctttcagggttgaactttgcaggttcatgcccatttttgccgcccattctgcggtggcgttggagccggatccccaccagatgcggtcgcgcaggccttcagagagcggctcaggacgcagcaggcctggcggattggggaacatgggctgtggatttggcttagcaaaaccttcgccgcgcagcacctccagaaactcttcggtgtgacgacggcccatatccgcatcgctttctcccgctttcggttcaaagccgaagtaacgccagccatcgattacctgctcaggtgaaccgcggctcagacccagttgcagacgaccattggagatcaggtctgccgcgctggcgtcttccaccatgtagagtgggttttcgtagcgcatgtcgatgacaccggtgccgatctcaatcgttttggtgcgcgctgcaacggcagccagcagcggaaacggcgagctgagctggcgggcaaaatggtggacgcggaagtaagcgccatctgcgcccagctcttcggcggcgaccgctaagtcgatcgattgcagtaacacatcctgcgcggtacgggtggcggactgagacgaaggcgtccagtgaccaaaggataagaagccaatatttttcatctgtatttctcctgacaggcggtaaacgcccgtggatgcaaggcgatttctgatagagaaaggttacgcccccggagccgccactgatagtcaatatctttcagcgccatattcaggaatttcgacatagctaagcagattatccactttgcctttgcccgccctttctttcactgttcagattcccgcttccgctgtcaggtgaatcatgcacaccggttatctctctctacagcagcgcgcctggcttaaagcgcgcgcacgcagctggctctggcgcagcgaactgccgacctggctgctaatcggtgtgatctatggcggctggtttgcggtgatgctgaacgcgcagacgctgggacggctgcccgccaccctgctgctgatcgtcttcactggctggtatatgtcgctgcagcatgagctgatccacggccatcccacccgctggccgcgggtgaatcagctatttggcaccctgccgctggcggtctggtatccctacggactctatcgcgattctcatctggcccatcatcgcaatcacaccctgactgagccggatgaggatccggaaacctactacctctccgctgctcgctgggcgaagttaccgcgctggcagcagcagctgattcatctgcgtaacacttttttgggacggttgctactcggcccgctgctggatgtagcggcgaccttcggcgggatgtggcaggcactgcgccgtggcgatcgatccgcgatagcgatgtggctgctgcacggggcgctgctggcactactgtttttctggatggcacggcagggattttcgccgctgtggtatctgctgacggtgagttatccggcgctggcgctgaccaaagtgcgatctttctatgagcatcgtgcggcggacgatccgctggcacggtcagtgaataatgaagcggcgtggccgtggcgcatgctattcctgaatctgaactaccattcagtgcatcacgacctccccggcgtcccctggtatggcctgcgccgcctctatctgcgcgaccgcgagcattactaccagcgcaatcatggctttcgcgtggcgggttatcgggtctggctgcgtcagtttctgggtcagaccggtcggggtcaatgtccatccgggacgatcagcggagaaaacgcatgaataacctgctcgccttgccgatgtatgcgattcacccgcccgccacacgagcactgatgcaggcagtggttaccctgctgacgcagcacggcatcgctacgcagccggtctggcctgaggatctgctgacacactggcaggataatcgattgctgctgagccagacctgcggctatccgctggtcagccagcttcctgcggttcagctggtcggcacctttcactatcaggccccaggctgcaccggccgtgactatcgcagctggctggtggcgcgggacaaacaggcgacgctggccgattttaacggccagcgagccgtagctaacagcctggactctcactccggctataacgcgctgcggtttgtggctgcgcttcagggcgtgaggttttcgcagctgctgctgagcggtgggcatcgtcagtcgctggcagcactgcgtgattcacaggcggatatcgcggctatcgactgcgtcagctgggctctgctggcgcgctatgagccggatgcgctgcgcggcctgcatatcatcggtgaaacgccagccgcacccggattgccgttgatcacggcagccccgacgtcagtggaccggctggagagactccgcacggcactgcatcagctggtgaacgatcccacctggcgcaccgtctgcgacgataacctgatcggcggattcagcccggtagagagagacgattatcagggcgtgctggcgtgggaacagcaggctgccgcgctgggcgtcacccggctgtaacacccccctctgtttcgaactgcttaccgggcagggaaaatctgatatctctgcatcgtcacctccctgcccgcgctttcccgacctctcatttcatgctccccgacgcgctctgaccgaggctaagactggtaagcccggtcacggcgttctaaggtagaggttttcagcagagggagagtgggatgcgcattctgatggcaggcgccggcgcgaccggtggatattttggtgcacggctggctcaggcgggccaggacgtgacttttctggtccgtgaacggcgttatcagcagcttcaggccagcggcctggtgttgcagacgccgcaaggcactgaaacactaaagccgcagctggctcaggcgagcagcctgacgggccactatgatctgattatcgtgacggtgaagagctttgcccttgatcaggtgatggaggatattgcacctgcagtgggtccggaaacgctgatcatgccgattctgaacggattgcggcacatcgcaacgctgcaacagcgtttcggcgaagataaggtgattggcggcctgtgcaaaatcaacgcgacgctgggtgacaatggcgaagtaatccagatgacgccgctgcatcagctctattatggcgcgctggatggtaacaacgatgcgcgactgcagcgggttgatgcggcgctgcgtgactgtcaggtcgatacccgattcagcgataacatcatggatgagctgtgggagaagtggctgctgctgagcacgctcggcgcggtttgctgcctggcgcgcggaaatacccaacagatactcacctcgcgcggcggcgaagcgctgttacagggtgttttctcggagattctgtcagtcattactgccgaaggctatcagacgcgtccggcggccactgcccgcattcttgagctgttaagcgatccggccaccccgatgacctcctcaatgtaccgcgatttaacccagggctttgatatcgaagccgatcaggtgataggtgacctgctgctgcgggcgaaacgccatagtctcgccacgcccctgcttaacgcggtggatgtgaaccttcaggtctatctgcagcagcgttaatggccctgccagataccgtgaccgggtgctgcaacgggcccggtttttgtggtcgtgaaagtgtggtgtgcagcagcagtgcagcaggaaaatttgctacactcgtcgcttcatcttttggagagttcaatgacttcccgctccgtgaccctcgatgatgtcgctcaactggccggcgtctcatatcaaaccgtttcacgtgttttaaatcgttctgaacaggtgtcagcccgcacgcgggaaagggttgaggcggcgatgctgcagctcaattatgtgcccaatcgtgtggcgcagcagctggccggtaaggcgacgcgtacgctgggtctggccaccagcgacctggccctgatggctcctgcgcagatcgcctcggcgatccagcagcgcgccgccggggcgggttatcatctggtgatcgccatggacagtggtaacgatgcggcagcaacggtgaatgaactgctggcacagcgggtcgatggactgctgatcaacctgccgctggaggcagatgaggcgcaacagatccagttgctctgcggcagcaaaccggtgctgtttctggatgtcgaaccccaggcggcggtagcgcagtgtcagtacccgaatgagtctggcgcacgtgccgccgttgaacatctggtggcgctgggtcatcgtcagattggtttgttaaacgggccgctgcgctcggtctcggcccgtcagcgtgaaaatgcatggcgtcaggcgctggccgatcatcagctgacaccgcactgttctctgcgcggcgactggagcgcgcagtcgggttatcaggcgctgctggcgcagcttcccgacgatctgccgcaggcgctgctggtggcgaacgatcagatggcgttgggtgcgatgcgggcgctgcatcagtatggcgtagccattcctggcgagatatcggtgattggatatgatgacaccgccgagagtgcgtggtatcagccgccgctgaccacggtgcggcaggatttgcaatttctcggcgcgcagagcgtcgagcggatgctggcccggcttcagggagcagaggcgtcagacaacgcgctggaaaccacgctggtgatccgggagaccaccgccccgcctgctgatgagcgggtcaatttagtggcgctgtcacagcagttacaggtgatcgcccgcaggctggcgggaaaataaccctgcgctgacgcaggcaataaaaaacccgccccaccggagtggatgcgggtttgcataggacgtctgacgcttgcgcgctgctgtctgcccttacgctttcgggtgttcgcccacgcccatcgctttgatctttttcgacagctcgcgacgctctttagacaggtcggcgtttttgatgatgtactcatccacgcgatcttcataatccacacgcatgctggcgatgatttcctgaatagcctcaacgctcatgccgggtttgatatattcgctcaggttgtcgagcagcagtacgcgcttctggttgtcgcgaattttcttctcgttgtcgacaatttcacgctgcagtttgtttttgcggcggaacatacgcacgaactccagtacgtcctgaaatgattgcttggcattttccatgatggcacctttctttgagcctgctgacgcagggagagagtcaaaacgatcagcttagcggctagcccgccaggtaagcaattttcacagctaaattcagactggctcttatcttagcgcaaagaaaccctgtttcacattaagtcattgtctgaggtgattatttgcgcagcgccatccgcatcaggtcggtcatccgttccagctgttttgccagttccagtgtcagccagacgtagccgtagatcggcgtctcctccagaccttcgctgcccgcttccgcgatcagtcgccgcagtttcgccactgatttcggtcagctcgtgactgttagccaccacctcttccgtttccccttcaatcgccatgaccgacagcgcccgcagcgtgttctcagtcatctgctgggtgcggcgcaatgcaggcgcgttaagcataatcagatggctctcgcgcgatgcccaccaggcattaatctgcatctcaatggtgtaaaccatattacggttgatggtctggatcgcttcaagcaccgattttggaatgcgcgtctctttgcttgacggctccagcagcgcccgcattttgatcacgctgctcagcaatttgcccagcggcttgttcaggcgtggcttttcaaccaggttgggtgagaaaccggcgtgatagatttttgccatttccgccagcgcgtcggagagctgaatgcgccagtgtgtataggcacgctgcgcccagatagcggtaaacagcagcgccatcagcgagcccagaatcacatcaccgccgcgccacagtgccatcgtgaaatcgccggttggtgcgcccacgaccacgctcagcgtaatcccgatcaacaacgccatgtagggatgtttgcccagcgtcaggtagccgctgatcatcatgatgatgccgcaccaggccagcatcatcggcatcgaaatcagctccagtttcagggcaatcagaccggatattgacccggcgaccgtgccgctgatgcgctgcagtgcgcgcggaaagacattcccccaggtggagatgggccccatcaccaccaccagcgtaatcagcggccaggtgccttcagggatatcggtcgcccgcacaaagataaagcagagcaaaaaggcgatggcaatacgcacaccgtggacggagcgataatggcgataaaaccagaactccagttttgatatgggcttatcgggacgcaaaatgactttccggttgcgggaacatgatgtggctatcttaacgctgaacgcggctcaggcttagcgcgggccggatatttaaaacagttttgacgttcgcttacaattatcaacatccgcctcacatactttcccggtagttaaaaacaacttaatgtgattttttaacctttatcggctctctgtaacacgctcagagcagccagcgtgcaagtaaaaacgggcagcccgcaggctacccgttttagtgctgacaatcggctaatcagaacttctgcctgagataatccgtcaggcgggtaatcacacctgcgggttcaaccgcactcagcgccaccagcggatagtgggcaatctgctgatctttatccatcacctgaatttcaccaatgacttcgttggctttcagcggggcttccagatctttgcgatcgataacatacttcgccttcacgtttctgcacttcactgcgcggcagtgacagataaacatcttctgcggtacccacatccacctgatgaggattgccataccagacgttttcgctgccaatcttcttaccggcatggaacagctgaacggtatcaaaggtgttctgtccccagaccagcagtttacgcgcctgctcttcgcggcctttcgggcttttaccgcccatgacgacggcgatcaggcgatgcttgcccaccacattcgaggcgatgatgttaaagcccgcggtctcagtgtgaccggttttcaacccatcaacgtggagattattatcccacaacaggccattacggttgttctgggtaatgccgttccaggtcagggtcttctcactgtacatggcataaaaatcaggctcaccatcaataatggcgcgtgacagtttcgccatatccagcgcgctggagaactgacccggcgcatccagaccatgaaccgtttcaaaatgggtattctgcaggccgagcttctcaacgtagtgattcatcatgccgacgaagttcgcttcgctgcccgccacataatcagccagggcaacgcaggcgtcgttaccggagtcgatgatgacgccacggcttaaatcccggacgctcagcttatcgccaggcttcaggaacatcagcgaggagcctttgaacaccggattacccgccgcccaggcatcttttccgaccgtaaccatgtcgtcacggctgattttcttctggtcaatggcgcgatcaaccacgtaaccggtcatcagtttggtcaggctggcgggattacggcgttcatcgggattgccagcggtcagaacctgtcctgtggtggcatccatcagcacccaggaagccgcatcaatcgctggtggcgtcacaggaaagggaatcgcatcagcctgtgccagcgaggcccaaaaaacagtagcggtaacggtgaacagcagacgccttttcaacacttcatccttaattgcacgggagagaaaatttctaaaacgaaacggaaacagccgcacgttttacggcaaaagcgttgtgaaggtttgaataaattgaaaaaaagtatgaactgcgacgggtatggctgatgcctgcaggagggagataacggctaattgatgcaggaattgagactgaatatttcaatatcatcctgaaaaacgttaaggtcaccacggtatcgccctgccttgcacccagcggcatgagcagcacgcatctggaaacaccggaattacagtatgcagcaataacctggaaatatgtcgaagggaatattatctatcgtggcacatgggatgagcgagctacagcctgagaggtaaaaagtccgctttactccttgcccctgaccgctcagtcagatactacgccccccgctaccatccgaaacttcaggccagtcggattatggtttaccatgtagtgagtgaagcctgagcctgcatgaccttgcccggcaaaggcaccgctctcgcaccagcagccaggcgccgatgaagaaaggcatccagcgaacgggaagcctgatgactttctgttcatcagtttagtgaacgcaatgaacggatatgaaatttgaataacgaccgcgtacagcccactttcctcttccacgattacgagaccttcggcaccagcccttctcgtgaccggccagcccagtttgccggcctgcgcaccgacagtgagtttaatccggtcggcgaacccgaagtgttctactgccgtccgcctgatgactatctgccacagcccgaagcggtgatgatcaccggcattaccccgcagatagcgatgagtcgcggcgtgatcgaagctgagttcgctgaacgcatccacgcgttgttcaccacggagcaaacctgtgtggtgggctacaacaacgtgcgtttcgatgatgaagtgacgcgcaatatcttctatcgcaacttttacgatccctatggctgggcctggcaaaacggcaactcacgctgggacctgctcgacgtgatgcgtgcctgctacgcgttacggccagaagggatcaactggcctgagaatgaagaaggttttcccagtttccggctggagcatctgaccaaagcgaacggcgtgtcccatgaaaatgcgcacgatgcaatgtccgacgtttacgccacgctggcgatggcgaagctggtgaaggagaagcagccaaaactgtttgagtttttgtttacccatcgtaacaaaaacaagctgatgaacctgattgatatcccgcagatgaaaccgctggttcatgtctccggcatgttcggtgccgcgcgcggtaacaccagttggatcgtaccgctggcctggcatcccgataaccgcaatgcgctgattgtggtggatctggcgggcgatatgtcaccgctgctgcaactggatgccgacacgctgcgtgagcgtctttacacgccgaaaaacgatctcggcgatctgcctgcggtgccggtcaaactggtgcatatcaataagtgtccggtgctggcgcctgccagtacgctgcggccggaagatgcggcccggctgaatattgatcgtcagcactgcctggcgaatctggcgctgctgcgtcagcagcccgacgtgcgggaaaaactggtcacgctgtttgccgaagcggagccgtttgcaccgtcagatgatgtggacacacaactctatgatggcttcttcagtgatgccgaccgggcggggatgaatattatccgtcagaccgcgcccgcgaatctgcctgcgctggacctgagctttgagagtgcacgggtagcgaaactgctgttccgctaccgggcgcgtaacttccccggcacgctggacgatgccgagcagcaacgctggttgcagcaccgtcgtgacgtgcttaatgccgatcgggtgcaggcgtttatgcaggaactggaagctctggcgaatctgcatgaagcggatgcagaaaaggttgggcagcttaaagcgctctatctctatgcgcaggagttggtttcctgaagcactaagagtctgacccggtatcgcctgccgggtcagactttctgatgctgcttaatcagagcaaggtccacgccagccaggtcagcgcaaagccgctcagccccattagtgttgtcagcaccgtccaggtgcgtaaaccgtcggccaccgaaagtcccagataacgggtcaccacccagaatcccgcatcattgacatgcgacaatcccagaccaccaaaacaggccgccagggtgaccagtacccgttgcatatccgtcacgccggtcaccgcctgcgtcagcagcccgctggtggtcaggatcgccaccgtggcggaaccctgtgatgcacgcagcgccagcgacaggataaatgccgcgggcaccagcggcagatgcagcgtttcaagggtgaccgccagcgctttacccacgcccgactccaccagcactttgccgaatgcaccaccggccccggccaccagaatcacgctggctgaggtgggaatggcccggccggtcagatcttccagcttatctttgctccagccacgccgcacgcccagcagccatgccgccagccctaaagcaatcagcagggcaatcggcggtgtgccgatcacggtcatcacgctacgcagcagactcccttcagccagcagtgtgtgtgacagagtttcccagcacgatcaatacaatcgggaccacaatcaggccgctgatggtgagcgcaccgggtggtgccggttcattcttcttttcctgcccttccggcttcgccatctgcaactgttccagcacctccaccgacagggggtagcggcgacggttcatgaatttcgctacgtagtagccgatgatcccgaccggcacggaaatcgcgatccccagtatcatcagccatcccatgtcggtgtgcaggatcccggctgccgccgctgcgcccggatgggtcggcaatgccacatgtaccgtcagcatcacacccgccatcggcaggccaaacttcagcggcgagacccgcgccactttggtaaagccataaatcagcggaataacaatgataaagccgacttcaaaaaataccgggatgccaaggataaaggccgccatggttaatgccgcaacggtacgcttcagccccagcgttttactgaaacgctgcgccagcgactcggcaccgcccgaggcttcaatgatcgccccgagcatggcaccaagcacgatgatgatggtgatgtgaccaagcaggccgcccatcccggtgataatcgtctccatgattttttcagccggaatgccggtggcgatggccaccagcagactgacaattaacagggcgacaaagggatgaactttggctttgatgaccagcagcagcaggatcacgatgctggcggtcgctatggctaacagcagtgcggtggacatagtaaacctcagaaattgttatattttttaggttatcggcgtacagaataaacagatgcagggtcagaaaaaggacgaaaaaatctcaaccggtgccgaaacaccggtttttttagcccattaaatcaggtttttctcgcccagggcgcaaaccagccaagaccagcggtagtgctgccgcgcgggatatattcgcagcccacccagccggaatagccgacctcatccagcagtgagtagagataggggtagttgatttcaccctcatccggttcatgacgatccggtgccgaagcaatctgcacgtgccgatagcgtccggcgtagtggcgaatcagatggctgaggttgccatccacccgttgcgcatggaacaggtcgagctgagtgaagacattgggtcgatcgatctgttcgaccatctccagcgtctgatactggctggcataaagatagttgggtttggtggtgggattaagcgcctcaatcagcaggatgatgccgtgcggcgcaaagcgctcagccgcataacgcatattgctgataaaggtctcaacgtagcgctgacggtcagcgtcgggcggcaccgtcgccgccatgatgtgcacctgcgggcagttcagcgccagcgcatagctcagggcgcgatcgatatccgcctttgcttccgcttcccgtccagggatggccgaaacgccccactcacccgctgcgacgttgccgggtgcggtattgaacagcaccaagtccagctggttatcatcaagccactgcttgatctgcgtggcgggatagtcataaggaaacagaaattcgacggcggtgaaaccggcttctgccgctgcagcgaagcgttcagcaaacggcaattcagtaaattgcgtcgaaaggttagcagcaaacttcggcattatcggctccttaattctgccacttcggcatcattgagataacggatcgggcggtcgcccagggtaaagatcagccgggcggtctcctccagctcttcagtgttgtctgccgcttcctgcaacgatttccccactactaccgggccatgattcgccagcaggaaggcacggtaacgtggagccagcgccgcgagatcctcggccagtcgcccatcacccggcttgtagtaaggcacaaccggcacatcaccgacacgcatcaccacatagggggtaaacggacggatgcagttgtccgtgtccagcccctgtaagcaggagagcgccgtcaggtagtggctatgcagatgcaccaccgccctgcagtcgggattattcagatagagcgcgcggtgaaacgcaatctctttggagggtttatcgcctgagagccattcgccgtcaggcgtgacttttgccagccggtcaccctgtaattcacccaggcatgaaccggtgggagtcgccagcagattgccatcctccagcaacattgagaggttgcccgccgagccggtggcatagccgcgctgaaagaacgaagcgccaagacgcaccatctcgtcacgcgcctgctgttccgttaaagagaaagattcagacatcagtaaactccgtttgcgcgcggcggaagaaatcttcatcgccaaaattgcccgatttcagtgccagagagagcggctgatgaatgtcgcgcacccagggcacgccgggcgaaatcgtcggaccgatatgaaaggccgtcacacccaggctctgtgcgaccacgccggaggtttcgccacccgccacgataaagcgctgccatccgcgccgtttcagctcgcgggtgacggcagcaaacagttgctcaacggcttcgctgctgcgctgagcgccaaaacgctgttgaatcgcctgcaagtgttgcgcgtcagcggtggcaaacagcaggggtgccagcgtctgatcgctgttcgcttccacccagtcgcataactgccgggcataagccccggcatcttccagacagcgttcagtctcaacttcgcaggccggtgccagctggcggtatgcggcgacctgacgattggtcatctgtgaacaggaaccggaaagcaccacggcgcgatcgccctgcggacggcctgcctgctccgcttttgcatcactttcagccgctgcccactgccgtgccagaccgatggccagcccggaaccgccggtgaccaggcgcagatcgctcagtgcttcgcccagggtcaacagatgttcctgatgcaggacgtcagttacgacgtagttgatcccctgcgccaccagctgacccagcgcctgccgtactgactcagcgccctgatcgacctgtgccgcagcgatcagcccggctttgcccgtcgcctgtgatgtcatcaggcgcagcaggttactgtcgtgcatcggtgtgaccggatgatgccgcataccggaatctgacagcagctgatcgccgacaaacaggtagccctgataaacggtgcggccattcaccggcagcgccggacagattaccgtctgcgtttcacccaacgcctgcagcagagcgtcggttaccggaccgatattgccctgcgcggtgctgtcgaaggtggaacaatatttgaagtagaaacgctcacagccctgcgtctgcagccaggccagcgcagccagcgactgagcaaccgcctggtctgccggacaggagcggctcttcaggctgaccacaatcgcctgcgcctctgtggtttcctcgctgtcaggaatgccgttgaactgaatagtggtcagcccgtttctgcaccagaaaactggcaatgtcagtcgcaccggtaaaatcgtccgctatcacgccaagccgcatcagattttctcctctgcctgcggcagcgtgatgccgctgaagattttaattactgcactgtcatcttcacggccgtaaccggcgttgctggcttcggtgaacatattgagggcggttgaggccagcggcagcgggaagtgcaaggctttcgcggtatcggccaccaggttgagatctttcacaaagatatcgaccgccgatttcgggctgtagtcgccatccaccacatgccgcatgcggttttcgaacatccatgaattgcctgcggcgttggtgaccacttcatacatggtttccagcgggatgccggcacgcgccgccagcgccatcgcttctgccccgaccgcgatgtgaacacctgccagcagctgatggataattttgacggttgatccgaggccgatctcactgcccacgcgataaactttggctgccacggcatccagtacagattgcagttgcgtaaaggccgcttcactgccggacgccatcaccgtcatctcaccgctggccgctttagcggcaccgccggagaccggtgcatccagcatcagcagctgatattgcgccagctgttgttcaatctgctgcgcatcccgggcggacaatgtggatgagaccatgaccacggtgccgggacgcagttttgcggccaggccctcttcaccaaacagaatggcgttaacctgctgcgcatttaccaccagcagcaaaacggcatcaagctggtctgcaaaggcggatgctgaaggctgcgcatcacgcgcgcctgcctggcgtaagttctcaagcgcggcgggattcaaatcgacaccccaggtattgagaccggcacgcaggcaggatttcgcggcacccatgcccatggaacctaacccgataacgcagatattttcagctggcacgatacgcctccactgttaatttaagtgattatttgtttgttactgttaatcctgccagtttactgtcggcaaaaatgtgtttccgctcacaaaaaaacattccagatgtgaaccagaacaatttttaacattacccgattggcagcaccggccctgccgcagtgcagttaccgccgccgttgccgggattgccgctgttattatttattctggttaaccggcagatactttataatgtgaaaaaatggtaatcatcagggagccgatatgattccggttgaacgtcatcaacagattcttgcgctggtggccgatcgtggcgtggtgagcattgcagaactcactgaacggctgggtgtgtcacacatgaccatacgccgtgatgtgcagaaactggaggagcaaggggccgtgctgtcggtctccggcggcgtgcgctcagccgaccggctggcggctgagccgtcacatctgacgaaaagcgccctctacaacgaggagaagcgcgccattggccgcaccgccgcccgacagatcccccgtaacagctgcatctacctggatgccggaaaccacgacgttagccctggcaagagaagtggtggatcgcgatgatttactggtggtgaccaatgattttatggtggcgaatctgctgatggaggccagtcagtgccgggttattcacacgggcggcaccgtatgccgggagaaccgctcctgtgtcggcgagtcggcggcacgcagcctgcgtcatctggccattgatattgcctttatttccgcctcctgctgggggccgcgtggcttgtttacgccggatgaagataaagtgatggtgaagcaagcggtgagtgaggtgagcagtaagcgggtattgctgagtgacagttcgaagtacaacaggattgcgacgtttctggctttaccgctggagagctttgatcgggtagtgacagacacgcatctgagtgagtcggcgcgggagttgttaagtgcggggagctgtgaactggtacttgctggttaagctgtcgccgccttccctgagaccgggaaggcggcaacgtgagcgtaattaaacttcttcgctgaactgcggcaccggattacggaagctgcgggttacgaacgccaggtagataatcccgatggcggcccagatcaggcccagctccatagaactctcttccaggttcacccacagcgcacccaccgtcagcgcgccaagcagcggcagcagcagatactgaacgtgatctttcagcgtgcggttacgcttctcacggacccagaactgcgcaatcaccgacaggttaacgaaggtaaacgccaccagcgcaccaaagttaatcagcgcggttgcggtcaccaggtcgaagttaatcgccatcagtgcaatcgcacccaccagcagcacgttgagcgacggagtacgccatttcggatggatgtaaccgaagaaacgctccgggaacacaccatcacggcccatcacatacatcagacgcgagacgccagcgtgcgccgccataccggatgccagcaccgtgaccaccgagaagatcaggatgccgacctgcaacgctttaccggccacgaacagcatgatttcaggctgcgatgagtccgggtgctggaagcgtgtgatgtccgggaagtagagctgcaggaagtaagatgccgcgataaagatcaccccaccaatcagcgcggtcaggaaaatagcgcgcggaatggtgcgttctgcatctttggtctcttctgacagcgaactgatgccatcaaagccgaggaaacgagaagcagagtatcgtcgcaccggtaatcatcggcaccacatgcgcattctcagaccagaatggacggctgctcaccagcgtgccggaaccaacgccgcttgccacaccgtagattaccatcgcggtaatcccgaccatgacaaccacctgcagcaccacaatcacactgttgaagttggcgacggttttgatgcccttgaggttagagagcgtcataaacccgaccagcaacaccacaaaaatccacgacgggatgcccggcaccagcgattcgaaatagtttttagccagcaggatgttgatcatcggcatgaacaggtagtccagcagtgatgaccagccgaccataaagccgacgtgcggactgatcgccttctgagcgtaggtataagcggagcccgcagaggggaagcgtcgtaccagcttaccgtaactcacggcagtgaacagaatcgcaatcagcgcgaaagcataagcggtggcgacgtgaccttcggtcagcccggaaacgatgccaaaggtatcgaacagggtcataggctgcatgtaggctaagcccatcatgacgaccggaagtaacgtgagtgtttttttgagttgcgcacgctgcggtgcggcggaggtattaagcgacatgcttcagtcccccatgtgcgacaacctggctgggctgggtcacagggcaactgcgcattaagcgacagggagtaaagttagcggttaacgcggcgccgtagtcatcacgaaaacgcgtaccagcgttggctggcagagtgtaaaacatccccatctttgtaatcctcaatctcacgcttatgcgtgttttcagtgtttatctatccgggtgcgtgcccggcctcggttaagtcagcaaaaaacgctctaataaaactggatgcaaaaaaataaccggcgcggttagcgtcggttatcatctgattttgcaggccgcgtattctgccctaacccgtggcaggaatacaagccatcggggcatcttatgcaaaaaaaagcgcgtcagatgacaggtaaaaaaacctgtcaggcatttttcagcatccagtcaatctcggtagacgtaatcagccgttcaaactgcatcagttcatgatgcttacagctgtgccagacactggcaaagcgttcgcccagtaacttctgcagcggatagctgttgtcaaactcatacagcgcatcgctctggcgaatcggcagtgccagaccctcggcatggtgaccgttgccggtgaccggatggggcaacggcaactgggtatccagcccatgcagcatcccggcaagaatagccgacaccaccaggtagggattagcatccgcgcccgcaacccggtactcaatacggtgattgtcgatatccccgcacggcacccgcagcgcaacggtccggttgttatggccccacgatgcctgcaacggcacataggcgtccggaacaaaacgacgataggcattcacattgggtgccagcagcgccattgaggcgggcatcagatcgatcatcccggccagcgcccgtttcatcagcggcgaatcactgccgtcatcgcaggcgaaggcgttatgatcggcggcatccagcatgctgatatgcacatgcatgccgctgcccgcatactcctcatagggcttcgccataaacgtggcggtcataccgtggttttctgccacctgacgaatcaggcgtttcagctgcaccgcatggtcacaggcccgcagcacgtcgcgggtatgatgcaggttaatttcaaactgtccgggcgaggcttccgccagcgcaccatcggccgggatgccctgctgacgagccagatcgtcgatgtcacgcagcacatcggcgaaatgatcgaggttatctaccgagtagacctggctctgcatattgcgttcatcactgccgggcgagcacggcggctggataaagccttccgcatcgcgctttttgtccaccagatagaactccagctctaccgctaccaccgggaaacagacctcggttacgcagctgttgccacagccggttaaggacatttcggggttcaacgtcaaagggagtgccatcttggttgcacatggttaacagcagttgcgcaatgtgctgagggtcagacgcggagggaactaaagtaccggtgacgggcaggcagagattatcgggttcgcccagtgactggccgagtcccgcttcttctactgtgttgccgaggatatccatggcaaacaccgaggcggggaaataacaccctttttccagcttaggcagcgcagagaccggaatacgcttgccgcggaacacaccatttaaatcatttaacaggatgtcgacatactgcgtgtcaggatggcgctccagccaggttttcacctcaagctggaacgcgctggttcgtttctcttcactgtgaagcgtgaagtcttccacttctaccaggttagtcatgatctcacccgcccctattaggtttgcgtaatgctcaaaataacagccacaccactaacatagcgccaacataaaaagtgtgcaaatgtaacaaatctgtttgaagaacaaacagcagattgctagattgaaaaaatattgcacacttaaccgccagacgtgccctttcggtagatatttcgaacagcgatgcgaggacgtgagatgggcattatttttgacaagccgttgatcggcgtagtgatgtgccagaaggatctgggcggccatccgagccagacggttcacaataagtataccgatgcggttgtccttgcgggtggcgtaccgctggccctgccccacagtctgatgaaagcgcctcatctattagaaaacgctatggctgttctggatggcctgctgctgaccggcagccccagcaatatcgaaccctggcattatggcgaggcgggcgaagagccgcatgccgatccgggccgtgaccatctcgcctttcagctgatcacctgggccaccagccacaagatgccgatgttcgggatctgccgtgggctgcaggagctggtggtggcaaatggcggtgcgctgtggcgggagctcagcgggcagccgtcgtttcagcgtcaccatgaagatgagacgctgccgctggagcagcagtatgctcaggcgcatcccatcactatcgaacccgacggcctgctggcgacgctgctagacagcaatagtccgctggcggtcaattcactgcatcatcagggggtacgcgaaccgggcccgcagttgcgcgttgaagcgcgcgcgccggatggcctgattgaggcggtgagtctgcgccatcatcccttcgccctggcggtgcagtggcatcccgagtggcagccggaacacacaacgggatcgcaggcgctcttcagcggctttattcaggccgccattcgttatcacaaggaaaaagaaaatgagtgatgccacgctggcgccgggacgacggctggcgcagatccggcagacactggggctgtcgcaacgccgtgtcgccgaactggccggactgacccatagcgccatcagcaccattgaacaggataaggtcagcccggcggtcagcaccctgcagaagctgcttaaagtctatgggctctcgctgtcagagttcttctcggaacccaaaccggacgcggaacctaaggtcattgtccgcgccagcgacctgctggagattggcagtcagggggtttcgctgaagcttatcgacaatggccgtgcacagcgcacgctgggcatgctgctggaaacttatcaacccggtgccagcaccggcgagaagctgcgtcatccgggcgaagagaccggcacgctgctggaaggagagattacgctggtcatcaacggagagcactatcatctctccgccggagagagctacgtcattgatacgggcttaccacacagtttcaccaaccgtgctgaaatcccctgccgcattgtcagtgcccatacgccagccaacttttaggcgcattccggagattgttatgaattacgtggagagttattacgcagcgaccgccaatccgcatgtgccctggccgacattacaggagagcattcagtgtgatgtctgcattattggcggcggtttcaccggtctttcggcggcgctgcatctgaccgaggtgggctatgacgttgtcgtgctggaagcggcgcgggtcggctttggtgccagcgggcgtaacggcggtcaggtggtgaactcctacagccgcgacgtggatgtgattgaacagcgctacggtaaagagagcgcccgtatgctgggcagcatgatgtttgaaggcgctgaaatcatccgcgatcgcattaagcggtacgcgatcgactgcgattaccggcctggcggcgtttttgcggccctgaatgcacgtcagatggcgcatctgcgaaaacagaaagcgttatggcagcagtatgggaatcatgatctggaactactggatgagcgagccatccgccgtgaagtcgccaccgaaacgctacgttggcgggctgctggatcggcgcggcggccatctgcatccgctgaacctggcgctgggggaagcggaggcgatccgtcgacatggcggacgcatctatgaacagtccgcggcgaccagtgtggtttatggcacaccaaaccgggtaaaaaccgcccagggcgaggtcagcgcgacctttgcgatcttcgccgggaatgcctatctggccccgcagctggaaccgcgactgagcaggaaaagcatgccgtgcggatcgcagattgtggcaaccgaaccgctgtcaaccgaccaggcgttgtcgctgatgccgaacaactactgtgtggaagattgtaactatctgctggattacttccgtctgacggcggacaaccggctgctctatggcggcggcgtggtttatggcgcacgggaaccggccgatattgaagcgttgatccggcccaggttgcgccgcactttcccgcagttgcagaacgtgaagctggacttcagctggagcggcaatttcctgctgacgctgtcgcgcatgccgcagtttggccgactggagaagaatgtctattttatgcagggtgacagcggtcatggcgtaaccagtacgcatctttccggcaagctgatcagcgaagtgttacgcggcgacgccgagcgttttgatgccttcgcccgcctgcctcacctgccgtttcccggtgggcgacgatttaaggtgccgctgacggcgatgggcgcggtgtggtatgcgttgagggatcggttaggggtatgaacccgtgtaactaaaatcaaaacgacctttaagatcattggttatctaaattgtaactgcattagatagcttgagtctttattcaaccctgattatgggggttccccccccataactatgaatgtttaatgagtattgtcagtcattttgtatcccttccagacccactctttaccttgtgtaaattgatctttaagataatctggcatggcaaactcaggataaacatcgtgcttatccgttataaagaaactgtcaccatatgcgctgatattcgctacgggatggcaattgttgtcaaggagtgagcatcccataaaataatttttagcctttgctatttttaaaacattgagcaatgttggcgcaaaattcacactattctttccttcggcatcaatcacctgatgctgaacaccttcccaatacataagcaaaggaattttatcaataaaataattctttggagtatcaatgaccgaagtaaactctggagccgggaatgaggcatggtcagaagttagaacgaaaatggtgtttttcgacatcccactgtccttaagatatttaatataacgaccaacctgcgcatctaaattatggaatctattcagtgcaatacttcgtccatctttgtatttaatgtcagggctatcaatagtaagatgagtaccaaaattataaagaccaataaagaatggtgctttatcacttttggtttttttgattaggaaatcaataagtgctttatcacttaatggctctgtagaggaacctttaaactgcatatcatctgcacgtgtataaacgcggtcaaaacctagagatgccagcatagtattaaggttagcaccttgataatgaggactgatgaagtaggtgttataaccctcgtcacgcagaatatttggcagtgtagttaacttatttaatgtatgaagcactacctgtttcggatgacagttgatcaagacctttagctaatgaatctgtcccgcctatatattgataggtagatgtcaattgtcctcgcaatccccggaaagtggcagcagtatgattgtaatagtttttaaaaaccagagaagagttagctaattgatcaatattaggggtaagatctttgtatttaccaccataataatcaatgatatttgctgacataccttcgacaaagaaaactaccacattcggtttatgtggtattttactaaataactcttcatcctttccttctgacggatagatagtgtaatgtttaaattcattatatatcttttcacgctctgaaccattttctttcatagcatccagctttcggttcatctctatataattatgcattgttgtcacaatagaaagcaaaggcgaacgccattctgaaaaagaaggttcatgcctgacattcgcataaacaataccacaatatgataatatagccccaatactaactgctttagtgaattttttattaatatagcctgaattaggacgacaaattaaaaaaagaacaagaaaaacagcaaaaggaaaataacttgatgctgagatatttataaaatcagcggaatctctattccacagtgataaaacggttataaatgcaccagacttctgaacaaactgaagttgtaataatatgaaaaaagctaaaattacagaaataaacctaactatggaaaaatgtaattttgcaaacttgacaaataaaaaaagagttacttgaataaaaaagatctcaacaagtgttggaagtatataaaccactaaattatattgaacatacgtaactgatgcatatacagcaagtaacaaccacacaaaaccccagcgacaattgaacagaaaattcattttacaatcattattagttaagtaatttttagtattataatgcttatgagagttagtgtgaacccccataaacatcacgtatatacaaaatttttttagataggcattttaatcgggtcgtcatagcggtactcaaaaccgagttcgctacagatgcgggaaccatcaatcagcttgccgctattcttttccggctcgggtgcgaaactgcggcggctgcagcccaagctggtgcgtgaccgcaggatagaaggtgtcacgcgagggatgtttcgaggcacacagattgtagacccgtccccctttgggcgactgcaatagcagcgtgatcgcctccaccacatcatccagatgcaccagattcacgccctgcgagccattggccacatcctgcttgccggcgaggaagcgtcccggatggcgctttggtcctaccagaccggccagccgcacaatatctacgctggtgcctggcagatcgtgcagccagttctccagtttaaccagcgtctttccggccaccgtttctgcgtccagcgggctgttttcccgcttagcgccggcgctgctgccatagactgaggtggaactggtaaagataatgcgcggtaccttataaaccagcgccgtatcgaccacattctgcaccgcctgcagataggcttcgccaccttccgcagtgcggctggcgggcagtgtaacgatcagcgcatcgacgttgaatagcggctcaatatcggcggcatcacagagcagttccggcgtcagttccagctggaacgcctcaatgccgcagcggcgtgccgcgtctataccgtctggcgtggttttgctgccggtgacctgccagcctcgcgccgttaacgccgtggccagcggcatacccaaccagcccagtcccacaatcgcgaccttcttcattttgactcctgacgtgaaacatcaaccctgacttcaccgtagtttgcccccggattgcaaaccagaacaacctgtttcagcgctttccgaaccgcccgtttaaaaaagtgttgccaagcgcagccatcttcgctaggttaaaccccacaaatgaatactcattcatcgacgagattattatgacacgcgttcagttcaaccatcatcaccaccatcatcctgactagtctttcaggcgattggtgctggaagactttcaagatcttccagtggtgtgaacgcaagagaacccccggaagatcgtcttccgggggtttttttatgggctgacgtaaccacacattcaggaccgaattaagaggacaggaaccatgttagataacacccgtttacgcatagctatgcagaaatctggccgtttaagtgatgattcacgcgaactgctggcgcgctgcggcgttaaaatcaaccttcagcaacagcgcctgattgcgtttgcggagaacatgccgatcgacatcctgcgtgtgcgcgatgacgatattcctggcctggtgatggatggtgtggtcgatttaggcatcatcggcgagaacgtactggaagaagagctgctgtcgcgccgtgcccagggtgaagatccgcgctactttacgctgcgccgcctggacttcggcggttgccgtctgtcactggcgatggcgacagatgccgagtataccggcccggaatgcctggataaatcccgtatcgccacctcctatccgcacctgttaaaacaatacctcgacaaaaaaagcgtcagctttaagacctgtttactgaacggttccgtagaagtggcgacccgtgccggtctggctgatgccatctgcgacctggtctctaccggtgctacgctggaagccaatggcctgcgcgaagttgaagtaatctatcgttcaaaagcggtgctgatccagcgtgacggcgagatgcctgccgccaagcaggagctgatcgacaaaatgatgacccgtattcagggcgtgattaaagcgcgtgaatcgaagtacatcatgctgcacgcgccgagtgagcgtctggaagaagtgatcagcctgctgcctggcgcagagcgcccgaccgtgctgccgctggcaggcgatgtcagccgcgtggcgatgcacatggtcagcagcgaaaccctgttctgggaaactatggaaaaactgaaagcgctgggtgccagttcgattctggtgctgcctattgagaagatgatggagtaagccatggccttttctaccccgattgagtggcagcagtgcacccccgaacagcagcaggcgctgctgttacgtcctgctatcgccgcctctgaaaacgtgacgctgacggtgcgcgatgtgctggagcaggtaaagctgaacggtgatgacgctctgcgccagttcagcgcccgcttcgacaaagcgcaggtggataacctgcgtgttaccgcgcagcaaatcgcagaagccagcttacgtctgagtgacgagctgaagcaggcgatggccgtcgcggtgggcaatatcgaaaccttccacaacgcgcagatcctgccgccggtggatgtggaaacccagccaggcgtacgctgccagcagattacccgtccggtgaaatcggtcggactctatattcctggtggttccgccccgctcttctccaccgtgctgatgctggcgaccccggcccgtatcgctggctgtggccgcgtggtgctctgtttcgccgccgccgattgccgatgagatcctgtatgccgcccagctgtgcggcgtagaagaggtgttccaggtgggcggcgcgcaggccatcgccgcgatggccttcggcaccgaaaccgtgccacgcgtggataagatttttggcccgggcaacgcctgggtgacagaagcgaaacgtcaggtaagtcagcgactcgatggcgcggcgattgatatgccagcgggtccttctgaagtgctggtgattgcggatgaaggcgccacgcccgcgtttgtcgcgtctgatttgctctcacaggctgaacatggtcccgactcgcaggtcattctgctgacgccttcattgcccctggccgaggcggtcgcggtcgcggttgagcagcagctggcgcagttgccgcgggctgccacagcgcgtcaggcgctggaaagcagccgcctgatcgtggcgcgtgaccttgagcagtgtatcgcgatctctaatctctacggtccggagcacctgattctgcaaacccgccagccgcgcgatttggtggagtcgatcaccagcgccggttcggtatttttaggcgactggtcgccggagtccgcaggcgattacgcctctggcaccaatcacgtgttaccgacctacggttacacctcgacctgttccagcctgggcctggccgatttccagaaacgcatgacggtgcaggagctgacgccgcagggcttcctgaacctggccgccaccattgaaaccctggccgccgccgagcagctggatgcccataagaatgccgtcaccctgcgcgttgccgcactgaaggagcaagcatgagtcaggatattgagcagctggcgcgcgccaatgtgcgcgccctgacgccctatatgtcggcgcgtcgtctgggtggcaacggagatgtctggctcaatgccaacgagtttccgctgccggtgccgtttgagctgtcgcagcagacgctgaaccgctatccggaatgtcagcctaaactggtgattgagcgctacgctgcttatgcaggcttaacgccggagcaggtgctggtgagccgtggcgcagatgaagccatcgaactgatcatgcgtgccttctgtgagccgggtcaggatgcgattctgttctgtccaccgacctatggcatgtacagcgtcagcgccgaaaccatcggcattgaataccgcaccgtcccggccctgaccgactggcagctgaacctgcctgccattgcagagcagctggatggcgtcaaagtggtttacctctgcagcccgaacaacccgaccggcaacctgatcaatcaggaagacatccgtcagctgctggcaatgaccgccggtaaagcgctggtagtcgcagatgaagcctacattgagttctgcccgcaggcgaccctgaccggctggctgaaggattatccgcatctggtgatcctgcgtacgctttctaaagcctttgcgctggctggcctgcgttgcggctttgcgctggcgaataagccggtcatcgacctgctgatgaaggtcatcgcgccctacccgctggcgacaccggttgccgatgtcgccggtcaggcactgagcgaccagggaattgcgctgatgcgtgagcatgtggcacagctgaatgagaatcgtagctggctgcaggctgaactgactcagctggcctgcgttgagcaggttttctccagtgaaaccaactatgtgctggcgcgctttaccgattcaccaaaagtcttcaaaaccttatgggatcagggcattatcctgcgtgatcagaacaaaaatccgggcctgtcgggatgcctgcgcatctccattggcacgcgtgaagagtgcgaacgagtgatcgccgcgctgcaagccttttctgtggagcaagcatgagccagaagaccctttttattgaccgcgacggtacgttaatctctgagccgcctgaagattatcaggtggaccgcatggataagctggcgtttgagccagatgttatcccggcgctgctggcgctgcaggccgccggttatcgcctggtcatgatcactaaccaggatggtcttggcaccccgggtttcccgcaggccgatttcgatggtccgcacaatctgatgatgcagatcctgacctcgcagggcattgcgtttgacgatgtgctgatctgcccgcacatgccggacgatcactgcgactgtcgcaagccaaaaacccgaatggtggaagcctggctggccgaaggcgcgctggataccgccaacagctacgtgattggcgatcgcctgaccgatgttcagctggcggagaacatgggcatccagcctatccgctacggtgctgacggccagaactggcagactatccagcagcgtctgacccagcgtgaccgccatgcgctggtgcagcgcaacaccaaagagacacaggtgcgggtagaactgtggctggatcgcgaaggcggcagcaagattaataccggcgtgggtttcttcgaccacatgctggaccagattgccgtacacggcgggttccgcatgaacatcgaagtgaaaggcgatctctatattgacgatcaccacacggtggaagataccggtctggcactgggcgaagcgctgctgaaggcactgggcgacaagcgtggcataggccgtttcggctttgtgctgccgatggatgaatgtctggcgcgctgcgcgctggatatctccggccgtccgcacatcgagttcaaagcggagttcaactatcagcgcgtgggcgacctcagcaccgagatggtcgagcacttcttcagctcgctctcctacgccatgatgagcaccctgcatcttaaaactaaaggcaagaatgaccatcaccgcgtcgagagcctgtttaaagcctttggccgtacgctgcgtcaggcgatccgcgttgagggcaatacgctgccaagctcgaagggagtgctgtgatgaacgtggtgatcatggataccggttgcgccaacctgtcgtcggtgaaatgggcgattgaacgtctgggctacaccccggaagtgagccgcgatcccgatgtggtgctgcgtgccgataaactgtttctgcccggcgtaggcaccgcgcaggcggcaatgaatcagctggaagagcgtgacctgatcgatctggtcaaagcctgtacccagccggtgctggggatctgcctgggtatgcagctgctgggtcgaggcagcgatgaaaacggcggcgtgccgacgctggggattatcgatgagccggtgtcgttaatggacacgcacggcctgccgctgccacacatgggctggaaccagattaccgcgcaggcgggcaatcatctgttccgtggcatcgacgaaggctgctatttctacttcgtccacagctatgccatgccggtcaacgccagcaccatcgcacagtgtcactacggtgaagctttcaccgccgcggtgcagaaagataacttctttggcgtccagttccacccggaacgctcgggcaaagcgggcgcgcagctgctgaaaaacttcctggagatgtaatgattatccccgcgttagatttaattgacggcaaagtggttcgtctgcatcagggcgattatggacagcagcgcgattacggcagcgatccgctgccacgtctgcaggattacgttcgccagggcgcgaccgtgctgcatctggtggatttaaccggcgcgaaagatccggcgaaacgccagatcgcgctattgaaaaccctgctggatggcgttgatgtgacggtgcaggtcggtggcggcattcgcagccgtgacgatgttcatgcgctgcttgaagccggagcgagtcgtgtggtggtcggttccaccgcggtgaaacagcctgaagaggtaaaacggtggtttgcggaatttggcgcagaggcgattgtgctcgcgttagatgtgcgcattgatgccagtaaccgcaaagaagtggcaatcagtggctggcaggaagcggcgggtgtcacgctggaagaggtgattaccgactttcagcaggtgggcctgaagcacgtgctgtgcaccgacatttcccgcgacggcaccctgagcggctccaatgttgcgctctatcaggaagtgacggcgcgctttccgacgattgctttccagtcctcgggtggcattggcgacctcaatgatatcgccgccctgcgcggcagcggcgttcagggcgtgattgtcggacgtgcgctgctggaagataaattcactgtttcggaggcgatcgcatgctggcaaaacggataattccctgcctggacgtacgtgacggccaggtggtcaaaggcgtacagtttcgcaatcacgagatcatcggcgacatcgtaccgctggcgcagcgctatgctgccgaaggtgccgacgagctggtgttctatgatatcaccgcctcatccgatggccgggtcgtcgacaaaagctgggtgtcgcgggttgcggaagtgatcgatatcccgtttctgcgtcgcgggcggcattaaaaccccggaagacgcggcgcgcattctggagtttggcgcagataagatttcgattaactcgcccgcgctggccgatcccacgctcattacccgcctcgcagatcgttttggcgtgcagtgtattgtggtcgggatcgatacctggtttgatgaagccagtggtaaatatcaggtgaatcagtataccggtgacgaagcgcgcacccgcgtgacgcagtgggaaacgctggagtgggtgcaggaagtgcagaagctgggcgcaggcgagatcgtgctgaacatgatgaatcaggatggcgtgcgtaacggctatgacctggtgcagctgaagaaaatgcgtgaagtctgcaacgtcccccttatcgcctctggtggtgcaggcaccatgcagcacttcctggatgcgtttactgaagctaacgtggatggtgctttagccgcctcggtattccataagcagattattaatattggtgagctgaagagctttctgatcgacaacggagtggagattcgcgcgtgctaactgaacaacaacaggcccttctcgactgggataaaacacagggcatgatgccgatcattgtccagcacttcgtctcaggcgaagtgctgatgcatggctacatgaacccggccgcgctggagaaaacgctggcagaaggcaaggtcacctttttctcccgcaccaaaaatcgtttgtggaccaaaggcgaaacctccggcaactttttgcaggtcgtgagcatcacgcctgactgcgacaatgacaccctgttagtgctggcggatcctattggcccgacctgccatctgggcaccaccagctgcttctcaccggcggtccctgagtggacgttcctctatcagcttgagcagttgctggcttcgcgcaaaaccgccgatcctgaaagctcctacaccgcacgactctacgccagcggcaccaaacgcatcgcgcagaaagtgggtgaagaaggcgttgaaaccgcactggccgccacggtcaacgatcgggatgaactcaccaacgaagcttctgacctggtctatcacctgatggtgctgttgcaggatcaggatctcgacttccgcgccgtgattaacaacctgcgtgaccgccataagtaactgtgcaatatgctgctcagaatgccgtttttatgcggattctgagtagtcttcagctcattcctcacgtccatccggcacaatgacggcaactcaaacctcagggagagaaccgtgaccacccatgagaaattaatcgccctgctcgaccagcaccaggcacgctatcgcctgatggagcatgaggcgaccggtaaatgtgaagcggtcgcggcgatacgcggcaccgaaatcggccagggtgctaaagcgctggtctgtcatgtgaaaggcaacggcgttaaacagcatgtactggcggttttacctgccgatcatcaggccgatctgggtaaagtcgcggccgcggtcggaggaagacgcgcctcactcgccagtccggcggaaaccgatctgctgaccggctgcgtattcggggcgattccgccgttcagctttcatcccgacctcagactggttgttgaccccgcgctttttgaacgttatccggagatcgcctttaacgctggtctgctggaacgttcagtgatcctgaataccgaagattatcgcgcgttatgcgcggctgacgtggtgaagattacgcagtaattgccatcccggcagcccggcgatactctgcataatcactcatcacgacagaataagagcaaaatcatgaacattttcactcaacgcctgcgtcagacgctggctgtggcggttatggcaggctgcgcttttggcgcgcaggcaaaaatcgaacaggtgcgtttcgcggtcgatccgacctatccgccattcgaatcgaaaacgccacagggcaagctggtcggctttgatattgatctgggcaatgcgctttgtactcagatgcaggcaaaatgtgtctgggttgaaagccagtttgacggcatgatcccggcccttaaagcacgtaaatttgatgccattctgtccgacatgggcattaccgaagaacgcctgaagcagattgatttcaccgcgccactctatgacacccacacccagctgattgcccgtaaaggtgctggcatactgcccaccgttgaatccctgaaaggaaaaacggtcggcgtagaacagggaacggttcaggagcgttatgcgctggcaaaatggcagcctcacggtgtgaccgtagtgccttatggcgatcaggcacaggttgaaagcgatctggtttcaggccgactggatgcggtattcacagatgcggcacaggctgccatcggcttcctgaagcatccgcagggcaaagattttgaactggctggcccgattatacaggatccgatcatcggccccggcacggcgattggcctgcgtaaaggcgataccgagctgaaaaccgcactggataacgccttcttcgaaatcaaaaagaatggcacctttgaccagattcagaagcgctacttcgccacggatatctctatccagccttaacctcgcggtcgccctttttcatcctcaccgcgatccggcactatactctaactatttcgggacggcgcgctgtcgtcctttgccgattaaaggacattaacacggtatgcatcaacaacatcatccactgttaagcgcctctttaggcacccagcgtgaaatcatcagtttccatttcgcggaagacaacgagcgtcaggtctacatccaggctgcgctgcatggcgacgaaactgcccggtatggcggtggcgtggtttttaaagcagcgactacaggcgctggagtccgccggtcaacttaaagccgcctttaccctggtgccggttgccaatcccctggcgctgggacagcactggcatggcacccatcttggccgattccatacgctctctggccaggacttcaaccgccgtttcccgtcactgggcgcaaccctggcggccgggctggctgagagtctgactcagagtgaaacgcaaaataagagcctgatccgcgaggcgattgatcgccactatcgcgataccgtgccaaaaaccgagctggatgcgcaacgccacacgctgatgcggatggccagtcaggccgatctgatgatcgatctgcactgtgactgggaagccgtgcctcacctgtacaccacgccgcacgcctggccggacattgagccgctggcgcgctggttaggcagtgaggtgcagctgctggcgcagatctctggcggtgaaccgtttgatgaagcctgttgcgaaccctggctgacgctggcggaacggtttggcaaagattatccgatgccacggggattgctgccggtgacgctggagttgcgcggtgtacgtgatgtatcgcctgaacaggcggagaaagacgcggaggcgattatttcagcgctacaggaaggcggttatatcggctacagcgagcctgcgatttccgtggaagtggcggcacccgtgatcggtggcgacgaactggtcccggcgagcgcgggcggagacgatatcgtggctatcaatgacggcccgattggtttaaacgtgccagatatcgctgaagcacctggagaagctggcgtcatcaaagagcgtcacagcgaaggatcggcggcggcctcccctgccctgaaaaatccacctacgccgttagcgggctgtgaatatattcattcgccggtatccggactgatcctgcatcgtaaaccgctgggcgcaaagattcggccgggagaagtggtggcggagattgttgacccgataactgaccagattacgccgctggtgacggaacatggcggtattctctatgcgagacactgggctaagtttgcgacggcaggcatgctggttgtgaggctggcaggtgagcgagagattcggagcggggatttgctggtaggataaaaaaagggcttcccgagggaagccctttttagtgattaatctaaccactcggtgtggaacacaccgtctttatcaatgcgcttgtaggtatgcgcaccgaagtagtcacgctgcgcctgaatcaggttagcaggcagcacttctgaacggtagctgtcgtagtaagcgatcgccgcagagaaggttggcgtcggaataccgttctgaatcgcgtaggaaaccacatcacgcagcgcctgctgatactgatcagcgatatctttgaagtacggtgccagcaacaggttagcgatgcctgcatcttctgcgtatgcatcagtaatcttctgcaggaactgggcacggatgatgcagccggcgcggaagatcttcgcgatttcaccgtaatgcagatcccagttgttctcttcagatgcggcacgcagctgtgagaagccctgagcataagagacgattttacccagatacagagcgcgacgaactttctcgatgaactccgctttgtcaccggtgaaggccttcgcctgtggaccgctcagtactttagaggctgccacacgctgggttttcagcgaggagaggtatcgagcgaacacagactcagtgatcagtgacagaggttcgccgagatccagtgagctctggctggtccatttaccggtgcctttgttcgctgcttcatccagaatcacatcaaccaggtatttaccttcttcgtctttcttggtgaagatatctttggtgatgtcgatcaggtagctgctcagtttcgccgttgttccactcagtgaaggtctcagccagctcttcgttgttcagacccagcgcgcctttcagcagagcgtaggcttctgcgatcagctgcatgtcgccatactcgatgccgttgtgaaccatcttcacatagtggcccgcgccgtccggaccgatgtaagccacacaggcttcgccatcttctgcacgtgcagcaattttatccagaatcggagcaaccagctcgtaggcttctttctgaccgccaggcatgatagatgggcctttcagtgcgccctcttcaccaccggaaacaccggtaccgatgaagttgaagccctggtcagaaagctctttgttacgacggatggtatctttgtagaaggtgttaccgccatcgatcagaatgtcgcctttatccaggtgtggagtcagggaggcgatagtcttatcggtcgcttcacccgcctgaaccatcagcaggatacgacgaggtttttccagcgattcgacaaactcttcaacggtgtaaaaaggagcaagtttcttgccctggttctcggcgatgacttcatcagtcttttcgcgtgaacggttaaagatagaaacagtgtaaccgcggctctcaatgttaagagccaggttgcggcccatcactgccatacctacaacgccgatctgttgcttggacatcttttactcctgttatataaaacgtaatgaatacgtttagaactatatatcacatagaagataataacttactgaatgagaagataaatagcatttggtgccattagttaaaatcttaacagtgcgctgacggcaattttatttagaaaaacttccatccatgtttattaaagaatttaaacatcgaatgtgagaaaaggagtatatgcttaagacctttcctggaaacattaccaccatggtggattattttcacatccggaacataagcaacctcagtaacctgacgagctcgtaaactcaggtctgtatcttcaaaatataagaaaaagtttttatcaaaaccattcagttgcaaaagaacgttatttctgaaaaacataaaacagccactaacactatctggctgccacaaaactgtctcagattgcgtttctttcatcatgcagtatgtttcaagtttacttttgaataaatgatggagtgattttggaagaaaagcgcgaagaaataatgtgaaaacatttggataacgcttgcaaagatattgcctatcgccatttctccaaaaagcctgcggtgataacaagccacaggctttatttttttccataaaaaccagagcattagacaaagagtcatctgtaaaaataacatcaggattaagaatcagatgataatcataatcttcagaaaaagtaacattatggccccgaccatagcccaggttttcaccacttatgatgatttcacaaaactggaattgttcaacaactttgttatgaagtggctttaattctttataaccgttttctacaatcacaaaatcgtaacgcagatgatcaatgtaagatgcggcctttttaaatgattcaagtaattcaagtatatcatcatcaatatagtaacaaacaattgaaactcgcaaagaaatctcacgtttcgggattgttggagtttatttcatttgtttgagaattattgactgtatcttccgtggatgccacgtaaaccatgcataactcccctgaaaatcatctttaactcgagcgacttgtttcgagatgcaataatgtaaaaggacatctttactattaatttaaatgcatctaccactttccagttaaaagggatgtagttacgcttgtataatagcaaagcatttcgagcctgatagtagtgtctgaggggagaatgaatagcaattgagttacttaaaaaattaactctttcatcgcctaacgtatgtgtcatatgggcgttacaagctccataactcttaaagcctttactcttagcccttaatgcccattcaacatccacataatcaataaagagcgtatcgtccatcaagccaactttttgaatactttcgacggatattaatgaaccagaagaaattagatgatcaacaataacacatccattatcatctggctgaagttctttatcaatctttaaccctctaatttggataaagcgtgaccgcacattgttatttacgtctaaaaattgtggtcccaccgctgcagcatctgggtatttaaccaaaacttcctgtaaggaagacaccatatcatttgcaggtaaactatcttgatccatcagtaatatatttttatatctattgatgatggcatggtttatacctatattttgagctgccgcaattcctaagttgctatcgcacaagataacttcaatgtgcttatcaaattcgaaagccatatttttcagtgcataattattatccgaagcattatcaacaataataatatcgacattactttttgacaatatattaacttgagacattaattgctcaagctgtggatgataagtaacaatgattgcgagggtgttatttggcatgtgattatctaataaaagggccaaaggcccttatttgatacagctgcgatagatatctttaagctcttcgtattgctcgccgaatgatcgtatgtgtgaatgaggcagttgtactacgtcagtttgtggcaaataggagaaatgcgctatggtttttttaacacattccagaagcgtgccaccatcattattaaaagggataataaacccattttcgccgggtataatatcttctacagcaccacccgcatctgaggtaataacccagacgtttctgattagcgcttcacgtacagtcaatccgaaactttctttagactgagttggatataaaagaacatcgatagaattgaaaaattcgtccatgttatcctgtgaaaaagcaggcacaacttcaacatttttcaatccggctagatcgctctcatggaaagacttaaaaccgaggttaagtgcattatcaacgattattaacttaccttcattttctgctatatgattaaatgcatattttattaagtgataaccttttatgtctgtatttcctcccgcataaccgaatcgtaatggtcggccaggaaactttaggcgaaatacactgaggataagtaactccatttttattaagcagagcttcagtaaaaccttctttacgataaagctcagtggtaaacatacttggagaaattatcttagtagcaagagatagtgcatctcttttcttcatttccagatagtccatttttgctggaatgttgccattcgtatcgtcactacttccacgggacttgtgatcttctttaaagctcaatataaattgatgctcatataaccaccaataatcatgtgtagttacaacgatggggatattacgttcagcgcatatccgtagcatagtaatgccaagcccttgaatagaatgataatgtacaatatctggtttaactagatccagtacatctgtaaacgctttatctatatcagggttaataacctgacggttttcagaaagtaagttgggcaaaactataccataacaatcctggccgtaggcttcgtatcgtcgaagagtattagcagcaccatattcttctggtaaagaagttaatatatgaatattaaattctttatcattaacgaaggatttattcaaagcctctgctacaacagtcgctccaccaaaagaacgtggattataatagcaattgacagagagaacatgcttaaccttattattatttaaacgttcaaaatccttaataattatggaagcttgttcacgggcaatgctttcaggtgaatagtgtttcaaaacagactttttagcgttttcaccgacattctttcgtaataaaggatcttcaataagcatcttaaatgatgcctcccattcttctgtgtcataacagagaaaaccattcactccattttctattacggaaataaagtttggacgaggagagcaaacacttggcaaacctaagattgaagcttccagatacttaatatttgattttgagtcgttgaaaatataattttcaagtggcgcaatactaatatcacactcagcaaggatccttaaataatctgcataaggacaaaatcctattctttctatttgattttttactttatcaaacttgtcaggtagtttctaacatacccgctaaacgtaaatgaacattaggagaagaaacaagaatattatagatggcatctgaagcttctagaaagtctacattatgagtacttgttccagacccatagacaatacgaattataccatcagtttcactttttcttatttctgggatagatcctgctgtttcaattgtttcaggatcaagcgcattttcaatgactattgatttactagctcctgattttaacatagcttcttccagaggctcagtcgatgcaatgacgcctttacaacgcatcattgcatcatggtataacctggcaccatctattaaccctttaaaggtttctttatcaagctcatttaacgttttacttttaagaagtatgtcttcatcgaatatcagatcatcgacttcccagtatgtttctaaatttaaacgtttacactcatcaaagagtgtcatcactgtttcaaacgcaggtacacgataaaaaatgattatcgaatgatactgtaaagcctccatacaaccaattaagtcggtccaattcagagttttgacaggaattcctagctgtttaaataaatcgactttctgatctacacgatatttcttacactgaggaatagacatttcagcaataataagtactcgtggtaagagcaaagattcgttatttaacattacagctgggagagttttagctgataaaacagtttgtgacgcggattgtaagttattaatatgatatatcttgcgaacaatccctttaagcccattctttttatatagagaaagtgttcgattcacacttccttttatgccataactagagaccacactttttgcaactttagccgctttcttaacgcgacgcgcgttaagaactgcctttctcataggcgcagtaattttccagctagtggaggtcagcagagcattattttcaaaggataatctatttgctagctcagactgattgtttagttgcgccttaagatcgtcaatttcagttcgtagtacatcttcaattcttttataaagattaatttgccttgcgcttacagataactgatcggataagctggtattctgagtaacaagttctttccactccatttccggaaagacacttaggttactccatgggttttctgtttgtttctggcgctttaaatacgctgccatttaactcgagattaccaactactacttcttcatcctcaccaacaacgtgacgtagacctaataaattctcttttctggatttttttgtaattatacataatgaatttatgaaagtgacggagtgaatctctgaataatcaacattatctagttctgcactatcataatgtttaaataatgaagagaggtaatctgaagcagaacgctcaataccccagtgttcaaaattggtaatatcagcaagtttttttaaaaaggccatagaagaatatgggtcataaagtcctccttcccattcttgccagtaactacagtgtaggtcttcaacaatataaacaccatcctgctccagtatagggaagtaaagtaaaaaagactttattatgtctgatgaattgtgcgaaccatcatctattatcaagttatatgaaggggtaatttcactaattttatttttaatttctaatgtagaagagttcccgatcaaaactttaatcgatttattttcgtattcaagacgagcacaatcaggattaatatcacaacccactatgttttcagcatttggaaaatatttactccatatttccaaagacccgccattctggacaccaatttcaagaagattttttagagttttttgttgtctggaaaggatattatgataagtttcaagataaatatcccatttatcggatgatttaccatgatgctcctgatagagctcttttaaatttttcattcttgtctcagcttaactttatcaaatttaattccaaccagtccccagcgtacttcactggatgatacattaatgatcatagcatcatgaagccagtgatgctgaacatgattattcaaatctccgtttgcaagggagaccattagtgcatattcaccattaggtagcattggcaatgtaaattcaaatgtggcatgaatcttactatccgcagaagcaaccaacggtttttcagtagtgaagggtaacgtattttctccaaataatacctgccccaaacggtcctttactaaaaaaccaataattggcgagtcaagatcctgataaatgttagccctgacagataactcaactttttcgcctcctttaaagagattcttacttttatgatctttattgataaatgacacatctgttatttctgcagcacctgttttccatccattagcttcagaaaggttgttagcaatcccatattgaaccttataatcgatagctggggtttcatttaattctttaggggttaaatgcttgtcgttttcttctaatgttgcttcattatcttgtttgatactttcgagatgtgtttcatctccataaacttcctgcagagtatattgcagatatttttctgcaacttgcttcgccgttcctgaagttatcatttcacctttgtgtagccagatagctttatcacacaggttaatgacagagttagtatcgtggctaacgaaaagtaatgttccattttctttaaattttcgtataaatcgcatgcatttctgtgtaaaaactgcatcacctacggcaagcgcttcatcgataaccaatatgtctgcatctacatgtgcgatgacagcaaatgcaagacgcacatacataccacttgaataggacttaaccggttgatctatataatcaccaatatcagcaaaggctaatattttttcatatcgatcgcggatctgttcattggttaatccgtatagcgacgctgccatgaacacattttcatgcccggtaaactcagggttaaagcccgcaccaagtttcgagcaatgcagcaatacgtccattgactgttacactgccattcgtcggagtcagtgttccacatatcatctgcagcagcgtcgatttccccgatccattccgtccgatgatgcctactgtttctccctttttgagggaaaatgttacatctcgaagcgcccagaattctcgatacatttttttatgcgatctatagaacatctgcataagacgatgctgaggtgattcataaatctgataacatttactcaacccagcgacttcaatgatattatcagatgacatcagcaaatcctttacgtgttttctgaaaccacaaatatcctaaccatgccagaattgcatttataatcaatcctttaatataagggattatttcaggaacttttccccaatacataacatcacgcgtttgctcgataaaatgggctaacggatttaaagataaaagcggtcttactgaatctggcagtgccgaagtagggaaaaagataggtgataagaacattaaaaccatcgttaaaatcccgacgatttgactcacatctcttaggtataccccaagtgaagctagtatccaactgatgcccattatcataaacatcagaggaagcaaaataaagggtaacagcagacttgttaaatgtggcatcccgacttcaaatacataaaatgttatccatacaatgcaactgatcgcaaaatgaaacaatgcagcgcaaagatttacccatggcaatatttctaaggggaagataaccttttttacatagtttgaattggcaagaatgatgccaggcgcccggtttatgcattccgaaaataaattaaaaattattaatccggaaaataacagtaacgcaaaagacgatttagaagtatgaccttcactccacttggcctgaaacactacgctaaaaataaacgtataaacgactaacatcaatacaggagtgaaaaacgaccataacaaacccaatactgagccccgatagcggctaataacttctcttctagtcagtgtatagatcaatcttcgattagacaccggcgatttaacacattgccaagtcattttaagaagcgaattcattcaaagacctcagctccggaaaataaagaagcaagcttatctttttctgatagcaggacctcatttttcggccactcaatattgattgaaggatcgttccagacaatgctacgctcattctcttttgaataaaagttagtggttttataaacaaattcagtattatcaatgagtgttaaaaatccatgtgcaaaaccttctggtatccataattgccttttattttcactgctaagttcaacaccaatccattgaccaaaaaacggagattgcttgcgtatatcaaccgctacgtcaaacacagctcccgcaacacaacgtactagtttaccttgcgcataaggattaagttgatagtgcaaaccgcgcaaaacacctttgcttgattttgaatggttgtcctgtacaaaatcaacatgcctgccgacagcttcatcaaattttttctgactaaagctttcaaaaaagaacccacgttcatcgccaaacacagcaggctcaaaaattttaacatcaggaattttagtgtcgatgattttcattataaacgcccttccaccagcgccatcaaatatttgccatattcgtttttaagatacggcttagcaagttcctgtaattgcgctttatcaataaaacccattctgaaggcaatttcttccggacaagctactttcaggccctgtcgtgattctatagtctgaataaagttgttcgcttccatcagactctgatgcgtaccggtatcaagccaggcatgaccgcggcccatgattgatacagaaagtttgccttgctccatgtagatacggttaatgtccgtaatctcgagttcaccacgaggtgaaggctgcaggtttttcgccatttccacaacactgttgtcgtaaaaatagagcccagtaacagcataattactgcgagggttcttaggtttttccaccagcgaaatagctttaccctccttatcaaattctacaacaccataacgctcaggatcggtaacgtgataagcaaagacggtagcgccatcatccttcaatgacgcagcttcaagctgcttgtagaggtcatgaccgtagaaaatattgtcgccgaggataagtgcgactgaatcatcaccgatgaactcttcaccaatgatgaacgcctgagccaggccatccggactcggttgcactttgtactgaattgagatgccccactgagagccatcacccagcaggctttcaaagcgcggagtgtcctgcggcgtgctgatgatcagaatatcgttgatccctgcgagcatcagagtactcagcggatagtagatcattggtttatcatataccgggagcaattgcttactgactgccatagttaccggatagaggcgcgttcctgagccaccagcgagaataatacctttattctttttcacaatttcacctttatgaacaggcagcttttgctacctgtttaaattatttaagagtttcaagcaacatacgttcaacacccaatttccagtcaggcagggtcaaaccaaacgtatgttgaaacttctcagtattgagccgggaatttgaaggacgtctggcaggtgtagggaatgcacttgttggcacaggattaatcacctgaacattaagctcaacaccctgcattttagcaaagtcgattacgctcttagcataagcatgccaggtcgtctcacctgctgcaatcagatggtagatgccagcaactgcattattattcaatgccactctgattgcatgtgcagtactgtctgcgattagttcagcgccagttggcgcaccaaactgatcattaatcactgacaatgaatcccgatctttagcaagcttcagcatcgtcttagcaaagttattaccctttgcagcatagacccaactggttcgaaaaataaggtacttcgtcatggtgcggacgattgcctgctccccttccagcttagtctgtccatagacattcaacggagctgttgcatcatcttcacaccaggcacgatcgcctgaaccgtcaaaaacataatcggtagagtaatggaccaaccacgcgccgatttcctcagcggcctctgccagtgacttcatcgaagtggcgttaaccaggcgagccttatcctgctctgattcagctttatcaacagcggtgtaagctgtcgcgttcacgattacagctggttttatcctgcgaaccgtctcagccagcccctttgggttttcaaaatcgccacaatagtcagtagactgacgatcgaccacaatcaaattgcccaatggcgccagcgcacgctgtaattcccagccgacctggccgtttttaccaaaaaggagaatatccattagctacgtttctcgtaattttcttcgatccagttctggtacgcaccactcttcacatgctccacccactgtgaattattaaggtaccactcaacggttttcttcaggcccgtttcaaacgtctcttccggtttccagcccaaatccttttcaatcttagcggcatcaatcgcgtagcgacgatcgtgtcccgggcggtcctgaacataggtaatttgatcactgtacggggtcgcttttggacgcagttgatccagcagtttcgcaaaccttcatcacaacatcgatatttttcttttcgttgtgtccgccaatgttataggtggtgccagtcttcgcatttttaactacggtgtatagcgcgcgcgcgtggtcttcaacatacagccagtcacgaatctgatcgcctttaccgtagataggtagtggtttgccttccagcgcattactaataatcagtgggatcagtttttccgggaaatgataaggaccatagttgttcgagcagttggtgacaatcaccggtagcttgtaagtgcggccccaggcgcgaaccagatgatcgctggcagccttggtagaagaataagggctgctgggtgcataaggcgtttcctcggtgaacagagggaggtcgccatccatttcatccggatgaggtaagtcaccataaacttcatccgttgagatatgatgaaaacggaatgccgctttacgttcttcaggtaacgcgctccagtattgacgggttgcttctaacagagcgtaagtgcctaccacgttagtctgaacaaattcagccgggccggtgattgaacggtctacgtggctttctgcagccagatgcatgatggcatccggttgaaactcatttaaagccttagtgatagcctgaccgtcgcagatatcgatctgtttaaaggtatagcgtggattgctgctcacctctttaagagactcaagattgcctgcataggttagtttatcaacgttaatgacttcatcgttcgtattgttgataacatgacgcacaaccgctgaaccgataaaacctgcaccaccagtgataagaatcttcataacgtatttattcctgacaagctatctgaggcatgggtgcccgaataaaaagcagacaatcataggcgttttaagagcacgctaccgcccctgggttacagctcccacgatgctgattatctttgaccgaatgagtatgctgacaacatgaatccgccagatgttcagcattcagttgattgatatcactttattaatgaaattgtttaagtgggtttatcattcaacaatcgtaaattctatcactcaggtatagctattacgaataaaatgcgtttatgtcgcaggtgttagttcaactaatgagcacttttgtggcgcaggagatggttgctgatgcctcagggtgatgcaatcagaattatgagaaaggtctgataagatatttcaaatcaaatataagaaaggcgaacctgagttcgccttttttcaactaccgaaacccatccgggttcttgctctgccagttccacgtatcgcgcatcatctcatcgatgccgcgcgtcacgcgccagtcgagcgtggtgtttgccagtgacgcatcggcccagaaacgcaggcaggtcgccatcgcgacgtggcttgatctcaaacgggatcgccttaccggacgccttctcaaacgctttgatcatctccagcaccgagacgcctttgccgccgcccaggttaaaggcggtgtagccctcaactttgctcagataatccagtgctttcagatgcccttccgccaggtcaacgacatggatgtagtcacgcagacaggtgccgtctggcgtatcgtaatcaccgccaaacacgcccagcttctccagacggccaatcgcaacctgtgcaatgtacggcagcaggttgtttgggatgcccgccggatcttcaccgatttcgcctgactcatgcgcgccaaccggattgaagtaacgcagcgcaatcgccttgaacttcggctccgctttggcgaagtcgcgcatcacgaattcggtcatcagcttagaggtgccgtatggactggtggtgccgccaatcggggtggtctcaacgtaaggaaccggggcatctgcgccataaacggttgctgatgagctgaagataaagttccagacgccggcatcacgcatctcttccagcagcaccacggtgcccgcgacgttgttctcgtagtactccagcggcatacgcgtagattcaccgacggctttaagcgcagcaaagtggatcacggctgaaatgctgttggatgcaaacaggtcacgcagacaggcgcgatcacggatatcgccttcaacgaaggtcgcttttttgcctgccagtttctcaacgcggttaatcgcttcgcgtgaggcattgcagaggttatccagaaccacaacatcatcaccgcgctgcaacagcgccagtaccgtatgggagccgatatatcctgctccgcccgtgactaaaattgccatgtgagctcctttcaatctgccgcgcagggcgcgacaaataaattactgttgttttgcgaggatggtctggatagcttcgcggaaatcgcgaccctgcgcgttgctgcgcaggccgtaagagacaaacgcctgcatgtaaccgagcttacgaccgcagtcaaaactgtgaccggtcagcagcgaaacatcaacggttttatgtttgctcaggctggcgatggcatcggtcagctggatacggccccacgcgcctggctcagtgcgctccagtttcggcccagatatcagcagaaaggacatagcggcctaccgcagccaggtcagagttcagtccggcggtatcttcaggcttctcaacgaaatcggtaatggtgctgatatcgccagggtgatcaatcggctctgcagtggtgattaccgagtactcagtgagattggacgctggcatatgctgcgccaggacctggctgtggccggtctcttcaaaacgggcaaccattgctgcgagattgtaacgcatgtggtcagcggtggagtcatccagcaggacgtctggcagcacgaccacaaacggattatcaccgatcatcggacgggcacagagaatcgagtggcccagacccagcggctgcgcctggcgcacgttcatgatagtcacgcctggcgggcagatagactgcacttcgctcagcagctgacgcttcacgcgcgcttcaagcagcgcttcgagctcataggtggtgtcgaaatggttttctacggcatttttcgatgcatgcgtgaccagcacaatctctttaatacccgcggcaacacactcgtcaatgatgtactggatcatcggtttgtcgacgacaggcagcatctctttcggaatggctttagtcgcagggagcatatgcataccgaggcccgcaaccgggattactgctttaagcttggtcatatttattccgtttaataaaatgaagatgtgggtcgattatgcaggatcggccggaagagcaagtataatctttatctgaaaatcggacagtaactctctgtcataacttggaaattcggcattttgcccattgccagcaacggcataaactgaataaagacaatcagtaatcgaatatcgcctctgttatttccacccctggtcgccgcgcggctgagaccagccataaatgaaaacgggcgaccctgaggccgcccgttgatataacgcaattgtgattacaaccagccttcaaaccactctggcatcacaaacagattaaagtgattgaccagcaacattatgccgacaaatactaccgacaccgccacccactgtcgggcataagggataaaccgaatgccaatcaccggcttgataaagaatggatgagccagtgccgagatcagaatctgcgagatggagagcgtcagcgccacatagagcacgttcggccagataaaggtggttgccagcaccgccagaaccacaatactcgccacgatgttccagtagaactcaacgttggtccgtccattggcctgggaaattgccccggtcagtccgcccatcggccgcagcataccaaacagcagcatcagcggaatcagatgatagacctgctcgtgggatgcgccgtagagcacacgaacgataaccggcgagaagatgccaatcaccaggtacatcgcgctgctgaacagcatgatccccagcgtgcctttgaggaacagcttcttcagctgctcggcatcgtgctgcttctctgcaaagcgcggcagtgccagtcggttaatcaccggcgtcaccagcttcagcggttgcagcaccagctctttcgccagcgagtagacgcccagcatctctgcgcccatcactttaccgaccaccagcgcatcggcctgggttcgcagctggttaatggtctgcgagccgagctgataactgccgtagcgaatcgcgccaataaaagtcgctttatcgaactcccaggtcggacgccacgacttctcacccagcgcaatcatgcagaggatgcgggtaaaggcgttgataaacagaccaagaatcgccgccgctacggtgagcgaggtgaactccagcatcgccaccacacagaggaaggcaaacagcttggtgcccatctcaatcttcgccagcgaaaccatccgcttggttttgatgtagtgcgcctgatactgcgacagatgccccagcaccaggaagttgaggctggtcagcatgatcagacccaccagctccggcaggtgatagaaccaggagaccgggaaggcgatcagcagcatgatcaggccagtacacaagctgagtgagacgttcacccagtagatagtgctctgctcacgacgggtaatgttctggcgatgcaccagataactgctcatccccatatcctgcagcacacccgccaccgccaggatggcgttgatgatggctaacagacccagctcgtgggtttccagtttgcgggcgagaaagcttagctgtgcaacctgcagcactgccgagaagcaggtgctgccgaacagccaaatcgcctgtgacttaaatccactcacaccagtcgctccagaatctgtgccagttcgccgtaggcgatatgctgattaaattcagtctcaactttgtgacgggcggccgcgaccacgggcgccacatccacttcaccctgagagagcttcagcagcgtctccgccagcgcctcaggatcgtcctcttccaccaaccagccagatacgttgttctcgatcagctccggaatgccgctgtggaaggttgagaccaccggcaggccgaccgccatcgcctccatcagtgcaaccggaataccttccatatcgccatctgcggcggttttggagggcagcaggaagatgtcagcctcactcagcgcgcgacggatctcctcctgcggtttaaagcccggcatgctgacgcaatcttccattccctcgcgggcgatgaaatcacgcatcatctcatcctgatcgccgttaccgataatggtgtactgaaactgaccgccacgctgcttcaggatggcgctggctttgaccgccacatccagccctttcttctcggtcagacgtgccaccgaaacgatacgcagcggcgtctgaaacgcctggcgcggctggaagttaaacttctccggctcaatgcccatacgcgtaacgtgaattttttccggcgggcagcccatctcaatcagcttgttcttccacagattgctgataggcagcatcagctcactctggcggaacagattcacatagtcgagtttgtgctcttccagaatgtgacgacgggaaatatcggcgccgtgaaacacggtcgcctgtttacccttgagcacgcccagctcacgcagcttgttcgccagcgcaccggcatagccgaaatgcaccaggaaaacatctgcggtgaaggtctgtttagcattcgccacaatcgacggcagcagcagtttgctggactgtgcgccataacggcgcacattcagcgaacgcagcagcgacggcttcgtcacttttggcagcaccagcttgatgcgctggttcagcttatcgacaatcgagatcttctcttccggcagcagataatgcgtcttcgccgccagaccatactcatcaaaagcggcatgccggttcactaaatcgccgggaaagactgaaataatctccacctcgtaaccggcatcaataaagtgggttacctgatttaatacgaatgtctcagaggcaaccgggaaacgcatggtgaaaaaagtcagtttcatcacattaccctaatactttgagaatctcttcagtgatccggttgccaatttccctttcattcgcaacggccgtgtcgaccttgagcttgatgttgtcgtaatcggcaagcacagttttcaccttgtcgattagcgagccatccatcaggcttttcacatcggttgccatctgcggcagaccaagctggttcatcacacccatcgacttgtgctcgtagttgatcgccacagccggggtgccaaagttcatggagataatcgccgagtgcaggcgggtaccaatggtcagatgacaatgattcagcaggatgcccagttccaggtcattaaactcatccataatgacatggtaatgttcaggctgcgtcacgtggtcacgcagggtcagtgcaaccatgcggtcatctttggcatagctgtcgatgccggtacaggttgagaaacgccacaacctgatagccttcagcaatcatggcattgatcacccggccaaatgccgcttcatactctttctgcgtcacacccagacgtttatcaaaaggtgccagttcacgcacggtgatcgcgatggttttacggccatcgataatgccctgccagtagagcaggttatggctcggattttcgacttcgcgtgcccgcaccaggaaagcggtatcaacgccagacgcgactttagaactggtcacgccatcgcgcttcatcaggtcaagactgaccgattcacgcagcaccaggctgtcgacccgatcaaagacaaagtttgccagcgcattgacgcgcgggttctggaacggccccaccgagtgaccgatcaggtagatcggctttttcgccatcagtgcacagagggcatggtcaaactgggtcacaccatagaggtcaacgaagaacgatccgccaacctgaataatcgcatcatattttgccaggctgtcagtaaacgccttcaggtgcgggggtacagcgaacgacttaaagatcccgcccttgcccagatgcgccatcatgatatcaggcatcaggcggttcgcgactttacgcttgaacgaaccgaccagacctttgcctgatttgctgttgtgcagatacagcgcatcctgcttaatatcctgctgaagcagataaccggagctggttggataacggcttataacatcaatttctaaatcactgcgtgcagacttcattgaatcaatcagtccacgaagaatcgcgccatccccgcgatttccacacgtatggttacccaccaataaaattttcataacaactccgaatgaatttttttaattctgtaagccgcccagatccgcaatgggcaaaatgaactctgtttaaagtaatgctttacgggataacgcacccaaaggtagtgctcctgttaaaaccggccgcctccattgtggcggccgtgatgcaaggtgttacgacttgattgcgaagtaaggcagtgcgacctgtttgccgttgatcacgacggaaacaaaaccttctggcttgctggtatcgacctgatcggcggagagcggacgcgaagccatcagcaggtcgccctgctcattagcgcccacgcccgctttgccgttgtgcaggctgaagcgctgcggcgcgcgtttagtcgcgtcgcccgccggaggattgcccttctccatcttcgcgttaacgcgcgcacagcgaccggtgacaaagcgatctttaccggtggttttcaccagcacggccaccgacggcgtccagcccgccagtttgacgaagatgcggacatcggtgtcatgctcagccacatagcgcacatcgacaatcgggctgctgccttcggccgaccagctcgcttcagagcgatcttttttgcgctgtacgtggatcatcgcgcggccaccggtggtcttgtcaccgatcaggtccatcagcggcttatcgccactgccgttactgaactgcgactgaccaaaaatttcgatctcccacgaatcacccacggtcggggagtagaggctgccgagatcaaaccaggtttcctgattcgtgttgttctctaaacgccagcgcgaggtgatgtagttgtacttcaggctgccatcgagcgcgacgccataggactccacgcgggtcgatcccatctcccagatgctgagcagacggtcgccctgcatggagttgtcgatccaactgcccgactgcaggctggtctgccgcatattcaggcgcgtgttatgcgcgatcagcggattcttacaatcttccaggctcagcgcatcgacaatccactggccgttggagagatcgcctggattatcacagtgctcaatccagccgttatggataatcgactggccgcagcgcggcagattgaggactttgccaccacgacagtactgcgcattgaagttcgacagctcaatcgcggtgctgtggtcccatttgccctgcttctgacctgaccagcccgatttgatcacatcgccgctgcagcgtgaggcgtaccactggtcgattttacaatccagagtatcctgcaggctgatggcggtgccgccaactgcgttaaagcgcaggcaggcaccacggaaatattgtccgccagggcagttgttatggaaaaagccctgcttgttggggcttttatcgctgttgccgttaaaattcaggttggaaagctcaacccgacgggcattcatctcaaagacgaactctgacttaccatcggagacaatcgtggtcgccgggaagtagccgaagtttaccatcgcaccggacatgcggaagaagttgagatacttatcgccaaggttacaggctgagaccatgaaggtaccggccgggaaactggacacagatctgctggtttgcctgctgtgaccactggaacatcgccataatggcaggtgccgtatcggttttgccatcggcaatcgcaccgaaatcaaacagggtcaggcggttaaaatcgtctaccacgcgacgccaggaaaagccctcaccggcaaagttcacgccgccatcattctgcgcaggctggaagctgccaacaaactcgccgccgccgacttcccgtccttcatgccagcttttcagcttaaccttggccccttcaaacagcggacgggttttgcgtaactccgctacggacgggatctcaccaatcagctgataacccgctggctgcgccagacgctggctgaaatctgcagcgcccggacggctgacatccgcgatgttaaacagcgtctgaccattgctgtcttcaactgccatcgaatgcgacggattggcaatcagcgcagcattgtcctgaataaactgggcaaagttacctttgttcagcgcgataggctgagcaatctccgacactttgccgctggcatcacgcaggaagaccgggatctggttgcccggtttgctggcatctgcacctgctttaccaatccagagtttgccttcaaaaccctgccagaactgcggtggcatggcgtagacattttccggggtcagaattggcacgtcgcctttaggcacgtcagtggcatcaaccggcttcagggcgataccgttactttttgcagcgtagctggaaaaggtgctcacggagagagcccccaccagagcggaggcggcggtctgtaaaacttctcttcttttcatgcatcaattcccgtagtcaataaggccattggccatggcggtgtccctgaggcacgtcgcaagtgagcttttccagctccggttaaaccagtgacagccagctttgcttaatctgattaccgtcgaatttcagcgcggtctgtttcgttttttcgctcatggcatagaacagcgcgtcatcgctggcgagctgctccattcgggccagaaacgtggctttgtcgttcatcggaaccaggaaaccatcttcaccgtgattgatgatctcctgtggaccggtcgggcagtcatatgccactaccggcagtgaccaggattttgcttccagcagcaccagtggcaatccttcgtagcgcgaggtcatcagcgccatatcgctgtcgcgatagtagtcgttgatattgctgaccttaccgacaaacttcacgctgtcggtgatgcccagcaccgccgcctggtcatgcaactgttgacgcagttcaccgtcaccggcaatcaccagcgtccagtcaggatggctgcgggcgaagtcgcgccagatatccagcatcaggtcaaagcccttctggttatccagtcggccaactgccagcgcctggcgatgacgtgtctggcgctgatagtctttgtaaaccaccgggttggggatttgcttgctgggaatgcgccagcggctgaacacctgatgatctttgtcggtcagaacaatcacgcggtcgtagtagcgcagcagcagaaacttgaggaacttaatcggtttgctgaaggagttaatggcgatgtgttcgcaggcgtaggctttgccccgcttcttcttcatcgccagcagattccagaaagcgaacatcacgctcaggcgacccatgctgatcaggaagacggtatcgaaaccctcttcgtgaatccgggcaaccgcgcttttgatcggattgctctgcccttcaaagctgacgatctgtttgacgtgctcaaacgggtaaaaggtttttccactgccttccagcgagtagatggtgacttcatgggtctcgccaagacactctgacatgaagttacagatgttctcggtgcccgcatacgaataagcatctttgatcaccaggacaatttttttcatgaaacgctatccacctcaaattttaaagacaatcctgccgacaggcttaacgatgcttaagggtaaacagcacaccattcaccatataccaggcgtaatagtaatagatttttaaaggattgtttttatagataattcttaataattcaaggtgccactgggccgctttgttcttattacgggaaagggaatcgcctaattcgtaatagttgaccagaatcgtctgaattacgcgtgcctgcttatagcgggtgaataattcatacaaaaacaggaaatcttcgtggcctttgcgctggaagaaaagcccctgcggcgggcggcggaaacagacggaggagaagcagacgcgatactgcttcttcacaaagttttcctgctgcaggtaaggtttgccgtaggtaatgtcgtgctcagccttgcgggttttatagtgatattcggtaatcacaaaatcatcaccggccgcgatggcagcgacctgctgggtcagcttatccgcatgccactcatcgtcgctgtcgagaaaggcgataatctcttcagtggccgcgcgcagcccgacgttacgggtttctgctgcgcccatgttgaccgcgttatccagaatggtaatgcgcggatcctgacaatgctcacgcacaaattccagcgagtcatcggtcgatttatcgttgaccagatagagatgccagtcggtatagtgctgattgataaccgattgcaccgcgcgtaacaccgtctgacgtgcattatacataggcatgacaatgccaacggttccaacagaagtattcatcttcaaccctgaattaatcgtaaaaagagtcgctcctggcatcaggagcagagcgaggcgcggcgcgcgtcaggagatcgctttctcaccgccgaaacgtgctctgaccttgtctttaacccggttcatgaaataagcacggttgtctttgttggtgaggaagaagtagcgcgcgaagctcaggctcgccatcagcgacttaccatccatcttgtagcgcagcggcagcttaaaagctttgtaggtgtggatatcacgcggggtaagatgcggcttcatgctatcgagccagaacatcgagtagttcaccgattcgcctttgtgtttcgagccaaacttagtgaccaggtggtagtttcgccagcggtgcagcgatcatcacaaagtcatagcccatgcggtcggcacgtatgcagaaatcatagtcctgatgacggatgtagcgggtatcgaactgaattttcgccgcgtcttcccgcttaagcacaatggtgctggtctggataaagccgtagcagccgaacagatactccgcgaccgtttcatttttgcctggcggctgcatcggcatcactttcaggaacgtgccatcctgatagatattcacctggctgaaaatgacgaaattctttttgccctgcgcgtccagctgagcaattttttcgctcacctgctgcagtttgtccgccgcccactcatcatcggcgtcaaggaagctgacgtagtcaccggtcgccagctcaatgcctttgttacgtgcaccggctccgttgagtttgacctcggagagcaccagattgatatcgagatcccggtagcgttcgctgcgcaccacatccgccagcgcggcggcatccgcagatttatcatcaacgatgatgacttcgaaattgcgatacgtttgtgctttaacgcaatccagcgtcgtgacaatcgattctgacgcgttataagccggaattacgatggagaaacgaatgtccttcattgccagcacctcattaaagtagttcaaaaataaacagttcattcgacaacggtcgatgaaaaacctgtgttctgaccggcgaccgcccctgggtgaaactcgtcatccagaggcggtcgtcagattgattagtggatcagccaaaactcccgcgccacttcataaccggtaacggcctgtttggttgaaatggtgttgtagtagaggtaatagagcaggaagaacaccagcatggcatacagcgctggcttccaggatcgccttgcctgataaatcagcgaggtcaggatgatcggctcaacctgctgcagatagttggacaggcgcgaacctgacgggaagttgtacaggaagatcctgatcgccccgccgatggcaaaacttaaaatcagcagatagttaaggcgatactgggcgtaattctcgcgcttcagcttatcggtcagcatgaaatagaagaagacgaacaccagcatgatgtttttcaggttcgatacggccaggatgctgccacccattgcataggaggggtcattgttatagcccgatgccctctctcccagcgatcccagatgaccggcaatcagggcaataaagcccgagccacccacaaccgatagcggcagactggcaacgatgataatgaccggccaccagcgccagtcccggataaacaggaacggcacaagcgtcaccaccatgacaccggtgttatggctcgtgaacgacagaataaagaaggcaaatgcccaccagtagcgcttgagatagatcgaccagagaacgccaaggaacagcgcagaactcaggccaaagcgaatctggttaatgtctttgttaataaagatgtgcgccgaatagagcaccagcgccagcaccggatacggagacatcttcctgaaaaaccaggtattgatggaaacggcaatggcgcagaagacaaacaggaagatgctggcattgtgcgaaaagaggctggtgagccaggccatcgcaaaaatcagcggttcgtaacggaaaaacgcaacggtattaaagaagccattaatctcaatacgtcttacaaagtcttcgaagaagctccggtactgaaagtcatccatgccggtaccaagaccgcgtattcccccgaaaataatcaaagtcacggcggcaaaacagagtagccaggtcagaatataatttgtgcgttcgtctttttttagcgctatttcaaacagcgaaagcagcagtaaaaagcctgatacataccaatatggagccatggtgtgattccttaattccacaagttctcatgccagcaataatcacgcttcgccttcccgactggctttacagcgagtctgattgcacggtcacaaattgcgtgcgggcgatgcctgctggtgatgaattctgttgagtgacgctcgccatgcgatttatagatgtatcgcttttgtgggtttggacagaataacctgtgtaaattgatgcgtgtcgtcattcaaagggacgataaaaaggggcggtcagaccgccccctgttttattgctcaatgatcagcttttgttcgtcttgccgtagtcataggcgtagtagtcatacccatagccatacgcattagcggctttacgcaccacggcgttgaggatcacacctttaatctcaataccgttctgggcaaagcgtttgaagctgacgtccacttctttggtggtgttggcttcgaaacgcgccaccatcagtgaggtgccggccagcttaccgatgatggaggcatcggtgacggccaggattggcggcgtatcgattaacaccaggtcgtagttcttgctcgcccactccagcagctcacccatgcgacgatgcatcagcagctcagacgggttcggcggaacctgaccacgtggcaggaaatcgaaaccgtacacgccctgctgaatcagcgccgggctgaactcagttttaccggacaagacgttggacagacctgatttgttatctgcgcccagcagtttcgtgggtataaccacgacgcatgtcgccatcgataaacagaacacgctgacccgctttcgcgaccagggtcgccaggttggcacagataaaggttttaccaatacccgggctggcaccggtgatcatcaggatgttgtttttcgcttccatcatcgcgaagtgcaggctggtacgcaggctacgaatcgcttcaatggagaggtcagtcggattacccagcgccagcagcgtttcgtgcggatcggttttcaccttgctgccacgacgcgccagggcttcggtatctttcttacgctgccagtctgacagtggaacgctggcatagacattcatgcccagctcttccagctgatccgggttctcgatgccgtgatgcagcagcgctttcagcagaaccagacccactgacacaaacagaccgaaaatcaggctcgcagcgatgatcagcagcttcttcggtgcaacaggcgagttagcggtctgcgcgccatcgatgatgcggacatcacccacggtgctcgctttactgatacccagctcctgctgacggttcagcagctgcatgtagatctcctgaccagactgaacgtcacgggtcagacgcaggatttcctgctgagtctgcggcatgccagcaattttcttgttcagctgagcctgctcaccttccagcgttttgcgtttttcaagcagcgcgcgataagtcgggtgatctttggtaaacagctgagagacttcggcttcacggaaggtcagttcgttcagctgactctgcacgctgacagaggagtccagagcggatttcgcttcaagcgacaggtctacagattcgttctgacgacggaaggtgttcagcttgtcttccgcttcatccagcttgctgcgcacggcaggcagctgagtgcgtaagaactccaggcttttctctgcctgcgctgacttgcgctcaacgttctgtaacagatagttattcacaatctggttcagcactttgctgatctgctctggatcttcacccagatactccagacccagcacgccggtatctttacctttgtctgccacggtcaggttagagagcactgaacggatcgcctgcaggttattcagcttggtcacggtgaagctggtgccttcatcagcgtgaatctcgctgaccagcatgctgatgtcgccatgcgactccagctggccgactttacctttgaacagttcatcgccatcttttgagacggtgtagctatccggaccggtcacttccagttcaacgttacgtttgtcgatagtgcgtgggatttccaggcgcgaaatcgcgatactggcgggtttgttgcccatcaggcgcgacagacctttaccgataaccgggaaatagttctgctcaacgacggtatccagacccagatcgtcaacggttttgccgatgaccatacgggattccagaatctcgatttccgtatcagaggctggtgtcggtggcagaatgctgtcaatttcgttcagaacggtgctggcattcttctgctcaacctgaactaacgcatctgcgctataaatgggtgttgcaaacagtgtgtagagtgttcccgccagcatgaaaaaagcggtaacggcaacaatgatccagcgatgatcaattagctgtcccacaagatgcgccagatcccatccattcgaatcctctcccggcgcggttctgaccttattttttatattcatggataatcccaactatcggcttaatacgttcacccacttctgggtagcgttttccagtaatccgtaaatctcttcaaaggcctcacggctttttctgtacggatccgcaatttctttctgattgagccagtgcccaagcagcatggttttgccacgcgcggccgggtcgatgcgattcacctgttcaatatgtcgcttttccatcaccagaatcaggtcaacgttgcggcacatctctgccgtcaactgttgcgcctcatgtccttccagcgacagaccctgcgcagcagcgacttcagacgccgtcttgtcggccgggtggccgacaagcgcccccaggccggcagagcgaacgtctaaatcaggcagcgcacgtttaaacaggcgctctccggtaggagagcggcagatgttgccaacgcaaacgactaacacggacttaatcatgacgggaccttaattaccccaggtacggattcgcgatgcggcctgtgttgcatcgttgatacctgcgatggtcggtatcaactgcccaatcacacggtttccagcgcgtcagcggcgtagaggtgacataaacgatgtcgtaaggctggagctggaaatcggttcccatcaccatggatgccgcatctttggtgttcaactgatagatgttggcaatcttgttgcgatcggtgccgtgcagtggacggataacgaatacaccggtggcgtcagaggtggtttgatccatcccggccgcattgcccagtgcttccgccagcgtcatgccgctacggtccattttcagggtggtctgctgcttcacttcacccatcacgaagattttcagatcatcgttacgcggaacgtaaagaatatcgcctggatagaggaggtggttctggctcaggtcaccattctgcatcagtgcctgcagagagatacgctgttcacgaccgttgtgcgtcagcaccacgttgcgccagtcagcatcagcggccaggccgccagcggcgttgatcgcatccagcaccgtcaacggaacgttggtgatgggctgctgaccagaagtggtcactgaacccgtcacataggttttctgtgatttgaacgaggcgatgctgacatcaacctgtgggctttcaatgtactgagccagacgacgtgacacttcgtcacgtacttcgccgacggtacggcccgctacacgcacacgaccgatgtagggatagaaaatggtgccgtcagaatgcacccagttaccggtgtcgctggcgctacggtactgacccgctggggtggtcagttccgggtgatcccagaccgttacggtcaggacatcgcccacaccgatacggtattcgtagttctgaatttcgttctgcagggcaggattcgtctgagccaccagtggcttcggacgcatcctttcaaccagtgaaggcgttaacgggaagacgttgacatatttatcgatgtcaaagttgctatcctgctgttcaacaacatcttttcctgatgtagaaaggtgagaacctggttcgatcgtacacccgctaaggaatgtggcggataccagcaagggtatcaatttcattttgattgtaatcatttagatcttcgctatcagttatttattgatagaggcgaaaccgccgctgtgtaagcgtccaacaaaaagtaaatcctacctgacttaagcactgaacctgtcgttcattatccttgctccacttgttataagtagcggccatctaccagggtgtaccctgaacgccacgcatcatagcggactatggatgcacagcgatatccctgatgatggccactatcaacgacacgcctgacaacggcaaaacacctctgagcgcgcattaacgcgctcattccgactcacgattaataggcaccatcgcgtttcaacaccacgcccactgttttaaacagaatcgcgatgtcgttccacagtgaccagtttttcacgtaccacgagtcgaaatagacgcgggtttcatagtcaacatcattacgaccgctgacctgccacaatcccgtcatgcctggctttgccatcaggtaataatcaacatcaccggcataacgacagagttcatcttcaatgaccggacgcggtccgaccagactcatatcaccgcgcaccacgtttccagagctgagggagctcatcgaggcttgttttacggatgaagtggcccactttagtaatacgtggatcatttttgagtttgaaatctttatcccattccgcacgggcaatcggatcagtgcgcagcacctcttccagcacttcttttgaattaatgaccatcgagcggaatttcagacatttgaatttacggccattcattcccacacgctcgtgaccataaatcgggggtccaccgtcacggcctaccaggaagcccagtaccagcagcgctggcatcagcatcaggataatcgagagcgcacccacgatatcgaatgcccgcttcaggaagcgcgacgtgcgtttagccaggttgttctgaacccgcaggatcatcacttcatggctgaagatataggccatgtcagtaccgtagagcggtacaccacgcagggttgggatcactgacactgaacggcagttgtgcatcgccagcgatttaagccagacatcacggtactgactctgctcatactcaaccgcaacgataaactgcgtttcgctgttggtgaggctccagagctcctgctcgtcgcgcagcaccggcacgccgttcatgatctcctgcggacaggttccatcaacgtcatagaaggcgataacgtcaaaacccatgacctcttcgctttgcagtgcctgccaggcttcatgcgcatttttgctgctgccgataataatggtctgttttttccacaagccatttttattcagcagacgtttagaaagcgcgcggcaggtcggaattaaaatcagcgccaggatccaggtcagtaaccagacgaaacgcgacatctgccactgcgacagggcggtaatcgacaggtcgataacagaaaatataagaatggtacgaaaaacttcttttaattcgaaccagaaaggtttgcggtaagtgtagtgacgcagccttacccagaaccagccaatacaaattaccgatagacaaatgtgtgtggcaatttttaaattcatttctttttcagaaatatctgccagcggcgaatctgactgcaaattaattagcatcatcgccaaaaagaacgctgcgttgaaacaaattaagtctgaacatgccagcattaatttggtaataagacttttaaacgtaaattctgtatcgcgcatatttaactctttattttatttccttaaacccgcaacggctatcgcctgtttaatcattaagcgacgaaacctctccagagtgagccgtttctaaggggagctcctgcggcgtttacgccaatgatcttaaccatgaaaccaataatatcgtgatgaataccaacagattactctgacttaaccaccgccagcgctgctcactttatcaacaaaaacgcgattcgggcacgctaccgcccttggctgtcgctgccaatatcgctgtcatcattcataatgctccccgtaatgtgttagcgttaccgcaacgcatcatacagacgttcacaggcgaattactcattcgtgacattgcgattaatgtcgaataggtacgcagattacgactctggggcagagtttgctaacttgttgctatactagttattactggcttgtttacaagcaggtcccgccatccctggactattttaggaaaaagactaccagcaattagtattgaggtctgacgggcagtgcaatcctttcttcacaattcggattaatgccatactcccgatgagataaatcgcataagcccgacaggtgaatatctctttcctgtcagccaatgactaagaattatctctaccgcgccctgtgaagttaatcaaagcgtcacactattatgttcatattttgcacgatatagcgcggttatctgagaacatgccccctgccctgccatttgtacgtggcttcgcactccactatcatcagagaaaactcaatttaagacattcaggtgaacaacgcatgctggaggtaattgcagatccctcgctatgggcgggattagtaacgctaatcgttctggaactggttttaggcatcgacaatctgatcttcatcgccatcctggtggagaagcttccagggccgcttcgcgaccgcgcgcgcgtgattggactgctgctggcgttattgtgccgattattgctgctggcatcgctttcgtggctggttacgctgaaagaaccctggattacgcttatgggccaccccttcagtgcgcgcgatttactgctgctgacaggggggattttcctgctatttaaagccaccacagagttgaatgagcgtcttgaaggggatgatgaggcgtccggtcaacaaaaaggcggcgctaaattctggccggtggtggcgcaaatcgtggtgctggatgccatcttctcgctggatgcggtgattactgccgtcggcatggttaatgacttaccggtcatgatgattgcggtcaccatcgccattctgctgatgctgctcgccagcaagccgttaacccgcttcgtgaacaaccatcctacgattgtgatcctctgcttaagctttctgctgatgatcggcttcagcctggtggcggaaggctttggctttgtgatccccaaaggctacctctatgcggcaatcggcttctcggtggtcattgaggcactgaaccagctggcgcactttaatcgtcgtcgggtgctgtcggccggtcgtccgctacgccagcgcacggcggaagcggtgttacggctgctgcgcggcgccgcagaaccggcggagctggatgcgaaaacttcgtcactgattgctgacagcgatgacagcatgctgtttaaccggcaggaaacgggtgatgattgcccgcgtactgggcatgggtcagcgccacattaacagcatcatgacctcgcgccacgacgtcgaacatatcgatctcagtgatgatccggcagagattatgtcgcgcctcgaccgcaatcagcacacgcgaatactgataacggatcactccagcgaaccgctgggcgtggttcacgttatcgatctgctgcaccagtcactgcaccacaattccctggatttacgcgccctgattcgacagccgctggtctttcctgagcggctgacggtgctgcaggcgctggaacagtttcgtcaggcccatactcactttgcctttgtggttgatgagtttggttcggtggaaggcgtggtgacgctgagcgatgtaatggagaccatcgccggcaatctgccgaatgaggcgggtgaaatcgatgctcgctacgatattcagattcaggatgaaggtcactggattgctaacggtcatatgccgctggaagatctggcgctctatgtgaaattgccgctcgatgagcagggtgactatcatacgctggcgggattactgatggataagctgcaacacatccctcaggaaggcgaagtgttgcaactgggtgactatctgctgcgaacgctgcaggtcgaaaatcatcgggtgcagaaagtcgagatcctgctgcagcccgatatcagttacgaggtctgagcgattagcaggcagaaggaaatgcgcccgctacgggcgcatgattttcttcaggttctctttgttctcgccctctttctggcgatcgatccactgattcagccgtgatttcgcctcactctgcagccggttacgcagaacgtcatccaccggcagagagtattgcaggctgtcccagcgaccatacatgcgcagcggaaccggctgactggagagcgctttcaccagcgcatcatcgccacgccagccgctgattttcagccccagggtcatatccagctgttgctgcaccatgtcaactttgcccgcgccctgcaggcccagattctggccgttgccattgatatcgctgaagctgagtacgcccttattcagcgccacctgtgcgctaatcgactcaatcccctcatccaccgcctgatcgctgctgaccttatcgctgacccgcgccacggcacgctgcaccatctgctgcagattcagctctgccagcttcaggttgctggcgctgatggtcgccctgccctgccagcgatgtttggctgcttcgaccgtcagcgtatcacccgacaggtcgccatccagactcaggttcccctgcacactttccggcagttcaaacgctttaagcagcggctgaatcgcaattaaacggagttggggtttaaggctgacccgcgtctctggctgacggatatcgatactgccaggaatggagaaactgccattgcccagcttgccgctgagcgtcttcagcgtcatcactccctgctgattgctggcgttcaccgaaagactggtcagagagagtccgcgccataccgcattgtcagcctgtaacttcagcgccagatccaggtcattcagcggagagtcggcgttgctgcgtttcccgcggcgcagctattaccggcgaacgggccacggtggcgtgctgcacgccaggtgcgtcagagacgggcgcactggtgagtaaattatcgacgttaaggttgctggctttcagatccagcgccagctgctgcggtggcgcaatatggccactgccctgcccggtcagggtgctgtcattggcggtgagctgcagattactgaaggagagctgctggcggtcaccatcccactcgccctgcaggctcagcgagcctttgatcccctgtgccggaatgtcggcgccggacaaggtgtaatcaagctgctgcaactggccgctgaggcgatggggatattgcgcggcatccagctggcctttgagattcagtgtggcgttgcgctggttgcgcatcagcgtggtgctcagcgacagggtcgccagcttgttcgcgtcctgttccatattaatgttgaggtcgcggaaattatactcgtcgccgcctggctgctgccagatcaacagactgtctgctacccgcagtttagcgatatcgaatgaccagccgctggaaggcgaagccggctccgcatcacgcggaccctggggcgcatttctggcacgctgcgcgcggctatctggcgtcacccgcactatcgcatttttcagcatcacctggctgacgctgagctgatgggataacagtggccagagatcaacatccagccgcatgttttccgccgagaccatcggctggctggcgcccggcgcggtcaggctcatccggccggccagaatgctgagctgaggccagacgtgccagcgcagatcgctgctgacctcaaggcgataaccactgcgttgttcgacctgctgcaccatataggcacgaaagtcgttgggattgaccagcagcaccagcgcgctcattcccgttacgaccaccactaacaggatggccagcgtggttatcactcttttcattacatcctcagatcagtctttgtcgatacggctggcatcagcgccctgctgaccgcgatatttcgcatcttcacgccggttgtagggacgcgcagccgggcctgaaagcggttcaaaactcagcgcgccgatcaacatgccgggacgcagagccagcggcagtttacctgaattgtagaactccagcacgatacggccctgccagccaggatcgatgcggtgagccgtaacgtgtaccatcaacccaagtcgcgccagcgatgaacggccatccagccagccgaccagatcgtcaggcagcgtcacggactccagcgtcaccgccagcgccagctctcccggatggaggaaaaaggcttcgccatcaggcaacacgatctcatcgctcatgacccgatccagtgccgcgctcacttcctgtttcgggccgctcagatcgataaaggccgcggtatgaccgctgaaggtgcggaaactgattacccagacgcacatcgacggtggctccgttaatgcgctcgaccggcgggcgtggctcaatggccagtttgccattgtccagccaggcttcaatatcgcgatcgcataatctcattgcggtaactccatggcataagtgtagcaaaccggcatgcgtgcctgccgccggtctgcaccacgtccggacggacgtgtgttattcaaaaaactggttgattttcgccttgaggatatcgatggcgatacggttttttccgccgcgcggcacaatgatatcggcgtactgttttgatggctcgataaactgcaggaacatcggacgcacggtcttctgatactgactcattaccgaatccattgagcggccacgctcattgacgtcacgtttcatacgacgcatcagacagatgtcgagcggcgtgtccacgaagatagagaagttgagttcctggcgcagacgggcatcggttaacagcagaatgccttcaaggatgatgaccttttttgcgctcagatgatgcgtttgctgggtgcgggtgtgctcaacgtagctgtagaccggcagctcaatatcctgaccagctttaaccgcctgcagatgctgcaacagcaaatcatgatccatcgcgctcggatggtcataattggttttaaccctctcttccatggtgaggtgactttgatctttgtaataagcatcttccgggatgaccccgatgtgctcgccacctacctgatcacggatttcacgatagagcgtgctggcaattaaacttttaccggatgcggaagcgccggcaatgcctacaatcacgcactgatgagacttgtcagtcatacttttttaagacctgataactggagcctgccactggtcacacattacgcgggcagcggacgggccgaaatggagagggtgtgttcgcgctaagtatagggatttcggccttttgatgccagagaaatggcgtcggcgacttttcagactttctcctttggacgccactcatttcaccgataaactagcggcacaccatactataaaaaaatggcctgcgcggcgcgctgttcagacaacgcgtgtcgctaacgtgacgaccgaagatgcatcaggagtggtatgcactggaagactttgacctattttggcgacagcatgctgttgattccaacagcggtgattattgcgctgattttgccgtggaagagtgataatcgtcatacggtcttttactggattgtggcatttggcctggctggcctgaccgtcagcatctctaaaattctgtttctggggtttggcatcggcagcgcccgctttaattttaccggtttcagcggtcatagtgccatgtccgccacgctgtggccggtcatgctatggctgatttccgggcgctggtccgcgatgtggcgcattgcggcgattggggttggctatctgattcccctgatggtcggtttctcccgcctggtcatccacgcacactcaaaaagtgaggtggtcaccgggctgctgctgggcttcacgctgagcacggcgtttctgatctcccagcgtcgcacctcgctcaaaggcttcagctggccgcaggtcggtgctgcgctgttagtgccgtttgtattgatgagtcacggtcgtgtcgccaccacgcagcagtttcctggagcgtttcgccgccagccttgcgggcatggagaaaccctatacccgcgccgatcttttccgccagtaatcaacgtgctggcaatcaatcttaccgtgcccgtcaattcgccgaataacgggcaatattgatttcaccccttttttctttgccggatgtgctagcatgcagtgagagaatgactggtgcctgattcgccattgtggagcgttgcaccctgccggaagtccgcatgacgatagagatcctgtccccgcaaaatagcacgccaaaccgctggctctcggcgctgctccttggctgcgtggtgtttgtcctgacactcttctgtctggaactgatcgtcgtcagcggcaaaatctccccgctctggtttccgactacgttaatgaccgtcgtggttttccgctgcccgtcacgccagctcccgttgctgctgacagcctgcgtgcttggcaccgccggggctaatgccatcatcatcgggcctgccctctcgaacattaaattcgccctgctcaatcttatccaggccggtgtgggtggcatgctgctgcgcgccctgctggatcggcgcgcgccgctggattcgctgcatgactgggctcggatggtactgtcggtgggcatcgtgacgccggtgctcggcggcctgctggcactctggacgcttcaggtcagcggccacgcctcatttcccttcttttatacctgggtgatctccgaaatcatcggcatgctggtgttaggcccgatgctgttactgctgccgtggccgctgcgtcgcacggggttcagcaatctgcgcctggccgaagctctgctgacgcttcttctcaccctcggggccagttatctggcgctgcgctttttgccgtggccctttacctttatcgtggtgatcctcttctggtgcgcggtccgcctgcccaagctgcaggcgttcgtgctgttcttcctgaacgccagttttatctcgatactgctcgcctttgatctggtcagcgtggtgaacaacaacagcgcgctgggcccggtctccagctggctgccgtttcctgctggtgctaatccccagtcacattatgtcgctggtgatggatgcgttccggcgcgaaaagctccatatcactgacagtgaaacccgcttccgtcacgccatggagtactccgccatcgggatggcgctggtggcgccccacggcagctggttgcaggtcaaccgctcgctgtgccagatcctgggctacccggctgaggagctgaagcggctgacttttcagcagatcacccatcccgacgatctcagcctcgatttgcaacatgcgaaccgactgctggcgggtgagattgatacctacacctttgagaagcgctatttccgcaaagatggcgagattgtctgggcgcggctgacggtatcgctggtgcgcgatggtaaccaggaaccgctctactttattgcgcagattatcgatatctctgagctgaagcagagcgagcaggtgaatcgcaggctgatggagcgtattacgctggccaacgaagcgggtggcattggcgtatgggagtggaacctgctgaccggcgagatgttatgggacaagcgcatgtacgcgctgtttggtcttgccccgcatgagtcacccagctatgacctctggatccatctgctgcatcccgccgatcgcgagtatgccgcactgacggtgcaacaggcgattgagcttcgcagcgcgtttcacatggagtaccgcgtggtcgatgaccagggacatcgctgggtgcgcactcaggccaaccggctgctgagtaaagaaggccgcattgagcgtatgctgggcatctgtcaggacatcacgccgctacgcaatcttaacgaggcgctgtttcaggagaaagagcgcatggcgatcaccctggattcgatcggcgaagcggtcatcagcaccgataaagagatgcgcgttgcctttatgaacccggtggcggagaaaatgagtggctggtcgcaggagcaggccgccggtcagccgctgagcgagttgctgcatatcacgcagggacgtaacggccctgaggtagagaatttgctgttatgccagctgccgccggaaaaaatcacccccggtctcgctgaagatctggtgctgcataccccggacggcggccatatcgatattcactacagcatcacgccgctgcgttcggaagcgggtctggaacagggggcggtgatggtcattcaggatgtgagtgagtcacgcaaactgatgaagcgcctgagctacagcgcgctgcatgacaccctgacccgtctgcctaaccgcgccagcttcgaacttcagcttaagcgtctgctgtttgatgccgctgaacatcagcatcagcatgtgctggtgtttatcgaccttgataagtttaaagcggtcaatgacagcgccgggcatgctgcaggcgatgcgttactgcgcgaactctccgatctgatgcagcaccctctgcgcagcagcgatttccttgcgcgactgggcggtgatgagtttgcactactgatgcccgattgcgatatcggacaggctcatgatgtggtgcagcgcattgtcgccgcggtaaatgattaccggttccagtggctgggacgactctatcaggtcggcgccagcgcgggcgtgacgcagatttcagcagaaaactgtcagagcagcgacgtgctttcgcaggcggacatcgcctgttacaacgccaaacgcagcgggcgcggacggctggtggtctacgaaacagcatcgcttaccgctgtcgggcaaccatcagggcatggatgcggcgatgattgatgcgctgcagatcgaactgcccgcctgggccgttgcgccgccaaaaacgccgcaggccgcctttatctggctgcttgaggtgcagctgttaaccgctgacggaatgctgctggatgagacactgctgcgcaataacctgcctgatgaaacgctgcgtcgccggctagataataatattcttgaggcttttttccgccacgacgtgcagcggctcaataacaaaggcattccggtgattctgccgcttaatgcccaggtgctgagtgatgccgcctttgtgcagcaactctgtcagcgctttgtcgccgccggtctctccagcagcggctgtggttttgctttccctgccgccagcgtgctgagccagggcgatcagctctatgccgcgctgctgcaactgcggcagtgcggctgccgcatcgtattgcagcattttggccgtaatctggatgcttttaatctgctgagtgacgaggtggtcgattatctggtgctggcacctgaactggttgccaacgttcacaataatctgatggatgagatgctgctgaccatcattcagggccaggccacacagcgcaatatctcggtgctggccggtccggtttcggtaccggccctgctcagcaccctggctaaccttgatgttaacggcgtctggggcagtgccgtggctgagcgccagccgttgcgttcactggctgaagatcacatcttcgctattcgttaattccggcgctgcccgcttgccaccctgctgaagctgcgctaaagtcgcccccttttttccggcatgggggcgaaaatgttcataggattcgattacggcacggctaactgctctattgcagtcagcgaaaatggcacgccacgtctgttaacgctggaaaatgatcagcgcctgctgccgtcgatgatctgtgcgccgacccgcgagtcgatcagcgaatggctctatcgtcatcatcaggtcgcgacacctgacagcgaaaccacggcgctgctgcagcgcgcgctgcgatataaccgcgaagaagatatcgatgtccagcccaatagcgtgcagtttggcctcaccgcgctgcagcactatatggtcgatcccgaagatgtctggttcgttaaatcccccaaatcgttcctcggtgctactggcctgaagccactgcagattgccctgtttgaagatctggtctgcgccatgatgctgcacatccgcaagcagggtgaaagccagcttgatcaggctatcgatcaagcggtaatcggccgaccggtcaacttccagggtttaggcagtgaagagtctaaccagcaggctgaaggtattctgctgcgcgccgcccaccgcgccggtttccgcgacgtggagtttcagttcgaaccggtggcggccggactcgatttcgaagccacgctgcagcaggagacgcgggtactggtggtggatattggcggtggtactaccgactgctcaatgttgctgatggggccgaagtggcgtgataaagctgaccgccgtgaaagcctgctgggccacagcggttgccgcgtcggcggtaacgacctggacatcatgctgacgtttaagaccctgatgccgctactcggtctgggcggtaacacccagaaaggcaccgccctgcctgcgctgccgtggtggaatgcgatcgccatcaatgatgtgccggcacaaagtgacttttacagtcccgcctgcggaaagtggctgcgggatttagtgcgtgatgcggaacagggtgacgtagtggctcgcctgctgaaagtgtggcagcagaagctcagttatcgcctggtgcgcgcagcggaagagagcaagattgcgctgtcagccagcccggcgcataccgcttccctggactttattgccgccgcattagagacagagattggcgtggatcagctgcaggacgccatcagtcagccgctggagaaaattctggaacaggtgcagctggcattagccaccagccagattaagcctgatgtgatttacctgaccggcggcagtgcgcgtttcgccgttgctgcgcgcggcgctgcagcagacgctgccggatacaccgattgcgggcggcgatgatttcgcctccgtcaccgcagggctggcccgctgggcggaagtgatgttccgctaggcttgcactgcaataacaaagacggcacctgagggtgtaatgccagtcagttaagcgacaggtgataacgcagtctggtgccgggccccggcctgctctgaagcttgagtgcatgttgtcagaaagggcacgagagtgaaggcctgagcgcctctgctgctgaaagggctatccgcagcgctgaggcgtgacgccgggccagaagtccacgccgggaagcgtggacagttcggagccggccagggagggccgatccccgaacggttcgtcggcacggcgtcaaagccgaaggtaccgcgtgagcggcgcgaggacggcccggcagcagcagaggtgcgctggcccgcactgcggctcgctcgcccggaaaatcagaaggcgatattggcgctgataccaccgataaacgcatctttcacttcactgactgcgcccggtgcaaccacatactgcaggttaggtcgcagtgacatccagttagttactttagcgttatagtaaacctcatagttgtactctgaaccttcctgaatcggcagataggtcgggctgtcaaagcggctctcgccattagcctgattctgctgacgcagtgagcgggtatagtcgctgttcacatgaatacgtgacgcgcccacgccgatctcatcctgaggacgggcatcaaacggtcctgtccaggtaaacgcaatagactgatagttgtcggtctttgaggtcttgtgatcgttcatcaccgcctgcacccgcacacccagaccgcgattcacatcgccgtcctgcgcggtcagctgttgctgtaacagcagatagccgccataggaatgggcctgatcctgatagccgccgttgcgccagctgccataaacatcgccatccaccgaggaatagtaatagccgatgcggtagttacccggtaatttctccggcccgaaggttggcttccagcccagtttcgaccggcaccagattcccttctgaattgctggtatccagacggaaaccatcaccgcgatcgtagttagcgctgttctgattatagaaaccgacctggaagaaaacgtccggcgtgatattgaatttcacccggccgccccactgcgagaccggccagttaaaccagcgatcgccgcgccagttacccgcctgcccgctacccagcgccaggttctggaacagattgccatcgaagttatcgaagtcttcccctaccgtcacccgcccggctttcacatcgaccacatcgttaaacaatcctttgcgtaaccagaactgggtcagacgccaggtctggccgcgaccgtaaacctcctgcaccgaggagagcataccggtgcgttgatccgcgacctgttcagaaagattctgtccgttacgactggtcacggtcatctggaactcggcatcctgccagtccagcagcttctgcagatcgaaattggtgccaaacgaccactgatcgctgtagcgcatggtggtattggtatctgccccgccgcctaaattcgcggcgctttccatggtgtagttaacgtcaaacttaatgccgtcgtcctgcagctgcgttcggtacccgccccagtcaccaaacatccattcggagtccgggctcagggcgtcagcggcaaacgcctgcgcggaaaacatggccaggattagggtgccggttgccacacggcgcagcgggaaacgctgctctgcttttctgtttttcatcttgcttattcttatgtaagttacggaaaatgacgcgcagaggatagtgctggataacctctgttttttgtaaatacgtgcgcataattacccgtaacatccgtttattaacgcatttgtgatcgggatcgctgattggttattctctgggcggggtgccaattttttgacaggtgtagcgtaaaaaggggcgctatcgccccttgtgtttactggcttgcctgattcagttgttcaatctgcgccggggtcagcgtcagctgcatcgcgccactcagatcgtcgagctgtttcagcgaggtggcactgacaatcggtgcggtgataccgggacgggcgatcagccaggccagcgctatctgcgtcggcgtcacctgatgcgcttcgctgatagcatccagtgcgtcgaggatccgcaaaccgcgcgggttaagatatttatctacgacaccctgaccgcgcgcgcttttaccggcatccgccgcctcgcggtatttgccactgagaaagccgctggcgagtgaatagtagttaataacgcccagcccctgcgccatcaccaccggctccagctccgattcatagggctggcggtcataaaggttgtattcaggttgcagagtttcatagcgcgccagcccctgcgtttcactgacctgcaacgcctcctgcagccgtgccgcgctgtaattggaagcaccaatcgcccgcactttgccctctctgatcaggctgtcaaaggcgctcagggtttctgccagcggcgtatcctgatcgtcgcggtgcgcctggtagagatcgatatagtcggtctgcaaccggcgcagtgaatcttcgaccgcctgacggatatattgcggtttcagcccggttttctccggcgacaattccatgccaaccttggttgccagcacgatctggtcgcgtttgccgctttttttcagccattcacccataatggtttccgattcaccgcctttattgcccggtgcccagcgggaatagacgtcggcggtatcgataaaccacaggcctcgatccaccagcgcatccagcagagaaaaggaggtggtttgatccactgtccagccaaacacgttgccgccaaacgtcagcaacggcaccgcgataccactgtcacccaactgccgggtttgattctgactcatttcctgctccttatttgcctgaaaaaaccgtctgtctttcagcatagcaaagtgatttcacggctttatgacgattgtgatgcgattaatgaaagaacaggcataattaccccgccctgacagatatccttatttccttcaacttctgcccgtcagaggcggctacactctgtcgtttgcaggctacccatttgatgcctgcgcctgggactacgtcactgctggagagcaccaacaatcatgagcacccgacatcctgttatgaagaaaacccttatcgtgctggccctgatcgccgtggccgctggcggctattatgcctggcagcgccatgcccagccgcagagcagcagtcagagtgacgcacctgcgccacgtggcggcaaaggcggcggtgacggcgcccgtcgtcccctcgcgccggttcaggccgctacggccaccagccagagcgtgccgcactatctgagcggactgggtacggtgaccgcggctaacacggccacggtgcgcagccgggtcaatggcgatctgctggcaatccacttcaccgaagggcagcaggtgaaggcgggcgagctactggcagaagtcgacccgcggccttatcaggtggcgttaacgcaggcgcagggccagctggcgaaagatcaggcgacgctggccaacgcccgtcgtgacctggcgcgcttcgagaagctggcaaaaacctcgctggtgtcgcaacaggagctggatacccagcgctcactggtcagtgaaacgctcggcacgctgaaagcggatgagggaagcgtcgccagtgcgcagctcaatcttacctacagccggatcaccgcgccgattgccggccgggtcgggctgaaacaggtggacgtcggcaactacgtcaccagcggcgacaccaccggtatcgtggtgatcacccagacgcacccgattgatgtggtctttaccctggctgagaacagcatcagttccattctcaaggcgcagaaaagtggtgaatcgctgctggtggaggcctgggatcgcagtaatcagaatctgatcgccagcggcaaactgctaagccttgataaccagattgatgtcaccaccggcaccatcaaaattaaagcgcgttttgataatcaggacgacacgctgttccccaatcagttcgtgaatgtgcggctgaaggtcaacaccctgcaggatgcgattgttatcccacctgccgcgctgcagatgggcaacgaaggcaactttgtctgggtggttaacagtgacaacaaggtcagcaagaaaagcgtgattgccggcttgcaggatagcgagaaagtggtggtcagcgccggtctggaggcgggcgaacgcgtcgtgaccgatgggctggatcgcctcacggaaggcgcaaaagtcgaggtggtcgcgccgcagagcaacgcaccgcgcgctacccgcgccaccctgccgtcaaaaggagagcgtgagtaatgcaggtcatgcctcccgatcacagtggcggaccgtcacgccagtttatcctgcggccggtcgccaccacgctgttgatgattgcgatcctgctggccggggtgctgggctaccgcttcctgccggtctcggcgctgcccgaagtcgactatccgacgatccaggtcgtcacgctctatccgggtgccagcccggatgtggtcacctcctccatcaccgcgccgcttgagcgccagtttggtcagatgtctggcctgaaacagatggcgtcgcaaagctccggcggtgcctcggtggtgacgctgcagttccagctgacgctgccgctggatgtggcagagcaggaggtgcaggctgccattaactccgccactaacctgctgcccaacgacctgcctaatccgccggtctacagcaaagtgaatcctgccgatccaccgatcatgacgcttgccgtcaccacgcgcagcatgccgctgacgcaggtgcaggacatggtggaaacgcgggtggcgcagaaaatctctcaggtcagcggcgtcggactggtgacgctatcgggcggtcagcgtccggcggtgcgggtgaaaatgaatgcgcaggcgctggctgcgctgggtctgaccagcgaaacggtgcggaccgccatcagcaatgccaacgtaaattcggccaaaggcagcctggatggtccgacccgctcagttaccctgtcagccaatgaccaaatgaaatcagcggaggattatcgccagctgattatcagctacaaaaacggcgcaccggtgcgccttggcgacgtggcgaccatagaacagggagcagaaaacagctggcttggcgcctgggccaaccgcgatgcggcgattgtgctcaacgttcagcgtcagcctggtgccaatatcattgccacagcagataatatccgtgccatgttgcccgccctgaccgcagccctgccgaagtcggtggaggttaaactgctcaccgaccgcaccaccaatattcgtgcttcggtcaacgacacgcagtatgagctgatgctggcgatggcgctggtggtgatgatcatctatctgtttctgcgcaacgtgcccgccacgctgatcccggcggttgcggtgcctctgtcactgatcggcaccttcgcggcgatgtacttcctcggcttttcaattaacaacctgacgctgatggcgctgaccatcgccaccggatttgtggtcgatgatgccatcgtggtgattgagaacatctcacgctatatcgagaaaggggaaaagccgctgaccgccgcgctgaaaggtgccggcgagatcggctttaccatcatctccctcaccttctcgctgattgcggtcctgatcccgctgctgtttatgggcgacgtgatcggccgtctgttccgcgaatttgccgtgacgctggcggtggcgattctgatttcagcggtggtctcactgaccctgacgccgatgatgtgcgccaggatgctgagcgcggagtcgctgcgcaaacagaaccgcttttcgcgggccagcgaagcgatgtttgatcgtatcgtggccgcctatggccgcggcctgaaacgggtacttaatcatccctggctaacgctgtcggtggcgcttggcaccctggtgctgacgctgttgctgtggatgatcatcccgaaaggctttttcccgcagcaggacaacagcattattcagggcacgctgcaggcaccgcagtcagtctcctatgccagcatggcgcagcgcacccgcgacgtcgcctccatcatcatgaaagatccggcagtggagagcatgacttcgtttgtcggcgtggatggcaccaatgcctcgctgaacagcgcgcgtctgcagatcaacctcaaaccgctggatcaacgcgacgaccgcattcctgctattcagcagcgtctgcaacagcaggtcagtgaggtaccgggcgtgcagctgtggctgcaggcggtgcaggatctcaccatcgatacccaggcgagccgtacgccctatcagttcacgctgcaatcgggttcactgtcgtcgctcagcacctgggttccggcgctgctgacccggctcagcaccctgccacagctgcgcgatgtcagcagtgactggcaggatcaaggactggaagcctatgtcaaagtggaccgcgacagcgccagccgcctcggcatcagcatggcggatgtcgataacgcgctgtacaacgcctttggtcagcggctcatctccaccatttatacccaggcgaaccagtatcgggtggtgctggagcaggacaatagtgccactcccggcatggagagcctgaatgcgattcgccttaacagcagcgacggcggcagcgtaccactgagcgccattgcccgaattgaacagcgcaacacgccgctcagcattaatcatctcgaccagttcccgtcggcgaccttctccttcaacgtggctgacggctattcgctggaagatgcggtgaaagcggtgtcgcaggctgaagccgagcttggcatgcccgcagagctgatgacgcagttccagggcagcacgctggcgtttgaagcagcgctgagcagcaccgtctggctgattgtggcggccattgtggcgatgtacatcgtgctgggtgtgctttatgagagctttatccaccccatcacgattctctcaacgctgcccacggcgggtgtcggcgcgctgctggcgctgatgctcagcggcaatgagctggatatcgtggcgataatcggcatcatcctgctgatcggcatcgtgaaaaagaacgccatcatgatgatcgactttgcgctggcggccgaacgtgaacagggtatgaagcctgttgatgccatctatcaggcctgcctgctgcgcttccgcccgattctgatgaccacgctggccgccctgctcggcgcgctgccgctgatgctcagcaccggcgtcggtgccgaactgcgtcatccgctggggattgccatggtcggcgggctgattctgagccaggtgctgaccctgtttaccaccccggtgatctacctgctgtttgatcgactggcgcacgccacccgccgccgctttgcccgcacggaggccgcagagtgaagttctttgccctgttcatcaaccggcccgtcgccactaccctgctgacgctggccatcgcactggcggggatgctgggtttccggctgctgccggtggcgccgctgccgcaggttgattttccggtgatcgttatctcggcttcgctgccgggtgccgcaccggagatcatggcgtcgtcggtggccacgccgctggagcgctcgctgggacgcatcgcgggcgtcagtgaaatgacctcaaccagttcgctgggcagcacccgcatcattctggtgtttgattttgatcgcgacatcaacggagccgcgcgcgatgttcaggccgcgattaacgcggcgcaaagcctgctgcctaccgggatgccgtcgcgcccgacctatcgcaaagtgaacccttcagatgcgccgattatgatcatgacgctgacttcggatacctataatccgggtcagctctacgattacgcctcgacccagctggcgcagaaactgtcacagattgagggcgtgggcgacgtcaccgtgggtggcagctcgctgcctgcggtccgcgtggccctgaatccacaggcgctgtttaatcagggcgtctcgctggatgcagtgcgcaccgccatttccaacgccaatcagcgacggccgcagggcgcactggatgattcgcagcagcgctggcagttgcgtaccaatgacgcgctgcagaccgccagtgagtatcagccgctgatagtgcattacaacaacggcgcggcggtcaggctgtcggatgtggcgacagtcgaagattcagtgcaggacgtacgcaacgccgggatgtcgcgcggtaaaccggcggtgctgctgctgatccgcaaaacgcctgaagccaacgtcatcgatacggtggaccgcatccgcgccgaaatgccgctgctgcatgaggtgatcccggccgccatcgatctgcagatcgctcaggatcgctcacccaccattcgcgcctcgctgcatgaggtggagcagtcgctggtgatcgccgtggcgctggtgattctggtggtgtttgttttcctgcgatcgggccgcgccacgctgatcccggccgttgcggtgccggtttcgctgatcggcacctttgccgcgatgtatctgtgtggcttcagcctcaacaatctgtcactgatggcgctgaccatcgccaccggctttgtggtggatgatgcgattgtggtgctggagaacattgcccgacacgtggaagcgggcatgaagccgctggctgccgcgctgaaaggggtgcgggaagtcggttttaccgtgttgtcgatgagcctgtcactgattgccgtgttcctgccgctgctgatgatcggcggactgattggccgcttcttctcagaatttgccattacgctgtcggtggctatcgtcatctcgctgtttatctcggtcaccctgacgccggtgatgtgcgcttatctgctgaagccgcacgcgccgcgcagccagccgcgccagcgcggcgcgggccggctgctgatggcgatccagcagggctatggtcgctcgcttaacgtggtactgaaccatgcgcgctgggtgatggtgctgtttttcgccaccatcgtcctgacaggctggctgtttgttcatattccgaaaacctttatgccggagcaggataccggacgactttccggttttatctctgccgaccagagcatttcgtttcaggcaatgcgcagtaagctgcaggattttatggagattgtcggggccgatccggcggtagagagcgtggtgggcttcaccggcgggatgcgtaccaacagcggctccatgtttatttcgctgaagccgctgtcggagcggaaagagagtgcagtggagattatcgcccgcctgcgcaataagctggcgaaagaacccggggcgagtctctatctgaatgcggtgcaggatctgcgcgtcggcggtcgggaatcgaatgccggttatcaatattccctgctgtcggacgaccttaacgccctgcgtgagtgggagccaaaaatccgtcaggcgttctctgccctgccacagctggcggatgtgaactccgatcagcaggataaaggcagcgaaatggcgctgacctatgaccgggaaagtatggcgcggcttggcatcgatgtctctcaggccaatgccctgctgaataacgcctttggtcagcgtcagatctccaccatttatcagccgcttaaccagtacaaagtggtgatggaggtcgatccgcgctacacccaggatatcagcgccctgtcgcagatgtttgtgataaacagcgaaggtaaagcgattccgctgtcgtggttcgcccactggcagcccgcgaatgcgccgctctcggtcaaccatgaagggctgtctgccgcctcgaccatctcatttaacctgccggaaggtgtgtcgctgtcgcaggcgtcggaggcgattgaacgcaccatgaccgcgattggcgtgccctccagcgtgcgcggcagctttgccggtacggcgcaggtgtttcagcagtcgcaaagcaatcaactctggctgatgctggcggcgattgcggcggtctatatcgtgctggggatcctctatgagagctatgtccatccgctgacgatcctctctaccctgccctcggcgggtgtcggtgcgctgctggcgctggagctgttcgatacgcccttcagcctgattgcgctaatcggtattctgctgctgatcggtatcgtgaaaaagaacgccatcatgatggtcgattttgcgctggaggcagagcgcaacggccagctcagcgcgcgggaggcaattttccaggcgtgcctgttgcgcttccggccgattatgatgacgacgctggcggcgctgtttggcgcgctgccgctggtgctgaccagcggtgacggcgcagagctgcgtcagccgctggggattaccattgccggtgggctggtgatgagccagttgctgacgctctacaccacgccggtggtctatttaatgatggataaattgcgccgtaaaaaacgcccgctggtcgccgcgcagcagccgtaacaggtatggcggcaacaggcatcggacgtgacgcctttatcggggggatcgatgagtacgcaaagcactaacgtccgctggcaactgtggattgttgccatcggcttctttatgcagacgctggataccaccatcgtgaataccgcgatcccgtcgatggcgcacgatctgggtgtcagcccgctgcacatgcactcggtcatcgtctattacgtgctgacggtggcggtgatgctgccggtcagcggctggctggccgatcgctttggtgtgcgcaacattttcttctgcgcgattgtgctgttcagcctgggatcactgctgtgcgcactttccggcactctggatcagctggtgctgtcgcgggtggttcaggggattggcggggccatgatggtgccggtgggtcgcctgacggtgatgaaaatcgtgccgcgcgagcagtatatgtccgccatgacgtttgtcactctgcccggccagatcggtccgctgctgggtccggcgctgggcggtgtgctggtggagtacgccagctggcactggatctttctgatcaatatcccggtcggcattgcaggcgctatcgccaccctgatgctgatgcccaactacagcatgcagacgcggcgctttgatttcggcggttttatcctgctggccgccggaatggcaaccctgacactggcgctggatggtcagcgcagcagtggcggctctccgctgctgctgggtgccatgatcctcattggcatgttctctctgctgttctacctgatgcatgcgcgcggcaatgataatgcgctgttcagcctgaagctgtttgataatcgcatctactccatcggcctgcttggcagttttaccggccgcatcggcagcggcatgctgccctttatgacgcctatctttctgcagctcggcatgggttacagcccgtttcacgccggtctgatgatgattccgatggtgctggggaatatggggatgaaacgcattgtggtgcgcatcgtcaatctttatggctaccgcaacgtgctggtgatgtcgaccgtggcgctggcgctggtggtcctgctgttcccgctggtggcaattctgggctgggtctggctgctgccactggtgctgtttctgcagggcatggtcaacgccatccgcttctcttcaatgaataccctgacgctgaaggagctgcctgatgagctggcgtccagcggcaacagcctgctgtcgatgattatgcagctgtcgatgagtattggcgttaccgtggccgggctgctgctgggggcatttgctcaggagagcgcagcgaacagcacggcggaacatcagatgtttatttatacctacctttgcatgtcgctgattatcatcctgcccgcgctggtgttctggcgcgtgccgccacaggtgagtaccaacgttgatttgcgacgccggagaaaaaaatgagagataacctgcgcttgggcatcggggccaaactgtttatggcgattttcgccacctgcatgctggtgctgattaccatgcactggggggttcgcctcagtttcgagcatggctttgtcgactacattaagcgcggcaacgagcagcggttaaatctgctcagcgatgccctggccgatcaatatgagcagcacggcaactgggattttttgcgccacaacgaccggctggtgttcaccatgctgcgttcgctggagcagaatcccgacagtaacagtcagctgccgccgcacggctggcgcacccagttctggatcctcgatcagcaatataaagtgctggccgggccaaaatcgccggtgccgcccgaaggcacgcgacgcaatatcaccaccagcaataataaagtggtcggctgggtcatcggctcgccgccggagcggctgacgcgcagcaccgacattaactttgatcagcagcagcggcgcaccagctggattatcgtcgggctgtccacgctgctggcggcgctggcaacctggctgatggcgcgcggtctgctggctccggtcaaacgactggttgacggcacccatcatctggcggccggtaattttgccacccgcgttgaggtcagcagccgggatgagctgggccagctggccagggactttaacctccttgccagctcgctggagaaaaatgagagcatgcgccgcgcctttatggccgatatctcccatgaattacgcacaccactggcgatcctgcgcggtgaactggaagcgatgcaggatggcgtgcgcaaactgacgccggaagcgatcgcctcgctacaaagcgaagtggtggtgctgaccaagctggtcgacgatctgcaccagctgtcgctgtccgatgagggcgcccttgcctaccgcaaacaggcaaccgatctggtgcaattgctggaagtgacggcaggcagctttgccgaacgctatcgtgcacacgggctgacgctgaaactcaatctgcccgataacgcccccttctttggcgatcccgaccgcctgatgcagttgttcactaatctgctggagaacagcctgcgctacaccgacagcgggggccgggttgaagtgacgctgaactatgaggcacccaactggcgcatcgagtttgatgacagcgcgccgggcgtggatggggaacatcaggcccagatttttgagcgcttcttccgcaccgaaggctcgcgcaatcgcgccagcggtggctcgggcctgggcctggccatctgtaaaaatattgctgacgcgcatggcggcgatattcatgcggcgcactctgatttaggtggactgaaaatcgcgctacacttgcgctatgttccccttgtgtagacgcttatgagcctggaaaaccacgacccgctgattctggtggtcgaagatgagccgaaactggcgcagctgatgatcgattatctgcatgcctcgaactaccgtacccatcacatcgccgacggcaacgcagtgctggagtatgtgcgccagacgccacccgacctgatgctgctggatttgatgctgccaggcaccgacggtttaacgctgtgccgtgaaatccgtcgtcattccgagctgccgattattatggtcaccgcccgcaccgaggagatcgatcggctgctggggctggagctgggcgcggatgactacatctgtaaacccttcagcccgcgtgaagtagtggcgcgagttaaaacgattctgcgccgggtaaaacggtcggcggaagagccgcaaagcgcctcgttacttcgcgtcgatgagagccgcttcttcgccagctggcgcgacaagccgctggatctcacgccggcggagttccgtctgctgaaaacgctgtcgctggagccgggcaaggtcttttcacgcgaacagctgcttaaccatctctatgatgactaccgcgtggtcacggaccgcaccatcgacagccatatcaagaacctgcggcgcaagctggagaatctcgacagcgagcaaccttttatccgcgccgtctacggcatgggctatcgctgggaagccgatgcctgtcatttgatctagtttgatcccgatcaatttacttcccttttctcactgcctacaattccgcaccttttgcagggcttaactgccctgcacctgccgcctgaggcgacatgctgacctgacatcagtgagaaaatcatgaaacccgaactgctttcccccgctggcaccctgaagaacatgcgttacgcgtttgcttatggtgccgatgccgtttatgccggccagccgcgctacagcctgcgggtgcgcaacaacgaattcacccacgaaaacctcgcactgggcatcagtgaagcgcacgcgctgggtaaaaaattctacgtggtggtgaacattgcgccgcacaacgccaagctgaaaacctttattcgtgacttagcgccggtagtggcgatgcagcccgacgcgctgattatgtccgatcccggcctgatcatgctggtgcgcgacgctttcccgacgatgccggttcatctgtcggtgcaggccaatgcggttaactgggccacggtaaaattctggcagcagatggggctgagccgggtgattctgtcacgcgagctgtcgctggaggagatcgccgagatccgccagcaggtcccggagatggagctggaagtatttgtccatggcgcgctctgcatggcctactccggtcgctgcctgctctcaggctatatgaacaaacgcgacccgaatcagggaacctgcaccaacgcctgccgctgggagtataaagtggcggagggtcagcaggatgaggtggggaatatcgtcggtatccaccagcctgtcgccgtacaggatgtgacgccaacgctgggcgttggtcagcccaccgacaaggtgtttctgctggaagagaagatgaagcccggcgaggtgatgagcgcgttcgaagatgagcacggcacctacatcatgaactcgcgggatcttcgcgcggtcgcgcacgtggagcggctcagcgagatgggcgttcattcgctgaagatcgagggacgcaccaagtcctactactactgcgcccgcaccgcccaggtttatcgccgggcgattgatgatgccgctgccggtaagccgtttgatccctcactgctgttaaccctggaaggcctggcacatcgtggctataccgaaggtttcctgcgccgccacactcacgacagctaccagaattatcagcagggcttttcggtgtccgaccgccagcagtttgtcggcgaattcaccggcgaaacgccggggcgaatgggctgaagtggcggtgaagaataagtttatgctgcacgacagcgtggagatcatgacgcctcaggggaacctgaattgccagctggacgcgctgcagaatgcacgtggtgagcccactgaagttgccccgggcgatggccatcgcgtctggctgcgggtgccagaggaggtggatctgcgttttgcactgctgctgcgcaactttgatcatggtgaagatacccgggaccctcataatcgtttaccaacggaaacattttgaggaaatcagaacaggatcacagacccttgcgcggtgctgctttatagtcccgcctgctgctaacgagtaacaacaaacggcagatttaccaggaaccacctcatttacccgcccggctcccccgtgcgggttttcttttttctctctttcgccaataatttactgctggcagctgtgttataaatcccttcttactctgtagatcttcaaggaacgcaaaatggataataaaccgcttacgctgctcatcctgaatgggaaaggcgcgggtaatgatgatctgcgcgaagctattacgaccctgcgtgaagaaggcttcgacattgcggtgcgtgtcacgtttgaaaaaggtgatggcgatcggtacgtcaaagaggccattgcgctgcaggccgcgaccgtggtggccggtggtggcgatggtacaatcaatgaaattgcgactgcgctggcttcttctgaagcggatcatcgcccggtgctgggcatcctgccgctgggtaccgccaacgattttgccaccagcgtcggcatcccggaagagatggaaccggcactgcgactggcgattcagggcaaagccagtgccatcgatctggccagggtaaaccagagccactacttcatcaatatggcgaccggcgggtttggcacccgtatcacgactgaaacgccggaaaagctgaagtcggcgctgggcggcgtctcctactttattcacggcctgatgcgcatggatacgctgaaaccggatacctgcgagatcagcggccccgatttcgcctggcagggtgatgcgctggtgatcggtattggtaatggtcgtcaggcgggcggcggtcagcggttatgcccttctgccctgatcaacgatggccgactggacgtcagtgttgtcaccgcgcaggagttgctgcctaccctgctgcactcgctgaccggcgacgatgacaatcccggcatcgtcaccacgcaactggagtcactgacgatccgttcgccgcatgagatgacctttaacctcgatggcgagccgctttccgggcgcgaattcgtgattgaggtgatggcgggcgcgctgagctgccgcctgccgccgcagtgcgcgctgcttgcctgaaccgacatcaggggcgaaagccccttttttcttctgctaccattagcgcccattgtcttcgtaacattcctcctgctgcctcgctttatcacgccttaacgggcgttttcaggcaatgtaaacactctgtgattccgttcacaactctgccaccctaacttgtatggtagtattaaagagcgtactttttcatcattgaacgctgacttaaggcaaccaggatgaaaattgttaaggcagaagtatttgtaacctgcgcaggcagaaactttgtcaccgtaaagatcaccaccgatcagggtctgaccggcattggcgacgcaacgctgaatggccgtgaattaccggtcgcctcctacctgaaagatcacgtctgcccgcagctgattggccgcgatgcgcatcagatcgaagacatctggcaatatttctacaagggcgcttactggcgtcgtggcccggtcaccatgtccgctatctcggcagtcgatatggcactgtgggatatcaaaggcaaagccgccaatatgccggtgtatcagctgctgggtggtgcatcccgtaccggcgtgatggtctattgccacaccaccggtcactccattgatgaagtgatggatgactacgcgaagcacaaagagctgggcttcaaagcgattcgcgcgcagtgcggcgttccgggcatgaaaaccacctacggcatggcgaaaggcaaaggtctggcctatgagcctgcaaccaaaggtaactggccggaagagcagctctggtcaaccgagaaatacctcgattttaccccgaaactgttcgcggccatccgtgacaagtttggtttcgacgagcacttgctgcatgacatgcatcatcgcctgacgccaattgaagcggcgcgttttggcaagagcgtggaagattatcgcctgttctggatggaagatccgacgcctgctgagaatcaggagtgcttccgcctgatccgccagcataccgttacgccgattgccgtgggtgaagtgttcaacagcatctgggattgtaagcagctgattgaagaacagctgatcgactacatccgcaccaccattacgcatgcgggcggcattaccggtatgcggcgtatcgctgattttgcctcgctctatcaggtgcgcaccggctcgcacggtccttctgatctctcccctgtctgcatggcggctgcactgcactttgacctctgggtgccgaacttcggtgtgcaggagtacatgggcttctccgaacagatgatggagctgtttgatgcaaactggacctttgaccagggctacatgcatccaggcgacaaacccggtctcggcattgaattcaacgagaaactggcgtcgaaatatccctatgaacctgcctatctcccggtcgcccgtcttgaagatggcaccctgtggaactggtaaggagaagctgatgaaaagcgttgttattgaacagccgggtgaactggtggtggctgaacgtccactgccacaacctgcggcgggcgaagtccgggtcaaagtggcttatgccagtatctgcggctctgatgtgcatatctggcacgggcataacccgttcgcgaaatatccacgggtaattggtcacgaatttttcggcgtcattgacgcggtgggcgacggtgttgatccggcccggctgggcgaccgcgtggcggtggatccggtggtgagctgcggcagctgctatccctgctcggtgggccgtcccaatgtctgcaccacactacaggtgattggcgtgcaccgtgacggcggcttcagcgagtttgcgctggctccggcaaaaaatgccttttccctgccggacagcatccccgatcggctcgccagtctggttgagcctttcactatcgccgccaatatcaccgcgtttctcaagccgcagccagacgatgtggcgctgatttacggtgccggtccgatggggctcactgcgattcaggtgctgaagggcgtctataaggttaaaaaggtgatggtggtggatcgcctgccggaaaggctggcacttgcagagcagagcggtgccgatcaactgtttgataacaatgaaatcccgctggcggcacagcttgagggcgtgcagcctacgctgattatcgacgcggcctgccatcccaccattctggctgaagcagctgccctcgcctcaccggccgcacgcattggcctgctgggcttctccggcgagccgtgcagcattactcagcagagcctgaccagcaaggagctgtcgctgtttacctcacgtcttaacagcaatcgtttcccacaggtgatcgaatggatggaaaaagggttaatccagccagagaaactggtcacgcactacttcccgctgcaggagattgagcgtgcgatgaccctgtttgaaaaagatccgcgcacctgctgcaaagtcatacttcagatgggttaattatccgctgaacaccaggtctcctcagccggtgcgtacccgccggcatgactataaagataaaacagatcacggagtttgtatgttcaagaatctgcgctggaccctcgttttgctgctgttcctggtttacatgattaactacctcgatcgtgtcgccctgtcgctgacggtgccgctggtggaaaaagatctggcgatcaatgctgagcagtttggcatgatcttcggcagctttttctttggctatgccctgtttaacttccttggcggccttgccactgaccgctatggccctaaaatcgtgctggccgtggcggtaggagcctggtccattttctgcggcatgaccgcactggccaccggcttctggtcgctgctgatcctgcgtgtgctgtttggcatggctgaaggcccgatctgctcctcggccaacaaagcgattaacggctggttcccgaaaaaacaggccgcgacggccatgggcttactgagtgccggatcacctttgggtggtgcggtcgctggcccgatcattggttatctggcgctcgcctatggctggcgtccggcgttcgtgattgtctgctgcatcggtctggtgtggatggcgttctggctcttcttcgccgctgacaatccggcgaagagcaagcgtgtcagcgaagaggaacgtctgctgattgatcgcctgaaagcgacgaacccgaatgatgaagttgatctgtcggaaacgtcacatccgtttggctactacctgcgccagccgattatcctggtcaccgcttttgccttcttctgctacaactacattctgttcttcttcctgagctggttcccggcctacctggtgcaggcgcacggcctggatatcaaatcgatgagcatcaccaccatgatcccgtggatcgtcggtttcgttggcctggcgctgggtggctggatctccgataagatctttaacatcaccggcaagctgttgttgtcccgcaaaattgtgctggtggtctcactgctggccgccgcaatttgtgtggcgctggcgggtacgataaaagatgtggtgcctgcggtaattatgatgtcggtgtcgattttctttctctatattaccggcgcaatctactgggcgattattcaggatgtggtgcacaagagccgtatcggcagcatcagcggctttatccatctggtgggtagcctctccggcatcatcgggcccatcgtcaccgggtttattgttcatcacaccggtaaattcgatagcgcctttatccttgcgggctgtgtcgccgcgctgggtgccttcctggtgttatttgtgattcgcagtccgaaaacccaggataaaccggtttcggtctgagtgttgtttcgctaacagatgtatgatttcggggcgctttgcgccccgtttgccataaggatgaactatgttacagattgatcgcctgcccgctgaggtcaagcgccccgcttacgaccgcagccagttaaaaacccgcatggtacatatcggttttggtgcatttcaccgcgcccatcaggcgctctgcagcgataagctggctgaacagggcagcgactggggttattgtgaagtgaacctcaacagcggcgcgttgattgaggccctgcgagagcagcatctgctttataccctcaccgagatggccgatgattcattgcatacccgggtgattggcgtcattactcaggcactgcacggcaaaagtgacggtattgaggcggtgatcaatgccatgagccagcctgaggtggccattgtctccatgaccgtcaccgagaaaggctattgccaccagcctgccagtggcaatttaaatcccgatcaccctgacatcgtgcatgacctgcagaatccgcattcgccgcgttcgctgcccggtctgattctggccgcgattcgccgccgacgggatcagggcttacccgcctttagcgtgatgtcctgtgacaacatgccggaaaacggtcacgtgacccgcaacgttgttgtacaactggcacagcatcaggatccggcactggcagactatattcagcaacacattaccttcccctccaccatggtcgatcgtatcgttccggccatgaccgatgcagcgtttgcggcactaagcgagcgtctgggttccgatgacccggttgcggttgaagcggagcccttctttcagtgggtgattgaagataacttcgtcaatggccgtccggcgtgggaaaaagcgggcgcagaactggtcagtgacgttctgccctatgaagagatgaaactgcgcatgctgaatggcagccactctttcctggcctatctcggcttcctggcaggttatgaatacatcagcgactgcgtggccgatccccatttccgcgccgccgcccgtgcactgatgatcgatgagcaggcgccgacgctgcgtacccagggcgtggatctcaacgcctacgccgattcgctgatcgcccgttacgaaaaccgtgccattaaacatcgcacatatcaaatcgccactgacggatcgcaaaaattgccacaacgcatgctcgacagcctgcgctggcatctgcagcgcggcagccgctgcgacctgctgctgctgggcgtggcgggctggatgcgctatgtcggcggcgtcgatgaacagggtcagccgattgagatccgcgatccgctgaaagccacgctggcagagacggttgccggtagcgaagaaggcgaagcgcgtgtccgtgcgctattgggtctgcgcgacatctttggcgacgatctggcgcagaacgccgatctggttgcccgactgacgacgtattaccagcagctgacgactcagggcgcgcgggcgacggtgcaacagtgtatgagtcaggcataacagcctggtgacaaagcgctggcgcagatgcagcgcgctgattagactgacactttcccatcgcgctggcccctgccagccgtaatatggatattgctgcatgtcgatcgcctataccattactaccagcgaaccggtaaatcagcagatttaccggtatctgcgcaaagatatcgtcacctgcgcaattcagccgggctcgctgctctcggaaaaagaggtgtccgcgcgcttcaacgtttcacgccagccggtgcgtgaagcgttcatcaagctggccgaagccggactggtacaggtattgccgcagcgtggcactttcgtgcgcaaaatctccgctaagcgggtggcggatggccgctttatccgggaggcagtcgaggtgtcggtggttcgccgtgcggcactggagattgatgatccggctctgatggcgctggagcataacctgcagctgcagcgcatggccgctgaacggcatgacagccaggcttttctcactctggacgatgagtttcatcgcctgattgctgaaagcattgactgtaagctggcctgggaaacggtggagaacatcaaagcggccatggaccgggtgcggtttctgacgctgagtgaagtctctccaccggacaagctgattgagcagcatgaagagatttttgcggcgctgaagcgtcatgacgccgatgcagccgaagcggcaatgcgtcgtcatctgcaggagatgatcttctctatcaccccgattgccgagcgtaacagcgcctggtttgaagcaccctgaacctgaaaccgcccgcaccacctgattaccaggtcgatgcgggccttcgtcgttaccaccattgatgaaaatggtgaaccggcccaatacccttcccgacctccagcgaatccgcctgcagcagcgcctgctgtaaccagtttttggcttccccaatcgtctctgcccagtcagcatgacgtggtcgcaacgcggctaaggctgccgacagcgtacagccggtgccgtgcgtatgacgggtattcacccgcggcgtactgaatcgctgctctgctgagtgcgtgatcagccagtccgggctctccgccgccgtaaggtgaccgcccttcatcagcacggcctgacagcccagtgccagcaatgcccgtccctgctcgcgcatttccttttcatctgccgcaatggcgcaatccagcaacgccgccgcttccggcagattaggcgtgatcagcgagacctgcggcaataacagctctcgtacactggctacggcgtctggcgagagcagcgcatcaccacttttcgcaaccatgaccgtgtccagcacgataaacgggattgccgcattgctcagccgggccgcaacctgctccacgatagccgtttctgacagcatgccaatttttgcgctgtcgatgcgcacatcactgagcaccgaatcgagctgggcggccacaaagtcaggcgtaatgcgataaaccgactgcacgccgcaggtgttctgtgccaccagcgcggtgatgacgctggtgccataggctcccagagccgagaaggtcttgagatcggcctgaatccctgcgccgccgctgggatcggtacccgcaatcgtcagagcgttaatacgcttcatgattaccctccagcgtccagagtgcatcaataaacgccgtggcaaagctgccggggccggcagcctgcgccgctgccttttcacccgccagcgccatcacctgacaggcggccgcgacattcatcagccgatcgccaggcagagagctgaaacccgccaccactgccgagagggcgcagccggtcccgactacccgtgtcattaaggggtttccaccgtgtacagcaaggagtcgctgaccatcggtggcgtagtccacttcaccggtgacgaccaccagcgtgctccaggtttccgcgagctgttgggccgcatcgagtgctgcatccgcctgatgcagcgtgtcgacaccgcgcccgccgctggcctgttgtgccagcgccagaatctctgacgcattaccccgaatcaccgccggttgctggcttaacaattgctggcagaagtcactgcgcagcgtcagcgcgccgacggcaaccggatcgagtgtccagggcgtgcccgcctgattagccgcagtgacggcagcctgcatcgcctgctggcgctcgcgggttaaggtgcccacgttaatcagcagtgcatcggccatgctactgaactgggcggcctcagcggtatcgatcaccatcgccggtgaggcatggagagccagcaacacgttggcggtgaagttctggaccacgtcattggtcatacagtgcaccagcggtgactggcggcggaaagcgtgcagaatgggcgcgaagtgcgcggcagaaaggtgttgagattgatgtgtcatcgtagctcccaaccggcgaacaagaaggcgaatgcggtcaggcatcagacttccctacgctggcattatccagttcaggtcagcgggtttttctcagccctttccttgtggaaagcggcaccccgagtcgtgttacggcttgcagcataggcaagccgcgcagcgaaagcaagcgactcccgcctgggaaataatcagagctgaaacaattcacatgatcccgatcaacgcctgagggtgcaaaaaaaggcttaatgctgcgggttaacgagatacctctttataggtagtcacacttattacccggatgggtaatatttcccgcagtgactctggtcaccccataataattaacctgctcgcagtatcatcgtaaaaaacactttatttcatggagtcagaaaactcctgaagcggaacttcatactattcaggatgtatgatgcgatttttagcgcttattccacaccgccatcgatggcaggatattaatattgaacgcaagggtgccgtggcacccaatggcagacagtacctctccacctatatttccgcccgttgcacaggctgtggtgaaattattcaccgtgtctattatcgcgacatcagcgatcggcaggcgcgccgctggttaggttagcgtcccggcaacggtcattccggacacagttcaggttaacagttagttagcaatttgttagtctggtaactaatcatcgtctgaccagactctctctatgccactgctgtttgaaagcttaagtcatcaaatttacctgtcagccccgctgtttatcctgatcctgctggggtactgcctgacgcgcctcgggaaatggcccgccagcatcagcgaagggatgaaccgctttgtgtttaacgttgccctgccctgcatgctgtttcgggtgatgagcaccttctcgcaaagtccaccggtagatgcgcgcctgttgctggcctttttcggcagttgcctgctggtgtttatcgtgggacgactgctggcaacaaggctgtttaatctggatggcgtagcggcgtcggtttttgcgctgggcggcatcttttccaataacgtcatgctggggatcccggtggccacggtgctgctggggccagaagccctgcccccggtggcgctggtgctggtgtttaacagcctgatcctctggaccttactgaccgtttcggtcgagtgggcaaaacagggcagcttctcgctggaaggactctggcgcaccctgctcggcgtgctgaagaatccgctgatcatcggtattctcagcggtacagcctggagctttctgcaacgtcccttgccgctgctggccgctgaaccgctaaagatgctggcctcactggccgcacccttgtcgctggtgacgctgggcatgagcctggcgcactatcgggtgcgggatggcttaaaagagagctataccatctgcctgctgaagctggtgctgcaaccgatgacggtatgggctatcgcgtggctgaccgatctgccgccgctggagagtaaagtggtggtgctgctgggatcgatggcagtcggggttaacgtctatctgatgtcgcagaagtttaatgtcattaccggcccggcggcggcgagcatgctcttttctaccgtgtttgcggcggttacaacgccaatctggatgatgctgatgacgctggcgggctattaacaaaaaagcccctcagcacacgtgctgaagggctattgtatggctaactaaatgttactctgccgatttggtacgaatcagatagtcaaaagcactcagtgaggctttagcaccttcgccgctggcgatgatgatctgcttgtacggtacggtggtgcagtcgcccgcggcgaacacgcctttcaggctggtttcgcatttaccatcgatgatgatctcacccattttgttgcgctcaaccgcaccttccagccatggggtgtttggcaacagaccaatctgaacgaagataccggagagcggcagctcatgagtggtctgcgtcgtgcgatcgatatagtgcaggccggtgactttggtaccgtcgcctttcacttcggtggtctgggcgttcaggatcacatccacgttcttcaggctgcgcagcttatcctgcagcacctgatcggcgcgcatctcaccagcaaactccagcagcgtaacgtgttcaacgataccggccagatcgatggccgcttccacgccggagttaccgccgccgatcaccgccgtgcgtttgcctttaaacagcgggccatcgcagtgtgggcagtaggtcacgcctttggtgcgatactcttcttcacccggcacgcccatgttacgccagcgtgcgccggtcgccaggatgatgctgcgtgatttcaatactgcgccggaggcggtttcgatggcgtgcattccgccctctttcgctgccgggatcagtttgatggcgctctggctttcaatgacgtccacgttgtaatcatccacgtgtgcgcgcagtgaaccggccagttttgccccttcggttttcggtacggagatatagttttcgatatcgaccgtgtccagcacctggccgccaaaacgctcacccagcaggccggtacggatacctttacgtgctgagtagatggctgccgctgcgcccgccgggccgctgccgataatcaggacttcatacgcgtcacgcttgttcagctcttccgctgcacgtttgtcggcattggtatccactttgctgacgatttccgccaggctcatgcgaccctgaccaaactctttaccattgaggtaaaccgctggcacacccatcacgttacgttcctgaatctcgttctggaacaggccaccgtcgatagcggtgtggctgatgcgcgggttaatcaccgccatcaggttcagcgcctgtacgacgtcagggcagttatggcatgagagtgaatagtaggtttcgaaatggaagtcgctgtccagcgcggcaatctgatccagcaggctttgtgcttctttcgacggatgcccaccggtctgtaacagtgccagcaccagtgaggtaaattcgtgacccagaggtgaaccggcaaaacgcgggccactgttcgaacctgggttggtgatcagaaatgagggcttacgcacctgacgatcgttctcttcgcggaagctgactttgtcagacaaaccggcgatatcaaccaacagttcacggatctcggttgattttgcaccttcgtccagcgtggcaatcaactcaacaggtttggttaatttctcaaggtaagccttgagctgggttttcagatttgtgtcgagcatagtgatatcctggtcaaaaaatcgggtgccgcagcacccgattggagaatggtcgaaaggccgaagcggaattagattttaccaaccaggtccagagacggagccagtgttgcatcaccttctttccatttagccgggcacacttcacctgggtgagaagccacgtactgagccgctttcactttgcgcagcaggtcagaggcgtcacggccaatgccttcagcagtgatttcgattgcctggataacgccttccgggtcaacgataaaggtaccacggtcagccagaccttcgtcttcgcgcatgatttcgaagttacgggtcagcgcgccagtcgggtcaccgatcatcgtgtactggattttcgcgatggtgtcagaagaaccgtgccaggctttgtgggtaaagtgggtatcggtagaaacggagtagatatctacgcccagtttctggaactcttcgtagtgatcagccacgtcgcccagctcggtcgggcagacgaaggtgaagtcagctggatagaagaagaacacactccatttaccttcaacgtctttctcggttacgtcgatgaattcgccgtttttgaatgctgcgtttttgaacggcttgattttggtattgataatagacatctggtggcctccgttaaaatatgtgatgcaggttacataatttccgggccaacatctaatatgcagtcgttatcaatttgattaacgaaagctatcaaacgctaagagcctgatgctctctggcccggcaggcagtgtacagcgatttacgtgacatttaacccgctttatcttttccgcccctctccgcgaatcgctgctagttttgtaagaccggattaaaagggagctgacttgtggagattcgtccgtttactgaagccgatcgtccttttctgcgtacgctgtttctggcggcgcgtcggcataactggcgctggctggacggcagcgagtggcagctggaagattttgatggggtaatcctgggtgaaaccgtgctggtcgcggaagctgacggacagcgggtgggatttgccggcctgctggagaacgataacttcctgcacagcctctatgtcgatcctgactggcaggggcgcggcgtgggcagcgctttgcttaaggcggcagaggcgcgctttacctcaaccggtgcgctaaagtgcctgcagaagaataaagcggcgcaggccttttacctgaaacatggctggaagatgatttcacagggcgaaggcgaacatggcggctacgtgttaatgcactacccgctggcctcgcaatatgccagcgggtcgggtcgtgcttaaagcgcgcggaaggcgatgtcgccggggatgacttcgccctgccagtaaagctgggcagcaacgcgtccggccagctggcgataaagcgcggtaaactcgctatcgggccggcgaatcaccgtcggctgaccttcatcgagatcttcgcgcaggtcaatgtgcagcggcagctgggccagcagctgcgtctggtaatcctctaccagtttctgtgcgccgccagtgccgaaaatcggctcatggaagccacactgactgcagacatgcaggctcatgttttccaccacaccaagtaccggcacattgaccttttcaaacattaccagccctttgcgggcatcaatcagggcgatatcctgcggcgtagtcaccaccagcgcgccggtgaccggtacgttctgcgccagcgtcagctgaatgtcgccggtaccgggtggcatatccagcaccagataatccagctcaggccacagcgtctcgttcagcagctgcatcagcgctttgctggccatcggcccgcgccacaccatggcattgtcgtccgtgaccagataaccaatagagttggttgccagcccgtgcgccatgatcggcgccatgtgggtgccatccggcgaggtaggccgttgatcctgggtgccaagcatgttcggcactgacgggccataaatgtcggcgtcaagaatgccgacccgcgccccctctgctgccagcgccagcgccatgttcacggcggtgctggatttacccacgccgcctttgccagagctgaccgcaataatatttttcacgccgttgacgcccggctggtttttcacccgtttcagggtggcaatgtcatggctgagtcgccagtcgatggcacccgcgccggtctgacgcagcagtttcggcgctgacctgctctttcaggacgtcgaacccgctggcccaggcaaacggcatcagcagctccacatgcagcgtaccgtcaagctgtgccacgtgatgtaacgccttcagggcggtgagattctgcttaagggtcggatgctcaaagcttctcaatacgccagctacgatggcgcgcaggccttctggcgtctgcggttcccgggattgtgctgtcatcccctactccttatttctgctgtgcttacgctgtgtttcagcgatgtattgtcaatgatatcagatgcccgtggatctgcggtgaccgtagggggtgaatcccttgtgtttacgcaggagaagccttcagttaccatctaagcccgttttttcaatcaacagaaagctacgcaaactatgactcaagtcgctaaaaaaattctggtaacgtgcgcactgccttacgcgaacggatcaatccatctcggccatatgctcgagcatatccaggccgacatttgggtgcgttatcagcgaatgcgtggcaatcaggtttatttcatctgcgccgatgatgcgcacggtacgcctatcatgctgaaagctcagcagttagggattgcaccggagcagatgattgcagaaatgaaaagcgagcatgaagccgactttgccggtttcaacgtcagctatgacaactatcactcgacccacggcgacgaaaaccgtgagctttctgcgctgatttatggtcgtctgaaagagaacggttttattaaaaaccgcaccatctcccagctttacgatccggaaaaagggatgttcctgccggaccgttttgtaaaaggcacctgcccgaaatgtaaatctgccgatcagtatggcgataactgcgaagtgtgtggcgcgacctacagcccgaccgagctgatcgagccaaaatcggtggtctctggcgcgacgccggttctgcgcgactctgaacacttcttctttgatctgccatccttcagcgccatgctgcaggcctggacccgctcgggtgcgctgcaggatcaggtggcgaacaaaatgcaggagtggttcgaatcgggcctgcagcagtgggatatctcccgcgacgcgccttacttcggctttgaaattccggacgcgccaggcaaatatttttatgtctggctggatgcgcctatcggctacatgggctcgttcaagaacctgtgcgacaagcacggcgacatcgacttcgacgaattctggcgtaaagactctactaccgagctctatcacttcatcggtaaagatatcgtctacttccacagcctgttctggccagcgatgctggaaggcagtaacttccgcaagccgaacaacctgtttgtgcacggctatgtcaccgtcaacggtgccaagatgtcgaagtcgcgcggcacctttattaaagccagcacctggctgcagcatcttgatgcggacagcctgcgttactactacgcggcgaaactctcttcacgtatcgacgatatcgacctgaatctggaagatttcgtccagcgcgtaaacgccgacatcgtcaacaaagtggttaacctggcgtcacgtaacgcgggctttatcaccaaacgctttgacggcaaactggcggctgagctggccgatccggcgctctatcagacctttgtggacgcgtcagagaagattggtgaagcctgggccggtcgtgaatacagccgtgctattcgtgagatcatggcgctggctgacctggcgaaccgttatgtcgatgagcaggctccgtgggtggtggcgaagcaggaaggccgtgatgccgatctgcaggcgatctgctcaatgggcattaacctgttccgcattctgatgacctggctgaagccggtgctgccgtcactgagcgcccgcgcagaaggcttcctgaactgcgaactgagctgggatgctatcgcgcaaccgctgctggaccaccaggttgcgccattcaaagcgctttacagccgcattgagatggcaaaggttgaaggactgattgaggcctcgaaagaggatgccgctgccgcaagtgcaccggccgcaagcggcccgctggcagattcgccggtaggtgacaccatcaccatcgacgatttcgccaaagttgatatgcgcgtggcgctgattgagcaggcggaactggttgagggttcggacaagctgctgcgcctgcagctcgacctgggcggtgaaaagcgtcagatcttctcgggtatccgcgccgcctatcccgatccctctgtgctggtcggtaaaatgaccattatcgtggccaacctcgcgccgcgtaaaatgcgttttgggatctctgaaggcatggtgctgtcagcgggtcctggcggcaaagatctgtttgtgctgtccgtcgacagcggtgctgtaccgggaatgcccgttaagtaacactctgcattctgcggctttaaccgcttagcgcagtgccgtttctcaaacccttcgtgcctcatcacgggcgcgaagggttatcactcctcgctctgaatgtgcaccgcttccattccactcccgcccctgaaaaactgtatctgctgcggccacaccgctgcataaatgtgatcgctagcacgctaagcggttaatgcgtatgatgaagctcagtgaaaacaggagcctgccatgctcaccgtgctgtctgtctgcgggcgctatcttcgcgcctttatcatcatttatctctgcttatacgccggaatcggcatcgcctcgctgctgcccatcaaactgcctggcagcatccttgggatgttaattctgtttgccctgctcgcctcgcagatcctgccggtcagctgggttaaaccgggctgccatctgctgattcgctttatggcgctgctgtttgtgccaatcagcgtcggggtaatgagctacaccgatattctgaccgcgcagtttggccctatcgtgatctcctgcgtcgtcagcactttcctggttctctctattgtcggcgtaagcgcccaccagcttcatagtcgccgtccggccggggagtcaggcgatgagtgaaatatggtggtcactgccactgaccctggcggcattttttctggcgcgcaaactggcgatacggctgaaaatctcgctgcttaatccgctgctggtcgcgatggcgattattatcccgattctgctgctgttgcagctgccctattcgcgctatttcgcgggcagtcagattcttaatcagctgctgcaaccggctgttgtcgcgctggcactgccgctgtatgagcagatgcatcagatccgtgcccgctggaaatcgattattggcgtctgctttatcggcagtgtgaccgccatgacctctggcaccgctattgctctgtggatgggtgccacgcctgaaatcgccgcgaccatcattcctaaatccgttaccacgcccattgcgatggccgtctccggttcgctgcacggcattcccgccatcagcgccatctgcgtgctgattgccggggtactgggggcggtgttcggacataccgtgctgaatctgcttggcgtgaaatctaaagcagcgcgcggactggcgataggtaacgcgtcgcacgccctcggcacagcacgcgccgctgaactcgactatcaggaaggggcattcagttcactggcgttggtgatctgcggcatcatcacctcactgctggcgccgtttatttttccgctgctgctgcactggtttggctgaaagtttgcgagagatctcgcaaagttgaaacatgcaacacaggttacattgtcagagcgatgtggatcacatataaaccggtgactggcacatcgccctgctgaatctaatgaggctcacatgcaatcccgtttcctctctgcctttgaggcattgccgtcaacgctgcaaaccgcactcgctccgctgctggacgatcctggctttcaggcggtgctgagcgccgaccaggtcgcctcactgcagcaacagacacagatggatgccgatgctctggcgctggcgctgctgcccctggcggcggcctgtgccgttgctaccgtgtcgcattttaacgtcggggctatcgcccgtggcgtcagcggcaactggtacttcggggccaacatggaatttatcggtacgcctttgcagcagacggttcacgccgagcagagcgccattactcatgcgtggctgcgtggcgaaagtcagcttgagacgatcaccgttaactacacgccgtgcggtcactgccgtcagtttatgaacgagctgaacagcggcacgaacattcgcatcagcctgccacaacgcgcgatcagcaccctggccgattatctgccggatgcctttggaccgcgcgatctggacatcacgaccttcctgatggacagcgtggatcacggctatctagccgaaggcgatgaactggtgcaggccgcagttgccgctgccaatgccagccacgcgccttacagccagtcacacgccggtgttgcgctgctgaccgcaaccggctcgattgtcaccgggcgctatgcggaaaatgccgcctttaacccgagtttcccgccccttcaggcggcgctggtcctgctgaacatgcagggtggcgatgttcgtcagataaaaaaagcggtattagccgaagtggaaaatgccacgctaagccagtttcgccgccacacaggcgacgcttaagacatttggttgcggtgagctgctgcaggtgacgctgaacaaagcataacccgctgtcagagaggccacagttttgtgagcttttatgaacaaacgctgtacttctgcgggaaatttcataggatctggcgccagaattcacgtcattacaaattactctgaataattcaggttgcaggatggcagcacggtcgtgaatgtttctgcagcggttaccctgccgctgccaggcctgcagtctgagctataacgggtaagaaaactggcgctacctttccggcgtgacgccagacaacactgcaaccggagcattaccgcatggaactcgactacgaaagtaaacgcccgctgtatatcccttatgctggcccgattttgctggaatttcccctgctgaacaaaggcagcgcctttagtatcgaagaacgtaacgaattcaacctcaacggtctgctgccagaagcagtggaatcgattgaagagcaggcgcagcgtgcctggcgtcagttccaggacttcaaaaacaataacgataagcatgtctacctgcgtaacattcaggacaccaacgaaacgctgttctaccgcctgctggataaccatctcgaagagatgatgcccatcatctacaccccgaccgtcggcgcagcctgcgaacacttctctgaaatctaccgtcgtgcgcgtggcgtgttcatctcctaccctaaccgcgaccatatcgaagatatgctgcaaaacgccaccaagcagaatgtgaaggtgattgtggtgactgatggcgagcgtattctgggcctcggcgatcagggcatcggtggtatgggtatcccgattggtaagctttcactctacaccgcctgtggcggcatcagtccggcttacaccctgccggtggtgctggatgttggtaccaacaaccagcagttgctgaacgatccgctctatatgggctggcgtcatccgcgcatcactggcgaagagtatgatgcgttcgtgaacgattttattcaggccgttaaacgccgctggccgaaagtgctgttgcagtttgaagatttcgcccagaagaatgccatgccgctgctgaaccgctatcgcgatgaagtctgctgctttaatgatgatattcagggcactgccgccgtgaccgtgggtacgctgattgccgccagccgcgccgccggcagccgcctgtgcgaccagaaagtggtgttcctgggcgccggttccgcgggttgtggtatcgctgaacagatcatcgcacagatgaaatccgaaggtctgagtgacgaggaagcgcgtggccgcgtaatgatggtggatcgctttggtctgctcactgacaagctgcctaacctgctcgatttccagagcaagctggtgcagaagagcgaaaacctgcagcagtgggatgtcaccaatgattccatctcgctgctggacgtggtgcgcaatgcgcagcccgatattctgattggtgtctctggccagccgggcctgttcaccgaagagatcatccgcgagatgcacaagcactgtaagcgccctattgtgatgccactgtctaacccgacatcacgcgtggaagcgacgccagccgatatcatcgcctggactgacggtgccgcactggtcgcaaccggcagtccgtttctcgccggtgagctggaacggtaaaacctatccgattgcgcagtgcaacaactcctacatcttcccgggcattggtctgggtgtgattgcttcgggtgccagccgcgttaccgataccatgctgatgaccgccagccgcgcgctcgctgactgctctccgctggtgaatgaaggtgaaggcccggtgctgccagagattaaagatatccagggtgtatcgaaaatcattgcgatggaagtcggtaaagctgctcagctggcgggtgtcgccgtggtgacctctgaagatgtgttgtcacaggctatcgccaacaacttctggctgccgcagtaccgtcattatcgtcgtacctcgatttaatcttcagactgccggattgcatccgatccggcagtgttcaaaaagagcacagccagccggcagtaacttgcttcacagtgacagctcaagtagccttgtcccatctcactattctgacatcgagtctccaggcgcatgctgaaacgcgttttcattggtctgcttttcatcatcttactgatgatggcaacggcgctcggccttgatcgctggatcagctggaaaactgcgccctttatctacgaaaatgtcgcctctttgccacatcgtcaggtcggtgtggtactgggtacggcgaaatattatcgcaccggcgtcatcaatcagtattacctctatcgtatgcagggcgcgctgaatgcctacaacagcggcaaggtcaattatctgctgttaagcggtgataacgcgctgcaaagctataacgagccgatgacgatgcgccgcgatctcatcaaagccggtgtcgatccggctgatatcgtgctggactatgccggtttccgcacgctggattcgattgtgcgcacccgcaaagtgtttgataccaacgacttcattattatcacgcagcgtttccattgtgagcgtgccctgtttatcgccttacagctgggtattcaggcgcagtgttatgcggtgccctcaccgaagaacatgcttagcgtgcgcttccgtgaggtaggtgcccggctgggcgcgctggtggatctcttcctgctaaagcgcgaaccccgcttcctgggcccactggtgccgatccccgccgtacgcgatgtccctgaagatgcgcagagttacccggcagtgacgccggagcaactgctggagctggaacaaaagctgcggaaatagctcacgcgctgcggcttctttatgctggttactgctatgtcgaggtctggcagtaacgtgcagggctctaggagctgacggtaatatgctggctcagggagcatacgtttagtcgccgtctgttactatgcagcgatcattaagctgattaattacatgactacggtagataattcagtgctacttcccctctgaaagccgacttagactgctgagaaatctgaagagggtgaatcttataacaatgaataagctcaacgcgcagggatcacggtcagaagaggaaagcgtcccacgccagggatggcgtgggccgagcgtgtcatggatgacggcttttgcgactttccgatctgaccgtgttccctacgcatactcgatctcacagcaacgaccccagcactctccgctataaaaagcgttctgcggaggaatgacacgggcagatcatttactggccttagcgactttccgatctgaccgtgttccctacgcatactcgatctcacagcaacgaccccagcactctccgctataaaaagcgttctgcggaggaatgacacgggcagatcatttactggccttagcgactttccgatctgaccgtgttcccttcgcatactcgatctcacagcaacacccaccacttccacataataaaaaagcgacccgaaggtcgctttatgagcactgaagaagacttacttcttacgagaatatttcagggaatccagcgccacggcgaagatgatgatgccgcctttaatgatgtactgccagtaagggttaacgccgatataggtcagaccatagttgatgacggtgaagatcaacacaccggtcactacgcccgccacgctacccacaccaccggcgaaggagacaccgccgaccacacaggccgcaatcgcatccagctcatacataaagccaaggttgttggtggccgaaaccgatacgacccgcttccagcatcccgccgaaggcatagaacacacctgacagggcataaatcatgatcaggttcaggttgacgttaacgcctgagactttcgccgcttccgggttaccgccgatagcaaaaatgttcttgccgaaacgggttttattccacagcacccagacgaaaataatggcaatcacggcgtaaaaggtgatgaacgaaagcttgaaatcaccaaagcgtaagaagccctgggtaaatttcgagaaccctgtatcaaaaccggcaatcggtgatgcgccaacaaagtcgtaatagagtgagttgataccgtaaacgatgatcatggtgcccagcgtggtgataaatggcgttaccttgaggtaagcaataatcacaccgttgaccagaccaatcacgccgccgatgatgcacacggtcagaataaccagtggaatcggcaccgtatccagcgtcgggaagactttgttcgcgttatccatcgcctgcagcagcgtcgcggcgaccaccgccgccagaccgacctgacgtccggctgacaggtcagtaccctgcgtcacaatcagacccgccacacccagtgcaataataatgcgcaccgaagattgggtcagaatattactcaggttcattaaacttaaaaatgaggggtcctggaaaataataatagccagcaataccagcagcacgacataaatgccgccctcttttaaccaggttagcgcattcttttttgtagtcgctttcatgttaacagcccttgcttcattaaaggtgtaatgacgctaaacgcaatatttcgttctgcgtggtcgttttggtatcaactatgcctgctaccagaccattactcattaccagaatacgatcggtaatgcctaacagctccggcatttcggatgagataataatgatgcccttttctcttttcgccagctcagcaattaactggtaaatttcgaattttgcaccaacatcaataccgcgagtgggttcatcaagcatcaggatttcaggctgggtcaataaccagcggccaataatcactttttgctggttaccgcccgaaagcgaaccaatctgagtatggtggcctggcgtttttacacgcatagaatcgatcacccattgggtatcactcttcatgcgtttattatccagcagtcccatactgtttttatattttttgatattggaaataagcgagttaaaaccaatgtcgaggaaagcataaataccggttgagcgacgctcttcagtcaccagcgcaaaaccgtggttaatggcttcattggcgctgtgattattaatcggtttgccatgcagtttaatggtgccgcccgatttttcgcgaatgccaaacagcgtttcgacgatatcggtacgtttggcgcccaccagcccggcaatgccgagtatctcccctttacgcaaatcaaatgagatgtcgcgaatcgatggctgacgcagtgacgtcagatgacgcacctcaagaatcgtctcgcctggcacgttggtacggtcagggaaacgctggttcagtgaaacggccgaccatcatggagatgatcttatccatatccagcccttccagcggctgagaggtgatccactgaccatcacgcaggatagtgatctcatcacacagctggaaaatctcttccattttgtgcgaaatataaacaatgccacagccgcgatctttcagcttacgaataatcgtgaacaggtgattaacctctttctcggttaacgaggaggtcggctcatccataatcacaattttcgcgtcgtaggaaaacgctttggcaatttcaatcatctgcatctgcgatacagaaagattggcaactttatcgcgcggatcgatatcaatatccagctcgtcaaaaatcgctttggtatcccggtacattttatcctgatcgacaaagaagcctttgcgcggataacgcccaagccacatattgtccatcacggtacgctgcaggaccagatttaattcctgatgcaccatcgacacgccattttccagcgcctctttggaacttttatagtcgatctctttaccctgaaacaggatactgccggtatcttttttataaataccaaacaggcattttaataaggtggatttcccggcaccgttctcgcccattaatgcatgaacagagtgaggccgcacttttaaattcacattatctaacgctttaacgccgggaaatgattttgagacatccgtcatttccagcagatattctcgctgcgcggtcgtattatcactggccatattttacctggctaaaaaacggtggtgacataaaaaaggcgcgacagcggtcgcgcccgtaatcgatcttatttcacgaactgagacagattttctttatcaaccggcacgtaaggaacgcggacgatcttatcaaccatcttgaagtttgttccgtcggtggcggctttgccgttagccagattgttggcaatatccagcgttgctttcgcctggttttccgcatcgttcagcacggtaccggccagcgcaccggatttcaccagcgccagcgcttctggcagtgcatcgacgccgaagaccgggattgaggtcatgttgtgcgctttcagcgcttcaaccgcacccatcgccatcgcatcgttgttggcaatcaccacttcgatttttttggcattcgggcctgacagccacgcatccatcttatctttggcctgcgcggtatcccacattgcagtatccatcgctaactgctgggttttcagaccatctttgttcagggtatcgatcacatatttggtacgggcttctgcatcaggatggcccggctcgcctttcagcagcacgaaactgaatctgaccatctttgttcagatcccacgcgggtgtggctttccagtgcttctcaatcagctgaccctgaatgatgcctgactctttagagtcggtaccgacatagtaagctttgtcataaccggccagcactttggcgttaggttctttgttgaagaagaccaccggcacgtcgttggcacgcgctttgtctactaccaccgcagccgcagccgggtcaaccaggttaatcgccagcgctttcacgccttttgccatcagcacgtcaatctgatcgttctgtttggactggtcattctgtgaatcattcatcagcaactgcacgccaccgatcgctttcgcttctttctcgatgtctttgcgcaccattgacatgaagttgtcatcatatttgtaaatggtcacgccgatacgggtgtcagctgcgtgagcggttgcaccaaacatcatgctggcaaccagtgctgtaagcgtgaaaaccttcttattcatggtatctccggttttattatgcagggtctttttagcgctaccgcgccatacaggcgggagagcaatcggtaaaacagatcggcgcgtcggttaacgtaatgagaatgttaagccattgaacaccgtctaaaacctgacttccctgtgacagaatgcttccatgaagagggtataaaccctttaaccggctactgagaccacaactgatgccgttacactggcgttacataatgtttcagtccggtaagacgctgccatcatagtgagagcaatgttaattaactgtgaatgtaatcacagattgaaaacggttacatggctgaatcgcctgaattagtgacggactccacattttgccgctgcgccaccgaatgacgccgcaccagcgttggcataaagatgtgcgttgccgtgtcatccagcagtccggctgcgccctgcagcgccagttcagtggcgatttttgccatagatacaatgggatagcgcacagtggttaactgtggatcggtgtaacgggaaatggggatatcatcaaagccaatgacagaaaaatgctgtggcacctggatgccgttgtctttcagcgcagtgagtgcaccagccgccatgccgtcgttataggcaaacaccgcactgaggttgagattgcgtcccagcagctccaccatcgccgcttcgccgccctgcatatcgggctctgcgctggctatccagctctcctggggccggatgccctgctctgccatcgcctgaatccacccttcacggcgctgcgccacatcttcgatgggatggcttgaacaaaggtagccaatgcggctatgcccctgctgtagcagggtttcgtgaagccatcaacgcacccgtgacgttatccagactgacactgcggtgttcaaatccgggcacgatgcggttaatcaccaccatgcccggaacgtggcgcataaaatccgccagctcagcgtcaggcagtgttttcgcgtgtaccaccagggcgctgcaacgctgacgaatcagcacttcaatggcatgacgctctttctcttcctgatgccaggagttgctgattaacacatgtttgtgcacgcgctgcgccacggtatccaccgctttaaccagtgcaccgaagaagggatccgaaacatccatcaccaccacaccaatggtgtcactgacctgcgtcgccagcgcctgcgcattggcgttggggcgatagcccagcgcttccaccgcctgtaacacggcgtcgcgggtgtcagaggtgacggcgctgctctgattgaggacgcgcgacacggtcgccaccgacacgccagcctgacgggcaacatcacgaattgttatcatgcagcagttccacaaaggaaaaataaggcatcacgccgggttgaacaccggcgctattttgtcaggggcaggaggcgtacagcgtgaattgcgtcacatcaatgaaaacggttacatacaattctgtaacctttgtgatggcggtcattatctggcgttgtcagtgatgcgcgatttaccggctgagatcagcgtgagccgccgccacagccactccagcggaccctgtgcgaagaaatgtaaccagatgagtgaaaacaggatattgataagccagaccgcaggcaccatcagcaccagctccagccgggtgaagtgcatatagaagccgaagcgatagaacagcgtggtgcagatcagcgactgcagcagatagttggtcagcgccatgcggcccacgcactgaatggcatagctgatgcgccagcgcgctatctgcggccagtaagccagacagagcgcggcatagcccaggctaatcagcgggctggcgagatcgcgcggggcttgcagataaaaagcggtccagcggaattcccaatgtaacagccattgcgctgccacaccggccaccgcaatcaacaaccccatcgtcagcagcagcgccgccgcctgacggtaatgttgcgctgaaaactcgccgatcagccagccactgcgcagcagtgcgccaccaatcatcatcaggcccgccagctgccagccatactgcgccgccagcgccatcagtcctgacgagagatgatccagccggttctgtatcgcttcccagccgccggtcagtttccagtactgttcatattgcagatcggcagcacctggcagccaggatcgggtcggttcaggatcggagattgacccaaacaccagcagaacgccacagcccaccagatagagcagaatgccggtattcatcaggctgcgggtggaagggacatcgcgcaacacccgccagaccaccagtccgataatgccgtagtccagcaggatatcgccctcccagagaaagacgccgtgcagaaaaccgatcagcaccagcagtgagagccgggcagtcagccagcgactgccgcgtggcagctgcatttgcagacctgcgccaaacagcagcgcaaacagggtgaggaatttgagctgggcaaaggcgtcagagatcgcccatgtccagacatcggacaggctgacgctgccctgccaggccggattaaggtaggcggcagaaggcaggccaaagccgacaatattgagcagcagaatgccgagaatggcacatccacgaatgaaatccagcgcgtgatagcgttgcatgcggcacctgcaccattgaggcgggcaacgttatgcgcccgccgtagactcaactatggcgcaccgcgcgcaaaaattcctggcgggtattctggctggacttgaacaggccgcccagagaggtcgtcgtggtggcgctggtggcatcttttacgccacgcgctttcacgcagtaatgcaccgcatcaatagaaacagccacattgttggtgcccagcagcgtctgcagtgcgaccagaaacctgctgcgtcagacgctcctgcacctgcgggcgctgggcgaagaactgcacgatacggttgattttcgacaggccaatcaccttttctttgggaatgtaggcgacggtcgctttgccatcgatgatcacaaagtggtgttcacaggtgctggtcagcgtgatatcacgcacggtcaccatctcatcaaccttcattttattctcaatgacggtgattttcgggaagttggcgtagtcgagaccggaaaagacttcatccacatacattttggcgatgcgatgcggcgtttccatcaggctgtcatcttcaagatccagattcagcagctgcataatctcggtcatgtgcccggcaatcagacttttacgtgtgttgtcatctatatcgcgcgtcggtgcacgtaacggcgtttccagtccacgcgccagcagcgcttcgtgaaccagggcagcttcctgacttagggtgctcatcttactcttctccggctggtgttgcgcccgccagcttttgccagcgggccctgtaatcaggcgcgtattgtgaaactttctttgcggggaatccagcaatcaatcagattggtgatgaaagcttttcacccggttcgccgccacaccagcaggccggcccagaccaggctaacccctgcaacccacagggcaggctccagccgatgtaacagggctgtggagagaaaagagagcagcgggccgaccagctgcccgatagcatagccggtggtcagcaggccagccatgtagcgcagatgattgggtgccagctcacgggcgcagagcagcgacagctgcaccacgctgaggaaaccgccccccaccagcagcgcaccggccagcagaccgctaaagcctggcagcagcgccgcggcaaatacgcccagcgcctgcgcccacagcaccagtgccaggcggacgtggctgtgcccccagcgtcgcgtcaggatccccagcaggatgccgatcatcgccgcgccgccaaaaatcggccagacaaactgcgcgaagatgccgtcaggaaaccgcgtggcggccatctgcgacaaaaaggtggcgggcagaatgtagccaaagcccgccagactgtaactcagtaccagccgtttaaggttgcgatccagcaccagcggctcgggtgcctgatccgggcgatgcagttcgccccgacgcggcagattacgggtaatcagcgcaatcagcagcagcgccagcgcaccataagcggcccaggccagaccggcagaaacctgcaatgtgtgcagcgctacccccagcagaccgctgacaaaaatgccgcagcctggcccggcaaaaacggccgctgacagccctgcccggccatggcgatgtagctgttcattgctccaggccgccaccagcaccatcgcccagccgctggcccagccaatcagaaagcggattgcgccgtgcagccacggtccgctggccaatgctgagagcagggtcaggatcaccgcgccccatacgcccgcctgcaatcgcagctcaacccgccggtgcgcgcgcatggcatcaaatgagccacacagatagccaagatagttaagtgccgcgaccaggctggcactggtgagtgtcagctggtgtgcctgaatcatcagcggcacctggggcgtaaaggcaaaccggccaatgcccatcgcgacaaataaggttaaaaacgcgctgagcgcgacgcgtaacgccattgctgaactcctgttgttctgccctgagatctcttctgacttgctaacagcatgcaggatgattaaactcacggaaagtgaataatattaaccaacttgcttacaggaagagaagatatggatttagttcagctgcgtatgttctgttccgtcgccgaaacgggttcactggcgcgcgcagcagaaacagctgcatcgcgtcccctctaatctcaccacgcggctgcgccagctggaagaagaattaggtgtggatctctttattcgtgagaaacagcgcattcgcctgtcaccaatgggccataattttctgaattatgcgcagcgtatcctggcattaagtgaagaagcgatgagcatgacccgcaccggtgaaccggcgggcaactttgcgctgggctcaatggagagcaccgcggcgacgcgtctgcccggcctgctcgccgcctatcaccagcgcttccccaaagtggcgctatcgctgattaccggcacctcgggcgaaatcatcgatcgggtgcgtgaaggcaccctggcggccgcgctggtggatggcccggtctcccatgacgatctcaatggctgcatcgcctttcgcgaagagatgatactgatcaccggcctcgatcatgcgccaatcgccaccgcgcgcgacgtgcaggacgataccctgtttgcctttcgcaacagctgctcttaccgggtgaagctggagagctggtatcgggacagccagaccgcgcccaacagtgtgatggagattcagtcctatcacgccatgctggcctgcgtggcaggcggtgcgggcgtagcgatgatcccggcctcggtgctgaagcagatggcggatcggacacgggtgcaggcgcatacgttacctcccgcttatcgcgacaccgccacctggctgatgtggcgacgcgacgcctttacgccgaatgttgaagcactgaagtacctgattattgaacaatttgacgatcgtccgctcaacgatgagctgatttacccattacaggcggcggaataagcgttccacgctatgtttaagagcctgacccaccaggctttgaattatcacgaccacccggcgccactgcgcgtcacaatctgactggaagagggattgcatgaatatgatcaaaacccgtgccgctgttgcctgggctgctggcgaaccgctgaaaatcgaagaagttgatttaatgccaccgcagaaaggtgaagtgctggtgcgtatcgtcgcgaccggcgtctgtcataccgacgcctacaccctgtccggcaccgacccggaaggcgttttcccggcgattcttggccatgaaggcggcggcatcgtcgaagccgtgggcgaaggcgtgaccagcgttgaagtgggtgaccacgtcattccgctctacaccccggagtgtggcaaatgtaaatattgtctttcaggcaaaaccaacctctgccaggcgatccgcaccacgcagggtaaaggcctgatgccggatggcaccacccgcttctttaaagatggcaaacccattttccactatatgggcacctcaactttctctgagtacacggtaatcccggagatctcgctggcgaaaatcagtaaagaagcgccgctggaagaggtttgtctgctgggctgtggcgtgaccactggcatgggcgcggtgatgaacaccgccaaagtgaaagaaggcgacaccgtggcgattttcggtctcggcggcattggcctctctgcggtcatcggcgcgaaaatggcgaaagcgggccgcatcattgccatcgaccttaacaccagcaaattcgatctggcacgcaaactgggtgccaccgatctgatcaacccgaaagattacgacaagccgattcaggatgtgattgtcgagctgaccgacggcggcgtggatttctcgtttgaatgtattggtaacgtcaacgtgatgcgttccgcgctcgagtgctgccacaaaggctggggcgagtccgtgattatcggcgtcgccggtgctggtgaagagatctccacccgtccgttccagctggtgaccggtcgcgtctggcgcggttccgcgtttggcggcgtaaaaggccgttcgcagctgcctggcattgtgcaggattacctcgacggtaaatttgcgctgaacgacttcatcactcacaccatgccgctggaagagatcaacgacgcctttgatttgatgcacgaaggaaaatcgattcgctcggtcgtgcattttaacaagtaatcaggaggcgttatggcatccactctggagctactggaagaacaccgtatttttggcggctggcagcagcgctggcgtcatcagtctttgctgctgaactgcccgatgaccttcagcatctatctgcctgggccgcacggtgatgcgccgccgccggtggtctggtttctggccgggctaacctgcaacgatgagaacttcaccagcaaagccggcgcacagcgggttgcagcggaactgggtctggtgctgattatgccggataccagcccgcgcggcgaaggggttgcgaatgatgaaggatacgatctgggtcagggcgcgggattttatctcaatgccacccaacagccctgggccagccatttccgcatgttcgattatctgagcagcgagttacccgccctgattgcggataacttcaaggtcagtgaacgtcagtcgattatgggtcactccatgggcggacatggcgcactgatgctggcgctgcgtctgggtaaccgctttgcctcggcttccgcttttgcaccgattgtgaatccgatgcaggtaccctggggccagaaagcgtttcaggcctatctgggcgacgatcgtgcaacgtggcgggaatatgacagctgccagctgatggcggaggtgtcacatcggctgccaatgctgatcgatcagggcgacagcgatcagttcctggccgatcagctgcaaccggagcggttagaagacgtcgcgaatgaggtgggtttcccgctgacgctgcgcattcagccgggttatgaccatagctacttctttatagccagctttgtggaagatcatctgcgcttccatgcgcagcatctgctggcgtaaacaatcagggccgcaatcgcggccctgaacttttatgcctgctctgctggctaacgctctgtcacagagccagcgtcctgccagcctgccctgtaaaaattcctttctcagaacagtgatgctcagcgccctaccgggcgcctcctcaatatcagaccagtgccgggccggtcagcccgtcgatcatcacctgcgggataccacgcgagcagtgttcgatacgaccatcgacgccatacacttttgccagagtggcaggcgtgatcaccttatccggctgcccttccgccaccagcgcgccctgcttcagcatcagcgcatgttgcgcatgacgcagtgcaatattgatgtcatgcaccactaccaccgtcacgatgttacgctgagcggtttcgcgccgcaccaggtccattacgtgaaactggtagttgagatccagcgcgctcagcggttcatccagcagcagcagcttagggcgacggatcagtgactgcgccagcccgaccagctgcttctgtccgccggagagctgatcgagatatcgcatcgccagatgggcaatgcccagctgctccagcagatgcatgatttccgcttcgctgctggcgctgtgcagaccaccggaggcacgctgcgccacgatgatcgactccagcacatgcagatgcacgcccgcaggcagcgactgcggcagatagaccacgttcttcgcacgccgggcaaacggctgggtcatgagatcctcaccgttgagccacatctcgccctggcctttattcagaccggccagtgcacgcagcagcgtcgatttaccacagccattcggccccaacagcacggtgatctcgccgcgcggcagcggcgcgatattaagattatcaatgactttattttttgggtacccggcactgaagccgcgtaacgtcagaccctgttccatcataccgtcccccgatgacgcagaataatactcaggaagaaacggcacgccaatcagtgaggtgacaatgccaaccgggatgattacaccagggagcaggtttttcgaggcgaccgacgccagcgacagcaccagcgcgccgaccagcgcactggcgggcagatagaaacggtgatcttcaccaaacatcatgcgggcgatatggggagcgaccagcccaatgaaaccgatcgggccgacaaacgcgaccgccagggcagagaggatactgatgcgcagtaacgtagtcaggcgcagacgacgcacatcaatgccaaagcttaccgcgcggtcttcgcccagacgcagcgccgtcagcttccagctgctcatcattgaaaacggtaccagaatggccagcgccacgctcagcacgcccagcttctcccaggaggcgcgcgccaggctacccatggtccagaacaccaggccctgcagggtatcttcgctggcgatgaactgcatcatggataccagagcgttaaaggtgaagaccagcgcgataccgaacagcaccacgcccgccgaagagacctgagtccagcgggtcacggcatccagcatcagcgcggcaaacagagcaaagacaaaggcgttggcagaaattaaccactgatcgggaatgccgggaatacccacgccgaggatgatggccagcgcggcaccaaacgccgccgccgatgagacaccgagggtaaacggactggccagcgggttattcaggatggtctgcatttctgcgcccgccagacccagcgacaggcccactaccagcgccatcagcgcatagggcagacgaatgtcccagacaatgacgcgcgtgccggcatcgacgctctcggggctgagcagcgtattccacagcgtttcaagtgagagtcccgccggacccagcgtgaagtcgaggatcagcgaggcgagtatcgccagcaacagcacgccaatccagattaagcggcggcgcagcacctgatgatagttctgcatggtgtggtgaagcgtctcttcccccgccagcagcgaagtttcggtagtcatgtttgaaccctgtgtggctatcacgtcagaaaacgcagccacaatagtgcaggtgataataattatcaattcgagaacataagcgagacgtgaaaaaacagtaaaaaacggtgttgcaggcaggagaaaagctcagggagcctgcgcctttcgcaaagacgcagaacccgccatccctggcgggctcagcgtgggcgataacgcagagttaatctttgtgaaccgggaactccatctcgctgtacttcacgaaacggctaccgcgcgtcagcttgtagccgaaccagataatcaggaacagcggaatgccgatgtaggttgccgccacgccgtaccagtcgatgctgtcgttgaggaatgcctggtagttctgacccagcgtgatgatcaggcagagcacaaaggcgaaaatcggacccagcgggaagaagccggaacggtaaggcagatcgttcaggttacgtccctgggccacatagccccgacggaagcgatagtgactgatggcaatacccagccaggcgataaacccggtcatgcctgaggtattcagcagccacagatagacttcctgattaccaaattttgaggtcaggaagcacagtccggccaccacggtggtggcccacagggcattacgcggcacgccgccctttgagagcttcgcgaaaatccgtggcgctttaccttcgctggccaggttataaagcatacgcgttgacgcatacatcccggagttacccgctgacagcacagccgtcaggatcaccgcattcatgacggcggcagcagagagcagaccggcgttctggaacaccagggtgaacgggctgacgctgatatcgtcgatatcattgtgcagcaactgcggatcggtgtatggcaggatcaggctgataatcaggatagcgaacacatagaacagcaggatacgccagaaaatctgccgcacagcgcgcggaatatttttcgccggatcttcagattcgcccgccgcgataccgatcagctcggtgccctggaaggagaatcccacaatcatcgccaccccgatcatcgccgcaaagccgcccgcaaacggcgcgtcgcccacctgccagttctgccagcccgcatgttcagcaccgcgcataatgccggtaatcatcagcacgccaacgatgataaagataatcacggtggccactttaatcagcgagaaccagtattccgcctcgccaaagccttttaccgaaatgtagttaagcaggaacatcagccccaggaacagcgcgctccagatccagccaggcgtgtcggggaaccagtagttcatcaccagctgggacgctaccaggtcaaccgcgatggtcaccgcccagttgtaccagtagttccagccgagtgcgaaaccaaagccctcttcgacatattttgcgccgtaggtggcgaaggaacccgataccggcatgaaggcagccagttcgccgaggctggtcatcaggaagtagaccatcaggccgatgaggatataggagagcagtgctccgccggggccagcctgagcgatggtggcaccggaggcgacaaacaggccggtaccaatggagccgccgatggcgatcatcgtcaggtgacgggcttttaacgcacgtcgtaatgcaggttgttgtgttgtatttgagtcattatgcatgtgttaacgctacgctgggtaaaaatgaggcgcgattgtagcagccagatcgcctctgtatagcgaatgccaacctgttattagttaacttcatgatcgcgccggaattattagtaattactcgcgacaataggaaaaaaaccgcgtcagtgctttggaaatatgcttctgccggtggtggatgcgatagagcgtgcggataagacgcggcagcggaatcgtcagttcaaccagcgtgcccgcctccagcagatcggcaatcacccggcgcgaaagacagctgatgcccataccgtgccgcaccgcatgcttgatcgcttcggaattgcccagctccatgcccagctgaaaactcggcagatgcgacagcagcagataatcgacaatttcacgggtgccggagccgcgtttcgcgcaggatccacggggcgtcagccagggtttgcagcgtcaccggctgttgcagaatcgccgcgtctggtgcggcaaacaccaccagctcatcttcgagccagggttcactgaccagctcggtcatatggcacggcccttcaatcaatccgacatcgacgcggaaatcggaaaccgcctgaatcacatcctgactgttgccgacactcagctccagcggcaggcggggaaaatcgcgacgataagcggccatcatgcctggcagcagatagttaccgatggtgctgctggcaaagatgcggatcgcaccgttatcctctttaaacagctgctcgatttcgcccgcctgctccagcagccctactgcacggggatagagcagccgtccatgctcattcagcaccagccgtttgccaacccggtcaaacagttgcactccgagctgactctccagatcggccagcgctgcactcactgcggactgcgacagtgccagcagttgcgaagcctgagtggtggaaccgctcttaagcacttcggtgaaaacttcaatttgtcgcagcgtaatgtgcatcgttgcctcttaactcagtgactgcctgaccaggtaaatgattaatgccagccagatcagccctatcgccaccagccagcctgcaatctttttgccgcgcgaacgttgagactgcgcccgctcgctgctgctgatgcgcacctcttgcggcagtaaacgcagcagcaccatgacgcccgtcggaataatcaccgcgtcatccagcagaccgacaaaggggatcacatcaggaatgatatcgatcgggctgatgccataggcgaccagccccagcatccccagcttgttccaccagggtgtgcggggatcacggaaggcaaaccccagcacaaacacatctcttttgatcagcgtcgcccagcggcgcagacgcgaaactatcatgattgctgccttatcgtttattctggttaattataaatatattatcaatttcacttttaagccagtcgccgtcatgatcgggtctcaaccaggaggagtgaccaccatgactgaactgagcatcgctaaaccgcatcatcccgttccgctctggatcccgggtctgctgctgaccgccgtgattgccggggcagccagctggctggcgcagcaaccgatgattgccgcgctggggctgggttcactgactctggcgattatgctgggcatcctggtcggtaacagcatctattcgccgctggcgtcacgctgcgacaacggcgtgctgctggctaagcagaaactgctgcggctggggatcatcctgtttggctttcgcatcactttacaacaaatcgctgacgtcggtttcagcggcatcctgattgatgcgctgaccctgaccagtaccttcctgataacctgcctgctgggcatgcggctgctgaagctggatcgcgataccgtctggctgataggtgcgggcagcagtatctgcggtgctgcggctgtactggcgaccgagccggtagtgaaagccgcaccgtcgaaagttgcggtggctatcgcgaccgtggtgctgttcggcacgctggcgatttttatctatccgctgctgtggccgctggcgcatgagctgttcccgggactgagtgcggcgcagttcgggatttttaccggctcaaccatccatgaagtggcgcaggtggtggccgccggacacagcatcagcccggaagccgagaacagcgcggtcattgccaaaatgctgcgggtaatgatgctggctccctttctgctctgcctgagcgccgtgatacgcggtaaacgtcaagggagcaacgcgcgccaggctgtgacatttccctggttcgccctgctgtttatcggtgttgcactgtttaactcgctgcagctgctgcctgccatggtggtggcgacgctgaatcagctggcgggtctgctgctggcgatggcgatggcggcgctgggattgaccacccgtttcggggcattgcgtgaggcaggcgttaaaccgctgctgctgggtgcgctggtgtttgtctggttaatcgcgggcggcggtgcaatcaatctgctggtgcaacatttcatgggctagcggcatcgggtatcatgccgtctcatccgtgcacagccccaggagaaaggcatgaaatatattggcgcacacgtgagtgcggcaggtggcgtggatcaggcagtgatccgcgcccatgaaatagaagccaccgccttcgcgctctttactaaaaatcaacgtcagtggaaggccgccccgctctcgactgaggtgattgatgcttttcgcgccgcctgcgagacgtacaaattcggtccgcagcaaatcctgccgcacgacagtttcctgataaacctgggtcatccggttgaagaggcgctggagaaatcccgcgcggcttttattgatgagctgcgacgtgccgaccagctcggcctgactttgctgaacttccatccgggcagtcatctgcatcagattgatgaggaggcctgtctgaagcggattgcggagtcgatcaacatcgccctcgatcagagccagaaacgtcaccgccgtcattgagaataccgccggtcagggcagtaatctgggtttccgcttcgagcatctcgccaccattattgagcatgttgaagataagtcgcgtgtcggtgtctgtattgatacctgccatgcgtttgctggtggctatgatctgcgtaccgaagcggattgcgaagcgaccttcgccgaatttgagcgcattgtcggctttaactatctgcgcggcatgcaccttaacgatgctaaaagtgccttcgacagtcgcgtcgaccgtcatcacagcctgggtgaaggcaatatcggcaaaacagcgtttagctggctgatgaaagatacgcggtttgatggcatcccgttgatcctggaaaccattaatcccgatatctggaaagatgagattgcctggctgaaagccgaacagcagggatagaaaagggagccagctggcttaatgctggtcagttaagattagatttgtaaaggctgtcacggtcaaacgtggcagcttttttgtcagtgcgagcgagccgcagtgcgggccagagcaggccggtggcgatcaggagcaggcaatccgcagcgctgaatagaatgagtctgccaggagagcccgcaggacgcgggcgaaaggcggggcggcacaggatgtgccatccccggcggtccgtcaggcagaggaatgaagtgaaggaaccgcgcagcggcgcgaggaccgccagcccctgagcggcaccagactgcgttatcacctgtcgcttaactggctggcatgctcccttttcgtttagagagtacgctggctcagggagcatacgccttccgtaaagacgcaaaaaaacgccatccctggcaggcgcagcgcgggcgattacgcacctcatccctgaggtgcgcccgtagccgggccaacgctttgcgttgttcaaaaacgctcccggctttttgtccatggcccgcgatgctttactccaggcgtatgctcccatcgctttgacttcgggaaccgtctgtaaaagcaaacagggagccatccggctccctgttattttcacttcagcagattatgcacttctgcaaatcaggctttcaccagctgctcttccggacgtttcagtaccgcatagctcagacccgcaatcgcggtgccgatgataatcgccatcagatagccgataaccggggtaatcgcgccagggatcagcagtacgaacagtccaccgtgcggagccatcagttttgcgccaattgccatggagatcgcgccggtggttgcaccgccaacgatacagcaaggcagaacacgcatcgggtcacgggcggcaaacggaatcgcgccttcagagataaagcaaagacccagaaccagtgctgctttaccaccttcctgctgacctttattgaatttacgacgggcaaccagcgtcgccagccccatcgccagcggtggcaccataccggctgccataatggctgccattggcgcataggtctgcgaactcagtaacccgacgccaaacgcgtaagccactttgtttaccggaccgcccatatcggtacacatcatgccgcccagaatggcacccagcaggaccgcattcgccgttcccatgttggccagccagtgcgtcaggccgttcatgatgccagcaaccggtttacccactacgtagatcatcagcagaccggtgatcagactggcgaacaggggaataatcagtatcggtttcagcgcttccatactctgcggcagtttaactttgccgctgatcagcttcgccgcataaccggcaataaagcccgcgataattccgcctaagaaacctgcgttaatgctggtggcgatcataccgccaatcagacccggcgtcagacccggacgatcagcgatggagaaggcgataaagcccgccagcaccggcaccatcagggcaaaggcgctgccaccaccaatttgcatcagcgccgcagccagcgtgccctgctctttaaatgccgtgataccaaaggcaaacgacagcgcgatgctcagaccacctgcgaccaccatcggcaacatgtaagaaacaccggtcagcaggtgacgataagcccctgctccgcctttcttctcttcttcactgctattgttctgtccgccagccgccgctttatacggcttcgcttctgctaccgctttatccagctcctgcgcggttttcttcagcgccagaccggttgaggtacggtacatcggcttaccggcaaatttcgccaggtcgacttcgatatcagctgcgacgatcaccagatcggcggcagcgacttcttccggagtgatcgcattaccggcacccactgaaccacgggtttcaactttcacccaccagccgcgacgggtcgcttcagcctgaatggcctcggcagccataaaggtgtgcgccacgccggtcggacaggcggtaaccgcgacgacgcgtttctgtgcaccagcctgagccggtgcagcaggtgcgcctgctgcaggtgttgctaccgcagccggagcctgccaggttttcgcttctgctttcgcgcggttcaggaaggtttctggctcacgtactgccagctggatatcgcccagccagaccgctttgccgttcagcgccgcatcgtccggcacgtttttgcccagcacaatcgccagctcagcgtcggcaggattatcagtcagggtcaggcccgccgcagcggcggcagccgccagacgttgttgcgccatatatgcggaagccagtcccagtgtagggtctttaatcagcagcgttttcattatcgctctcctgctgtcagttaacgggttgtaagtcgacgcgcgccatcattgcggccaactgagtacgatcggaaacgccaacattgctctggctgacggccatcgccgccacggcagtcgcaagacgcagcgtgtgttcgctggattcgcgcatcagcagtccataaatcaggccgccaaccattgagtcgcctgcacccacggtgctgaccacttcgcacaccggcggtttagcgatccattcaccagaagcgttgacccacagagcgccttctgcgcccagcgaaatcaccacatgggcgataccctgctcgcgcagtttcgtgcgcagcgccaatcacatcctgcagggttggcagtttgcgaccggcccagatttccagctcacgtcggttaggtttaaccagccacggtgccgccttcagtcctgccaccagcgcctcgcggctgctgtcaaagatgatgcatgggcagtgggtgcgaagttcggtcatccagcgggtaaaggcatcgtggtcgacgccctcaggcaggctaccgctgacgcagaccatatcgaactggcccagccaggtcagagaatcggtagtaaaacgatcccagtcctgcgccgtcacctgaaaaccggagaaattcagatcggtgacgtcaccggtctgttcagtgagtttaacgttgatacgggtacggccaggcacgacatggaaacggttggctatgcccagctcactgaacaactgctggaaaccgtcctgattctctttccccatgaagccaccgacggtgacatcgatacccagatccttaagtactttggctacgttgatgcccttgcccgcagcatgcagcccggtggttttcaccaggttaacttcgccacgttcaatttcaggggtataacccaccaggtcatacgccgggttcagcgtaatggtggcgacgcgtctgctcatgatgccccctcacccagaccactggtgatcgcttcttcaatcgcgttcagcgcctgctgtgcatcttcaccgctggcggtgaagcgcaggcgatgacctttcttcacgcccagcgcaaccactttcatcaggctgcggccattagcgggtttgccgctgccgtcgagattggtcacggtaatgtcgctgttgaactgcttgatcacgctaaccagcgccgtgcccggacgggcgtgcaggccgtgttcgttgcgaatggtaaattcagccgtcagcacgtcagcctgctcatcgacttcgctggtgagcagtgcgtaaacgcctgcagcatccgctttcaacagacgatccgctttgccctgctgcagcaatgcgctgaggtaacccagcacttccagcggacgttcatcggtcgccgaaacgctgattaacatcgcagccgattcgccctgatggtcgaaggcatgttcagcgcggctgatagccacgccgctgcgcaggttgccgaggctgctgtcgctgagccagatgccctgacccagattcagcggaggcgttgaaaccacgtctgcgacgtaactggcatccaccacaccagcggactgcagccgaccggcgttcatcgcctgtaaggtgatcagatcactggcagccacgttgagcgtgattaatgaggtgtcgaagctgaattcagcggcttgtttctcgcccatcagcaacgcacgaagatcttcagcagaggcggtttttagctgttctgcaatggtgtcatcgctcagcacatgggtcagctgacgcagcagcgccagatgttcatccgacttagcggcaatcccgatggcaacataggctgtctgatcgtcaccccaggcaatgccctgcggaaactggaaaacctgaacgccggttttcagcaccagatcgcgggtatcggtggtgccatgagggattgcgatgccgttgccaagaaaggttgaggtctgctgttcgcgcgccagcatgccgttgacgtatccttcggtcacattgcccgccgcggttaacgcggcagcaacctgacgaatggcctcttctttattctgggcgctggctccggtatggatggcctgcaattcgagctggaacataattctcctcgcttgctgagattgaatcgtttcagctagtgggaaagattttacgccatgctgaggaaaacagatggcgcagtcaccgctgaaacgtttcagggattgtggtacagccgctttcaccaggcaagaaaatgcgcaaatggcgtagcagatttttgacgttacgcacatttcgggcaggtttagcggattaacggacgaacaggctgacgctgctgctgtaaagtgagaatgagtggaccgaaaaacttcagcagcgtcagcgcctcagggcgcggtatccgcttcggtttacagcagatacgtttgcaattggtggatgcattctgcgcacgtcctgatgctgtactttcatgggatcgcgcagcggtagatgcaaccactgaaatcaaagcggcgctggctgctgccggaacgcccattggtcccaacgacaccgcgattgccgggcatgccattgcggccagggctattctggtgacaaataacacacgcgagttagaacgggtacccggattgcagctggaagagtgggtcagctaaccgctgacgcgggattaaatctaagcggtgggagggttctcaggcacgagtgctggcttcaagctcaatcaggtaggtcatggctgaggtacggtctgtaagacacatatcaactgaaggttgcagacttccgcatactttcggccttaaatctgaaccgaaaatcatgcacaaattttcatccgataactgaatgcagcggacattcgcgggtttaccctgcggcattccggggatggggctggagattgacggcgcgatgcagcaggcaccacaatcaatacgacactgcattaacacctctcacgcgaccttcaggatacaacagacagtaacagaacctcagagggagcgacacctcacccttcagctcttaacttcctgcttaaatcgttcactgtcacccatgtcagaaatcggtgaagaaatagcgcgcgctgtgcaacaggcaccgccctggctacggcattgcatgctgtgccccggcagagaaagtcgcggcgacaatagcagtccggggcggcaattgccatgaaagccgcggcctgagacaaaatttcacgccggtgatattgccagttttcatcggcgcgagtaacgttgcgcgcacttcactctcaagatagcgagaacagcaatgccaaaagccaatgaaatcaaaaaagggatggccgtcacgcacaacggtaaactgctgctggttaaagatattgatgtccagagccccagcgcacgcggtgccgccaccctgtataaaatgcgctttaccgatgttcgcaccggtttaaaagtggaagagcgctttaaaggcgacgagattattgatgcaatttcgctcagccgtcgcagcgtgaccttctcttatatagatggtgacgaatatatttttatggatgatgaggattataccccctactcctttaaacaggagcagattgaagaagagctgctgtttatccctgaaggcggtatccctggcattcacgtgctgacgatggaaggtcaggtgctggcgctggaactgccacaaaccgtggatatggagatcgtggatacttcaccaggcattaaaggtgcttctgccagcgctcgcaccaaacccgccggtatgagtacaggcctctcgattcaggtaccggaatacctcagcaacggtgaccgcatccgcatccacattgctgaacgccgctatatgggccgcgcagactaaatcagaagcctgctgccgatcgtgatagtgttatattattacattatcacgttattccccggcaggagtcacccccatgacacgcgttaatctgattaccggttttttgggcagcggcaaaaccacgctactctgccatctgctggctgccaggccgtccggggaaaactgggcggtgctggttaatgaatttggtgagatcgggatcgacggcgccctgctggccgatcgcggtgccacgctgaaagagatccccggcggctgcctgtgctgtgtgaatggcctgccgatgcaggtcgggctgaatatgctgctgaagagtaaacccgatcggctgctgatcgagccaaccggcctgggccatcctcgtcaggtgctggagatgttgagtgcgcccgtctatcagtcgtggctgcaactgaatgccacactgacgctgctggatgcgcgtcagctggccaatcctcgtatcgttgccaatgaaaacttccgcgatcagctggctgccgccgaccttattatcgctaataagcgcgactgctgggatcaggcggatcatcagcgactggctgactggcagcagcagatgcagcctgcgcgccctctgatagagacagaatttggtcagatccccctttccctgctggatacaccccggcagccgcgcgagcttcccgtgccgcagcaccatcattcgtcgggtcccaccagcggtctggcggcgttgcgactgaatggcgaggcgcgctggcgtcgggcgctgaaccacggacagggctatagcgcctgcggctggctgtttgatggtgatacgctgttcgacagcggcatgctgctggaatgggttcggcaggcgccggtagatcgcgttaaaggagtgatgcgcacgaaagaaggcgctctgcgcatcaatcgccaggcaaatgagctgcagagtgaaacactcccctcaccgccatccgatagccgcattgagatcattcattctcaacaggctgactggaatcgactacaatcggcattgttgaagtgccgtttacgctgacagaggtattgtcggcggttatttttaataataatgagtttaactatgcgcgtaactcgccttattactatcctgctgcttaatgcactgggcgtggtgctatttctgtcatggtatctgcccccggaacatggcttctggttcggcgtcgataaatctattttctttggcttcaatagccagatggtgacccatccgctgttcgcgctgatcgtcgctatcacgaattaccgtggttttgatgcggtgtcattgctggcgatgggtctgctttacctgtcgatctggcggcgcgaaacgccacaggcgcagcgccggatgctggcaatcggcatcaccatgctgctgaccgccgtcgtttctcaatcagctgggccatttattgccggttaaacactccagtccgacactgttcttcgagaacgtgcatcgcgtcagtgaactgaccggtattcccgcaaaagatgcttcaaaagatagcttccccggcgaccacggtatgatgctgatcattttcgcctgctttatctggcgttattttggtttcagccgctttttaattgccacggctattgtggtgatattttcactgccacgcatcatggccggtgcgcactggtttaccgatgttgccgtcggttcaatgtcggtggtattagtgggtctgagctggtggctattaacgccagccagtgacgtattggttaactggttttatcgcaaattgccgggtaaatataagcccgtgacgtaaatgttaagcgcgggcgatttaaacccctggtttgaaccgcccgtgcttataaaaaacaccccatcactattagcctgctaattaaattcacgaaaagaaaaggttatgaccctgctggcaggttaaatagtcgccaatatcctctgtcaataaagaaaactctaaaaatagcggctatgccccgaattagcccccctttaactccctgttctcaccatcatttgaccacaattgtagctaaattagtcagtgtgttacggtttgatttcacatcaaaaaaacctatatgaaattgattaaaagcactcgccacggcgtctgtaatcagttaacctcagtcgcagtgaggcaaaagcggcagaaaattcggattttttaccgttaaaatgtgtccattaacacattttagtaattaaggatttgtcttagtctgtttcgcttattaatctccctgttttgtcatctggctggcgacaatcttgtcgtaaggaaatcgaaggaaaacccgaataatggtcaagtctcaaccaatactgagatatatcttgcggatcgtgcccgcagtggcgctggcaacactcctctcagcttgtagcagtacccatagcagtcaaaacgcgaataacgagaatcatgaagttaacaaccacaatggttttttacttcaggcgtctcaggatgagtttgaagaaatggtgcgtaatgtcgacgttaagtcgcgcatcatggaacaatacgccgtctggaaaggtgtgcgctatcgcctcggtggcgataccaaacgcgggatcgattgttccgcctttgtacaacgcaccttccgcgatcagtttggcttagaattaccgcgtttctacctcacagcagcaggacaccggtaaagagattacccgcagtaaactgcgtcccggcgatctggtgatgttccgtgcaggctctacgggccgtcacgtaggcatctatcttggcaacgataacttcgttcatgcctcgaccagcagtggcgtaatgatctccagtctgaacgacgattactggaaaaagcgctaccgtgaaggacgccgtgtattaagtcgtaacccgacctgataaccactttcgatcttctctcagccagagaacatgaaacgctgcttatgcagcgttttttttcgcttttaatcatttttaccagcagttatataagataaaagcattctgactcagattaatagcaagacatttcccgccgtctcgttatattctcggtcgcttaaaccgaagccgtcgtgcgcaataacataataataatttgattaggggaagctcctcatgccactgtcgggggcgctacggcgccatgccacctatcctcgccgtatcgcatggagtagtgcgatggctggcggcttattctttctgttatttgctgcactctcgcttcaccagacctggcagaagcgcgaaacgacagcatcagcaactgctggagaacagccgcacggcattacagcaaacgctctccagcctgattaacagtactctcagtcccctgcttccgtttacccacactgcctgcaataccatcaatcgtgaactcacctcacgcgccgcctttgccggaaatcttcgtgccatcctgctggttaaagaaggtaatgccttttgctcctcggccaccggcagttttaatctgccgctcaatgtaattgcgcccctgagtgatatttcgcgtgatatcgatctgcagctgatgccgggcacgccgttgcagcccaataaaccggcgctggcgttgtggatcaaaaatcccggcagcctgcagtcaggcgttttcgcgacgctgaatattaccctggcaccctatcagctgctggcgtccgggcatccggaaatcaccggtatggcactgatggcacaacgcagtgccttaaccagctggcaatccgtcgtcatgcagaataaaaacctgccgacgccgctgcaccggcaggcgctgacaggctatccgctgcagtttgtgttgtacggttccactctgacgttcagcgattatcagaatatcctgctgagcggcctgctactgtcgctgctggtttcaggcgcttgctggctgctgttgtcggtttatcagcgccctggtaaagagctgattcggggcatgaagcgcggtgaatttcacgtcgaatatcagccgctggtcacctcccatgatggtcagccgtatgggatggaagcgttactgcgctggacccacccgacgaaaggcccgatcccgcccgatgtgtttattcactatgccgaggcgcagaacctgattattcccctgacccgacatctgtttcagctggtttcccgtgatgcccacctgctgtgtcataccattccccgtcatgcctgcctcagcctcaacatttcgcccctgcatctggctgacagcggtttccgtcaggatgtgctgcgctggcttgatactatgcctgcggaccactttacttacgtgtttgagatcaccgagcgagccatggtgcgcgacgaaaacgtcggagaaaactgtttgactggttgcatcagcagcagatccatatcgccattgatgatttcggtaccggtcacagcgcgctgatctatctggaacgttatgactttgattatctgaaaatcgatcgcggctttgttcagagcatcggtacggatagcctgacctcgccggtactcgataccgtgctgcagctggctaagaagctgaacctgaaaagtgtggccgaaggggtagaaaccggcgagcaggctgcctggctgattaaccgcggtgtgacccatctgcagggttacatctttagccgtccgctgcggccggaaacgctgatagactatttccggcgtcataacgcctgacactacctggcccgaatcgcgccagacatctgacaggagagtgcatgctgtttcgttccggacttctgctgctgtgcagcctgctcagcgccccgctgctggcggcctctgtccagcaaagctacgcgttcacccaggccggtgaagcgaaatatccgcccggcttcagccattacgactacgccgatccccgcgcacccaaaggcggcagcatcaccatggcggtagtgggtacttacgacaacttcaaccgctacgcttctcgcggtaatccgggcattaacaccggcacgctttatgatgggctttacaccagctcagacgatgaacctggcagttattatccgctgattgccgagtcagcgcgctacgccagcgattttacatggattgagatccgccttaatccccgcgcccgttttcagaatggcacacccatcaccgcccgcgacgtggcgttcacctatcagaaattcatgaccgagggcgtgcctcaatttcgcgtcgcctaccgtggcgtgaccgttaaagcgctgaacgatctcactgtgcgcatcgaggcacagaagccggataaagatctgctgcttggcttactgacgctgccggttatcgcagagtcattctggcgcgataagaagtttaatgagccgttaagcgagccacccttgtcgagcggaccctatcgcatcactcgctggaagctgggacagtttattgagttcagccgggtaaaagaatactgggccgctgatctgccggtcaatcgcggacgctttaattttgatcgaatgcgctatgactattatctggatgacaatgtggcatttgaagccttcaaggcgggtgcttacgatctgcgtgaagagacatcggcaaagaaatgggctacccagtatcgcggccgcaattttgacgatggcagcatcgtcaaagagaccacgcctaacgatgccgctatcgatacccgctggctggtattcaacaatgaaaaaacgctgttccgggatcgccgcgtgcgtcaggcgctgtcactgatgttcgatttcgagtggatgaacaaggcgctctattacggtgcctggcagcgcgccagcagctatttccagaacacggcgtatgcggccagcggcgtgccggatgcacagcagcaggccctgcttgaaccgtggcgcgcgcaactgccacctgagctgttcagccagccttatcagccacacaaaaccgacggcagcggctatgaccgcgccagcctgttaaaagcgtctgacctgctgaaacaggcgggctggcagataaaaaatcaccgtctggtcaatgataaaaccggtcagccgtttaccatagaactcctgctgcgcggtggcaccaataccgactgggcgttaccgttccagcacaatctttcccggcttggtattacgctaaacctgcggcagatcgacaactcacagtatctgcggcgctggcgtgaaggcgactatgacatgattgccacggtctatggggcgatgccgatcccgacgtccagtctgcagatcctgtggcagtctgacttcatcgcctcgtcgtggaataccgcgcgggtcaaagagcctgtagtcgatcacttcgtgaaacagattgtggcgcatcagggcgatcccaacgcgctgcggccgctggcccaggcgctggaccgggtgctgctgtggaatgcgtatatgattccgatgtggtacaacgcagagcagcggctggcgtactgggataagttttctcaccctgcccgcaagccagcctacagcgtcggactggaaaactggtggtacgacacaaacaaagccggacgcctgccggccagcaaacgctaaggagatcaccgttggccgcttactttctgcgcagattgctgctgatcatcccgacgttatgggcgatcatcacgcttaatttttttatcgtgcaaatcgcgcccggcggaccggtcgatcaggcgctggctaacattcagtttggtcagacaaccggtctgcccggcagtggcgcagacagcgccggttcacgcgccagcatcagtcatctcaatccggccgataatcagtaccggggcgcacgcgggctggatcccgaagtgattgccgagattaaacagcgttatggtttcgataaacctctctggcagcgttacggcgagatgctgtggaattatctgcgtctggattttggcgacagcctgtttcgcagtgcctcggtgatcgggctgatcaaagagagcctgccggtttcgatcagtctgggattatggagcacactgatcatctacctggtgtcgatcccgctggggatccgcaaagcggtgcgcaatggcagcgcttttgatgtctggagcagcgcttttattatcattggctactccatcccggcttttctgtttggcatcatgttaatcgtgctgtttgcgggtggcagctatctggactggtttccgctgcgcggcctcacctctgcgcagcacgacacactgccctggtatggcaaagtgctggactacttctggcatatcgccctgccggtgctggcgacagtgatcggcggcttcgccacgctgaccatgctgacgaaaaacgcgtttctggatgagatccgcaagctctatgtgatgactgcgcgcgccaaaggggtgccggagcgccgtattctctatcaccatgtgtttcgcaatgcgatgctgctggtgatcgccagcttccccgccacctttatcagcatgttctttaccagttcagtgctgatcgaggttatgttctcactcaacggacttgggctgctcggctatgatgcgactctgcaacgtgactatccggtgatgtttggcacgctctatatttttacgctgataggtttactgatgaatattctcagtgatctcacctatacgctggtcgatccgcgcatcgatttcgggagccgctcatgacgctctctccgctaaatcaacagcgctggcagcgctttcgtcataaccggcgcggctactggtcgctgtggatctttctgatcatctttctgctgtcgatgggtgccgaactgattgccaatgacaagccactgctggtgcattaccagcagcgctggacagtgccgctgctgtttgactacagcgagaccgactatggcggcgcactggcgacagcggcggattatcaggatccctggctgcggcagcgcattgagcagaatggctgggccatatgggcaccgattcgtttcagcgacagcaccatcaattttgctaccgaggtgcccttcccctctccaccctctgcgcagaaaactggctcggcacggatgccaacggcggcgacgtgatggcacgcctgctctatggcacgcgcatttctctgctgttcggactgatgctgacgctcttctccagtgtcatcgggattgtggtcggcgcggtgcagggctatttcggcggcacgattgacctgattgggcagcggctgattgaagtctggtccggcatgcctgcgctgtttctgctgattctcctctccagcgtgatccagccgggtttctggtggctgctgctggtcaccgtggctttcggctggatgagcctggtcagcgtggtccgggccgagtttctgcgtacccgaaactttgattacatccgtgcggcgcaggctctgggggttagcgacggccggattatgctgcgccacatgctgccaaacgccatggtcgccaccctgacctttctgccgtttattctgtgcggatcgattaccacgctgacctcactcgattttctcggctttggcctgccgctgggttcgccctcgctgggcgagttactgctgcagggcaaaaataacctgcaggcaccctggttaggcctggcgggctttttcaccctggcgatcctgctttcgctgctgatttttattggcgaagcggtacgcgacgcttttgatccgggcaaaggagcctgaatgaacacgccattgcttgccatcaatcatctctcggtcgcctttcgtcagggcgagacgcttcgccaggtggtgaatgacgtttcactgcgcattgacgcgggcgaaacgctggcgctggtgggcgagtcgggttccggtaagagcgtcacggcactgtcggtgatgcgactgctgcatgaggctgcggtggcttatcccagcggggagattctgtttaacggtgaagatctgctgcgcgcacgtgagcagcgcctgcgcgggattcgcggcaaccagatcgcgatgatttttcaggagccgatggtatcgcttaatccgctgcacaccgtggagaagcagctgtatgaagtactgtcgctgcatcgcgggctgcgtcgtccggcggcacgcggtgaaattctcagcgtgcttgatcgggtcgggatacggcagcccgccacccggctcaatgatttcccccaccagctctcgggtggggaacgtcagcgggtgatgatcgctatggcattgctgaccgagcctcagctgctgattgctgatgagccaaccaccgcgctggatgtgacggtgcaggcgcaaatcctgacgctgcttcgtgaactgcagcatgagctgaatatgggcatgctgtttatcacccataacctgaatatcgtgcgtcagctggcggataacgtcagcgtgatgcgcaatggtcacatcgtcgaacagaaccgctgccagaccctgctgaatcagccgcaacacccttacagccagcagttgctggccgccgaaaccggaaggaaaagcgctgccgctgcccgcagacgcgccggtcattcttcgggtcgataatcttcaggtcagctttccgctgcggcgcgggctgttccgccggcagagtggtgagaaacaggtgctctccggcctgagctttagcctgcggcgcggcgaaagtctggggctggtcggcgagtccggatcaggtaaaagcactacagggctggcactgctgcgactgattgcctcacgcggcgaagtctggtttgacgaccagccgctgcatcagctgtcacgtcgtcagttattgccgctgcgtcagcgcattcaggtggtgtttcaggatcctaactcttcactgaatccgcgtatgacagtgcagcagatcattgcggaaggcctggcggtgcatcagccagaacttagccgtgcgcaacaggagcagcgggtcatcgcggtgatggcggaggtggggcttgaagcggaaagtcgccaccgttatccggccgaattttcgggcggtcagcgacagcgtattgccattgcgcgggcactgattctggaaccggagttgctggtgctggatgaaccgacctcatcgctggatcgcacggtgcagaagcagattctgacgctgttgcgccgcttacagcagcagcggcagctcagctatctgtttatcagtcacgatctggatgtggtgcgcgccctgtgccatcagcttattgtgctgcgtcagggagaagtggtggaacagggagagtgtgaaaggttgtttgcttcacccgcggccgggtatacccgcgagctgctgcagtcggcgcaactcaacctgcgataaaagtctcggcaatcgctacgccctgatttttcaggcagcagttggtggcgctttcgtcacgacgctgaatgaacaggcagggctgtccttcgcactcggccactttacaatcgacctgaatatccgccagaacctcttttagctgctgaaggatctcccacgccggaatgccatcatggctgatcaagcgcagcgcaacgaaatcctgctcgtccagcgtggtgtcatcggattcgatagcactgtggtgatcgctggcccagcgaaaatgctgtggcagacgatgcacaatcgaaagttgcagcatagtttactctccccggatgagtttatgtcgcaacacaaagcagcccagctggaagcggcctgataaccgctgagtccggacagggtttaatggcccgtccgtgtggattgcagaagcgcattttttgcgactcacatcgcacttcagcctatatgtaccgcgttcacacgccgttaacaatcattttagctgcattgtgattacttttttaactaaatattttcacaatatcgaaacaaagtcaggaggcgtgcaagtcggcaggtcattgcagagggaaaccactgcgcccgattaccgggacgcagtgcggggacgtgaagcgtagaaaaagagcagcagagagattgtcgcgcacagtgcaatcgtgccgaccattggccaggcgctgttgaaactcaccagcgacagcagtgcgccgacaaatgccccgacgccaaaacgcagggtgcccgccagggacgatgccgtacccgccatatgcggaaactcatccagaatcaccgccatcgcattcgatgagaccatcgacacgcaaccgataaacatcgcgatccccatcaccagcggcaaaaagccgaggctgaaggcgctgaccagcagcagccagatccccatacagaactgtatcagcagtcccatccggaacatcgccaccgggccaaagcggcgcacggcgcggctgttaatcagcgtcaggacaaacagaaacaccacattgaggccaaagtagtagccaaagttttgcggtgaaacgtgattcagttcgatgtaaacaaagggaccggcattgagaaaggtaaacagcccggcaaaggagaaaccgctcgacagcatgtaactgaaacgcgcgcttgtggcgaaacagcgttacgaaattgcccagcgtagtacgcagatgaaaccgctgtcgctgctccggcttcagggtttcacggatctgcgtggtcaccagcacggtcgtcactaacgccgcgcccgccagcgcccagaagatggcgtgccagctccagagcaccagcagccagccgccgatgatcggcgccagcaacggcgcaatggtggtaatcagcatcacaaaggacatcatgcgggagaagtcctctttcgagtaactgtcacgcattaacgcattgatcaccacactggctgcggcagccgacagtccatgcagaaagcgcatcgtaatcagctgatcgatggtttgcgacagcgcacaggccgcggcggcgcaggcaaagatcagggtcccgagcgcaatcaccggcttacgcccatagctgtctgccagcggcccatagatcagctgcccaatcgcgaagccaagaatgtagaggttgagcgacatctgcacgctaccggctgaaacgccgaactcacgtgcaatctgcggcatggcgggcagatacatgtcgatcgacaacggcatcagcatggctaacagaccgaggatgaccaccagtcctgttggcgaattcttttccttacgcacaccctctcctgcccttatggtcgtgatgcgggccgccgggcccgtccggttattttgtctgcagctctttcggcagaccgatgctggcgatctcttcttctgtcagcgcacgatattcgcccggttccagatcggcgtccagtacgatgtcaccgatgcgctcgcgatgcagctcaaggacccgattgcctactgccgcaaacatccgttttacctgatgataacggccttcgctcagtgtcagccggacgtctgtcggggtgatcacctccagctgagccggtttagtcaggctcttctcattgtgcagttgcacgcccgccgtaaactgcgcggcggtatcgtcactgaccggtgattccagggtcacacggtaggttttctcgcagtgatgacgtggcgaggtaatacggtgtgaccactggccatcatctgtcagcagcaccagtccggtggtgtcgatatcaagacgccccgccgcgtgcagtttgaatgacatcggttcttcaatgaaatagatgatggtgggatgatcgggatcgtcggttgagcagacgtaaccctgcggtttgttcagcataaagtagcgtggaccagtctgcatctgcagtacgttgccgtcatagacgacttcgtggtcgggcagcagtttaaacgcggtatcgcgtacgatttccccgttaacggtgacacgctggccacggatctcgcgatgggcgatggcgcggctgatttccagttgctgagagatgaatttgtcgagtcgcatgaattcgttttgcctgttactgcggagggaatctgaaacggcctggttaaccgttgaaaatgtgcgggaagtataacgtgatccgcgccagcctgacagcgcgtttaccgcactttcatggcataattacccccagttttgcaaaagtgagcatcatgtcttttaccttacgcccctatcaacaggatgcggtgaatgccaccgtggcgcatttccgtcgtcatcaacagcctgcagtcattgtgctgccgaccggtgccggaaagagcctggtcattgccgagctggcacggctggcgcgtggccgggtgctggtgctggcgcacgtcaaagagctggtagcgcagaaccacagtaaatatcaggcttacgggctggaggcggatatctttgccgccggacttcagcgtaaagagagtcaacgcaaagtggtgtttggcagcgtgcagtcagtggcgcgtaacctcgaccagttcgacagcgccttttcactggtgattgtcgatgagtgccaccgtatcggtgatgataaagagagtcagtatcagcagatctttaatcatctgcgtcagcataatccgcaactgcgtttactgggcctgaccgccacgcctttccggctgggtaaaggctggatttatcagttccactatcacggtatggtgcgtggcgacgaaaaatcgctgtttcgcgactgtatctatgaactgccgctgcgctacatgatcaaacatcagtttctggtgccgccggagcgactggatatgccggtggtgcagtatgacttcagccgcctgacggcacaaagcagcggcttgttcagcgaagccgatcttaatcgtgaactgaaacagcagcagcgcgtgacgccccatattatccgtcagatcgtggagttcgctgaagatcgactgggagtgatgatttttgcctcaacggtggagcatgcgcatgaaattttgcggctgctgcccgctaacagcgcgctggtgtcagcggaaacgcctgccagagagcgcgatgccctgattctggcctttaaggcgcagcagctgaaattcctggttaacgtggcggtgctgaccaccgggtttgatgctccgcacgttgatctgattgcgattctgcgcccgaccgagtcggtcagcctctatcagcaaatcgtcggacgcggcctgcggctctcgcccggtaaaaccgactgtctgattctcgattatgccggtaatccgcacgatctctttacgcccgaggtcggcgcgcccaaaggggccagcgacaatcagccggtacaggttttttgtcccgcctgcggtttcgccaacaccttctggggcaaggcgaccgaagatggcatggttatcgaacattttgggcgacgctgtcagggcgtgctggaagatgatgagggcgagcgcgaacagtgtgacttccgcttccgctttaaaagctgccccgactgtggcgcagagaatgatattgccgcccggcgctgtcaccagtgcgacaaaattctggtcgatcctgacgatatgcttaaagcggcgctgaagcttaaagatgcgctggtgctgcgctgtggcggcatgacgctggaacagggccgtgatgccaaaggtgaatggctcaaggcgacctattatgacgaggaaggcaccagcgtcagcgaacggtttcgtctgcagacaccggcccagcgcaaagcgtttgaacagctctttatgcgcccgcatcagcgcgcgcccggcgtgccgctgggctggcaaagcgccgctgacgtgctggcgctgcagccgctgctgcgtcatcccgactttgtggtggcgcgggccaaaggtcagttctggcagatccgcgaaaaaatgttcgattatcagggtcgctatcgccgtgccaatgagctgcgctaatgagcgctatcgggtccggctaaccggatgccgagcccggctggcgggtatatcgtttgctaccacccggcataacggctatactgccgcccgcttttgcatgtgcatcagcggtattgaataaccagcctgttactgggtcgcctgtagcaggaattaaataaagagatatattaatgctcactatcaatgcagtagaacgtaaagagcagggtaagggtgcgagccgccgcctgcgtacagcaaaccgtttcccggccatcatctacggtggttctgaagcggctgttgccatcgacctggatcacgactccgtaatgaacctgcaatctaagccaggtttctacgacgaagtgctgaccctgtcagttgacggtaaagaaactaaagtgaaagttcaggctgttcagcgtcacccgttcaagccaaaactgttccacatcgacttcgttcgcgcttaatcgcgaacttcgttgaaagcagaagggccggttgcgaaaccggcccttttcttttggcgctgcccggtgaaatgatcgccgcgtgcagggaatgaaagccgggctaagcccggcttttttatttgctgctggtacggcgctgcagctgatcgcgcagattgggtggtgtgcccttaatcgtcagggtgtccgttgccggatcccagaaaatgcgttcgcccagcaacatcgcatcgaagttcagggtcagtcccccgccgcttccggcaaacttcgtcagctggcgcagagtactgcgatccgccgggaagctctcttccagttcatacccctgctcctgggtaaaggcctggaacgttttttcacccagcggtggcagttcgctcgacaactcttccagcgcaatctcctcgcccgcctgcagctgctcgttgcagtagctgtagacctgctggcgatagttctgccgctcctgcttatccagttccgattcgttgcagtagtcatctaccgcctgcaacagaccgcggttctgcgccttggtgtctaatcccacttcggcacccaggaagtccataaagaagtcagccactttacgtccgacgcggccacgcaggaaagtcagataacgggtcgattccgggttagtttcccactcggttaaatcgatgcgtgccaagatgtcggcatgattgatgtcgagatagtgggtgctgctgatatccatctgctcgttgacgcgcatgctggactggctgttcagcaccgcaatcagcaggtattccaccgccagatagcggtagtgaataaacagcaccacgccgccttcagcgaaggggtattttgcaagctcatcgcgcagacgaccggtcgcggcacggctaaaagcgagaaaatcatcgttgcccttacgacaattacgcagcgcttctgccagttcactctctgcattgaacaggccataggctttgctttttgcgctataaacccggtgtaactcctccaccatcgcgttgaccgtgttggtggcaggcagcagcgaatcgcgcagcgccagttcaagctggttttcatcgcgtttaattaactgatgcagggcaatctggtcgatatccagactcatggtagactctccttttagcacaggcgcgtattcaaacaccgccagcatcggctttcaactccatgcgtatagcgaacgcgctgctttcgataaaattgcggtaaaaagtgcgctgttccggtaatatatcgccttttgaaatgagcttagacgacgatatggcacaatcatcccgttacagtgacgaacgcgtggaacaactcctcgcggaaatggcccaaatcctgcacaaggacaaggcccccaccgatctctccctgatggttctgggaaatatggtgaccaacttaattaacagcgatgtcgctccggcgcaacgtcgttcactggcacgatctttcgccgatgcccttcaggcgtctgtgcgtgacgataacgcccattaattggctgatttgacttcataatatggtaaccaaccggcagcgctaccgcgaaaaagtttcccagatgatcagttggggtcactggtttgctctgtttaacatcttatttgcgctgattttaggcagtcgctacctgttggtcgccgactggccttcttcgctggcggggcgcatctacgcctataccagctgggttggccacttcagttttgttgtttttgccgcctatctgctgattatcttcccgctgacctttgtggtgatgtcgcaacggctgatgcgggtgttgtccgcggtggtcgctaccgccgggctgacgctggtgatggtcgacagtgcagtgttcagccgcttccacctgcacctgaatccggtggtgtgggagctggtcattaaccctgatcagagcgagatggcgcgcgactggcagctgatgtttatcagcgtgccgctgattttcctggttgagatgctgtttgcgacctggagctggcagaagcttcgcagcctgaatcgccgttcgtttggtaagcctgtcgccgccctgtttatcagcgccttctttgccagccacctgatgtatatctgggccgatgcgaatttctatcgtccgattacgatgcagcgtgccaacctgccgctctcctacccgatgaccgcccgccgcttccttgagcgtcatggtctgctggatgcccaggagtatcagcgtcggctgattcagcagggcgacccggaagcagtggcggtggaatatccgctgagcgagattactttccgtgatgccggcacacgcaacaacctgctggtgctgacggtcgatggtctgaacaacgccacgctggccaaagcgctgccggagcttaatcagttcgccagcgagaacgtgcgttttacccagcactacagcgcgggtgatacgccagagaaagggttatttggcctgttctatgggatctcatccagctacatgaacggtattctggcatcccgaacgccgtcggcgctgctgggcgcgcttagcacccagggttaccagtttggcctcttctcctcggaaggctttaatccgccgctctaccggcaggcgttgctgactgattattcactgcctgcaacgaccagccagcccaacgccagtactgtggcgcaatggcagaactggctggagaaacagaacggttcacaggcgccgtggttctcatggattgccctgaaacggcccggacgtcaccggcgacagtgcaaaagcgcgtcagcgcagctatctgcgccaggctcctgccgttgatgagcagatccacgcggtgctcagcagcctgcaggcgcgtgatttactgaagaacacggtggtggtgattacggcgcagcgtggactggcactggatggcaatcctgacagcgctggaaaccgccagacgctgcaggtgccgttagtgattcactggcctgatacgcccgcacagaccgttgatcgcctttctgatcatcaggatgtgatgtcgacgctgatgcagcgactgctgcatgtgcggaccaatccagtgaactactctcagggtgaagatctgtttgctgcgcgccgccgccatgactgggtcgtcagcagcgaagagaataagctggtgattaccacgccgcaggtgacgctgctactcaacaataacggcagctatcgcgcttatgatgcgcagggcaacgccctgaaagatcacaagccagaactggcgctgctgttgcaggtattaactgaagagaagcggtttatcgctaactgattaataatcaggcaaatagccggcaggtatcttgcattaatggtgataacaagtagactaatcctccagtgttcggcacgtagcgcagcctggtagcgcacggtcatggggtgtccggggtcggaggttcaaatcctctcgtgccgaccaaattccctgaaaagcagccctaaaggctgctttttttgtttatgtcatcaaaccttaactttcctcgcacctcccacaattcgttctatacttaactgcgtgtgggtaacaagaggagagttcatgacatatattgaaaaagacgatccaacagaagcacccgagtcaggcgataagcaaccttccccgccagaccagaagtaacccacggggccgcgtctgacgcggcctttctatgtcagcttacctctccgtttaacattcagaatagtcccgtatggcagttaacattcctcttacaatcagtaggttaacagttgcattataatctgatctgcttcacaaaatcggctaccggctgcgcttattcatcaaactgaaacaaaaatgtcacataaaatgcctaccctgaaatccccagaaattgacggataatttttatggcgatcaaagcgaaaagcctgaaagatgcagaagcattgctgcattcaggcattagcaaagtggaactggcgtatgacattggcagcgacgatttctttcgtctggcaagccactggtgcgaccgaggtgcacgcatcagcaggggtcaccaccatttcgttgtttctctgaagagttttgccattcctcccaacgactgattccggcgggctgcttgccctgatccatcgcgcctgatttaatgcctttttggttttgatgatggtcccgcatgcgctatcccgacctgccgctgccgcctgttgcaggcggctttatcctttcccgacacattaaccgcagcgatcccttgctggcggtgagtcaattcgatccgcaaaagtatcaggatgggctggctatcgaatgggatattccgctgcctgcccgactgcagcaggctgtcagtaaacggcgtgctgaatacctcgccagccgtctgctggtccggtcagtgatggcagaactgggtattgctgatttcattctgactaatgcagccgatcgatccccctgctggcccgctggcattcaggcgtcactgtcgcacagtgcaggcatcgttgtggtagcggcaacccgtcagccctgcgctgttggggtggatgtcgagcagttcatgtcggagacgacggcgcatgaaacggctgagttgctgatgaacgagcaggaacagcacctgttacggacgctgcccgtctctttttgcgctgccgctaccctgctcttctcactcaaagagagcgtttataaagccatgtggccgcaactgcttcagccgatggactttccggatgcggaactggtgtcggtagatttctcacagcagcgcgcgacgttgcgactgactcaggacttcagcgggtgttttgcgatgggaacgttactggaggcaagctttgtgtggcgggatactcaggtaatcacgctaatcacacatcggctttaaaaaaaccggctaaacaatacgcgttaaaactttgcggtttagccgggggtaacacagacgaaagaaaaggttcagaatggcagaaaccggagtttctgctgatcgctaacgtagcctggttcaggcgaagcatgccactacgcttttttgctaagctttgccagctgccgttaaagcccggtgtcggtgcgtttcaccgagtcgagcgtggcaagatcgcgctcattaccggtcagctccgtcaacttgccttcacgcatctccagcagccgatcggcatgaatgaagtagtgatcgtcatggctgatagcaaacaccgttttacccgcctgctgtagccacggcagcagctcgcgatagaagatacgtcggaagtgagggtcctgatccgccgcccactcatccagtagcagcacatcgcgctcttctgccaccgccagcagcagtgccagtcgcttactctgtcctttagaaagctgcagattcagcactttgttaccttcaatcttcagcttatcctgcatcttcagtctctccagccagagctgaaccagcgccggattagccgcaatcccctcccgcccgattaaccggtcaaacaggtgcaagtcggtaaagaccgccgagaaactgactgcgccacacatcaagctcatccgccgttatcggcttgccatccagcagcagcgtgccggactgaggctgataaagaccggtcagcagcatcgccagcgtcgatttcccgctgccgttgccgccaatcagaaagaccagttcgccccggcgcagcgtcaggttaaccggcccgacctggaagccgttatcaccatagtgaaaagagacatcgcgcaactccagcgtttgccagtctgaggacgtggaggcggagtggaatcctgactgataaggagcgaggtcaaaggcgttgagcttacggaatgcgacctgggcactgagcaacgtcggtagcgcgcccaccgcggagagcagcggtgtgcgtaaaaacagcagcgtcagggaaaaggtagcggcgacggcggtattggcccagcccaggctgttggccataaaaaagaccatgccgatagcgcctaacgtcatgatatttgaccagttgaccgcactgagatggtaagtatcggcgcggacaatgtggtgtcgccaggcgcgggcatcttcctgataaaccgtgtcgtagacctgctgagcgcgtgagcggttaagctgtagctctttgcgcccttcaatcaccgtctgataatcgcgatagaggttatcttcgatttcccgcagctttgccatgtgctggtaaacccgcgagaccagcagccagccgccaaccagcgtgacacccagccagacactggttaccagcagcattttaggcgacagccacgcgagatagatcgttgagccaagcgtaataatcacgccctgaaagagctccggcaggcgtacaaaggccagagtaatggcccgcacgtcgctggtcagtcccgccagcagttgcgcactaccgagttgctcgatgcgttcaatgcgggtatcgaggatacgcttgataaattcgccgcgcagtcgccagacaaactgatggccaagcatggtcagcgccagctgcgaggccagtgtcaccgccatcagcaccaccagctgcaacagaaactgcggcagtaccgcaaatgaggtgttgatggcgacaatcatttcgcgattgataaaggcgatcatgccgatacccagcacggcgcttaacaacgtgagcgcaatcaccccgataaaaggccagcggaactggcgaaaaacaacgcttagcaacgtcatgcaggcaatccagcagtcaaaaaacagcctgcagtgtaatgggatgcaaaatgatagcaatagttattcgtaccacgccgtaaccggcgtggtgggtcagaaagcgcgtcgaaacgtcaggttataacgccaggcacccaccagcggatgaacgcctggcttaagtggcaggatgccgtggtaacgcaggcgcgacggcccgccccacaccacaatgtcgccatgctccagcagcacacgctgggtactgtcaccccgttcgaaaccgccaaactgaaagaccgccggtaaacccagcgacaccgaaacgataggctgacgcagatctttctcatctttatcctgatgcagcgtcagcttcgcgcccggctcatagcgattaagcaggcaggcatccggattaaagccagggaaccccgcctcagacgccgcctgctgcgccagagtacgaaacagcggcggcatagccggccatttacgcccgttcaggttgtcctgctgctgatactggtagccgcgtgaatccaccgaccagccgaaatcgccacagttggtcatcgccaccgacatgcgatggccaccgggcgtaatgcgatgggcaaacggattctgctccgcaattgccattatttgctgataaagcgcctctgcatcctcacgtgcgcgccgccgcaggatcaccgcgccctcagccagcgtctcctgccagggttgctcttcactaaacagatctaacatcagggtttctccggattcagcggggatcaggaaagcagcgaactgcggcgacatccagctgacaaatttatcgccctgcttgctgatcagatagaccgccagatgctgttcaatcgccagcgcctgggctttttccgtgccaagtaccatcagtccggtatcccagccatcggcttccagcgccgtggtggcgatcaccgtggcggaaaccagtttatgctcaattggccgtccggtaacgggatcgataacatgagaaatgcgtttgccgtccagttcataatagttgcgatagctgccggaggtactgatgccgtgtccctgcagattaacgcgcgcctgaaccgcattctcacgatcggtcggtttctgaatcgccacccgccacggctgctgctgcgcattaaggccacggctcagcacggcgccgcccacagacaccagatagttattgatgccgagctgctccatcagtcgcgccagatgatcggtggcgaagccctcgcccaccgtcgagagatcgacatagagacctggcagatctttctgcagccactgtccgtctgcgccctgcaccacccgcagatgctgcaatccggtctgcgcccgggcggcggcgatttgtgccgcatccggcgtatggccgggctgcttcgtcgggccaaagccccataagttgaccagtggcccgatggtaatatccatcgccccgccggttttacggccaatccgcagtgaggtcgtgacaatatctgccatgttttcactcaccggctgcggtgacaggtcacggctttggttaaagcgcgataaggcggagtctggcttccaggtagagagttccgcatcgtccgcatccagctgctgctgaatccgctgttgcagttccgctctgcgctcactcgccacaccggccaggcttacccgccagacggttcccatggtttttccttccagcaccagcgcggatgtggtcgctggcttatcacaggccattaacatcaacgctaacatcgccataaacagcagattaatctgagaacgcatctttcctcacttgtaacactttattcagctctgctacaaagcataaacttcgggtaaagacgcttaaagagagttgaatatttctctgaaacctatcagtatccaccggtcatctaccctgtatccgcctttcatcaggcgactaacgttaaccaaagtaaggagcggcagatgatctatctgattctcgtcattgccctggggctgtttatcttcagtagctataaagtcttgcatcagcgtcgtcaccgtcacatgacaccctcacgcccgcgccaataacaggcttaactgcacctgattggggcaagatcgccctgacgcgcgcggcaagtgtaccaaagtgcgcgcgaggtctgtggctatgagagcggtaaagctggcatgaattctgcactgttgaaacagtgtttatctctgagaggtgcagaatgaaaaattcacagaagtggcagtcagcatggcatcactggctgagcttttcagccttcaccctggcaggcgtggcatttgaaggcgcgcgattcggcagcgtggtgtcgtcagtgacaaccgcgccggaagccactaagtggcgaaaggctgaagcgctcagcccgaaaggtgacgcaggagcgcagcggtaactgcgctcccgtacaactcagaactggtaaaccagacccagtgccaccacgtcgtcggtattgataccggctgcgtcggtgaaagcgttgtcgtccagcaggttgatctggtaatcaacataggtggacatgtttttgttgaagtagtaggtcgcgccaacgtcgatatattttttcagattctgtttaccccagttctgaacatcggtgccgcgtgaggtgacgtacgccagggatggacgcaggccaaagtcaaactgatactgcgcaaccagttcccagttgtccgctttatccgcatagccataagctgaagagtcgttggtgctgtcgccgaagcgggtcgcattgtacgagcgtgagtacatagccgccagatagacgttgttcgcgtcatatttcagaccgccagtatagacttccgctttatcgccactcccgaggatgcctgatgttgcgctgttctggtcgttggtacggtcagactggaaagcagccgcaccaatgccgaaacctgaacccagatcataagttgtgctcagaccccagccgtcgccattctgacccagtacgtcacggccattcggagactcggtgctgttgccattcttgccctgatactggactgcaaagttccagccatccaccagaccgaagaagttattgttacggtaggtcgccatgccgttaccgcgctgatacataaagttatctgcgccgtaggtgtcgccgccgaaactctggcagcacgtcggtccatgcgccgatgtcgtaagctacgccgtagttacgaccgtagtcgaacgaacctgcatcaccaaatttcacaccggcaaagccaacacgggtgtagctgtcagccgtaccttcagactcggcgttgttcagcgcggcctggtattcccactggccgtaaccggtcagctcattgctgatttcggtttcgcctttgaagccgaagcgaacgtaagactgatcgccatcagaaccatcgttatcagagaagtagtgcagaccgtcaactttaccaaagagatctaatttgttgccgtctttgttatagatttcagctgcgtttgctgatcctgctgcaaccagcaacgcagggatcatcagggagagaacgcgacgtttcattttattaccctctgttatgtgcctttattatttgccactgctaactgaatgattaaaaattcagccggcaggccattgttgttttataacgggcaataatccaccaggaaaatgctactaaatttccaaaagtgtttcatacgtcgaaacagttatttcataatgtaaataacggggaactaataaccagcacggatcgataaaaaatggcgcacaaatcgataaaccgattcagagagctatgttatcaacaggttacaccagagtattccgaagcactgaatgataaaacttatacggcatctggtaatagaatagaccccgctatcatcatttattccattattaccttcattctccccgaatgagatgtacaacttattatttcccgccggacaagttgtccggcatttttttgcctgctgtttgccgttccgttatatcttcgtaaactttcttaaccgggttaaattaactacggcctgtttccgcacatattgttaaaatacgcacactttgcgccctgactgcccaaatatccgccatgttaatttatcaccgtaattaagcaggcggatattttagctggtgcggattttcagcgctcgcgcatcgattctttgactttattcaggggcttaatcagataatccataaccgatttctgaccggttttaatctctacattggccaccataccgggcacgatcgggaattttcgtccggcacggttagtcagctcggctttctgggtacgaacataaacacgatagtaatattgatcacgttttacctcatcctgcagggtatctggcgagaccgtttcaacttcgccgtgcagatcgccatagatggaggagtcataggcggtcactttgacggtagccgccagaccgggccggatataagcgatatcgcgtggattgatgcgcgtctcaatcagcagttgatcctccagcgggacgatttccatcagtttaccgccaggctccagtaccccaccgaccgtggtgacctgaatatctttaacaatgccgcgcaccggtgaatagagcgtggcacgcgtcagctgatcctctttgcctgcagcaacctgcagttgcgcatccagttcggcattatttttcacctgctcttcgtgggcgcgcaccagatagtcattgcgcgcctcatcgattttgccgcgcagatcgctgacctgacgacgcagtcgaatcacctcgacctgccctgctgcgcctttggcaaccagcggttccgtcaggcgcagttcatcctgcaccagtcgcagcgactgctgcagattactgatggtttcggtgagattacggcgtcgcgactcgtagagctgccgtttcgcgcgtcaccaggttcggctccttcagcgtttcggcgctgaatgtcagcggcgtgcccgacagctccgcctccagccgctcggacgaggcgcgcagggtgcgcactttggcctgcgcctcgccgaagttcgactggaagcgtgtcggatcgagggtcgccagcacctgccctttttcgacaatgtcgccctcatgcacgttaagctgtttgacgatgccgccatccaggctgtcgatcacctgcgcgcggctggaaggggtgactttaccggtgccgaccgtgacctcatccagaatggcaaagtgcgcccagatgagaaaaatcgccagcgcggcggtgcagagccagataatcgccgatgtccggcgctcatgacgggcaagatctttatcaacaataaccagactcatgcggtgtctcctttacctggcgacggtgccggcgcgggtgtcgtcgcacggcgcaggatctcgtcgcgcgggccgtcggccacaatccggccgttatccatcaccactatacgatcgaccatcttcagcagcgccggacggtgcgtcaccagcaccagcgtccggccgctgatccagccctgtagctgacggatcacatgctcctccagctgttcatccatcgccgcggtgggttcatccagcaacaccacctgcggctgacgcaggatcaaccggctcagcatcaccatctgacgctggccgcccgaaagtccgcgcccgccttcattgataatgcggtccaggctggcggcatcctgctggaccagcgacagcgcgccactgatgcgcagcgcctgcagcatctcctgttcgctggcatggggattgcccagcatcagattctgccgcagcgtgccaaaaaagaggcgggagtcgtgcgacagccagccgagctgacgacgtaaatcggtgggatcgatacgctcaatatcgacgccatcgacaatcactttgccctgggtagccagcgcctgaccggcgaggatcttcagcagcgtcgatttccctgccccgactttgcccagtatggcaatcttctcgccgggcttaatctgcagctgctgaacgttgagcacattcttttcattctcttcgtcatagctgtagtgcacattgcgcagatcgtactggccggtgagcgtcgggcagtgtgccagcgtggtcgcttcaggttgatcaagcggctttttcagcaactcatccagccctttcatcgccattttggcatgctgccagcgcgagaagaccatggtcagctgcatcagcggggcgatggtgcgtgatgagagcaggctgcaggcaaccagcgtaccggtagtgatttgcgaatcgagtaccagatagacaccaaacaccagcatgcccgcataggtgagctgctgcacagtcgaggcccagccggtgaggcgcgcgccccacaaccgctgctgattactgattgaggcgctgacttcgtgcgtctgctcccactgacgctgaaaatagggttccgcctgcagcgccttgatatcctcaatgccttcaatggtctcaaccagcaccgcattgcgcagcgcgccctcgcgcagcccctctttggccagccgcgccatcgggatctgcaccagcagaccgggaatgacgatcagcgggatcgccgccagcggaatcagcaccagccagccgccaacaaacgacataataaacaggaacaggataacaaacggcagatcggccgctgcgcctaccgtggtcgaggtgagcagctcacgcacctggtcgatctcacgcagctgcgagataaacgaaccggtcgacttcggacgcgcctcattacgtatgctcatcgcccgggcaaacagcatggccgagactttcaggtcgatgcgtttgcccattaagtctgacacctgggtccgcatcagccggatcagatactcaatggccgcagcgatcagcacgccgacaaacagtacccacagcgtggactgcgactgggccgggatgacccgatcgtagacctgcatcgaaaagagaataccggccagtgccagcacattactgatcaccgaggccagcgaaatttccgtgatacggcggcccataccgcgaaaatttttccagaaaccagtgtggttcataaggctgaacgaattcgtcgatgcgcgcatcacggccacgcgccgctacgccaatcacgccgacatcgccctgggcgcgtgccagcagttctgataacgcgctttcacgcaccacatcgccaccttcactgagccagtagcgcgcgctgttgtctgaatcgatgctctccagcaccgccacgctggcattctccagcaccagcaccaccggggtgatctcctgacgccagcgcagtttgttctgcggcaccatggtcagatgcagtcccagcaggccggagagtcgttccagctgctgtgacaccggcagatgttcaaaccagcgcatctgctgacgcagggttttgccatcggcaggtttaccgaatcgcgcggctacgcgcagcatggcggcaatccagttatcggtattcagggttgatgtactcattattaatgccttatcgctattgcagcgaaggaaggagatcgccgctgctttgctggcgatcgatacccatgatatcgagcagattgtctaccgcggcggcataacgcacggtggcgtcccagccatcgtaaagcgcggtgatacgtgagctgtcagcctgaaacacatcctgttccacgctaagcagatcgttcaggctgcgcttactcaggcgatattcatcggcgtagacattacgggtatggtcggcgctggccagctgcacttccccggcagcctgccgctgctgcgcgccaatcatgtcggcataggcggtagaggcgttttgattgatggcgagcttggcctgctgaatagcggcctgcgccgcttcacgatcgccctccgctgactgggttttcgcattcaccaggccgccctgataaagcggcgcttccacctgcagctgcacttcatcatcccagtaagattgacgatcgttttcatagcgggtccggcccgcctgcactttaatcgtcggccagtgaccggactctgcctggcgcacccgttcacgagcggcttcctgcttcgactgcgcactgcgcactgcgcaccgccgcgctgctttcataggcgattttgtcgagggtgatctgctgcttaagcagcgcctgtggcagttcaggcagcgtagcggggaccacgccggtcagcacggtcagttgcgcggtggcggaacgatgctgggcgcgatattgctccagcgtggcctgcatcgcggcgatgcgggtttctgcctgcagcacgtcggactgggaattgaggccggcatcggcgcgcagcttcgcgatatcccgcacgcgcttcagtgaggcaatattggtatgcgccgtttctgccagcgcctggtaacgtttgacttcgaggtaggcctgcagcgtatcttccgccacggtggtcatcgagtcgaacaggctgtaacgataagcatccgacagcgcgtgctgctcatcgatggcgctgccggtgcggccaaagtcgtagagcagctggctgagcgtgatgccaccggagccgttattgttcaggctcccggcggagtcggtctgatgagagcgtcccgccgcgccctgcagtgagatctgcggataccaggcgctgcgggcggcatcaagatccccctcaccgatgtggatctgtgccgccgcttccgagattttcggattgcgggcgaaggcccgaagaatggcgtcgcgcagcgttaagctggcaatctgctcttcggtgggcgcggcgcgccagttaaattcggctttaggtaacggtgcggcaaaggccgcgtgcactgcaacgccactcagggcgcacaacaaaaaagttaatcgcgctttgttcattatccataccaacaggggttcttatcatcatggtgtttttcctggtgaacaaagcgagcaaaaaggggtgctactcagcgtctgacagatttactgcgttattttatttatggttcgcaagcgagacgctaaacgacctttaacattattagatcagatcccgcgcttattcctgctaaaaacagatgaaatcgttaatatttctgctgaacgaacgaaaagcaaccactgagcgagctcgcgccaatccagacaggcttaacagacctgtccggaaggcagtgcgtttactaatgtgtcagcgtcagaccagggggtgtgccgcaggatgctgcagcaggtggtcggcgagcgtataaggaatatcagagaaacagatgactttcctgcggtgcggcggcggcagaagatgcatacgccacgtgcgccgtctccgcctgctgggtcaggctgaccgtctccagcaactggtccaccgtctgaccctccagcgggttggcactttcggtatgtgaggccacctgtaccgtctggctggcactggccagattaccggcgctgtctttgccgctgactgtcatctggtactcaccatcgtccagcggtgccagctgcccggccagaatggtcagcgcccagccgccatcggcttttacactggcgctgtaatgctgatcgcccagcgttaattccaccaggctgcccggttgcagatgactggagctgccctgaatcagatgccagctgttgacatcggcagcatcaattttgttatcaccaaaagccgtgtccagggtcagcgttggccgctggtgcacggctacggtaaagagtttatcgctggtctgggtgtcgctgttgccatattcatcccagcggtgaaaggtggcggcgaccgggccatccggcagtgccagcagctcgctggaggtcagtgttaccatacctttggcatcgggctggtaggttttaccgttgatctccagggtgttggcgccttcaacgtagaagctcagatcgtgctgcgcctcctgatagttaagcgtcatgtcaccgccgatatccatttcggtgtagatcggaataaaaccggtgtggatattcagctcatgcgtgacgtcgatgtagttttttgccccgtcgatcgaccaggcgcggatttccccaacgttgataaaggcgtgcacatccgctgccgggatcaccacctgccagtgtccatcatcgcctatggtggcggcataatctttctggttggcacccgtgatcaccagacgatggcccggcatgacggtggagagcgtgccgctcagtagcagatcctgctggctttctgccaggtttatcacatcgtccgcagtgaccttatcaaaggtaatttttggcaggctactcagatgggtgatcagcgtcagatcgtgatattcggtggcggttttcccattgggatcggtcgccgtgactttcaggctgtagaccccgtctttcagcgcctgcatatcgctttcatgaaatgtgccataccacttaccgtcatttcccatgctggcggtggtggtttgcgtccccagcgtcagtttcagcaccgaccccaccggcaagtgcgttgcgctgccgctaatctcgacgccataaatgctctcagcaatactcaccgcgttgtcaccactgaccgtgtccacggtcagggtaggtttgatcgtgcggtcggtatagagaccaaaatctacggtggttgccgtgctttgccctgctttatcggtaatggtcagcgtcagcgtgtgattgccatccgctacgcctttcagcgtatcagccggcatggaggcgttccagtagccccacttattgacggtgctgtgccagctttgatcgttgaaggtcagcgttacggtggagcccgcttcaccttcagcacgaccgcgcagatgcaccggcttttgcgcttcccagccggcgatcacgccatcactggcgatcggttcatagggtcgcagcatagcgggcggcgaacttttcaccgcgctgacagccagtgtgctgtcgttgagcgggctgccatgcagtgactcggtggagagcgtagtgatcggcaggctctggcccggcgtggcgaaaggaaggctcagactttgcgtagcggctggcgcaatggcgggcactgcgctatcggcgacggcaaaatcgctcaccgccgtctgaaaaatggattcaagccggatggtacgaagcgtatcgcgtgatgacataggtaacctcagttcagaacagaaacgcagacaaaaactatcggataaaccgatcgtttagtctgacgacatggtagtgggacagctgaagctgcccgtttccgctggtcggaaccggttacccgcaggtaacaaggattgataaacaggacgctaataaaagcgccaaatagagtcagaatgctgattttacggcgtgacgccgtttgttgcgcctaccctaatctttcatcctgctaatgaatagtggcgataatctggaaaatgcaattatcacgtgactaaaacaaaaaaagcgggtgctttcgcacccgctttattcatcttctgaacagacctttcagtcactacacaacatgaacctgcaggttctgctgcaccagcacatcgcccagggtgttatcactggtcagcgccgagttgtggtagatctcaaagactctgccctcaacggtacgctcgcccgtcacttcccagattccgccgttgctgttagccagtgtcacctggctgccatctgcgcctttgatcagcaaatcgtcactctgcttatccgtgatattgagtgcttcattgagatcgagcttcacggagttggttccggttttacccaaatcgagcacctcaatgtgttcgaccttcaggcccagcgcggtgagatccagactgagatgctcaccattcagcaccagggtatcggtgcctgcgccgccatcaatatgggtaaagttaaggtcactgaccgtcacgatatccgccccgctgctgccggtcactgtcgccccctcaatggtgctgccatcggccagcgtaatcacgacgccgccgatggtgtaccccgcctcctctgccggtgccggtgccaccgcggcgtcatttgccgccgcgttttcactgctgccgacgggtgtcacggtatccgcttcggtgatcagcgtggaagccactgccacatgggcgctgctctcgtcgctgctggtgctgctgttatgctgcgtctccgcgctggcgacagtagcgctgtcatccgccaccgagaacagggcaaccgattcgtttgccgccagcgtcaccggtagcacggcacccagtaacagggtattggtggtcgagtagctgttaccggccgcgtcggtaatcgtgactttcgccagcgtttcccagcgacagcagcaggccccccaccgacagcagtgaaggtgagaagttaaccgcgtaacgccccagcgcatcggtcgtggtgtttagcgtcgggccgttgttgccgttggagagcagcagcgtaacgctcactttcgagccctgcgcggcattcagcgatcccccctgcaccaccagacccgccagtaaggaaccgacgatgctcagcaccggatcgactccgaccagcggctgattgtgcgacagcgcggtaaagctgctggtactggttgcggtgttgccgccaatgtccgccaccgtaacggtgagtggatggctgccatcggcgatccctttcagcgtcgctgacggcacgctgatgctccatgcgccattcgcaccaatggtcgtggtaaggatattacccgccacgttcaccgtcaccgtgccgcccgccgcgttggtgctggttcctctgatggtttcagtactgttggcttccgcaatattgaggtagccatcgccgccaaagaagctgttgacgctgaccgtcggcgtggtgtgactgaccacacccagcgacgccgaggtgttgccaatgctgcccgcaccgttggtcacgctggcggtgacggtctgcagaccgtcagtaatggcagcaaggttagccgccggaacagagaggctccagttgccgttgctgctcaccgtggtgctgtaagtctggccgcccagcgtgacgcgcacgaccgatccctcggcgttgctggcggtgccgctaatagtctgcgccgttttgacatctgccgcactcagcgcactgtcaccaaacagcgaggtaatggcgaccaccggcgtcgactgactgatgacgctcagcgttccgctgctgtttgccacgttaccgtaggcatcggtgccggtgactgtgacggttttactgccgtcagtgatagcaacaagatccgctttcgggacggtaatactccagttgccgccgctgaccactttggtggtgtaggtcaggccattcagcgtggcgctgacggttgaaccggcagagaggctggacgtcccgctcagggtctggttagaggccagatccgcggcgctcagcacgccatcgccaaacaccgtattcaccgacagggtcggctggaacagtcccagtgacacgcccgcgctggtgctgctgacgtttccgaccggatcggtgacggccgcgctgacggtgaagttaccgttcagcagcgtagacagaatcgctggcgagacggcggttgagaaactgccatccgcgttgacctgcgcgtcgacgatagtgttgccaattgccagcctgacgctgctacccgcagccagcccggagaccgtgccgctgatggtctgagtcaccagcgactccgccaggttcagcacgccgtcgccaaacagcggattgagggtgactttcggcaggttgtgaataccgaccagtgccccggccgtggtgctgttagtgttacccgcgctgtcggtgacgctgatgcccacggtcagattgccatctgcaatcccctgcaacagcgctggcgtcagcgagacgttaaagttgccattggcatcggtcgccgtcaccaactgctgtgaacctaccgacaccaccacgcgcgatcccggttccgcgccgccaatcaccccaccgatcacctgggtgaccagcgaatccgccacgttcagcaaaccgtcgccaaacagcggattcacggtgatggtcggcagcagcgtatcgacccggataccggcgctggtgctggcggtattgcccgccgcatccgttaccgacgcgcccaccgtcaggttgccctgcgccagcgtgcccagaatatctggcgtcactgtggcgctgaacgccccgcccgcacccacggtggcggtcacctggctgttgccaaccgagagcgtcaccacactgccctgcgcgacgttgttcaccaccccgctgatcacctgtccggtggcgatatcggccaggttcagcaccccatcaccaaacagtgaggtcagcgagattgatggcgtctgagtaaagatgccgatggatgcgctgctggaggcgacattacccgccacgtctctgacgctgacgcccagcgtcagattgccatccagcagagaggtcagatcgctgcccggcaggctaacgctccacactccacccgcctttaccgtcgtactgtaactcttgctgccaaaggtgaccgtcacctgggaacccacagccgcattttctatcacgccactgacgagctgtccggcagcggcttccgcaatgttcagcaggttatcaccgccaaacagcccggtgagcgcgccaaccaccggcaccgcatcgacaatcgcggtgacggtttcaccgacggtacgggtgttgcccgcggcatcggtcagggtgacgtcaagcgcaagattgccatcgcttaacaggcccagcaccgaaggcggcaccacgatggcccatttaccatcctggcccactgacgcagagagcgttgtgccgcccagcactaccgataccgtggcacccacgcccgccgaggtcgcaaccccggagatagtctgcgccaccgtagtatccagcgcgctgagcgtgccgtcgccgaacaccgaatcgaccaccagcgtcagcgcactgttgaccactttgttgaccgtcagcgtggcgtcggtctggtttccggctacatcattgacccgcacgccaaacaccagcgcaccttcagtgaggctcgccaggacatccggcgcgagatcgatgctccagcgtccgtcagcacccaccgtcgcggtggcgatcggcgcggcatcgcccagatagagaccgatggtctggccttctgctccctgcgcgctgccggtcagcacctggcttagcaccaggtcagcggcgttgatcacgttgtcgccgaggaacgcgtcgaccaggaccagcggcgcggcggtatcgaccgtcaccgtctgggtggtcgtcgtcacgttaccagccgcatccgccagctgcgcggtgatcaccggcgagctgccatcgggaagagcctgcatcgcgctggcaggaaccgttgtggaccaggtgccgttgctctgcaccacggcgttgtaggtctgattattgaaggtcaccaccaccgtgcgacccacttcgctgagatcggcggtgccactgatggcctggctggtggcactttcattgccattgacctggttgtcaccggtaaacggattgagagtcagtgccggtggcgtaaggtcgatcagcacgttaccgctggtggttacaggattagtgccgtcggtagcattcaccgtgatggcgacgctgccgtccgcattgccaaaggcgctgaccggcaatgccgccgttgaccagttgcccgacccatccagcgtagtcgcgtactcctgaccattgatcgacaccgtcactaccccacccgcgccgaggttagcggaggtgccactcactaccacaccgcccgctacatcctgagtgctgatgatgttgtcgcccgacaccgtgcccagcgtgaccagcggccctggcggtggggtaagatctaccgtcagcgcaaccgtgccgttggcggtattgcctgccagatcggtcactgccagcgccagagtcgtcgatggaccaaaggtggccatctgttctggcgtcagcgttacactccagttgccgttggctgtcactatcgcggtgccaagcagcgagtcattcagcgagatcgaaaccactgatcccggctcggctcccgctgcggtgccgctgagactctgcggctgaatgctctcggcgtagttcagcgcattgtcaccggtaaaggcggcaacattaagcaccggtggtgtggtgtcgagcaccagcgaactgttaatggtggtgctgttgcctgccgcatcggttgccgtcacggtaaccggataggtggcatccggcagcagtgaaagctccgccgttgtcagtggcaccgtccagttcccattggcatccactgtcgcagaataggttgtgccgccaagcgtaagctgcacagtctgattcgcacccgcctcaccggtggttccgctcagcgtcactcccgcggccacatcgccgccattcacataactgccaaggaattccggattgaccgcaggctgcggcgcgctgagatctgcggtgaacggcagctgcgccgatgcgctgttgcccgccgcatccacgacgttaaccgtcagtgattgcgcaccgtcacccagtgaactcagggcgttggcaggaatgttaacagtccagttaccgttgcttgccaccgtgccagaatagaggctgccgttgacatccacggtaatgctgaccgcctggttcgccccgacactgccggtggtgccggtcagggtcacccctgccgcggcttcactgatgttcagcaggttgtcgccgccaaatgcgcctgggttgaaggtcggcacaggcagcgccacctctgtcaccacgttctgcgccgtcgcgtcgctgttacccgcgatatcggtcgccgtcacggtaatggtgtgggtgccgctggtgaaggtggctaactgcgctggcgacagggccagagaccagctgccatcggtctgcaccgtggctgccagcggctgaccgttgttaaagccggagatgagcaccgttaccgtctgtccggcaccggtaatgccggttgtgccactgaggatctgttcaccggccgcctctgctgcgttcagcgcaccgtctccaaacggcaggttcagcgtcacgtccggcagcgcattcacggccaccagcacagtgccactggtgctgccgacgttgccgttcgcatcggtaaccgtcacgctcaccggccagttgccatccggcaatgactgcaatacagaaggcggcagatccagcgaccagcgcgaaccatccgcactgagcgtagcggaatagaccgtgccattaacggctaccgtgaccgaggcggcgttattaatattcaccgcaccagtcagggatccgcctgaggcggcctcttcagcattgatacggccatcaataaatggcgtatccagcgttggattagcaatcggcgtaatcgcagcgacgaacgttttggtcgtttcaatgctgttaccggcccgatccgtggtggtgagggtcagggtatgttcaccggttcccaggctggcaatgaactctgggggcaggctggcagtccagttgccattggcatcgaccgtcaccgacagcgggatattgtcatcgcctaccgtgacgctcagggtctggcccggcacgacggtggaggtgccggtgaccagctgaacggagcctgcttcgctgatattaatgatgttatcgccgaacagtgtcgtgtcgaaggcggctgaaacaggatcactctgcaggatctcaacgcctgcggtaacctgcgccggattaccggcaccatccgcggcgctgaccaccacctgtgtcaatccatcggccaggcccgtcagcgcgcccggtgccaggttcagcgtccagttgccgctgacatccgtggtggtgctgaagttctgcccgcctacagagatgttcaccacgctgccttccggcagattggtactgtcaccactcagcgttaacgccccttccgcatctgccgcactgatcagcgcatcgccaaacggcgtattcagcgtcagcgctggcagggtattaaacgctacgtccagtgtcgtggtgctatccgtggtgatattgcccgccgcgtcggtgaccgaaacggtaatcgcattggggccgtccgccagctgctgcaggtcagcggtcggaatagtaagtgaccagttaccgtcggcatctgccgtggtggtatagctgacgttattcagcgtcaccgtcaccggcaatgcgcccgtggtgctgccgctgatggtgagatcctgcagcgactccgccaggttaagggtatctcccgcatcgaccgtgatattcgtcagcgcaggcggtgtggtaatgaaactaacctcctgagtggcggtcgccggattgcctgcgacatcagtggcggtcacggtaaagatttgcgtgctgcccggagccacgctggtaaaggcagctgacgggacattcaccgtccagttgccgtcagcgtcgagcgtggtgctgtagtcagtgccgttaaacgacaccgtcaccagcgtacccgctgccagcagggtgctgctgccgctgaccgcgacatccgctgtggcctcggtggcgttaatcacatcatcgccggctaccacgttcatggtcagcgtcggctgaacctgctcgctggccagcacgaccaggctggtgctggcgctggccggattgccagacgtatccgctgagaccacgaccagcagctgatcgccatccggcagattacccagatcggcggccggaacggtcaccgtccagctgccgtcggctgccaccgtgccgctgtactgaatgttattcagcgtcaccgtcaccagctggccttccaccaggttgttactggtgccgccgatgttcagatcctgtagcgactccgcctggttaaggaagttatcgtcactgatggtcccgatggtcagggttggcaggttcagagtgtcagcatcacgcgtcagggtctgggtggccgtggccgggttccccgccgcatcggtcatcgagacagcaacggtgtagctgccgtctgccagcccctgcacgacgctggctggcagtgtcacctcccaggtgccgtcagagagcacctgagtggtgtaatcgacgttctggaagctgacggtgactgtctgtccggcatccgctaccgacgcactgccgctgatagcgaccgcttccagcacctctaccgaattgatgatgttgtcgccgccgatggcattgacggtcagcactggcggtgtgagatcgaccgtaacggcgctggtcagcgaaccactgttaccggcggcatcgctggcattgaccaccagcgtagtaaccccctcgcccagcgtctgcacctgatctgctgttaaggtcagcgtccagttaccctgcgcatccaccgtagcggaataatcattcccgcccagcgtcacgctgacggtctggccgttgcccgctacaccggtgctgccggtcagcgtctgaccgaccccctgttccgccaggttcagataaccatcgccaaacggggtgtctatgctgacggccagcgacgccgtcgccacggtgatttcacgggtttcggttaccgggttacccgccgcatcgctgaccgtcacggtcagaatgtacgccccggccggaatgccggccagcgaaacccgcaggcagcgtcagattccactcgccgttctggtcaaccgtggtggtccaggtctgattgttcagggtaatggtgacctgctgtccggcttcggcattgctgttgccgctgagaacaatcggcgcggtgctttcggcaatattgatactgttatcgcccgcaaccgtattcagtgtcagggtcggtggcgtcagatccaccgtcacgctgccctggctgctgccggtgttacccgctgcatcctggactgtgacggtatagttcaggagatcttccggcaggccggccagcgcggaagccggcacgctgatctgccagttgccattgccgtcgacggtgccgttgtaggttgcgccattcagcagcacgctcaccgtctggccgtcaccggttatgccggtggtgccgctcagggtttgtgctgtggcgatctcgctgctgttgagcaggccatcgccaaaggccgagacgagctgcggtgctggcagcgtcgccagcacgctgagcgctgcctcgctgctcagggtcgccccgccgctgtccgttgcggtgaccgtcagggtgtaaggcccatcggcgagcgccgtcagtgcctcagccggaacgatcactgtccagcggccgctggccgagacctgcgcggtgtagctgatgttgttaaacagcaacgtgaccgtgctgccctctgccacattcaccgacgtaccggtgacgaccagggcctgacccagctcctgcgcattcaggtagttgtcttcgctgatggcatccatcgccaggccagaggcattgctgttgacgtcaaaggtgagattgctggtggtggtgttgcccgccacatcgctgaccgccacggtaaaactggcgctgccatcattaatcgcggccagcgcaccggctggcacgatcaggctccatgccccgctcgcctgcacggcggcgctgtagactgtgccgtcaacggtgacggtgaccagctgacccgcttcgacgttggtggtggtgccggagagacgttgatcggtgaggcgctccgcgccatcgaccacgttgttaccggcaaaggcatccagcgtcagggtcggcagtgtgcctggctccactttcagcgcgaggtcgcggctggtggtggtggcatttcctgccgcatcgctggcggtcacggtcagcggatagctgccgttgcccagcccggtgtaaaccgtggcgggcagctccagcgaccagacgccgttgacgtctgcggtggtgctcagggtggtgccgttgaagctggccacaatcagggcgttagcttcgctgctgccggtcagcgtcagcggctgctgactttcagcggcgttaatgatgccatcggatggcgtaatgaagttcagcaccggaggcagcgtatccaccacgaggttgccatccgcctggctgttgttgcccgccacatcactgacgaccacggtgtagccactattgccctgtggcagcgcagacaagacatcggccggaacggcgacctgccagttgcctgcggcatcgaccgtgccgctgtagttgttgccgcccagcgtcacgacgacggtctggccgtcgccggtcacgcccgtgttaccggtgatcgtgccaccggcggcggcttcctcaccgttcagaatgccatcatcaaaggccacgcccggggtcgccaccggcaatgcgctggcgatcaccgtcagggtagcgtcgctggtcgccagcggctgtccgttagcgtcgctggcggtggcggtgatggtctgcgggccatctgccgttccggtaaaggtgcctgccggtaaggtcaggctccagcttccatctgccgtcacggtggtgctgaccgtggtgccgttggccagcacggtgacaatgctgccgtcaggcagaccgctggtgctgccgctgactacaacggcgccacccaattcctgcgcattgaggtagttgtcgtcactgacgggtgccagcgcgatcgacggcagggtgttgtccacactgaagtcaagcgggctgctggcggtgttacccacggcgttgatgacgctgacgttcagtgtctggttgccttctcccagttcagccagggcgcccgcaggcagaataatgctccagttgccgctggcctcaaccacaccgctgtattcgatgccattcagggagatgatcacctgctggcccggttcgacattcgtgctgctgccgcgcaccgttatcggctgcagctgctccgctgccgtgacgatgccgtcaccggcgaaggtgctgctgtcgatggtcagtacaggttgcacgtccggcgcggttgccacattcagatcaaccacctggctgctctgattcccgttagcactggtttccgtcaccgtcaccagattactgcctggaggcagtgccgccagcgcttcaggggcgatctgcagcgtccactggccgttaacgccaacggtggtgctgtagagctggtcattgagctggactgtgaccacgtcaccattctgaccactgccacttaccaccagcggctctgccagttccccgacgttcagcgcgttatcaccgctgaccggcgcgacgaccagcggaggcggcgtagtcgcaaccgtcagggcactgttctggctgctgctgttaccggctgcgtcggtgacggtgaccaccaccggatagctgctgccattggtcagaccggcaagcgccgctggcggaacagccagcgcccagtttccgtcaccatcaacggtgccggtgtaggtcacaccattcagcgtcacactgacgcgatcgccttcactgcctgcgccgctgaaactgaaccctgccgcctgctcagcgatgttcagcacgccatcacccgcgggcgcagcgatactgaagtctggtgccgtggtatccacggtaaccgacactggcgtagtggcgacgttgccgctgacggtggtgacggtcacgttgagatcgtaacggccatctggcaactgttgcagattcgcagcagacacggtggcggtccagctgccatcggcggcaaccactgcgtcataggtctggccattcagcgcaaggctgacgctgctgcccggcgtaacggtgccgctgagggtcagatcggtggcggtttcagcctcattaatcgtgccatcggtagcaatcgggttaacggtcagcgccggtacgccggtatcaacaatcagcggctcgctgatgctggtgctgttacctgcttcatcactcaccgtcacggtaatcggattgctgccctgcgcaagtgcctgcagtctgtctgcgggtatcgtcacgctccattcaccattcgcgtctacagtggccggatagctggcaccgcccagggtcacgctgacggcctggcctggcagcactgtgccggtcagcgtctgcgccgcgctggcttcatcggtattgagtatgccgtcagtgaatggcgtgttgatttgcgggtctgccagcggcgcggtcgccaccagcagcggcaggctgttctgcacatcacccgaagagacggtaacgctggtcgtgccctgcggcagcgtcgccagatcggcagccggcacggtcagggtccacgcaccggtttcatcggttgtggtggtgtagacggtgccgccagtcaccagcgttacgctgatcgggctgttagccggcaggttcgctgaaccgccgctgaggataagatcgctctgcgcctccagggcactcagcgcattgtcgtcactgattggggcaatcgacagcgacggtacgggtgaagtaaccacgctgaactgcccttcagcaggcagcgccgggttaccggccacatcggtaatcgccacggtgaaggttttatcgcctgcaccgcccagcgatccggctggcagcgacacactccagctaccgtttcgcctgtactacgccatcgtaagactggccattgatggtcagcaataccggctgacctgccggtacgccggtgacgttaccggtgaccagaatgtcggtgagctgttcagcgctgtcgacctgattatcgccggtcacgggattaatggtcagcgccggcgacgttgccgccagcacagtgacgctggtcggtacggtgctgctgttaccatatgcatcgctgagtaccacatccaccggataggttgcgtcacccagctggctgataatcgcggcgggcaccgtaacactccacgcgccatcagtatccacggtggcggtgtaggtctcgccattgaaactcaccgtgacggtgtcgccctgggcccccccgcgtccgtcgagtgtgagatcctgagtgtgttcagcgatattgatataaccatcactgcccggcgtggagacttccagcaacggcggtgtggtggcgaaaatcagtgaactgctggctggcgtggtattaccatcggcgtctgtcgccactaccgataccggttgggtaccgttgggcacatttgccaggtcggatgccggaacggtgacactccagctgccaccctgcgccaccacggcgctgtaggccacgttattcagcgtgacgcggatgatgtcgccttcgtcgccggttccgctgacgattagcggctgctgcgcgtcgctgacgttgatcacgccatcatcgctgagatcgttgagcgtcagagcgggcaccgcggtagccacccgcagttccgtattctgagtgctgatgttaccggccggatcggtcacggtgacggtcaccggataggtctgattggtcagcgtgccgagatcggccaccgggacggatgcactccagttactgttttcgtcaacaatggcggtgtaggacttaccgtttaactccaccgtcacgctgtcacccggtgtgccggttccgctgatttgcagcggcgtagtgagttcgttgttggtcaggacgccatcaccgcccggagcggtaacggttgcaaccggaggctgcgtgctgaccgccaggggctgcgtctgcgtggtggtgttaccgctggcatcagtcagcgtaactaccagcgtatagctgctgccatctgacagggcctgcagcgccgctggcggcacatccaccgtccagttaccctgcccatctacggtggcgctgtaactctcgttattcagcgagacagacaccacttcgcccggcaacgcacctgaaccgctgaccggcagaccggcagccacttcgctgctgttgagaatgccatcgccgcctgcgacctctgccacaatcagattcggtggcagcgtgtcgacgctgaagttgagcgtctcatccacgcggttgcctgcttcatcaatcgcggtaatgatcaggctgttggcgccctgtggtagtaaggcgagatcggcggccggcagcgccaggctccagctgccgtctgcattgaccgtggtgctgtaggttttaccgttaagttccagttcaacctgctggcccggcacggctttgccggtgctgccgccgatcagcagatcgctgcccgcttccacccggttgagaaggccgtcggtgatcgcgctctcctccagcgtgatttgcggcagcgtggctgcgaccacattcaactgagcggagtcggtcagcagtgcgccggtggcgtcggtggtggtgaccgaaatcagttttacgccgtcggtgatagtggtgagatcgcctgccggaacagtgacgctccagaagccattgctgttcactaccgcgctgtaattgctgccgttaaagttaacctgcaccgcctggcccgggttaacgcccactgcagagccgctgatgatcagatcgctgctcagctcctgctgattcaggaaaccatcaaggctgacaggttcactaatggaaaccacgccaggttcgcctgccgctggggcgacgttaatatcgcgggtgtcggtggctgaggcacctgccgccgttgtgacgctgaccgcgatggtgctgctgcccgccgccagtgcgctgagcgccgaagaggggatctgcgtgctccagctgccatccgcgttgaccagcgcagtgtaattttggccgcccagggtaatggtgaccgtctggcccgcctccacgttgctggtgctgccggacagcgtctggtccagcgctttttcgctgttatccagcagatcgtcaccggcaaacagggcgatcgtcaccgtcggcgtacccggttccgctggcgcttccaccgcaatcacccgatcttcgctgactgttacgcccgcctgattggtgactgtggccgcgatagtcgcgttgcccgccgtcagtgccgccagcgcgctggccgggacgctcaggctccagctgccatccgcgccgaccgtggcgctgtaagtctggtcgcccagcgtaacggtcacgacctgacccgcctcgacattggttgagctgccgctcagcagctgatcgctggttttctcatcgttgctcagcacgtcatccacggcgaactgatcgagcgtgatagtgggctggcccggctcggtaaccggcggctcaaccgtgatcggcagcgtgtcactgacggtggtgcctgccgcgttgctgaccgtgaccaccagcgaggcagaaccggctgccagcgcaccgagtgcatcggccggaatggcaatgttccagctgccgtcggcgccaaccgttccgctgtagctctggccgcccagcgtcaccgtgacaatctggcccgcctcgacgttggtggtgctgccggagaccgcctgcgcttccagcttctcatcgttgctcaggatgttgtcgtcagcaaaggcattgagggttagcgtcggggtgcctggcccggtgcccgaggactccaccaggaagtcgcgggtttcagtgatctgagtaccagactgatctgtcaccgtcacattcagggctgcgctaccggctgtcagcgccgccagtgaactggcaggaatcgacacgctccagctgccatccgcgccgaccgtggcggtaaaagtctctccgttcagagtgacagtgacctgctggccttcaccgatattagtggtggtgccgctcagcagctgatcgctggctttctcgctgttgctgaggatgtcatccccggcaaaggcgtcgatggttacggtggcttcacccggctgcgttaccggggcttcgacagtgactggctgcgttgaagtgactgtgtcgcccgctgcattactgaccgagacggtcagtgtggtggtgcctgctgccagcgcattcagcgcggctgacggcacggcgacgctccagctgccatcaccctgcacgctggcactgtaggtctgaccgcccagggtgaccgtcacgatctgcccggtttcgatattactggtgctaccgctgacaagctgatcgaccgctttttcgtcgttgctcagaaggttatcgccggcgaaatcattcagggtcagagacggcacgcccggttccgttactggcgtctcaaccgcgatatcgcggatttcggtagtgctcacgccatcggcattgctgacggtaacgctgatagcattagctcccgctggcagattacccagcgcggctgccggaacaattacactccagttaccactgccatcgacggtgccaaggtaagtctggccaccgaaggtaacggtcaccgtctggcccgcttcgatgttggtggtggagccggagagcgtctgggccgtccctttttcatcgttgctgaggatgtcatccccggcaaactgaccaatggtgactgtgggttcgcccggcaatgtgacaggggcttccacggtgatgggcagcgtgccggtcacggtatcaccggccacattgctgactgaaaccgtcagcgtcgtttcacctgccgccagggcgctcagggccgccgatggcaaagtaacgctccagttgccctgcgcatcaacgctgccgctgtaagtctggccgcccagggtgacggttaccagctgaccgggttcaacattgctggtgctgccggtgagtgtctgatcggtggctttctccccattactcagcacgttgtccccggcaaaatcatccagcgtgacggatggcgggcccggaacgaccggcgtatcaatgctgatcgcgcggttttcactggcttcaatgccagcctggctggtgacgaccgcggaaatcgcaaccgaaccggttgccagcgcattcagtgccgcaggcgagagcgtgacgctccagttgccctgcgcatccactactgcgctgtaggtctgatcgcccagcgtgatggtgacaatctggcccgcttccacattggtggtggtgccgctaagaacctgatcgctgcttttctcggcattgctgagaatgtcatcaccggcaaactgatcgatggtgataacgggcgtacccggctgagtcagtggtggttctacgtttacggtcaggctaccgctggcggcggttcctgcctggttagcaacggtggcagtcaccgtggtggtaccggatgccagtgcggtcagcgcatcagcaggcacggtaatgctccagctaccgtcgcctgccacgctgccgctgtagctctggccgcccagggtaaccgtgacgatctgcccggcttcgacgttggtggtgctgccgctaagagtctgatcgctggttttttctgcgttgctcagcacgtcgtcgccggtaaacggggcgatcgtcagggctggcacgccaggggtggtgtcaggtgcctgcacctggatacccaggctggcggcagccgccgtgcccgcggcgctggtcacactgaccgaaatggtgctgctgcctgcagccagcgccgagagtgcggcagccggaattgagacgctccagctgccatccgcccccacagtggcgttatagctctgtccgcccaatgtcacactgacctgctggcccgcttcgacattgctggtgctgccggacaacgtttgtggcgtggttttttcgctgttatccagcaggttatcgcccgcaaacgggttcaggctaatggacggcgcagccggtgtgccgggatcggcggccgcgacggtaatgggcaggctgccggtggtcgtcgtgcccgccgcgttagtgacgctgacgtcgatggtggtggtgcctgcggcgagtcccgccagcgcggcagcagggatagtaacgctccagctgccgtcagcaccgacggtggcgttgtaggtctggccgcccagcgtgacagtgacaatctgacccgcttcgacattactggtggtgccgctcagtacctgatcgctgcttttttccgcgttatccagaacatcatcgccagcgaatgcattgagcgtgatagcaggcgtccccggcgtgaccggtgttccaggatcggtgccaccgtcattgccgccaccgttacccccaccgccgccaccaccaccaccgccgacgccaacggccagaccggctaagccgagcacacccagaccgcccgccgttatcacacccatcgaggtgttggcattatctgccagcagcagcggctctacgctgtcgagtgattcataggttggcgtgaccgacgtggaagcgagttcagccccttctgcggtctgcggaaagagcgcgtgttccggtgggttgacgccatcatcgaacaccagtttcgctgtgctggccatcggcgtcgtcgaggaagaatttctgatagcggacagtcttgccgtcgcgcatatgcagcaccagatcgttaccctggcgctcatactgcgtcaccatgtcgcgggtgccgctgatgcgcacgacgctgggctcggtgaggttaatggattgtgacgaaccgctgacggactgcgagatgagtgtgccgttttcgcgcgagataatgtctacacggccttgcgtgagttctgccatttgtaacctctactccaccagattagctaatatactgaacccataaacataaaattattttatgcttacagtgttcacacatagtttcaccttctgaagatcagaagatgtcttaacctggtgtatgtcgaaacggcaaagccaaagctggtcacacgtccctaatcagagtggcgagtgacgctattattgttagttttacttgtacagactcacgcaaaatgtaacgtttctgacagattaacttttagcgtagccgtgttaaaaaacaatttcaatgtacagatttcattatggtttaatcttcattacataagcctcacttgaaaaaaggttttcataaaatccgctttgcctttgtttttacatgtcaatttattgctgactgtttccggaaatgatgcggaaaggttaaaaaaccaccactaccggaacatcagggctgtaaaaaaaatttgttcattaagcgattcagccatcatttataagtggccctgttccgatttttcagcagcaagtcgttgaaaaacgacagtgaaatttgagttaagtcattctgcggggcggtggtcatgccaggaaagttctggaaaaaattcgcagcgcgacaaaagtcggtaaactcccggttttgtcatttatgccatgttgcaatccccttcctgataagaggcgcaacgaccactgactcacggccagtgctacacttttccgctttaccattgatgaatctgacctatgaccgcactggacgctgcacaacaaaacaaacatcagagccgcctgaactggggcacacgcaccatctttttgatcaatggcttaggaatgtcagcctgggctccgctggtgccgtttgcccgcgatcgtctgcagctcagcggcgcatcactgggcgcgttactgctctgtttgggtattggttcgctggccgcgatgccggtgaccggcacactggtggcgcggtttggctgccgtcgggtgatgtgcttctctaccctgttagtgctgatgatgatgccgctactagccacggctgactctcatctggtcatggcggctgcgctgatgctgtttggcgccgggctgggcatgctggatgtggcgatgaattatcaggcggttcaggttgagcaggcggcggataaaccgatgatgtccggcttccatggcttcttcagtcttggtgggattctgggtgcgggcacggtcagcctgttgctgagccagtctttttcacccctggccgccacgctggtggtaatggcagtgatgttgttgctgttgctgtggcgactgccggtcttaatgaatgaacgcctgcatcagcccgatcaaccctggctggtgatcccacgcggctgggtcgcgtttcttggcctgctctgctttatcctgttcctggcggaaggggccgtgctggactggggcgcgctgctgttgctgcagaaacccggagatgtcacccgcctgggccgggctgggctatgcggtcttttccgtggcgatgacgctgggccgttttagcggcgataagatcatccagcgttttggtcgctacccggtgatgctgaccggcgcgctgaccgccgccgcgggcatgagtctggccgtctggctgccgtggccggagatcgccctgctggctttcctgctggtcggctttggtttatctaacacggtgccgatgttgttcaatgctgccgggaatcaacaggatatgcctgcgaacctggcgatttctgccatgacaacgctgggatatgcgggtattctctcaggtccggctttaatcggattcatttcgcaatggatcagcctcagcggcgcatttttagcgatcgccctgttgctgttagcggtagccgccagtgcgcgaaaagttgcgcaataattcaggtacctgacacgctatgttgtataagtttccactgacctccggcaacgtcacccgcttttttgtggttttcaatctggtgctcctgctggcgctgggctttatggtgcataactcggtgaatgcctggctgaccgggaagcgctatgccatggacgatctggcacgtgacgttcagaagcgcattgatgcctatcgctttgccacctggcagatctatgaaaacctctctaccagtgcggcaggtgcaacacccggcagtaacctgcaggagacgcgactgcgtcctgacgtctactacctggaaaaaacccggcgtaaaacggaagcgctgattttcggctcacatgacagcagcacgctgggcatgaccatgcggatgtcgaactatctcgacacgctgtggggcgcagaaaatcccacctggtcgatgtactttttaaatggtcaggacaatagcctgattatgatctcgaccctgccgctgaaagatatggcgacgcgctataaagagagcgccatcagttcaatggtcgatggtcgtcgtgctgagatgttgcagcaggcgaatgcgctcgatgagcgcgagagtttctcaccgctgcgccacttcgccttccagaacgatcactatttcacgctgcgtaccacctttaaccagccgggccatctggccacggtggtcgcctttgatctgccggttaacgatattgttccgcagaacatgccgctggaaaatttccagctgcgtcaggacagctcaatgcctgccagcagcagtgaacagcaggaggtggaaaatacccgcatctcactggttaatcccaatatcgagattacggccaccctgcccagcacctcgctgcagctggtttatcaggtgccgattggccgtctgattatcgacaccctgcacaatctgctctggccgctgctgattaacctgctgctgttcctgctttcactggcgggtatcgtgctgctgcgccagcagtcgctgcgtcccagcgagaaccagagcgctgaactcgattcgctgcgggtattgaatgaagagattgtggccagtctgccggtcggtctgctggtatatgactttgccagcaaccgcaccctgctgagcaataagattgctgaacatcttttgcctcacctcaatctgcagaagatcattaatatgtccgaccagcatcagggcgtgctgcaggccaccatcaataacgaagtgtatgagattcgccacgcccgcagcgtgctgtcgccgcatacccagctgtttatgatgcgtgaccaggatcgcgagctgctggtgaataagaagctgcaaaaagcgcagcaggtgctggatcgtaaccatcagatgcgacagcagctgctgcacaatctgggccatgcgctgaatcaacccctggagaagatggtgacgcagctggtacagctcagccagcgtgatgccgatgagaccgtgctggatctgctcgatgagagtcaggggctggcgcggctggtggatgatatcgtgctgctgaaccggcttgaggcgcacgactggtcacccgatgcgaccgtctttaacctgcaggaactgctggatgagatcgcgctggaaagcctgccgctgatgcgccgcaaagggctgtcgctggtggtgaataatcacctggctaatgatgagacgcgctttggcgaccgtcgcgccctgcgtaaggtgctgaccacgctgatgcactacgccctgaccaccacccgctgggggaaaatcaccctggaagttaaggctgcggacaagcaggccgatagattgattatcgagctggtggataccggtgcgggcctgacggtggatgaactggccaatgtcgacttcccgtttcctgggcgataccagtcaggatcgctacggacaggcttctggcatggcgttcttcctctgtaagcagctctgcaagcagatgggtggcagcctggatatcgtggcaaaagcggatatcggcacgcgctacaacatgcagttgccgctggtgctggagcagaagcgcgaagaagaagaggaaaaaattctggatggcgttaccgcgctggtggagatcaccgtggaggacgtgcataaaattgtctgccgccatctggaaaactggggagcgcgttgtctgacacccgacgagcgcatttccggtcaggatcacgatgtgctggtgaccgacgatccatcaaagcttagcggctgggcactgctgctggcggaagatgaactggggcaccatgcactgaacgaccagcagtatcgggtcaatttcaatctcagtaatgcgctgctggatgcattgctggcactgatagagaagcaactgtcgcatgatgtgatggataacgacacggaagacgacgcggccacgccattgatgagcggcggctatttccagctgtttacggagacagtaccggttgatgtgaagaggctgtatactgagtcggcggaaaaggactacgcctcgcttgctcagacagcgcatcgcctaaagggcgtgtttgccatgctcaatctgactcccggcaaacagctttgtgaagagttagaacaccacattaaagcgtgtgacgattcaaacattacaaataccaccagtgatattgacgcttacgtcaatcaactgctgcagcaaggtaaccaataagatgaataacttaaacgtaattattgccgatgaccatccaattgtccttttcggtatccgaaaatctctggaacaaattgaatgggttaacgttgtaggtgagttcgaagactcaacagcactgatcaataatctgtccaagcttgatgccaacgtcctgatcaccgacctctctatgccaggtgagaagtatggcgatggtattacgctgattaaatatattaaacgccactacccggatctctcgattattgttctgaccatgaacaataacccggcgattctgagttcagtgcttgatctcgatatcgaagggattgtactgaaacagggcgcgccaaccgatttgccaaaggcactggctgcactgcagaaaggcaagaaatatacgccggaaagcgttgcgaaactgctggagaaaatcagcgcgggtggttatggcgacaaacgcctgtcaccgaaagagagcgaagtgctgcgtctgtttgcagaaggtttcctggtcaccgagattgccaagaagctgaaccgcagtatcaaaaccatcagtagccagaagaaatcagcgatgatgaaactgggcgtggataacgatatcgcactgctgaactacctgtcgtctgtcagccagactcaggtcgaaagagattaagttacttcctgaggcggtgcagcctgcaccgcctcgcctctgctctatcccatccgcgttttacgtacccgatcagcatagattgccagcgtcactttcagcacatctaacgtcaccggtttcgacaggcagttatccatgcccgcatccatgcaacgctgtttctcttccgccagcgcattcgccgtcacgccaaccaccgggaagagatggcccagctgacgcaaccgctgcgtcaggcgataaccatccatattcggcatgttcacgtcggtgagtacaatatcaatctcgttacgactcagtacattaagtgcatcaacgccatcctgcgcagttttcacctgatagcccagcgtgccgagctgttccgacagcagcatgcggttaatcggatggtcatcgacaatcagcaccatgatgtcatcgttatgcactttctcttctaccggtgcggccagcaacagcgcatctgcggcgtcgttgcccagtgcgattcgatagatgcgcgccagcagcgccggaacctcatgcagcgtggcggtagagtggatccagcggccaggctgacgtttcacgtggcatatccacatgcgatccatcgaaagtgaccagcgcccgcaacggaacatcaatatccagttcgtaatcggtcattaccacatcgtcatggccaggcttaccgttatactccccgacctgaatgccctgctgctgaatctgacgcgtaataaattccgcgaggtactcattgcgcatcgccagccagattttcttatcctgtaaatcctccagcagcatcagtgacggcttctgccctttgtagattggaatacgcacaataaactggctgcccatgcctggctctgagtcgacctcgatgtcgccatccatcatattgatcagcttttcacagatcgccagtcccagcccggtgccctggaaattacgctgcacgccatttcccacctggaagaaaggatcaaacaggcgtggcagctctttcgccggaatgccgacgccagtatcacggacgcggaacgccagatagccctgcgcaacgtaagcatggaggataatacagcccgtatgcgtgaacttaatcgcgttattcagcaggttcgagatcacctgctgcagacgcagcggatcgccatccagcacctgcggaacgtcatgttcaataaagcagtagagcgtaatccgcttcttcaccaccagcgacagatagttgccgacgatgtgggtcacgatttcacgaggtgcaaacggacgcggctcaattttcagctgctctgattcgatttttgaaaagtcgagaatatcgctgatgattttcagcagcaggctggaggagttgttcatcgccgtcaccagcgagtcgataccgctgggcagctctttggtctgcagcagatcgagattaccgataatgccataaagcggcgtgcgcagttcgtgactgaccgtggcaaggaacatcgattttgactgactcgcctgctctgccgcgtgggccatctcctgcagcgactgctccatccgcacgcgcgccgagacgtcgaccagcacgcaaatcgccacgttctcattacgatagcgcgaatgcacgaagctgatttgcaaattggtattactgccggtgagcacatcgacaaagttgacctgctgcccgccaataatctcattcagccgcaggcgatcttcctgcgtcagcaacgtcagataattgtgcgccagctcgttactcagaatattggtgccgtcgctggtgcgtaaaatacagatcccgaccggcgcagaggcgacaatcttacggttaaactgctcatgctcttccagccggtgcgcattctcctccgccggcaggaacatccggcgctcaaacagccaggcgagggtaaacagaataacggcgctgaaaatattgagcagcagcgcattaatgatcatcagcttgagctgatccaccatcacgtcggtagatatcgaccacaccacgttaagatcggaaggcggcagcggctttttcagaaccagctgacgataaccattcaggtatccgaaccaggttttatcatcaggaagactatcgagcgagaaacccagcccgccgcgccgcgaatttagcagtggacgataattttcatcggtaatggacgcgataatcggcaggctgcccggctgaataaactcatccagccggatattctgttcgacgcccagcagcgcctgtaacttattagcaacgtagacgggcaccaccataaagaaggttccgacgcctggctgagcactgctgttaatccagtacatcggattgcggcgatcttcttcgctgctattgcgatagcgcagcacattctcacgcagcgatttcaggctgcgtttcccggtcagcattgctgctgccaatcgtgaagtcggccagacactgactctcgccaccgataaagaacacccgattcagctcatacgatgaggcgaagttacttttccagtaattgatgtagtaactgagtgaatcgagcgagttgcgccaggtattgctcatcgaggtacagtcgccatccgaaaacaggggcgtaaactgcggctgagatgttttgcctggcatcataccggtcagcacatccagaccgctgctggcgttggttaagcggttctcggtgatatatttcagctcacgcatcatgtccgccgaatggcgcacataccactgtatcgtgccgtagttgctggcaaactcctgccgaacctgcgtctctttattgtgcagcacgctgataatgtaaaacgcagtaagaacggcgcccagcgtccagattagcagcgccagcgcgcggaaaagatagcgcgagatgcgaagcgtagtgcggaaagagacaggatatttcaaaggtaactcgcagttggcaaggttagtcgcatcatcgatttttaatgcccatacactagctttatcgggcgtaaaaagccagccagccgcaggcttagcgggcggtttgggaatcttttaagatagccaaagcaacatctttatctactcaaagcggttccaccatcccaataagaaaggcctgctgtgcccgaagagcaaagcgtccacgccagggatggcgtggccgatccgcatggatgcgggaatcctttgcgatcgggcacagcaggccttgcgacggctcccatctgacagccatcagccagccattttcccgccccgcctctaagacctcaaacaacacgcccatcccctcaaagcgacacccaaatcccaccaagaaaggcctgctatgcccgaagagcaaagcgtccacgccagggatggcgtggccgatccgcatggatgcgggaatcctttgcgatcgggcatagtgggcctttcggcggctcccaactcacagccaccagccaccagccaccagccaccagccatcagccattttcccgacccgcctctcacacctcaaacaacacgcccatcccctcaaagcgacacccaaatcccaacaagaaaggcctgctatgcccgaagagcaaagcgtccacgccagggatggcgtggccgatccgcatggatgcgggaatcctttgcgatcgggcatagtgggcctttcggcggctcccaactcacagccaccagcaaccagcaaccagcaaccagcaaccagcctccagcctccagcctccagccctaagctccctgctccctccccatcacacaaaaaaaacggcaggccgggtttcccctgacctgccgtttctgcaacgaacctcagctcacgccagacaaattactcttcgtcttcagccgcgtcgtcttcgtcttctgcatccgcttccggcgcaatctcttcatcgtcgtttctctgcttccggcgcgatatcttcctcgccttccgccacgctaccgtcgattgaatccagctcttcttcttcaaccggctcggcaacacgctgcagacccacgacgttctcatcctctgcggtacgaatcagaatcacaccctgggtattacgacccacgacgctgacttctgaaacgcgggtacgcaccagcgtaccggcatcggtgatcatcataatctgatcgccatcaacgacctgaacggcgccaatcaccggaccattacgttcggtcactttgattgaaataacaccctgagtcgcgcgcgacttggtcgggtattcgctgttggccgtacgcttgccgtaaccattctgcgtcacggtcataattgcaccctcttcacgcggcacaatcaatgacacaacgcgatcgccttcagccagcctgatgccgcgtacgccagaggcggtacgacccatcgcacggactgcggtttctgcaaagcgcaccactttaccggccgctgagaacagcatcgcttcatcgttaccgttggtcagcgccacaccgatcagctcatcgtcgtcacgcagattcacggcaataatgcccgcgctgcgtggacggctgaactctttcagtgcggtcttcttcacggtaccgagcgcggtcgccataaagatattaaagccttcggtatactcacgtaccggcagaatcgccgtaatacgctcgttggcttccagcggcagcaggttgacgattggacgtccacgtgcgccacggcttgcttccggcaactggtaaaccttcatccagtagagacggccacggctggagaagcaaagaatcgtgtcatgcgtattggcgaccagcagacgatcaatgaaatcctcttctttgatacgtgcggctgacttgcccttaccaccacgacgctgcgcttcatagtcggtcagcggctgatacttcacatagccctgatgcgacaatgtcaccacaacatcttcctgattgatcaggtcttcgatattaatgtcagccgtgttggcagtaatctctgtgcgacgctcatcaccgaactgatcacgcatcagctccagctcttcgcggatcacttccatcagacggtccgcgttcgacagaatgcgcagcaactcagcgatctgctccagcagcgctttatactcatccagcagcttctcgtgctcaagaccagtcagtttctgcagacgcagatccagaatcgcctgagcctgctgctcggtcagatagtattgaccatcacggatgccatattgtggatccagccactccggacgcgcggcgtcatcaccagcacgttccagcatcgctgacacgttaccgagagcccacgactgcgcaatcagacccgcttttgcttctgccgggtttggtgcacgacgaatcagctcgatgataggatcgatattcgccagcgcaatcgccagaccttccagaatatgcgcacgatcgcgtgctttacgcagttcaaagatagtacgacgcgtcacaacttcacgacgatggcgaacaaaggcgtccagaatctccttcagcgccatgatcttcggctgaccctgatgcagggcgaccatgttgataccaaacgaggtctgcaactgggtcagtgaatagagattattcagcacgacttcgccaaccgcatcgcgcttgatctcaatcacgatacgcatgccgtctttatcagactcatcgcgcagtgcgctgatgccttcgacacgcttctctttcaccagctccgcaatcttctcaatcaggcgtgccttgttaacctgatacggcagctcatgaatgatgatggtctcgcggcccgttttagcatcggcttccacttcgccacgcgcacgaatataaattttaccgcgtccggtgcggtacgcttcttcgatgccacggcgaccattgatgatagcggcggtcgggaaatcaggccccggaatgtgctccatcagctcttcaatgctgatgtcttcattttcaatgtaagccagacagccgttaatcacttcacgcaggttatgcggcggaatgttggttgccatacctacggcgataccggaagagccgttcaccagcaggttagggattttggtcggcagaacttcagggatctgctcagtgccgtcgtagtttcggtacgaaatcgacggtatctttttccaggtcagctaacaggtcgtgggcgattttcgacatgcgaatttcggtataacgcatcgccgcggcggagtcgccgtcgatggaaccgaagttgccttgtccgtccaccagcatgtaacgcagggagaaaggctgggccatacgtacaatggtgtcgtaaacggcggaatcaccatgcgggtgatatttaccgataacgtcaccgacgacgcgggcagattttttatagggtttgttccagtcgttacccagtacactcatcgcaaaaagtacgcgacgatgaaccggcttcaggccatcacgcacatcgggtaaagctcggccaacgatgaccgacatggcgtaaccgaggtaagaattttttaattcttcttcgatattgaccggtgtaatttctctcgcaaggtcgctcatggagccgctatccctctacttaatcccggattttaaaggtgcgaaagtatatcacactgcaatgctctggtgaacgctaaccaccgatttcacccgcttttccttgcgcctgaaaggtgtgccatctgcggttaagcgtttatactgtgggcacattttgtcaggagttacgattcaatgaatgcacaaccgcagaatcatcagcagaaacgtcgatgcgcaggaaattgccaagtttgaggccgttgcctcgcgctggtgggatctggagggtgaatttaaaccgttgcaccgcattaacccgctgcgcctgggctatatcgcgcagcacagcaacggcttattcggtaaaaccgtgctcgacgtcggatgcggcggcggcatcttagccgaaagcatggcgcgtgaaggtgccgtggtcacgggtctggacatgggcgcggaaccgctggccgtggcgcgcctgcatgctctggagagcggagtgacgctggactacgtgcagcagaccgtagaagagcatgcggagcagcacgccggaaaatatgatgtggtgacctgcatggagatgctggagcacgtgccggatccgcgctcagtcgttcacgcctgtgcgaagctggtcaaacccggcggcgaagtctttttctctacgctgaaccgcaatccaaaagcctggctgctggcgatatttggtgcggaatatgtgttgcgcatgctgccgcgcggcacccatgacgtgaagaaatttatccgtccttccgaactgctgggctgggtcgatgaaacggccctgcgtgaacgccacatcattggcctgcactacaacccggtgactaaccgattcaaactggctcccggcactgacgtgaattatatggtgcacacccaccgcgccgtctgagtgacccgcccgcctgaatcagggcgggcatctcctcttctgcgcccgttctccctgtgccggtcacagcactcaccgcgccagaggcattctgatgtctgccaataggttacatcagcccggttccatcctcttcagcgttaccgcatccggttctctgctgaccagcaacccgctagcggcttttagccatttttcatcccttttcctgctgaatcctgaggattgaataagaaacacgcgcccgatcataataagaaaaaaaagtgtgatctggttgacatgatgccaggccttacaaggcgtgggctaagaaatttcgcaagaattacaacccctccagccatcattttttgctcttgttaagcggccgtaaaatactaaaatatgcccccatgtagttatggcttttcccatcaccccctagatgtagtgtttatccacacattattcacaatgaataggctgtgtataaaccgggatttcttttaatttttggatactcacgcaaaggtaaaaacgcgacatgaaccagagtctgctcgttactaaacgcgatggccgccaggagcgcattgatctcgacaaaattcaccgtgtgctggactgggcagctgaagggctgaacaacgtctcagtttcacaggttgagctgcgctctcacattcagttctatgatggcatcagaacctctgacattcatgagaccatcatcaaggccgcagcagacctcatctcccgcgatgcccctgactatcagtacctggctgcccgcctggcgatcttccacctgcgcaaaaaagcgtatggtcagtttgagccgccaaagctctatgaccaggtcgttaagatggtcgacatgggcaaatatgatcgccacctgctggaagactacagccaggaagagtttgcgcagatggacgagttcctcgaccactggcgtgacatgaacttctcctatgccgctgtgaagcagctggaaggcaaatatctggtgcagaaccgcgtttcgggtgaaatctacgaaagcgcgcagttcctctacatactggtcgccgcctgcctcttctccggctacccgcgcgacacgcgtatggattacatcaagcgtttctatgatgcgatctcgacgtttaaaatctccctgccgacgccaatcatgtctggcgtacgcaccccaacacgtcagttcagctcctgtgtgctgatcgagtgcggcgacagcctggactccatcaacgccacctccagcgcgattgtgaaatatgtctctcagcgtgccggcatcggtatcaacgccggtcgtatccgtgcgctgggcagcccgattcgcggcggtgaagcgttccataccggctgtatcccgttctacaagcatttccagaccgcggtgaagtcctgttctcagggcggcgtttcgtggcggcgcagccacgctgttctacccgatgtggcatctggaaatcgaaagcctgctggtgctgaagaacaaccgtggtgttgaaggcaaccgcgtgcgtcacatggactatggtgtacagctcaacaagctgatgtatcagcgcctgctgaaaggcgaagatatcaccctgttcagcccgtctgacgtgcctggcctgtatgacgcattcttcgccaatcaggatgagtttgagcgcctctataccaaatatgagcaggatcagagcatccgtaagcagcgtgttaaagcggtcgatctcttctcactgatgatgcaggaacgcgcctctaccggccgtatctacattcagaacgtcgatcactgcaacacccacagcccgtttgacccgagcattgcgccggttcgccagtctaacctctgcctggaaatcgccctgccgaccaaaccgctggaagatgttaacgacgaaaacggtgagattgccctgtgtacgctctctgcgttcaacctcggcgccatcgaaagcctcgacgatttggaagagctggctaccctggccgtacgtgcgcttgatgcgctgctcgactatcaggactacccgattccggctgcccagcgtggcgcaatgggtcgtcgtaccctgggtatcggcgtcattaactacgcctactatctggcgaagcatggtgtgcgctactccgatggcagcgccaatggcctgacgcacaagacctttgaagcgattcagtattacctgctgaaagcctcaaacgagctggcgaaagagcaaggtgcctgcccgtggttcaatgaaaccacctatgcgcagggcattctgcctatcgacacctacaagaaagatctggatgcgatcagcaacgaaccgctgcatctcgactgggaaagcctgcgtgaagagattaaaacgcacggcctgcgcaactcgaccctgtctgcgctgatgccgtctgaaacctcgtcgcagatctccaatgccaccaacggtattgagcctccgcgcggtcacatcagcatcaaagcgtcaaaagatggcatcctgcgtcaggtcgtgccggagtatgagcgtctgaaagatcagtacgaactgctgtgggaaatgccgaacaacgacggctacctgcaactggtgggtctgatgcagaaattcatcgaccaggcgatttcgtccaacaccaactacgatccgtcgcgcttcaccaacggtaaagtgccgatgaaacagctgctgaaagatctgctgacggcgtataagttcggcgtgaaaacgctctactatcaaaacacccgtgacggtgctgaagatgcgcaggatgacctggcaccttctatccaggatgatggctgcgagagcggcgcctgtaagatctaatggtcaggcgggagaatctcccgcctcattcatttcacgaggcctggcttcgtctacttttggacaacttttatggcttactccactttctcacagaacaaaaatgatcagctgaaagagccgatgtttttcggtcagtccgtaaacgtggcgcgcttcgaccagcaaaaatatgacatctttgaaaagctgatcgaaaagcagctctccttcttctggcgtccggaagaggtcgacgtttcccgcgatcgcatcgattaccaggcgctgccggaccacgaaaaacatatctttatcagcaacctgaagtatcagacgctgctggattcgattcagggccgcagcccgaacgtcgcgctgctgccgctgatctcgattcctgagctggaaacctggattgaaacctgggcgttctcagagacgattcactcccgttcttacacccacatcatccgtaatatcgttaacgatccggcagtggtgtttgacgatatcgtcaccaatgagcagattctggcgcgtgctcaggatatctcacgctattacgacgatctgattgagatgaccaactactggcatcagctgggtgaaggcacgcatcaggtcaatggcaaacctgtcgtcgtcagcctgcgcgccctgaagaagcagctctatatctgcctgatgagcgtcaatgcgctggaagcgatccgtttctatgtcagcttcgcctgttccttcgcgtttcgctgagcgtgagctgatggaaggcaatgccaaaatcatcaagctgattgcccgcgatgaagcgctgcacctgaccggcacccagcacatgctgaatctgctgcgcagcggtgaagacgatccggagatgaaagagattgcggcagagtgccgtgaagagtgcttcgagctgtttaagaaagcagcgctgcaggagaaagagtgggcagaatatctgttcagcggcggctcaatgatcggcctgaacaaagatattctctgccagtacattgagtacatcaccaatatccgtatgcaggctgttggccttgatttgccgttccagacgcgctcaaacccaatcccatggattaactcctggctggtctctgacaacgttcaggttgcgccgcaggaagtggaagtgagctcctatctggtgggtcagatcgattctgaagtaggcgctaacgacttcgacgacttccagctttaactatgagccgcgacgttgttattctgcgcagttccggcacccggctggaatgcacagacgagcataccaatctgctgacgctgctggaagccaacaatctctgcgtggagtttcagtgccgcgaaggttactgcggctcttgccggatgcggctgctgaaaggcgaagtgcattacccacaacggccgctggcttttgtgcagcaagatgagattctgccctgctgctgcaaagccaaaggcgagattgagctggagttataactgaggtgggataagtctggcttgatttgctgtgagatcgagtcagcttagggaacacggtcagatcggaaagacgcaaaaagcgtcatccctgacagctcggcccgcgcgattacgcacctcatccctgaggggcgcccgtagccgggccaacgcgttgcgttgttcaaaaacgctcccggcgtttttgtcccaggcgcgggacgctttcctcctctgcccgtgttccctgcgctttgagctaatttattgctgcgataatgacgctgtatgggattaattcgcagtcacatacaagacgggcgcctcaggcgcccgttttattttcactgatattactgtctgacagtttcaaccacatcaatccagccgtgaccggtgctcacttcgctgccgtgtaaccagcggcgcagcatgttcatcgccatcattgccaccaccttctgccgcgtctccagattatggcgaccggtactgaacttcacgcgctgaccaaaactgccatccggtgtatgcagcgccaccgaaatctcctcctgctccaggctgccaacagagagcgccagcgcggcctgctgctgtgcagcaagttcgcgggtgcggatcacctgctgctccagcgtctcctgcccggatggcaggatgtcagccccacgcagcggcacgctggcgccagccaactgccagtagagcagtccggcagtgtattgctcactgactgccagctgctcaccgcgctgctccagctcacgtgccagcagcgccggtaagccttcggtgccttcgaaaatggtgcactccgccagttgcaggcgcacctgctgccacacctgctccatcgctacccgctgactggccgggccggtgagcttgatctcaatgatcggcatggacgagcgatatcccatgaccacgccttccggcagcgccagcggctccagttcggcggcaatatcgctttcaccgcgaccaaaggtggtcagccgcagacaaatcggtggctcgggcggcgaaaatttcgctttcagacgggggatgatctgctgctccaccatcactttaaattcagacggcacaccaggcgtgaagaacatccagcagcgattgagttgcagggcaaagccacaggcggtaccgaccggattatcaatcagttccgcattggccgggatttccgcctgcttgcgattgctggccgccatcacgcgtccccggctggcgaaccaggcttccatctgttccagccactcctgctgcacctcaagctcaacgccacaggctctggcggctgccagcgcactgagatcgtcactggtcggccccagaccgccattcacaatcagcacatctgcctcatggctgcgcgcctgtagcgtggcgattagcgattcgagtgaatctcctaccgtggtacggctggtcataggcaacccttgctggaacaacatatccgccagccaggctgcgttggtatcgacgatttggccatgcagcacctcatccccggtcgacagcatctctactctaatcacgttgagttctccttttcacgtttgctttactgtacgaactcctcccgccagacacaatcggcatcaccagggattgtgaccattgcgtctcaggcacgttgcgcataaagatagcgagggtgaagcaggatcaagggtggtgaaggtgttcagggagttaaaaaccaataaaaacggcgggattgccccgccgcttttttactactgttgtctgctacaactgagtcagcgaatcgcgattagcgacgtgccagcagcagaccaagtaccagaccggctgttgcaccgataccgacaccctgccacggtttttcgtgcacgtaatcgtctgcacggtaagccgcttgtttagcgcgatagtagtagctatcggacgcctggctgacacgggatttcacatcgttcagcgcctgttcggctttgctcttaagctcaatgtacttctgatcggccggatcacctgatgccttaagaacttcttccagcgtttcggtcagtaacgcaatatcgtcatcgaggcccgtttcgaattgatttgtctgatttaccatcgtttcctccgtgtgaattgcaaagcagttcattaactatagtcataatctggcgctctgctgatttcctgctccaggaatcacctgatttttcatctgttaatcttgctcagtgcaggctgtgcgccgtttcgctacgcaaagaagtgtaagacgcagcggcaaccgcggaatttcgcttcgcttctttgattaatctgataaattttgtcgtgactgaattttccagtaaccctactgtcgtacccctctgttgcctgtgattatcgggccatgaaagtgcattttgcacgacagtcacgacaccctcgaacagctaaggaataatctctggcatgaatcgaagaatgtttatgaaagcgtcaatggccttctccgccgtcagcggcatgaccggcctgtcaacgctgtttgcgcaatccgcatgggcagaagatggcattgctgacggaaccgccgtacgcttcgatttcgacgtattgaagaaaaacgcggctgcgctggcgaaaaaaccctggggcggagcaccgggcgcgctgccggagacgctggccacactgaccccgcaggcgtacaacgaaattcagtatgacgccaaccactcactctggaacaacctgcccgatcgtcaactggacgttcagttcttccatgtcggtatgggcttcaagcggcgcatccgcatgttctctgttgacggcgagagtcgcgaagcacgcgaaattcacttccgtcccgaattgttcaactacaacgacgccaaagttgatacgaagcagctggagggcaaaactgacctcggcttcgccggtttccgcgcctttaaaaaaccggaactggcccgtcgcgacatcgtctccttccttggcgcaagctacttccgtgccgttgacgatactttccagtacggcctctcggcgcgtggcgtagcgatcaacaccttcagcaatggccaggaagagtttcccgatttcaccgccttctggtttgaaacgccaaaagcggaagataccacctttacctgctacgccctgctggatggtgccagcgtcaccggtgcttataaattcatcatccattgcgaagagaaacgcgtggtgatggaggtggaaaaccacctgtttgcccgtaaagagatccgtcagattggcatctcgccaatgaccagtatgttcagctgcggcaccaacgaaacgccgcatgtgcaacacttaccatccgcagatccatgactccgatcgcctggcgatgtggaccggtaaaggtgaatggattgcccgtccgctgaataatcctcagcgtctgcagttcaacgcctatgaagatgagaatccgcgtgggtttggcctgctgcagcttaatcacgacttcaaagattatcaggatgtgattggctggtatgacaaacgtcccagcctgtgggttgagccggttggtaagtggggcaaaggcgcgattaacttgatggagatcccgaccacgggtgaaacgctggataacgtggtctgcttctggcaaccggctgagccggtcaaagcgggcagcgagctgaacttctcctacaagctttactggagtggtctgccgccggtgcgtagcggtctggcgcgcgtggatgcaacccgtaccggtatcggtggtttcccggaaggctgggcgcctggcgaacacttcccggaaacctggtgccgccgcttcgccatcgattttattggtggcgatctgcaggctgctgcgccgaaaggtattgagccggtgattaccgtttcatccggcagcgtgaagcaggttgagattctgtatgtcgatccgcttaagggctatcgcatcctgtttgactggtatccgaacagcgattccaccgagccggtagagatgcgtctgttcctgcgcagcaaagatgagacgctgagtgaaacctggctctatcaatatttcccgcctgcgccggatcagcgtaaatatgtcgatgaccgccagatgacggtgggttgatgtaaacaggcgaggctcaggcctcgccttttttatggcgcgttcttcagcatatcgacgtgagggatcccatcttccaggtagttctcccccacagcgacaaagccatgctgcccatagaaactttccagatgcgcctgcgcggagagaaacagatcgcggcccggccagtattgctgacaactgttgatcgcctgctccatcagacggttccccagccgcgcaccacgaacccgatctgaaacaatcacccgtccgattttcaccggactggtctcatcctccggagagagcagtcgcgcataggccaccagctggtcatccgccattcccagcagatgccggttttccgcctgcaaatctttgccatccacatcaaggtaagcgcactgctgttccaccacaaacacggcactgcgcaacgccagcagtgcatagagctgtgagggggtcagttcgctatggtgtttatcctgccagttaatgtccatggtctctcctttaaaccacacactctacatcagcgcggtgtcgccagcacctgctggtgacactctcttacaggcaaaaaaaaatcaggcccggaggcctgattcgtcagtcgcagcaacgcgcttacatcagcggctgagccatctgcaccagtctgatcagcggctgcgggtaaacccctaacagcagcaccagaatggcagaaatcagtactaccacaccaccggccgtaaatgcccagttagccggggtatcacgggtatgcagtttccggcgggctgaggtagagactcaccgtcacgcgcagatagtagtagaggccaatcgcactacccgcgactacagcaccggtcagccaccacaggtgcgcactgacgcctgaagcgataacgtagaatttaccgataaagcccagcgtcatcgggatacccgccagtgacagcatcatcaccgtcatcaccgctgacagaataggacgatgccagaacagaccgcggtaggagtagagcgagtcagcatccgggccacgatatgggctggacatcagactcaccacaccaaaggcacccaggctgctgaacagataaccggccaggtaaacgcccgacgtttccagcgacagctgatgatctttcaccgcaatcagtgccaccagcagataaccgaggtgggcgatagaggaataacccagcagacgcttgatgttgctctgcgaaatcgccatcaggttaccgaacagaatcgacacgaaggcgatcatggccagcactgtgcgcaccgcttcgctgtcggtcaccggcgcatacataaacagacgcatgatgacaccgaagatagcaatcttgctggcggtggccaggaaggttgaaaccggcgcaggcgcaccctgataaacatcgggagtccagaggtggaacggaaccagtgagagcttaaagcccagaccgataatcatcatacccagacccaccagcagaagtggctcgtggatcatgctgtcagtcaggctctggcccagcgccacaaagctcaggttaccggagtcggcgtaaatcagcgcaataccaaacagcaggaacgacgaggccgccgccgaaagaatggtgtacttcagtgcggcttccagtgaacgtttctggcggaaggcgtagccaatcagaccaaacagcggcagcgaaagcagctcaataccgatgaacagcgaagccagatggttagcactggccagcacgatgccaccaagtgccgcaatgagcaccagcaggtagaactcatctttgttgtccgggaagcccgccagccatggataggcaaaggtgcaggtcgccagactcgccagcatgaccagcgcggtatagaacatcgaatagccatcgacgcgcagcagcggcgtgacatccatcgccccgacctgaccgacaaagtagagcgagagcagcgccaggttcaggccaactaccgttagcgtggcgttaacgaagtggttgcgtcgccaggcaatggacagcatcacaaccaccaccgtcaatccgacgattaacagcggtagcaacgcaatcaattggtgaggagttattgtcatggcgaattacggccttgtagttgaaattgaagcggtaaaccactgctgaatattgctcatggcagcgtgcgaagtatccagaatcggctgtggatagacgcccagcagcaccagcagcaccaccagaacaccgatggtcataaactcacgcggtgacatgcctggcagcggatctttcgatttcgcttcgccgtaataagcgcgctgcatcatcaccagcgagtaaatcgaggcaaacaccagaccaaaggtcgcgatgatgataatcatcggcaccacctggaagctgccggtcagaatcataaattcgccgacgaagttaccggtgcctggcataccgaggttggcaaccgcaaagaacagcgacagacccggaatccatttaatgcgcgaccacaggccacccatctgacgcatatcacgagtatgcagacgttcatacagctgaccacacagaatgaagagtgctgcagcggagagaccgtgcgcaatcatctgaatcaccgcgccctgcagcgccagctggctgccggtatagatggcaatcagcacaaagcccatgtgcgaaatcgaggtgtaagcaatcagacgtttgatatcagtctgcgagaaggccatccaggcaccgtagaagataccgatgatgcccaaccacatggcgattggcgcaaactcggctgacgcattcgggaacagcggcagactgaaacgcagtaaaccgtaagctgcggttttcagcaggatacccgccaggtcgacagaaccagccgttggtgcctgactgtgcgcatccggcagccagccgtgcaacggtaccaccggcatcttcaccgcaaaggcgataaagaagcccagcatcagcagatattcaacaccgctcgacattggggtctgcagcagctgttcgtagttgaatgtccagacgccagtcgcgttgtagtggacaaacaccaggcccagaatcgcaatcagcatcaccagacctgaagcctgggtgtagatgaagaatttggtcgcggcggaaatacgggttttgccgtccgatgctttatgaccccagagcgcgatgaggaagtacatcggcaccagcatcatttcccagaagaagaagaacaggaacaggtcgatggagaggaaaacaccgattacgccgcccaggatccacatcaggttcaggtggaagaagccctgatactttgaaatctcattccaggaacagagcaccgccatcagaccgagcaggccggtcagcaccaccatcagcagcgacaggccatcaatggctaaatggaagctgatgccgaagcgtgggatccacggaacggagaaacttgactgccactgcggaatgcccgctgcctgcgtcagtgaatagcctccctgcaaccagagttgcagtgaaagcgccaacgtcagccccatagtgatcagtgcgatccagcgtggcaccttcgcgccgaggcgctcagtgagccagcagatcagaccaccgacgaagggtatgataattagccaaggtaataacacggcacacttcccttttctttgtcttagttcgggctatcttacttgccattttggctcccggcagtgctcgcaatcctcacatacctcggtatgctccggttgctgtgcgctggcggtaaccaaactggccgcgacgataacgcccttgctcaggacaatttttgacattctcaatgggcagattagctaacctgccccgctcatcaatctttaaatcaccagcagcagagccagcaccagcacggcgcccacgctcattgacgcaacgtaccagcgcaggtagccattctcactgactaccaggcctttgttggcaatacgtgacagcagcgcaggcaggttcatcaggccattcagtgggtcacgcttcagcagccacgcaatacccagataaggtttgacgaacactttatcgtagagccagtcgaagccccaggccgcaaaccaccaggtgccgaagaaacggcctggtgcactgtttgcgatacgggtaaccagctcacgtttgcccagccacagcgcggcagcgatcagaatgccgacaatcgctacgacgcccgaggtgatttcaagtcccactttgcccgcttcaccgaactcattggctggcagtacacctgccagcggcggcgtgatcagcgcaccaataaaggtggagagcagcagcagcacaatcagcggcagatgatgggtaatacccttaccggcgtgcgcatgaattttctcttcgccgtggaacacgatgaagatcatacggaaggtatagatagaggtcaggaaacgcccccaccagacctgcaaccatcaggttgatgtgaccgttagccagtgcgccaaacaggatctcatctttactgtagaagcccgccgtaatcagcggcagtgccgccagcgccgcgccgcccaccaggaagcaggtgtagaccagcggaatgctcttacgcaggccacccattttgaaaatgttctgctcgtgatggcaggccagaatcactgaacccgaagagaggaacagcaacgctttaaagaaggcgtgcgtcatcagatggaaaatcgccgcatcccacgcctgaacacccagcgccaggaacatgtagccaatctggctcatggtggagtaagcgagaacacgtttaatgtcggtctgtaccagcgcggcaaagcctgccagcaccagggtaatcgccccgataatcccgaccagatgcagcacttccggcgtcagcaggaagagaccgtggctacgggcaatcaggtagacacctgctgtcaccatggtcgcggcgtggatcagtgccgaaaccggtgtcggaccagccatcgcatctgccagccaggtctgtaacggcagctgagccgatttaccgaccgcgccacccagcagcatcagcgttgcccactgcagcatatggttatctgcggcaaagtgcgcaggagccagctccatcatctcgcggaagttcagcgtgcccagctcgttgtagaggatgaacagaccaaatgccaggaagacgtcgcccacgcgggtaatgatgaacgctttcatcgccgctttgccgttttccggattgctgtagtagaaaccgatcagcagataagagcagaggcctaccccttcccagcccagatacatcagcatcaggttatcggccagcaccagaacaaccatgctggcgataaacaggttggtgtaggcgaagaagcgggagtagccctcttctccacgcatgtaccaggaggcgaacatgtgaatgaagaaaccgacaccggtcacgacagacagcatggtcagcgacaggccatccagcgtcaggttcaccttcatgtcgaagttgccgacatgcatccaggtccagagcgcctgcgtgtaggcttgctgaccgttggcgaagaagtcaaaaccgaccatcgccgtggtcagggccgccagacccacggatcccataccaatcgtggccgacaggttctctgaccagcgaccgcgcgaaaacgctaacagcagaaagccgatcagcggaaacaagacagttaaatagagaagattcatccgcgcatctcgctcacagtatcaatgttcagcgtctgacgacgacgatagagctgaagcagcagtgccagaccaatactggcttccgctgccgccaggctgatcgccaggatatacatcacctgtccatcggcctgaccccaatagctcccggcaaccaccagggctaaggcggcggcgttgatcatgatttcaaggccgatcagcataaacagcagattgcggcgtattaccagcgacgtcagtccaaggacaaacagcacggcagcaagaatcaatccatgttgtaacgggatcatgcgttctcctttttcacctgagcggcgtcagcattacggttactcaggacttcgccctgacgctcttcacgaccgatatggaacgccacgaccagacccgccagcagcagcattgaggccagttcaaccgccagtacgtaaggaccaaacaggctgatgccgaccgctttggcgtcgatgatggtgccatcgatgccctgatcgttggcggtcaggatggcgtagaccattacgaccagcagcagcaacgagacgatacccgggccaatccacagtgacgggctgagccactcacgctcctgcttctcggtctgcttgcctaagttcagcatcatgaccacgaagacgaacaacaccataatggcaccggcgtagacgatgatctccagcgcaccggcaaaataggctcccatagagaagaagacgcccgcgatcgataacagcgaaacgatcaggtacagcaacgcatgtaccggattagtgtgggtaatgacgcgcaacgtcgtcagcaccgcaaccagtccgcaaagataaaacgcaaattccatgccttgctccttaaggtaataagcctttgacgtcgataggcttcgcttcgttttctgcttcgcccttatctttaccgtcaatcgccatacctgccatgcggtagaagttgtactccggatatttacccggccccgaaatcagcagatcgtccttctcatacaccagatcctgacgcttaaactcacccagttcgaaatcgggggtcagctgaatcgccgtggttggacaggcttcctcacacatgccgcagaagatgcagcgtgagaagttgatacggaagaactccgggtaccagcggccatctttggtttcagctttctgcagcgagatacagccaaccggacaggcaaccgcacacaggttacaggcgacgcaacgctcctgaccatccggatcgcgggttaacacgatacggccacgatagcgtggtggcagataaaccggctcttccggatacatctgagtttcacgtttggcgaaggcgtgcagcccgatcagccagatactgcgaactgtcgtgccaaagcctacgacaatatctttcaaagtcatttgttaaccccttacggcgctgtgtagagaatcactgcggcagtcgccagcaggttcaacagcgtcaacggcagacacactttccagccgaatgacagcacctggtcgtagcgcggacgcggaagcgcagctcgaatcaggatgaacatcatcataaagaacgccgttttcagggcgaaccagatgaacggcggcaggaatgggccgtgccagccaccaaagaacagcgttacgatcagcgctgaaacggtggtgatcgccacatattcgccgacaaagaacaggccgaacttcataccggcatattcgatgtgataaccgtccgccagttcctgctccgcttctggctggtcaaacggatgacggtgacacaccgccacgccagcaatacagaaggtcacgaaaccgaagaactgcggaatgatgttccacaggtgggtctggctgttgacgatatcgttcatgttgaacgagcccgcctgcgccaccacacccatcagcgacagacccaggaacacttcgtagctcagggtctgcgccgaggcgcgcatcgcacccagcagcgagtatttgttattactcgaccagccggcaaacagcaccgcatagaccgcaaggcccgccatcatcaggaagaacagcagaccgatattcaggtctgtcaccatccaggttggcgaaaccggcacgatagcaaaggccagcagcagtgaaacaaaggcgataaccggcgcaagggtaaagataaagcggtcggtaaacggcgggacccagtcctctttaaagaacattttgatcatgtccgctaccagctggagcgagccgccccagcctacgcggtttggtccgtaacggttctggaacaggccgagcagacgacgctcggcgaagctcatgaacgcgccgcaggccacaaccaccagcagaatcacgatggctttaacaatggccagcagaatgtcgataacgtccggtgttaaccagctcattgcgccgcctcctgcagagtgtcgattttaccgttcgccaggaatggcggaacgcccggcatgcccagcggcagaccaatctgtcccgcctgcagtgacgccgagaaacggaccggcagacgcactgtctcaccggcacagatgaactcaaccgccgcgccattgttgacgcccagcttcgctgcatcttccgggttaatcaccagtgcaggcggtgccatacgctgctggaagaccggtgaacgctgtgacatctcttcgctaccaaacagctggtagagaggggccacgcgccactgcgcttcactgacgaatgccgccggaacgttgctgaaccagggcagactggctgcgctggcttcaaacagccgtacacccggatcgccattacgcagtttgccgcccacttcaacctggaacttgttccacgcctgcggtgagttccagcccggtgcccaggcaaacggaatctgcgaaacgcggtgcgcctggctggttgttcccttccattgagaaggcgaacatcgtgtcctgatcctgcggctgacgcggttcgtgcacgctgatattggcgcgcgccgcggtacggccactggcacggtgcggtgaacgcgacagtttctgtccacgaatacggaagctggcatccggtgccgcatccttgattccggccagctgtggcagatgactgaccaccgcatcgatcacgtggtccagctgcgtccagtcgacgtgacggctttccagcgtgctgtgcagcgaatgcagccagcgccagctctccagcatcactacgttgttgtcatagtaagaaggatcgtaaacctggaagaaacgctgtgcgcggccttcatggttgatcgaggtgccatcactttcggcgaagctggcggttgataacaccagacccgctttctcaagcgtcgcggtgcgctgatgatcaaccacaatcacgttagtggtctgggccagcgccgcatcaaccagcgctttcggtgcatggcgatagaggtcattttccagtaccaccagcgcatcggcttcaccgttgctcagttgctccagcgcgctttccagaggattgccgcccatcaggccaagacccacgctgttggcgtgtcccgccagcagcgtaatcccgacgtcggcaccgcgcgctttgagcgctttggccacgttggcagccgcttcgatcatcgcgctgctgccggaatgggtcccggaaataattaacggttttttcgcgccagccagcgcctgcacgatgacatccatcttgccgttcagtttgctgtcgaaatcggtcaccgccggggcggtttcatccagcgcactggcgatagcgaaaccgagacgcgcctgatcttcaaccggtgcgcgatagctccatgccgcgatatcatccagacgggtttcatcgacgttggtgataaacagcggatgtttcgcattctgaccgatgttcaggatcgcggcgatctgccagtctgccactttctgagcggcagccatgtcgcgcgctttgcctttcacggcctgacgcactgacagcgccacgcgtgcgcccacctgggtcagatcttcgcccagcaccagcaccgcatcgtagctttcaatttcacgcagcgatggcgtatagataccgccctcacgcaggattttcagcatcagttcaagccgtgcctgctcgcccgctggcatgccggtagagaagttctctgcaccgaccagttcacgcagcgcaaagttactttcgatgctggcgcgcggcgagccgataccgatcacttttttcgcctgacgcagcaaatctgcaccggcattgaccgcctgctctgcgttcagcgtcacccagtcgttgccgcgcagcagcatcggctggcgtgggcgatctttacggttcacgtagccatagccaaagcggccacggtcacacaggaaatagtggtttacggtgccgttataacggttttcgatacggcgtaactcaccataacgctcacccgggctggtgttacagcccacactgcactgctggcagatgctcggcgcaaactgcatatcccatttacggttatagcgttcggagtgcgttttatcggtgaagacgccggtcgggcagatttcaaccaggttaccggagaattcgctctccagcgtgccatcttccggacgaccgaagtagacgttgtcgtgcgcgccgtagacacccagatccttgccatcggcataatctttgtagtaacgcacgcagcggtaacaggcgatacagcggttcatctcatgggagatgaacgggccgagatcctgattacggtgggtacgtttggtgaagcgatagcggcggaagctgtggccggtcattactgtcatatcctgcaggtgacagttaccgccctcttcacacaccggacagtcgtgcgggtggttggtcatcagccactccaccacgctttcgcggaactctttcgcttcgccatcatcgatggagatgaatgtgccgtcagaggccggcgtcatgcaggacatgacaagacggccgcgggtatcttcggcattctggaattgctttaccgcacactggcggcaggccccaacgcttcccagcgccggatgccagcaaaagtaaggaatatcaaggcccagagagagacatgcctgtagcaggttgtccgctccgttcacatcatactctttaccgtctacatgaattgtagccatagtgacatgcttccgtaaggctcgtcagagacgagcgttaatcatattcttgccccgacgcacgacattgtcggggcggcggcaccaggcctgttccgtgttcttcggcgaattaccagcgcgctttcagcaggtttggctggatcccgccaatagcgcgggtattgccaaacacctgcggtgccatgccggcttcaaactcttcacggaaatatttaatcgcactctgcaggggctcaaccgcacccggcgcatgcgcacagaaggttttacccgggccaagctgacggcagagttgcagtaaggtttcgatatcgcctggctgaccctgcttctgctccagcgcacgcagaattttgacgctccacggcaggccatcgcgacacggtgtacaccagccgcacgactcacgggcaaagaactcttccaggttacgcaccagcgagaccatgttgatctcgtgatcgaccgccatcgccagcgccgtacccagacgactgcccgctttgccgatgctggcaaactccatgggcagatccaggtgctggtcggtcaggaagtcagtccctgccccgccgggctgccaggctttgaacttcagtccgtcacgcataccgcccgcataatcttcaaggatttcacgtgcggtgataccgaatggcagctcccagacgccgggatttttaacccgtccggagaagcccatcattttggtaccggcatcttcgcttttagagatgtttttgtaccactccacgccgttggccagaatcgccggaacgttggagagggtttccacgttgttcacgcaggtcggtttgccccacgcgcccgcactcgccgggaatggcggtttcgaaacgcggattggcacgacggccttccagtgagttaatcagtgccgtctcttcgccgcagatataacgacctgcgccggtgtggacgatcaactcaaagtcgaagccggtaccgagaatatttttaccgatatagcccgcttccgtcgcttcagcaatcgcacgacgcagatgcaccgcggcttcaatgtattcgccacgtaagaagatatagccacggtaagccttcagcgcaaaggcgctgatcagcatgccttccaccagctggtgaggcatctgctccatcagcaggcggtctttataggtgcccggctccatctcatcggcgttacacagcaggtaacggatattcatcgactcatctttcggcatcaggctccacttcagcccggtggagaagcccgcaccgccgcgccctttcaggcctgaatcttttactgccgcaacgatttcatcctgcgacatgcttttcagcgctttttccgcaccggcatagccgtttttactgcgatattcgtcaagccagacaggttgcttgtcgtcacgcatccgccaggtcagcggatgggtttctgcagtgcgaatgatctgtttaattgtcattgatactgctccagcaaaccagggatgccttccggcgtcagatgcacatgcgtgtcttcatccaccatcatcgttggccccttatcgcagttacccagacagcaggttggcagcagtgtaaagcgtccatcggcagtggtctgacccggtttgatattcagttgctgttccagtgctgactggatgccctgataaccggtgatatgacagaccacgctgtcacagtaacggatcacatgacggccaaccggctgacggaagatctggctgtaaaatgtcgccacaccttcaacatcactcgccgggatacccagaacctcggcaatcgcattgatggcgccgtccggcacccatccgcgctgtttctgcacgatcttcagcgcttcaatcgaggctgcacgcgcatcttcatagtggtgtttttcgtgctcaatggcgtgatgctcttccgcgctcagcacgaagacctcgttagggtcgatcgttttaatggcaatgtgttgatcgtgcataattagcggtccacgtctgacataacaaaatcgatactacccagatatacgatcaggtcggataccaggctgccacggattactgaaggaatctgctgcagatgcgggaagctcggcgtacgcacgcgggtgcggtagctcatggtgctgccatcgctggtcaggtagtagctgttgatccctttcgtcgcttcaatcatctggaacgactcattggctggcatcaccggcccccacgaaacctgcaggaagtgcgtgatcagcgtttcaatgtgctgcaacgtgcgctctttcggtggcggcgtggtcagcggatgatccgctttaaacggaccctctggcatgttgttaaggcactgctcaagaatgcgcagcgactgccacatctcttccattttcagcatgacgcggctgtaagcatcgctgatgccgtcgccgaccgggatttcaaaatcgaagttttcgtagccggagtagggacgccatttacgtacgtcaaagtcgagaccggtagcacgcagaccagcaccggtagtgccccacgccagcgcctcttccatgttgtaagcagcaacgcctttggaacggccaatcagtacgctgttgcgcagtgccgctttgtcatactctttaagacgttttggcatccagtcgaggaagtcacgcagcagacgtttcccagcctcgcggcaggtcatgcgcgacaccaccgatgcggaaccacgccgggtgcatacggaaaccggtaatcgcctcaaccacgtcatagattttctgacggtcggtaaaggcaaagaacaccggcgtcatggccccgacgtcctgaataaaggtggagatataaagcaggtggctgttgatgcggaacagctcagagagcatcacgcggatcacattaacgcgatcgggcaccacgataccggccagtttctccaccgccagtacgtacggcatttcgtttacgcagccgccgaggtactcgatgcggtcagtgtaaggaatgtagctgtgccacgactgacgctcgcccatcttttcggcaccacggtggtgatagccgatgtcaggcacgcagtcgacaatctcttcaccatccagctgcagaatgatgcggaatgccccgtgcgccgacgggtggttaggcccgaggttcaggaacatgaagtcttcgttggtggtgctgcgcttcatgccccagtcttcaggcttaaaggtcagcgcttccatctccagatcttctttctgcttggtcagcgtaaacggatcgaattcggtggcgcgcgccgggtaatctttacgcagcggatggccttcccaggtcgacggcatcatgatgcgcgtcagatgcgggtgaccatcaaaggtgataccaaacatctcccaggtttcacgctcataccagttggcattcgggaaaaggcgggtgatggtcggcagatgcatatcgttttcagagagtgccaccttgagcatgatgtcgcggttgcgttcaatcgacagcaggtggtagaaaacggaaaaatccgccgcaggcaggcctgcacggtgggtacgtaaacgctcatccacgccatgcaggtcataaagcatgacgtaaggcttgggtaatttacgcaggaactcgataatttccagtatctgttcacgcttcacccacaccaccggaataccggtacgggttggctgaacagtgaaggcatccggcccaaaacggttacgcaactcgccgatcaccgggtcatcaaggtgatcacgggtttgccatgaaggctgagcgagatcttgcgtggtcaaatctgtcatacgttactcaccattccggcctggtctcaggcactcaaatgaaggcgtcaggatggggccatgcattaaattgtgatgttctgctgcaggcgctgttttccatccatacggttttaaacttcgtccgggctgcgcaggtttgtgactgcaatgcgctcgccgcgttttctttcacgctcagatggcatgttggcgcgataaacgccctgatcgccaaccacccacgagagcggacggcgctctttgccgatcgactcctgcaacagcagcagtgcctgcatatacgcttcaggacgtggcggacagccaggaatataaacatcgaccggcaggaatttatcgacaccctgcaccacggaatagatgtcatacatgccgccagagttggcgcaggcacccatggaaatcacccattttggttccagcatctgatcgtacaaacgctgaataaccggggccattttggtgaacggcgtaccggcaatgaccatgaaatcggcctgacgtggcgaagcgcgcataacttcggcgccaaaacgtgccacgtcgtggaccgcggtgaacgatgttgtcatctcaacgtaacaacaggacaggccaaagttataaggccatagggagtttttacgcccccagttcaccatgtcatgcagggcattttcgagtttgcccatataaacgctgcgatgaacgtgctgctccagcggatcgctgacgatttcctgcttttgcagaggataacggtcgttctcaccaccgtttcgggtctatgcgggtgagcgtatagtccatcttattgcctctcttttactgcttatgaggattggtgtggctgaccgtagtggttttgaccaccacgcgacggcgagctggagcccagtccagtgcgccaatgcgtaccagatagaccagacccgccaggagcaccaaaatgaaaattgcggcttccacaaagccgatccaaccgctttcacggattgaagtcgcccatgcgtataaaaagagggcttcgacgtcgaagatgacgaaaaacatcgcaaccagataaaatttcgccgacaggcggatatgggtatcaccaacggattcaatgcccgattcgaatggcgtgtctttgtagcgggcgcgcgctctgccgccaagcagccatcctccggtcagcatgaaagcacacaggccaaaggcaataacgataaatacgataaacgcccagtgctgagcgatgatttcggtggtagttgacatactcattgcttactcatcaaaagtggcgctggcatcctgcacgcgtttcccgcagcaaactgaccacatcgattcaagggaaggataaaaacctttcaaatgtcgctgttattacgtaataagcagctattttatggggttttttactcctttctataaccttttgtcaactttgacaaaagtatccaaacattatttcacacctgcatcatattattaacaaatgatgccccgctttccagctaaatcgcttcagtctgtagggttaattttagtgtagcgggtattcacatgcatggatcgtgcatttaacaaacatattttgacaggtatcactgaattttccctcccctttccagggctatttttttgatccagaacacacttttgccctttatgcgttaattttccccacctgaaacggtgattcggaacaaagcgttcggttttttggtctggatgtttcaattaagcaggtggtgaaacttttttagtcgggtcaggagaggcagatgagcagtaaggaacatcggacgagggtcaggcacaaaaaagcctctcgttcttttcagggaaggagaggcttatttataagcgtttattaaggcaatcacgcaggtattgagtacaacacgttagcgaaattactcttcgtcatccagcaacagtgaaccgtcgggattattgctcaggttataaggatcattggtggactgcatggcattgaagatagccagcgccagttcattatcgctgtcaggattacgacacagcagatattgcgtatccggcagtaccggcagtccttcagctgcacccataacacgcagttccgggctcatcatctcgaccggacgtgccgtcacacccagtcccgctttcaccgctgcacgtactgcagccagtgtggaagcgacataagagatacgccacgggatgcccgcttcgttgagatgatcgatagccatatcacgataaggacttggctcatccagcaataccaatggaatggcttcgccacgctggaagatataatccgctgcgcagtaccacaaggtaggtgaagtacgcagtacctgataggtaaaattgcccgggctggaagtggtcacaaccaggtccacttcaccctgattgagcatttccatcataaacggattacgtttaacccgcacatcgattgccagtttcggatacaccgaggtcacccggtttagcaggaacggcagaatagtgtcagaggtgtcatcagaggcgccaatagtcagcacgccctgaatgttgctgtacatcagagatgtgcaggcttcgtcgttaaaacgaagaatttttctcgcatagcctaaaagctggataccgtgctctgtcagaagcttattacgtccatgtctggcaaacagctctttacctaccaattgttccagacgttgcatctgctgactgactgctgactgggttctgcagaccgctgcagcggcagctgcaaaggtattcaaatccgcaacggcaacgaaggttctcagcagatcgaggtcgagattcagtatcggacgatttgcattagtcatgttttttcttcacttataagatttttacgaactactaccctggtgttatcacaagcttatcaaagtgataagcagtaatggtgctcaatgacagtcctgtgtgaagactgacacaaaaaaagtttatgtggatcctgcactgttgactcctctgaagggtcatagtgctattcaagacagatacaacttctgaaccgatggcgctgggtgcgcaaatgcaggaagctgcgtagttgtcttattcccatcagaaagaatcgtgtgggatagaaagcgcactttacgggctatcaaagcgaagcggcaaagtgcactaaataataaattatacttaatcatttttgacttcaaaatggaaatgattttgtgaaaagcgctgtaaattttgtgctaaaggcatttccagacccttatgccacattattgatcactttttaagccttcagcgttctgaaatttagtgaggaagtgttaagtacggctcacaatcctgcaataaaggtgccatatgaagctctgcttttggcacttttccggcgaaacacaaggccttaaacacgccactcttaagcagcgttaaggcgtaatctttaggcacgttataaaatcgtccataatttgaacatttataaaatatcctttaactatttctctaagtgtatatttcaggtgcaaagaaaagttccatttcaataacttccagatagcgttcatgatgctaaagccatatgtcggttcagcagcgctttggacaagttaaaatcctgcattaatgcaaatttatggttttattaaccagtttacgcgacaacaaatattttttacgctgcgcaccgggcaaaaagttgttgaacccgccaaaacggggcggcacccttcttttgtgactgtcaggagagtacattgtgctggttggatttctgtggcagccaaaaggattctgcccattaaggcggtaacaatgacttttcaaattgataaatccggaaaactcgataacgtctgctatgacatccgtggcccggtactgaaagaggctaagcgcctcgaagaagaaggtaacaaagttctgaagctgaacattggcaacccggcgccgtttggttttgaagcaccggatgagatactggtcgatgttattcgtaaccttcccagctctcagggctattgtgactccaagggtctctattccgcccgtaaagcgatcatgcagcactaccaggcgcgcgacatgcgcgatgtcaccgtagaagatatctacattggcaacggtgtttcagaactcatcgtgcaggcgatgcaggcgttactgaacagcggcgacgaaatgctggtgccggcccccgactatccgttatggacggctgcggtttccctctccagcggtaaagcagtgcattatctctgtgacgaatcagcaggctggttccctgacctcgatgatatccgcagcaagataacgcctcgtacccgcggcatcgtgattatcaacccgaataaccccactggcgcggtctacagcaaagagctgctgttagaggtggttgaaattgcgcgtcagcataaccttattattttcgccgatgagatctacgacaagatcctctatgacgatgcacagcatcactgcatcgcagcgctggcacccgatctgctgactgttacctttaatggcctttctaaaacctatcgcgttgccggtttccgtcagggctggatggtactgaacgggccgaagaaacatgctaaaggctatatagaaggactggagatgctcgcctcgatgcgcctgtgtgccaacgtaccggcgcagcatgcgattcagacggcgctgggcggctaccagagcattagcgaatttatcatgccgggtggtcgtctctacgagcagcggcagcgcgcctgggagttgatcaacgatatcccaggcgtcagctgtgtgaagccgcagggcgcgctttatatgttcccgaaaatcgatgccaaaaaattcaacattttcgacgatcagaagatggtgctggattttctgttacaggagaaggtgctactggttcagggcagtgcctttaactggccatggcccgatcacctgcgcattgttacgctgcctcgtgtggatgatcttgagatggcgatcaataaatttggccgcttcctgcaaggctatcgtcaataatcaggcccgcgtatactgacgctatttggggagagccagagcctgtctctcccccgccagccaacaggaacgctcatgacacaaagccacttctttgctcatctctcccgtcttaagctgatcaatcgctggccgctgatgcgcaatgtgcgcaccgaaaatgtctccgaacacagtctgcaggtcgccatggtggcgcatgccctggccgtgatcaaaaaccttaaattcaacgggtcgcttaatgccgatcacattgccatgctggcgctttaccacgatgccagtgaagtgctcacaggcgatttaccgactccggtaaaatattacaacgcgcagatcgcccacgaatataagaaaatcgagaagattgctcagcagaagctgattgagatgctgcctgaagagtttcaggcgatctatcgcccgctgatcgatgagcatctgcacagcgaagaggagcaggcggttgtgaaacaggcggatgcgctctgtgcatatgtaaaatgtcttgaggagttgtctgccgggaacaacgaatttttactggccaaagcgcggctggaaaagaccctggcacttcggcgtttcaccggagatggattacttcgttgaggtgtttattccgagcttcagcctgtcactggatgaaatctcgcaggatacgccactctaagcccggcggtctggccgccgggccagcccttaagcctgctgacggaaggtaaagctgccgtcagactcgcgggttatcaccagtgacgccagtgagtcgagctgaagcgctacctcatccagccggggtgtctccgccggcgcattgatggcaatcaccgcacagccagcattcaggccggataagattccggcaggtgcatcttctgcaaccacgcacgatgtcgccgctaatcccagcttctccgcgccaagcaggtagggatcgggctccggtttgcccttagccacctgttcagcggtaataaacacggcaggcttcggtaagcctgcggctttatgacgtgcatgtgcgaccggcactgaaccggaagtgacaatcgcccaaggaatctgcagttcgttcagccggttcagcaacgcgttggcccctggcagcgcctgcacaccgtcggtgtccgccgcttcagcctgctccagcgcaacaaactccgcctgaatagcctcttccgactggcctgccatgaaatgacgcagagaggtgatcgcctgtttgccatgaatgaaatccagaatctcatcagccgcgatgccatgacgggcaccccactggctccaggctcgttcaaccgctggcagtgaatccaccagcgtgccgtctaaatcaaatagaaaacctctgtaggtcacgcgctcctcctcatcaggcattaatcacttgcgcaatttcgtttgcacttaaatggtactggcgcggacaagtctgccacaaagctaacatccgttgatacttttcccacattggggtctgcgcattaaaaccatgggtgccggaatcgaagtgcgtataacgcccttctgtattgaccataaaacggacataacccagcaggcgcgcttccgttgccgcatcgaagcccagaaaggccagacggcgctcttcaagctcacctttctctttaaggttcgaccaggagacgtggagagcgtgatgcatttccataatatcgatcaccgtccggcagatcgcttcgctgagttcgccaaactctttgtccagctcccgcatctgcagcgcataaccgcgttcgatgatggtctggtaacgacgaaaacgctccgcattttccggctcaagcatggccatcattttgtactgattagtgagaatcaaacgctgcgcatgggtcatttccatcatttactcccggtcagagaccgctcagttaatcgacaatggagaaatcattgcacagcgttagcgacacggaaatcgccgtatcaccattctttgatttggccgcaggttagcggtaaatattttaccgccagcccgggataggtcagagatcgtcgaggaaagtgcggtcgagttgtttgaacgcccgctttagcagatcggccagcgcctgataggtcggcttgccttctactggcgctgtcgcctgccccgcttcttccagccgggcacgaacttcatgaaaccagttaagcagcgtcggcggcagcggcgtcacagaacgctttcccagccaccataatccctgcatcggcagggtacaggcaaacagcgcggtcgccacggccgggcctaactgaccgcccatcgcgatctgccaggtcagcgtaaaaatcgccaaagggggcataaagcgaatagcaaaacgcgttgccgatgaaacacggttttccgggaacataggtgccaggcgcttatcagccggccaggtcttcatatagtgttggccgcgctgaaacatccgaaaccaattggtactgccagattcattcgccatggctcacctcaactaatgctgtaaaaattaaaaaatagttataactacacaactttacgtgacatccttcaattatttttgtctttaaaggtgactccagctattctgacgccgttttaccccctttccggaagcggattgcgcttttgggaaaaggcctgagccaggttcagacgaggcaatcttcaaattttcgcgtaagattgccgaaattttttgcggaaatgcagaattctgtctaccgcatgatgtttgtcattaatctaccagctttcatgggctacgctgttagtctgattgcgttttatttagccactctcaaaaaataggtacttccatgtcgagtaagttagttctggttctgaactgtggcagctcttcccttaagtttgccatcctcaaccctgccagcggtgaagaattcctgtctggcctggcggaatgtttccaccttcctgaagcccgcatcaaatggaagctggaaggcgaaaaacaggaagcgcctctgggtgctggcgcagcgcatagtgaagcgctgaactttatcgttaaaaccattctggcacaaaaacctgagctttcggcacaaattgctgcaatcggccatcgtatcgttcatggcggcgagaagctgactcagtcagtcatcatcactgaagaagtggtacagggcatcaaagacgcctcttcttttgcaccgctgcacaatccggctcatctgatcggtattgatgaagcgatgaaaaacttccctcacctgtcagataagaatgtcgcggtatttgacaccgctttccatcagacaatgccggaagagtcttatctctatgcgctgccgtacaaattgtataaagaacatggcgtttcgtcgctatggcgcgcatggcaccagccacttctatgtgacccacgaagcggccaaaatgctcaacaagccgcttgagtcactgaatattattacctgccacctcggtaacggcggttctgtctctgccattcgcaacggcgagtgtgtggacacctcaatgggcctgaccccactggaaggcctggtgatgggtacccgcagtggcgacatcgacccggcaattatcttcttcctgcacgatacgctgggtatgagcgtcgatgccatcaataaactgctgaccaaagagtctggcctgttaggtctgactgaagtcaccagcgactgccgctacgtggaagataactacaccaccaaagaagatgcgaagcgcgcaatggatgtcttctgtcatcgcctggcgaaatatatcggcagctacactgcgctgatggatggccgccttgatgccgtggtatttactggcggcatcggtgaaaacgccgcgatggttcgtgaactctcactgaaaaaactggcactgctgggctttgacgtcgatcacgatcgcaacctggcggcccgtttcggcaagtctggttacatcaataaagaaggcacccgcccggcgctggtgatcccgaccaacgaagagctggtcatcgcccaggacgccgcgcgtctgactgcgtaaacacttctctccgtcagctcaggctgacggagttgtttttgacaccctgccattactgagaggttcaaacgtgtcacgtacaattatgctcattccgaccggcaccagcgtcggcctgaccagcgtcagcctcggcgttatccgcgccatggagcgcaaaggcgttcggctcagcgtctttaagccgattgctcagccgcgtaccggcggcgatacgccggatcaaaccaccactattatccgtaagaactcctcgattcctgccgctgaaccgctgcagatgtcacgtgttgaatcactgctgggatcgaaccagcaggatgtgctgatggaagagatcatctcccgttaccatgccaacacgcagaatgcggaagtggtgctggttgaaggtctggtccctacccgtaagcatcagtttcgccaacgcgctgaactatgaaatcgcgaaaaccctgaatgcggaaatcgtcttcgtgatggcgctgggcaatgactctccggcacagctgaaagagcgcattgaactgacgcagagcagcttcggcggtcagaagaataaaaatatcactggcgtgatcatcaataaactcaacgcgccggtcgatgatcaggggcgtacccgccctgacctgtcagaaatttttgatgactcgtcaaaagccagcatcgccaatatcgatcctaagcagctgttctcagacagcccgctgccggtgctgggctgcgtgccatggagctttgatctgatcgccacccgcgcaatcgatatgtgccgccacctggatgcgcgcatcatcaacgaaggtgagattcagacccgccgggttaaatcggtcaccttctgcgcccgtagtatcccgcacatgctggagcatttccgtccaggctcactgctggtgacttccgcagaccgcccggatgtactggtcgccgcctgtctggccgccatgaacggcattgagattggcgctatcctgctgaccggtaactacgagattgacgatcgcatcgcgcgcctctgtgaccgtgccttccagaccggcctgccggtgttcatggttaaaaccaatacctggcagacctctctgagcctgcagagctttaatcttgaagtgcccgctgatgatacgcagcgcatcgagaaagtgcaggaatatgttgccagctacattaatgctgactggattgagtcactgaccgccacgtcagagcgcagccgtcgcctgtcgccaccggccttccgctatcagctgactgagctggcgcgtaaagcgggcaaacgcgtcgtgctgccagagggtgacgagccgcgtacggttaaagcggccgctatctgtgctgaacgcggtatcgccacctgcgtactcttaggcaacccggatgagattcagcgtgttgctgcggctcagggtgtcgaactgggcaaaggggttgagattgttgatccggaacaggtgcgtgaaaactacgtgccgcgtctggttgagctgcgtaagagcaaagggatgaccgaagtggtcgcccaggaacaactggaagataacgtggtgctgggcaccatgatgctggaaagtggcgaagtggatggcctggtttcaggtgcggttcacaccaccgccaacaccattcgtccgcctctgcagctgatcaaaacagcgcctaacagctcactggtttcatcggtgttctttatgctgctgccggagcaggtgctggtttacggtgactgcgcgattaacccggatcccaccgctgagcagctggctgagatcgcaattcagtcagccgactctgctaaagcctttggtatcgatccacgtgttgcgatgatctcctactctaccggcacgtcaggtgcaggcagcgacgttgaaaaagtgcgtgaagcaacgcgtatcgcgcaggaaaaacgtcctgatctggtcattgatggtccgctgcagtatgacgccgcgatcatggaagatgtggcgaagtcgaaagcgccagattcacaggttgccggtcgcgccaccgtctttatcttcccggatctgaacaccggtaacaccacgtataaagcggtacagcgttcagccgatctgatctcaatcgggccgatgctgcagggtatgcgtaagccggttaacgacctgtcgcgcggtgcgctggttgatgacatcgtctataccatcgccttaaccgctattcagtctcagcaggctgaacaaggctaagcgtcaggtaagaaacgcaaaaggcatgccccagggcatgcctttttttcgccggtaacagagtcggaggctttaatgcggatcgctgagacgcgttaaagcgcccgttttcaggcccggttatcgccgttgcggctcatccacagagagagcgctttaagcgaatcgtcagtgaactcatcacaacgtgcggtgatctcatcgggcgtcatccagataatctcatcgacttccgattcctgcatggcgaatggcccatgtgacacacaactgaacagaccgccccagacgcgacagtgctgatcttcgaagtagaatttgccatgctcagcaaacggcaccgcggcaatccctaactcctcttccgcttcacgtcgcgcagactccagcatatcttcaccgctctgcaccacgccgcctgcggttgcatccagtttgcccggcataaaatcttttatctctgtgcgacgctgcaccagaatcttgcccataccgtcatgaaccacaatataggtagcgcggtgacgcaggcactcagcgcgcatctgcgcacgtgttgcctgagcaacaacttcattctcttcgtttacgatatcgacccactcgatgccgtcacccgcagtttgatccaccatccgtaaccctttcctgtttggcgtacacttgggtacgcagtttgccacgtctttatttttatgtggcgtaaggtaatcacttccggcagcctgagcaagccctggctgttaccgatttttaccactttctgctaaccacagctgtactgaggctcgctgccactgaaactcagcataatcccgcagacgcgcgggcaaaggatcgccatgcaataccagccggttaagcatcaccgccagatcggtatccgcaattgaccactcgccaaacaggttctgttgcccgtccggcagcaggcgatcgacggccataaccagtttatccaccgcctgctgcgctgatgcggtcagcggcgcaaagcgctcaccggcaaacagcacttctgtgggacgctcctgacgtatccacaggaagtcactgcgcagccaggcctggatctctctggcgcgggcacgcttctcgcggtcgcggggatagaggcgctcaaattcgggcgccggaaagcgctcttcaagatattcggtaatcgccgaggattcgcttaacaggaacgcatcaatctgcagggtcgggacccggcaggtcagcgacagctcgcggtaagccgcggcgtattgctgattctgcgacaaatcgacgcgcttcagctggaaagggatccctttttcggtaagagcaacataggccgacatggcgtaaggactgaaaaatgatgaatctgaccacagggtgatggacggataattcatcggttacctcaattggctgtcagggttgcatcatgtttaccgatttttatttgggaaggcaacgctgagctgatccgatctctgcctccggaataagaaagcgcgacgcgactcacgatagagtggctcgactcttctatgctgaaagatgcaaataacaaaaacatcaagggagccgcaacatgcacattcttattaccggtggcacgggactgattggccgtcacctgattccgcgcctgcaacagctggggcatcagatcagtgtggtgacgcgtgacgtggtcagcgcacgtgaaaaactgggcgaagaggtcgcgctctggtcagggctggcgcaacagtcgaacctggatacgatcgatgcggtcattaatctggcgggagaacctattgccgacaaacgctggacggagccgcataaacagcagctgtgtgaaagtcgctggcagataaccgagcagatcgtctcactgatcaacgccagcgccacaccaccgtccgtgttgatctcaggttcggcaaccggcttttatggtaacaccggcgatctggtactgactgaagaggatcagggtcaggatgagtttactcatcagctctgcgcccgctgggagcagctggcgctcgcggctgaaagcgaacgcacccgcgtctgcctgctgcgaaaccggcgtggtgctggcgtctgagggcggcgcactcagcaaaatgaagctgccctttaaactcggcatcggcgggccgattggcagtggtaaacagtacatgccgtggattcacattgatgacatgctaaacgccattatctggctgctggagcatgacgatctgcggggtccgttcaatatggtcgctccctacgcggtgcgtaacgagcagtttgccgccacgctgggccgggtgatgcatcgtccggcctttatgcgcacgcctgccagcgccattaaactgatgatgggcgaatcgtcggtactggtgctgggaggacagcatgtgctgccaaaacggctggaagcctcaggctttggcttccgctggtacgatttgcaggaagcgctgcaggatgtcgcaggataaacatacggcggccctgggccgccgtatgtttcgttagttacgctgctctgctacacgcgacttcactaccttctcttcacgcgtatgccccggttgtggcacacgaataataaaggtcagcacgccagcgaacacgtatagcccggtataggcccataccacaccgacaatgtcgaagaacggcagcatgactgaggcgatagccggtgccacaaagttactgagtcctgcggagaggttgtaaatagagaccgcagcgcctttatgatgcggttccagcgtgggaaatacagcggtcatcggtacaaacgcggcgacaaaaatgcccagcattaccgcagggattaatgcgacccagaagttatgacccgcatacagcggcagataataaaaggtcaggctggagatggccatccccaggcaaccaaaccagcgcacctgacggatccagcccagcttctctcccgtgaggccccagaagatattcgtaaatatagtgacaaagaagaacaccgcccagatttgtagccattcagagatggtaaagccgagacgatcgacaaacagcagtggcatgataatggcgaaaccaaacagcgacagcgtgttgatgatgcgaatcaggcaggcataaaacacattctgattggtgaacaggatggtcacggcacgcgccatctctgtcatcttgtcacgcatcggcaaattcacacgagagcgatccaccggtaccttgcgcaggctgaagtatgcgaggatcccaccacaggccacccagataatagccagccacagcgtccccgtttcccccagcatcggaatggtgagacttggcagatagctgccaatcaccccgatgccgacagaatacatcgcccagaaccagccggtcgccgccgccagtttttcgcgcggtaagacctgcaccagcatcatcatgaaagagtagataaacagcggataagccagcccgcgaatgccgtagaacagcaccatcagcggatagttgcgcaggccaagccccagcgacataaacagcgtatgcatcacgatccataacacaaagccaatcatcatcgcgcgctgcggtgtgatcaactcggctaccacgccagatgcccaggccgccagggctgccgctaagccatagaaggtgaatacgactgcagactgcgcgggcgtaaagcccatatcggtgatatgccgcgacagaaacgccatttcaaagccatcacccgccataaagattgcgatagcgagaaagccccagaacatctttttcggtaagccaaaccagtattcgttcgattgcatcacaattaccttctgtctggttagtcgttatgcaggcagcaaactgcgcacctgttgttgctggacgtagagtttcccggaacagacatagccgcttttgcagcacggcaccgcgcgtctcatccggttggcagcgcgcctgcacagccggcttcagacacacctcatgctcaaggccgccatcagccagccacgctaaacgtgccgcacccagcgcgccagatgcgctggcgggatgggtaacaatgggcagttgcagcacatcggcaatcaattgagcccacaatgtgctacgtgcgccaccaccggtcaggctgcactgctgaatgtgatgcctggcatcgccgagcacactcaacccatcagccagcccaaatgccacaccttcaaccaccgcatagcccagcaaggcgcgcggggtttcatggcgcagattgaagaaagaaccggatgcgtcaggatcgttatgtggtgtgcgttcaccagacagatagggcaggaaaaccggggcgctacgcacttgctcatcactgagctgggccatctcctccatcagctggctttcactgaccgacagcagattgcacaaccagcgcagacaactggcggcgctaagcatcacactcatctggtgccagcggcccggtaacgcatggcaaaaggcgtgcaccccgcattgagggtcagcccgtaagcggtcgtttacgaaaaaaatcacaccggaggtacccaatgagataaacgcatcaccgggattcaccgcccccacaccgattgccgatgcggcattgtcaccgccgcctcccgcgacagtaaccgcagtagataagccccactcgctcgccagcgtcggctgcaggcgtccacttatggcactgccttctaccagttcaggcatttgggtacgcttcagtccggtgatggccagcagttcttccgaccagtcacgccgggagacatcgagccacagcgttccggcagcatccgaaggctcactgacaaagcgcccggtaagacgccagcgcaggtaatctttcggcagcagaaccttatcgatgcggctgaaaatttctggctcattttccgcgacccagtgcagtttcggcaaagtgaagccgggcataatcatattgccgctaatttccattatccggggattgctcttccgtagcctttcacactgcggtgcactgcgcgtgtcgttccagaggatacacggacgcagcaccttccccccggcatccagcaacacggccccgtgcatctgtcccgataatccaatagcgcgaatcgcggcccatgccagaggaaactgatgacgtaatcccgccagaacctcgctgcaggcttgccaccagcattcaggatcctgttcagcccagtggggatggggacgctgcacgctcagcgtggcgtgctgagccgccacaatctcaccgtgcgtattaatgatcagcgctttaagctctgaggtaccaatatcaatgccgagatacataattacaccgccgccagttcaggctgtttcagccactgctgcaaacttgcaacacggcgggtgactaattcatgaaacgccttatcagatgccagttccgcaaacagcgcgctatcactcaggtatgcatggagcggatcggcgctggcgaactgcttacgtagcgtatcgacctgtagcgcaccgtcctgatagcaatagggtaaattgtcatcggcccatcgctgcataaacaggaagaacagtgccggaatcaccgccgttgcggtgggctgcgcaccgcgctggtagcactgttgcagggttggcgtcaccatgccgggaattttggataaaccatcggcaccgacgcgctgattggtatctttaatgtaaggattactgaagcgggccagcaccacgtcacgataatccgctaaatcaagcgggctgggagacagagaaggaatgacatcctgggttacgtagtcgtgagccagttgataaatcgccggatggctggtgctctcatcgatatagttcagaccaatcagtgtgcccgcccaggcaatcgcagcatgtgtcgcattgaggatgcgaattttcgcctcttcccacggcagtaccgattccaccagttcaacaccgaccttttccagcgctgggcgcccggcaataaaatcatcctcaatgacccactgaataaaagattcggccattactgctgcgccatcctgtttgccagtcgccgcctgcacgcgttttctgccacctccggagtaggacggggtgtaatgcgatcaaccatggtattcggtgagcgggtttgcgtgcgcacccagtcggccagcgcggtatcgcctttggccgtaagaaacgccaggaaggcgtcacggaaacgctcaccattgtgccgcagattgtcgcagttcagcagcgtaaccggcggaccgccttgcgcaacacgctgtgtcagaatatggctgagtgcaccgtagagggtgcggatatcgccacccagatcggccttcacatctgcctgattgagatccagggtaaacgcgggcgtcaggtagtaacccgcttcggtcacggtaaagctaatcacacgcgtttccgcactggccccctgctcgatcaacgcactgatatcactgtcccagggcaaaattttgcgcagcgaagtgatggtttcgtagtcgcgcttaccttcaggcgtcacggtttccagcacatattctccctgctgcgccgcgagctgattgagcagcggcactgcgtcattacggatattgccgagcgcgatgctccagctttcatcaccctgttcacgcagtttatgcagataccacgcctgatgtgcacgatgaaaagatcccgcgccgatgtgcatccacactgattggttgttcataatcgcctcacttaaacatttgccacacctaagggcatttgcccgatgacctgtagcatagtgcctattacgaagatccttctgcgagctgagtcacaaataatatttttgctctcattccgggcttttgctcagttagtgcttttcgacccgcacggcgttaagatgtcccctcaaattcgacggaacatcgtgatgagcagagaagaaaaaaagcaggagctggccgcacgtgccgcatggatgtattacgtcgcaggcgtgacacagcaggagattgcgcaggcattgggattgtcacgacaggtagcgcagcggctggtatccagtgcacgtgaaatgggcatggtgaacgtaaaaattgatcatcccgtcacacactgtctgcagctggcgcgtgaggtacaggcgaagtttggtctggatttgtgccgcgttgtgccatctgccagtctgaatgatgaggctattcaacaaatgctggcagttgaaggcgcggcggtgatgacacaattcatcaatgaggaaacgcctcaggtgttcggtattggttccggtaaaaccctgcgctcaatgattgatgcgctaccctgggttgatcgcccgcagcatcattgcgtttccatgattggtgccatcgcgcgggatgattccggtactcgctatgacgtaccgttgaagatggccgaaaagatgcaaggtaagtatttctttatcccagcgcccttatacgccgacaccccagaggataaagcgatgtgggttcagcataaggtttaccagcgcgtcattgatcgcgcattacaggcggacgtggcttttgtgggtattggcgaagtgatgccgggctgtcctttgaatgccgagggattcatcacagatgcgcaggtcgaggcgctaaatgggcgcggcgtggtgggcgaaatgctcggtcactttttcaatcagcagggtgagcgggtatggggcgaaacggatgagctactgaccagcgtgcgactggaaagccggactcagcgtaaaattattggctttgcgggtagcgagcgcaagtatccagcaatccgtgccgcattacagggcggctgggtatcgggactggtgaccgatgaggatacggcgctgaagctactgcaaaagtgatatctcagcatggatgcagagtgcgagggcagaacgcagagatgacgcaaaatctcaaacgcggctcgcacttattctgcgcagggcacgttacgccggtgccctgattccctcgccttaactaacatctaaccgttacttcagcgatcccttgaggaactgctgtaaacgcgggcttttcggactgccgaacagttccgcaggcggtccctgctcttcgattttaccctgatgcaggaaaatgacatggctggagacgtgacgggcaaactccatctcgtgggtcacgaccaccatggttttgccctcctcagccagcttctgcatgatgcgcagtacttccccgaccagctccggatcaagcgccgaagtgggttcgtcaaacagcaacacctctggctccatcgccagcgcgcgcgcaatcgacacacgctgctgctgaccgccggagaggtgaaccggatattttgcctgtgcccgcgcatcaatcccgactttatcgaggtatttgatggcacgctcacgcgccgccgctttactcagccccagcacctgaatcggggcttccatcacgttttccagcacggtcatgtgactccacagattaaaatgctggaacaccatggtcaggctggtacgtaacgcgcgcagctgctctttgtcagccactttgagctgaccatctttgtcacggactaaggtgatttgttggttattcaccatgatgctgccctcactcggtttttcgaggaagttgatgcagcgtaaaaaggtacttttccctgagccggacgatccaatgatactgatcacatcgcccgctttagcagttaacgagacccctttcagcacttcatgttcaccgtaacgcttatgcaattcggtgacgcttaatttattgtcagccatagttctactcaatgcgatgaagagggtttcacgtgggccagccagcgacgttccgccaggcggaacaggctgatcaacacgtaagagataatcaggtacaacacagccgccagaccaaaggcggtaaacggctgataggttgccgagttaatatcgcgcgcgattttcagcagatccggcacggtggcggtgaaggccagcgccgtggagtgcagcatcagaatcacttcgttgctgtaggccggcagtgccgtacgcagcgccgatggcaggataatgcagcgataaagtttaaaagtagagaagccgtacgcccgtgccgcctcaatttcaccgtgtggcaccgagcgaatcgcaccggcaaaaatttccgtggtgtaggcgcaggtgttgagggtgaaggcgagcagcgtacagttcagaccactgcggaaaaaggcattcagcagttcagtgcctttcacaatctccagcgtgtacatgccggagtagaacaccagcagctgcacatagagcggcgtgccgcgaaagacgtaggtgaagagccagaccggaaagctgataaaccggttaggggaaacccgcgctatcgccagcaggattgccagacatccgccaatggtgaccgagaggatcagcagccacagggtgatagctacaccggtaaaacgataaccgtcagtccagagcagcgatttccagtattcctgaataatatcaatcataactcgccctctttacacctaccgtatagcgccggttgagccaccacagcacaccgtttgacagcgtggtaaataccagataaatcacaccggccacaatggcgaagtagaacggctgccaggtactttttcctgccagctgcgtcgccttcaccacatcttccagccccagcagcgagaccagcgcggtggctttcagaatcacctgccagttgttgccgatgcctggcagcgcgtagcgcatcatggccggaaacagaatgcggcggaacacctgcgcgccggtaaagccaaacgcggttgctgcttcaatctgcccctgaggcacggccataaaggcgccgcggaacgtttcggtgaagtaggcaccatagataaagccgagcgtgatgatgccggcgaccatcgggtcgatatcaaactgcgccatacccagcgcatcggttatctggttgaggacaatctgcagaccgtagaagatcagcagcatcagtacaaggtctggcacgccacgaatcagcgtggtgtagccttcaaaaattatcgccagtggccggctgcgcgacagtttcgcgcctgcgccaatcaggcccagcagcactgccagcacgacggaagtgagcgccagctccagcgtcaccagcgtgccccgaagaattacatcagaatagccatacagcatcgagagggtcctgtcgtggggtgaaaacgaaacgctgcccgcaagcgagacgggcagtttagctttacctctctgttgcagatgccatccgccattagcggaaaagaacccgattctgcacctggcagaaccggctcagacccggcaaaacggacacagagggtaaagcgacaggatggttagtcgccgtacacgttgaaatcgaagtatttcttcgcaatcttgtcgtaggtgccatctttacgcatgtcagcaaaggctttgtcgatggcggctttcagttcgctgtcatctttacgcagtcccatgccggtaccgacgccaaaaatcttgtcatctttcacggccggaccggcgaaggcgtaatttttaccgaccggctgcttcaggaatccttcgctggcctgcacttcatcctggaaggcagcatcaatacgaccggcattcagatcctgatagaccagatcctggtttgcataaggtgtgacgttcaccccttttggccgccagttctgattggcgtaagtttcctgggtggtgccctgcagcagaccgatgtttttgcctttcagggactcaatggtcggctcaattttcgatcccttcggcgcgactaaacgcgcgttagcggcgtagagtttttccgagaaggcgatctcttcctgacgtttcgctgtgatggaaagtgaggagatgatggcatcaattttcttcgctttcagcgaagggatcagcgcatcaaagtcgctctctacataggtacattgggtatgaatacgtttacagatttcgttagcgaggtcgatatcgaagcccactaacttgccttgcgcgtttttcgactcaaacggtgggtaagttggatctgtgccgatacggattgaacccggaaaccgccgcgaagacgctggcagcactggataagcccagcatcagggaaagagccagaacacgctttttcatagattaccctcaagtgaagtgctttttgttatgtggttcgtgatgtgtttgcgcaaagtaatttgcatgtttcatgccagttctgcaagttaaccacgctgttagcgtgaagtcagacaggcgaaaacgctgtgtttgtgaggggaatatagcagtgaagtaaaagagaaaaagcgacgttgttaacttttggtgcgtcaaatgcacgaagagtgatccgaggcgcgcttatgcactaaataagtgcgccagcggaactttatgcaccctgccagcgcgtgaagagatcttccgataattcgatatcaaactggtcgatcacccggttaacggtctgatcgatcagctgatcgatcgtttcaggccgatgataaaatgccggcacgggtggcatgataatggcacccagctctgcggcggtggtcatcattcgcagatggccaacatgcagcggggtttcgcgcacgcacagcaccagcttacgctgctcttttaacaccacgtcagccgcacgggtcagcaacgagtcactgtaactgtggacgataccagagagtgttttcattgagcagggtaaaatcgccatgcccagcgttttaaacgatccagatgagatatttgctgcaatatcgcgcacgtcatgcaccacatcggccagcgcctgcacgtcacgcagcgaataatcgctctccagtcccagtgtctgacgcgccgcctgactcataaccagatgcgtttctacttcttccacctgctgcaacacctgcagcatgcgcacgccatagatcaccccgcttgcgccagagatgccaatgatgagtcgtttcatattccaaccttatttcagccaatgggccatcatacgcggcctgcgggtttctgaaaacaaacagggcgggattgctcccgccctgttttatgctgcccgcctgctgaaagtatcagccttcgttgtgcagctcgaggttttcgacttcgtttctgccgctgaagcgctttggcatcatcattacgcagcgactcaagatactccagatattgctgatcgacatctttcgtcacgtaaatgccgttgaacaccgagcactcaaattgtgcaatgtccggattctcttcgcgaaccgcttcgatcagatcgtccagatcctggaagatcagcgcatcggctttaatcagctggcgaatctcttccacttcacggccatgcgcaatcagttccgtggcgctgggcatatcgataccgtagacgttcgggaaacgaatttccggcgccgctgacgccagataaaccctttttgcgcccgcttcacgcgccatctcaataatctgctctgaggtggtaccgcgaacaatagagtcatccaccagcagcacgtttttatcacggaattcggcgcggttagcgttgagcttgcggcgcaccgcgctgcggcgtaactgctggcccggcatgataaaagtacggccaacgtaccggttcttcacgaagccctggcgatagggtttgtcgagaatacgtgcaatttccagcgcgatatcggtggaggtttcaggaatcggaatcacaacgtcgatatcgagatcttcccactcgcgcgcaattttctcacccagcttggtgcccatacggacacgggcgctgtagaccgagattttgtcgaggaaggagtcgggacgcgcaaaatagacatactcgaacaggcacggattgcttttcggattttcagcgcactggcgggtagagagctggcccgcttcagtcacataaaccgcttcacccggtgcgacgtcacggatgaactcaaagcccagcgtatccagcgccacgctctcggaggcgaccatatattcggtgcgaccatcagcgataacgcgcttgcccagtaccagcggacggataccgttaggatcacggaaggcgaccataccgtggccgataatcatcgacaccaccgcataggcaccgcgcacctgctgatgcacggcagcaaccgcagcaaagatgttgtcggctgtcagcggatcgttttgaaaacgatctaactcctgcgcaaaaatgttcagcaggatttcagaatctgaggtggtattaacgtgacggcggcccttttcaaacaggtgcttacgcagcacgtgggcgttggtcaggttaccgttgtgcgccagggtgatgccatacggggagtttacatagaatggctgcgcttcagaggcactggagcttcccgcggttggataacgcgcgtgaccgatccccatattgccctgcagacgctgcatgtggcgtgcttcgaaaacgtcgctgaccaggccgtttgcctttcgcaggcgaaaacatttcagcgcatcgatagtacaaatgcctgcggcatcctgcccgcggtgctggagcaccgttaacgcgtcatagatcgactggttgaccggcatgaaaccggtgataccgacaataccgcacatgttgtcatttcctcattaagccgcactcccggtcacatcaccggggtaaaaaactcgacgtgcttttcaggtaatcaaaaaaccacctgattatataactgaactcgggaatgagttgagactgttgccagtccggacttttggaaaagccagtgaatgtatcgaggaagaacagcaaagcggctacgatcagcacaccacgcaatgccccgaaacacacgcccaacacccggtcggttcccgacaggccggttttttccaccagcgtgccgataacgtagttcacaatggcccccacaatcagggtcgccacaaacagcacaccgatggcgataccgttacgaaccagtttcgtcgtcaaaacctgtaaaccagactgcaaggtaggcgtagtaatgactggcgacaaaaaacgcgcatccccaggtaacaagagataaggcttcacggacaaacccacggaccaggctgaccagagccgaaaaaccaactaccgcaataatgacgtaatcaatccagatcatgaactcttccagcgccagtgcaattgcacccctgcatccagttcggggcgcattctaacagaaaaagaaaacgtttgcgtagcggttttctttttctgcatccataaaaaaggcgatgaaaaaaaacgctatcgcccgggtaattctcagccggacaggccgttgaaaatcgtcattttttttcgcggcagcgcgcattaagcgcgctgtctgaggggtaaaagacgctgcctgttactgctatcggcagcgccaatcgcccgttttagcgggcgctgtatggtttcacgacaccgcccagtcctgagatacttttcagctcgccaaccgcactctgcattttggctttcgacgcatcaggcccaacgtaaatgcgggtgatctgaccctgtaccggcgttgaaggaacggtaaaggcgcgatagcccgacagccgcagctgcgcgacaatctcattcactttgctggcgtttttcagcgcacctaactgcaccacataagcctgccctgccggcgctgtcgtctctgctgattttggcgcctcttcctgcttcggctgttcgaccactttaggctgttcaaccggtttaggtttaggctgctccacggcttttggcttctgctgtttcgaccggcttctgcttaggctgttctgttactttcggtttctgctgctcaacgaccttcggcttcgtcaccgtctgtgcgggcacagactgatggaccggcggcggcgagaccactaccggatcgctctcgtcttccggttgagtccgaccctgctctgccgtagcgttggttttaccgttgccattgctgctgctgaccgcattgcccgcgccttccggcggctgtgccggcagcgactgggttaccggcggcaccatttcgctgtcctgctgatcgtcaggtttcggcaccagcggaatggcggcaaactcctctttgtaatgctttttctgaccatccagcagccctggcagcacaatcacgccaacggcgaccagaataacggtgccgactaaacggttctgaaacttacttgccacgtcctttctccgtttcaatcgattccatgacctgtgcaacggtgtggaatgaaccacagaccagcacaatgtcctgcggcgctgcccgctggcgtgcctgctgccaggcgagctcaaccgaactaaaagcctcgccctgcgacaggttgttcagcagttgctcagcactggcgccgcgcggaccctcgaggggcgcgcagtaccaggtatcgaccaccggtgccagcgccgccagcgttccggcgatatctttgtcatgcagcatgcccaccacggcatgcactttgccgcgtttcggcagtgcagccagccgcgacgccagatatgctgccgcatgcgggttatgggcgacatccagaataacgcgcggtgattcgctgagggtctgaaaacggcctggcagcatcgccagcggcaggctggcgcgaatctgcgcctcactgacctcaagcccggagacccgcagcgccaccagcgcggtcgccgcgttaggcagcggcacctgcggcagcggcagatcgttcagctcacctgtcgcatcacgcagtgaccagctttctgcctgcgcatgccacgaccagtcacggttgcgctgcaacagctgcgcacctttttcctgtgcgaccagggcaatactctgcggcatatccggttcacccactaccgcaggttttcccgcccggaacacaccggctttttcacgcccgatgctttcgcgatccgggccaagccagtcggtgtgatcgagcgcaatgctggtgaccaccgcgacatcggcatccacgatgtttgtcgcatccagccgtccgccgaggccgacttcgaggatcacgacatccagctgcgcctggcggaacagattcaacgcggagagcgtgccaaattcaaaataggtcagcgaaatatctgcacgtccggcttcaatctccgcaaagctggcgcagtgctgtgcttcactcagctcctctccctgaacccgaaacgcgctcggtatagcgcaccagatgcggtgaactgtacacgccaacgcggtagcccgcggcgatcagcagcgtttccagggtgcgacaggtggtgcctttgccattggtaccggccacggtaaagacaaaaggagcgggtttcagcaggtcgagacgaagcgctacctgacgaatacggtccagacccagttcaatggcctgagtatgcaggtgctcaagataataaagccacgtggccaaaggcgacgtggcttggggaaggtgaagattgtccatatgtcccgttttgcttatttatacctggcaggctgctgctgcggtatacggtgcattggtaagaggtgctttggacgcacctctctatctcctgtcaggcctcgttgctttccgattcagtcgtcgccggagcggactgttcaccgtcatgcagcggtgccggcaggttcatcatttttgccagcaggcttgccagtttgtagcgcatttccggacggcgaatgatcatatcaatcgcgcccttttcaatcaggaactcactgcgctggaagcccggcggcagtttttcacgcacggtctgctcaataacgcgtgggccggcaaagccaatcagtgctttaggttccgcgatattgaggtcgcccagcatggcaaaactggccgaaacaccacccatagtcgggtcagtcagcacggaaatataaggcagaccgcgctcacgcatttttgccagtgccgcactggttttcgccatctgcatcagcgactgcagcgcttcctgcatacgcgccccgccgctggcggagaagcagatcagcgggcagttatcttctaacgcctgctcaaccgcacgtacaaaacgcgcaccgaccactgagcccattgaaccgcccataaaggcaaattcaaaggctgccgcaacaaccggcatgccgtgcagctgacctttcatgaccaccagcgcatctttctcaccggtgtctttctgggccgcgatcagacgatctttgtactttttggagtcacggaacttgagcagatctttaggttcaagttcactccccagctcaaccatcgtgccctgatcgaggacgctgccgaggcgctcacgggcgtgcatccgcatgtgatggtcacacttcgggcagacctcaagattacgctccagctcggcgcggtagagcacctgaccacagctgtcacacttggtccagaccccttccgggatactggctttgcgcacaggcgttccggtgcttttattaagaatgcgttcaatccagctcattgatgacctttctgtttaaaactgacctggtccagtcgtcttgatactgctgaaaaccgcttcagcagacggtaaatgtcgctcattaaaccacaacctgttcagactgtggataaaaatctggtcttacccctgagcgcagccttacggctgcttctgctgcttagcctgacggcgatgacgccagacttcaatcacacctggcagaatcgagaccaggataatgcccacaatcagcagcttcaggttttcctgcaccaccggcagatcgccaaacaggtagccggcataggagaacagcagcacccagagcagcgcacccgttacgttgaacagcgcgaagtggcgataggacatatggcccataccggcaacaaacggcgcaaaggttcgcacgatcggcacgaagcgcgccaggataatggtttttccgccgtgacgggcataaaacgcatgggttttatccagatggctgcgacggaaaatcttcgagttcgggttactgaacaaccgttcgccaaacaggcggccaatggtgtagttcaccgcgtcgcccagaaaccgcggccaccactaataatgccaccatcacatgcacattaagatcgttacccggcaacgccgccagtgcgcccgcgacaaacagcaacgagtcacccggcaggaagggcgtcaccaccagaccggtttcgcagaacaaaatcaggaacaaaatagcgtaaatccagataccgtactgtgcaaccagttcggcaagatgcacatcaatgtgcagaataaaatcaaccagaaaatggagaaactccatggcgcgcccttttaagtcctgaaagtgaattaatccgcgaggaacaacggtcccatcgacggctgtggtaacgcaaagtgggatgggtaatccaccgccaccagatacaacccctctgcccgggctgtggctgcggctaatgtccgatccttcgccgccagcagcgttgccatccatgactccggcttattgccgcagcctatctccatcaggctgcccacgatattgcgcaccatgtgatgcacaaaggcattggctttgatatccacaatcacgtagggaccctgacgcgtcacgttgaggtgaatcacgttgcgccacggtgtacgcgactggcactgcaccgcgcggaatgaggtgaaatcattctcgcctaacaaacattgcccggctcgctgcattttctctgcatccagaggatggtaaaagtgcgtcacgccctgcgccagcaccgccggacgcagacgctgattgtagatcaggtagcgatagcgtcgggccgtggcgctgaagcgggcatgaaattcatccggcaccgctttcacccagcgcaccgcaatatccggcggcagattagcgttgacgcccagcgtccaggcgccatcaggccgctgcgaggtggtctcgaaatggaccacctgccccgtcccgtgtacgcctgcatcggtgcggccagcacaaaaaatgctgaccggatgatcggcgactttcgacagcgcgcgttctaccttctcctgcacgctgcggacttcattctgacgctgccagccgtagtaacggctaccgtcatactcgatgccgagcgccagtttttgcgtctgaccatcggacatggttacagatactcctgaaccagtttctcagcggttttcaccgccatcagcgcgccgccaaaacgaatgttgtccgctactgaccagaaactgcagcagctccgggataccgtagtcgttgcgcacagcgccgatgctcagttcgccgttgcctgaggcatccgtgaccggcgtcggcacttcatcctcttcgctcagacgaatatctgacgccagcgccagttcggcacgcgcttcttccgcagagagcgggcgcaggttttcgatatgcacaatctgcgcattaccgtagaacaccggagcctgtacgctgctgaccgcaatcggtaagccttcgtcctgcaataccttacgcacctgatcaatcaggcgacgctcactctccacgctgccttctgcgtcggcctgttgtggcatcaggttaaacgccagctgacgaccaaaatggtgttcatcggccggaataccgttcagcaggcgggcactttccccggccagcgcatcgacagccactttgccgtagctggagactgagatcaggttagtcacctgtaaacgactcaatccggccgcatccaccagcggtttaattgcggtcagcagctggcttaccaggttgtccgccacgctgatgatgttgcgattgcgataatctgccagcacctgcggattcacatctggcaccaccagcggcacatcgggttccagcgcaaacagctcgctgctgtcgatcaccagacaaccggcattggccgcttcatcggcaaagcgcgccgaggcgtcacgtcccgccacgaaaaaggccagctgcgcctgtgaccagtcgaacgtctccgcattttcgacccgcaccgagcggccttcgaaacgtttgatttcgcccgcgctgttttcgctggccagcaaatataattcaccaaccgggaactggcgttccgccagcagttccagtacagcgttccctactgcgcctgtcgcgccaagtagcgcaatattccagccgtcagacatgttggtttactccagacaatgacataaaaacagaaggcggtgatattcaccgcccagggattcagatttatccccgtcgtctttcacgttgcatctttgttggctgcgttcactcacccgaatcacttacctgagtaagcgcatcgggattcgttctcttgccgcctcaatgcaacccgaaatccattgggtatatccccccagaacccgccgtcatgcagacatgccagcagcgcgcgccttccgttcactgattaattcagtgcagaaatcgcgccagggcgcctgacctgcagcgcccgctattccggggagatgattgcgttaaagcccagctggttcagcagctcagcggttgtggcgtcatcgcagttcacctgcagcgatgaccactcgcggcgctcctgatactgcttgcgcaggcgatcaaactcgccgggtttcgccgccactttacgcaggggggcatcatcgcggcgcacatcatacaccagatgcgccaggcgtttcagcgttggctgatccagcgggccattcagggtgatttcactgaattccggcaccggcagtaaggtactgagcggcacctgctgcggctgaccaataaagtcgcaccaggcttcaaacacctgggtggtgccgcgcgctttgccttccagcgtgtagcccgcgatgtgcggcgtggcgatatcgaccttatccagcagcgccagcgacagatccggctccggctcccagacatccagcacgacgctaagatcgtgccgcattttcagcacctccagcagcgcgctgttgtccaccaccgggccgcgacaggcgttgatcaggatagtattaggctttagcgccatcagcagcgccgcatccgccagatgccagcttttatacgggccctctttaaacagcggcgtatggaacgtcagaatatcagcctgctctgtcacggcctccagcgacaggaaatccccctcgtcaccgcgatcggcgcgcggcggatcgcacagcagggttttgatgccccaggcctcaagacgcttttgcagtcgctcaccgacgttaccgacgccaacgatgccgacagtgcggtcacgcagctggaaaccatcgcgtttccgccagcagcagcagcgcagaaaaaacatactccaccaccgcaatggcgttacagccgggtgcggcagagaacgcaatgcccgcctgctgcagccagttctcatcgatatggtcggtgcccgccgtggcggttccgacaaatttcaccggctttcctgccagcagggcctcattaacctgggtgactgaacgcaccatcaggccatcggcatcggccagttcagccaccggcagcggacgccccggcaccgcgaccacgtcgccggtacggctgaatagctcacgggcataaggcatattttcatcgaccagaattttcaccacggctttcctgtcagttacatatcaggcaattattctggcacaaagcgacgcgttagcctaaccgcgcacggtagcgttcgggcgtggttcccgcctgttgctggaacatcacaatcagcgccgaagctgaactgtaccccagctcatgggcgatgctctgcacgctttccccctgctccagcagcacaatggcgcgcagaaaccgcagccgctgccgccactcgccaaaggtcatatgaagctgctgctggcagcgccgcgccagcgtccgttcggtggtaaagacccgcgccgcccagcctgccagcgtggtgttatcgcccggatgcgcttccagcgcatgtaacaccggcgccagaaatttatcgtcagaggtgggcagataactctcctgtacctgcgccagctgcaggcgatcgcgcagcacctcgcacagccgccactgcgcatccgtttcgggttgctcgatttgctgctcagcaaactcatccataatggcatgtgcaatgggatcgaccagcagcaggcaggcgcgccggggcagatcggcgcataacggagccgccagattaaaagtacggaactgtgcctgacgatggttatagctactgtgaagctgacccggtgggatccagaccggaatatctgccggtgtcagcaatcgctcaccctcgacctgcatctccagtacgtggcttttcaccataatgagctgaccccaggcatgcgcatgcggcagatattcggtgcgggcattggcctgctcataacgcataaagtagcgcagctgcggcgcgtcaaggggcggctggtagatcactttcagggtcattatgtccgctccacaactaattttgtccgatattaactatctgaataaatccggacaagcgtacactgcgcctcattatggcgtgtggagagtcagcatgtttttcctgtacccgctctttgcggtaataatctggtcgatcaactcaattgtcagcaaactctcggcggatgcgatcgatccggcggcaatctcattctaccgatggttactggcgctgctggtgctgacgccttttgtgctgcccggcgtgtggcgcacgcgtcaggtcattaaaccgcacctctggcggctggcgatccttggcctgctcggcatggtgctctatcagagtctcgcctactacgcagcacaaagtgtcagcgcactctttatgggcattatcggcgccctcatccccctgctcaccgtgctgctgagcgtggtgatcctacggattgcgccgacgctgggcatcctgctcggcagcatcatctcctttaccggtctggtgtggctggtcagtgagggcaacgtgatgcagctgctgaatcacggtctgggcaaaggtgaactgctgatgctggccgcctctgccgcctatgcgctgtatggcgtgctgacacgccgctgggcgctgccgctgccgatctggcaaagcctgtatgtgcagattttatttggtgtcgtactgctgttgcctggttttctgctggcccccgaggtggcgcttaaccggcacaacctgccgctggtggcctttgccggtctgtttgcttcgatcatcgcgccgtttcctgtggatccacggtgtgcagcgtctgggtgccagcaccaccagtatctttatgaatctgatcccggtatttaccgcggtgatcgcggtgatttttctgcatgagcaactacacagttaccactggattggcggcggtctgacgcttggcggtgtgatactggcgcagcggctgcgtacccccttaacccgccgtaaaccggtgagtcacccgctgccctgaatagcgcggccggcagattacgggtagcggctgtggcgagtgagggtactgttgaggatggcagtgaagagagtctacagctgaagcgtaaatctcgcgccgaaacgcatgtcccccgtgggatttcccgggggcttttgctatcatggcctattcattttccggcgcaccccacgctgttctgttttcccaaggaatccgccatgcaaccactcagcggccccggtgtgccggtcggcgatcgttcatctgtcaatccgcaaactggcgtaacgcgtcacggttcagtggccggtgaacagcccctctcccctgcgcagcgcacaacgttagaacgcctgatcgtgcgtatctcatcgctcagtaatcttaaagcgcctgaactgtgggcgggcgtacgccatgaagtgggcgtaaagagtgaagcggaattacagtcgcgtcattttccggcagcggaacagtaccttaatggccgccttacgcagacgcaaaatgggcatgccacacgccagctgatgacccagctcaccgatctgctgccgaaagggaataaccgtcaggccgtcagcgactttatccgtcagcaatttggtcagaccgtactgagcgcgctgagccaggatcagctgcgccaggtgctgacgatgctgcagaatgggcagatgacgattcctcagccgcagcagatccgcgtcagcgatcgcacgctgctgcctgccgagcaccatacgctgaatcagcaggtggtacgcctggccgctgccactggcgaatccaccggtaagctgtggacggctgcgctgaaactggtcaacctcaccagcggtgatcccatcccgtcgcgccacttcccgctgctgacccagtatctgcaggtgcgccagacgttgagtcagcacagtgcaccgacgctgcaattgctggaagcgtccctgaaacagccgcttgatcagcaggagcggcagcaactggaggattacagccagcagcgtttccaggcgacaccgcagacggtgctcaccgtaacgcagacccaggatctgctgaacttcctgttcagccggcgcgccgaccgggcagaaaaacttctcgaacagccgctggctgccagcgagataaaaccccagccgatctggtcaccctttgttgcgtcgctgccgcccgcgattcagcctctggcagagcgccccctgctgggcttctttgtcgcactggtcgtcatcacccttttactctgggtggtcctctgagttaacagccacagaatgctttgggcgcggcgactggccattcgcccggtgcatcaccccaggtcagcggatgaccgtcacgtttccagaaatccagcccgccaatcaactccttcacctgaaatcccagcgaggccagtttccaggccgctttcgtcgagccgttacagccaatgccgtcacaatacgtgacataaactttgctgcgatcgagccgggccgtcgtagtggcatccatctcgcgatgcggaaagttgatcgcgccgcaaatatgcccggcgcgataagcctccggcgcgcgagcatcgattaccacgatatccgggatttgccgttccagatcttccgccagatcccaggcgtcggtgtaaaaagcgagttttgcctgcagatagtcgaggctttgctgcggggtggcggccggaattcgtaaaaccgatgacatagcgattctcctgttgtggtgagtctgcagtttacggcaaagtggactgcttactgatacccattccccatcaggtataagacccatatgtcttcaccgttattacaactttttcagcatcagaccagtggcggcgtgcgcgagcggctctgctctaccctgcgactggcgatcaaccggcaccatctgcatgctggtcagcagttgccgtccagtcggcagctggcgcaggatctgcgtctgtcacgtgtgacggtggaagcggcctacggacagctggaaagtgaaggctatctgcgacgcgagaccggtcgcggtacttttgttgccatcatcatccccacccaatcatcatcatttccggcccggcctcagcccgtccgtttctcggcgcggggccagcaggtactggcaaccggtggctgtcaggatcccccttttccccatgcattcgccgccggttcaccggagttacgcgcttttccccatgacacgtggcgacgcctcggcagcagcgtgcagcgttcactgggcagcgccgcaatgggatatggcgatccctgcggctacctgccgttacgcagcgcactcgcggattatctggcgctttcccggggcgtggcatgccagccggaacaggtgatcattctgaccagttcacaacaggcactgcagttactggcaatgatgttcgtcgatcccggtgatgaggtatggatggaggagccgggctatcctggtgcgcgtaacgcctttctggctgccggcgcacaggtgcgcgggattgaggtcgatgccgaaggtgccatccccgccagcggcagtgcaaaactgatgtatctgacgccatcgcatcattatcctaccggcgtgacgctgagcctgacgcgacgcctggcgtggctggactgggcgcagcgcaaccggtgctggctgatcgaagacgattatgacagcgaatttcactacgacgaacgtcctatccctgcgctacagggactggatcgccatcagcgggtgattacgctgggcaccttctcgaagtcgctgtttccctccctgcggctggcctggatggtggtcccgcccgcgctgattacccccataggccaggcacgcagcgtgctggatggacacagcgccctgctgccgcaggctgtcaccgccgcctttctgcaacagggacatttcgccagccatctgcggctgatgcgtcagctctatcgcagccgtcgcgatctgctgctgacgctaatcgctcagcaactgtcgccgtggatcacgccgattgccagcagcggcggattacagataactgtcagactgcaacaggatgaagcgcgattaaccgcactggcggctcaacagggtttgctgctgccgcgtctgagcccgctctatgccgggccttcgtctcagcaaggctggatgctgggctttgccgcactgacgcctgacgagattgtggcaggatgcgatacattgctgcggctgctgcagcgggagggctaaaacggagggttgaacgaggtaaagcggatgggctgtaaaacaaaaagggccggcaagccggcccttcagagtgctgacgtaataattacgcctgatatttacgcatggtcagcgtggcgttggtgccgccaaaaccaaagctgttagacatcacggtagtcagctctttttccatcggctcagtgacgatgttcataccggttgctgccgcatcaagcgaggtgatgttgatgcttggcgcgataaaaccatgctccagcatcagcagcgagtagatcgcttcctgcacgccagccgcacccagagagtggccggtcatcgctttcgttgctgagatgtatggcgtgttatcgccaaacacttcacgaatcgcacccagctctttcacatcacccaccggggtagaggttccgtggctgttcagatagtcaattggtgtatcgacaccgtgcatcgccatcttcatgcagcgcactgcgccttcacctgatggagcaaccatgtctgcaccgtccgaagtggcaccataaccgacgatttcggcatagatatgcgcaccacgtgccagcgcatgctccagttcttcaacgacgaccatgccaccaccaccggcgataacaaagccgtcgcgctcattgtcataagtgcgtgacgctttttctggcgtgtcgttgtaacgggtagagagcgcgcccatggcgtcgaactcacaggccatttcccagcacagctcttcgccgccacccgcaaaaacgatatcctgtttgccaagctggatctgctcaacggcgttaccgatacagtgcgcagaggtggcacaggcggagctaatcgagtaatttacgccatgaattttgaatggcgttgcgaggcaggcagagacaccagaggccatcgctttggtgaccacataagggccaaccgctttcaggccgcgtgggctgcgcattgcgtcagcaccaaatacctggaaacgtggggagccgccgcctgaacccgcaatcagacccacacgtgggttgctctgatacgcttcagcgctaaggccagaatctttaatcgcttcttccatggaaagataagcatagatggacgcatcactcataaagcgcacaactttgcgatcgatgaggccggtggtatctaatttaacgttaccccagacgtgactacgcatgccggaatctttcatctcttcagaaaaggtgatgccagagcgtccttcacgcagagatgacagcacctcctgctggttattaccaatactggaaacgatccctaagccagtaatcacagcacgtttcattcaatcttcctcatccacttcttcttaattggcatgcactctagcgtacacttgtacgccgaacaagtccgatcagctatttccttttgtaaatttgcgtcatgtcacgcgggtcgctagaatcgcgccactgcctgaaaaacgagcctttaccgtgaaattgaccccggttgaacatgcaaagctaaactggaatgaacagggtacacctgtttcccgagcgtttggcgatgtctatttctctaatgacaacggtctggaagagacacgctatgtcttccttggcggcaacggttttccccagcgttttactgagcatccgcgcgatctgctgatcgtggcggagagcggttttggcaccggtcttaatttcctgacgctgtggcaggcgttcgatgcgtttcagcgcgaacagcccgacgccactttaaaacgtctgcatttcatcagctttgagaaatttccgttaacccgtgaagatttaactgcggcgcagcagcactggcccgaaactggccccctgggcggaggcgctgcaggcgcagtggcccgctgccctgcccggctgtcagcgtctgctgtttgatggcggccgcatcacgctcgacctgtggctgggcgatattaacctgctgatgggccagctggatgagagcctgaatcgtcaggtagatgcctggttcctggatgggttcgcgccctcaaagaacccggatatgtggacgccggagctgttcggcatgatggcaaaactggcgcggccgcaggggaccttcgcgacctttaccgccgcaggtattgtccggcgcggtctgcagcaggcgggctttgcggtcatccgccgcaaaggatttggtccgaagcgcgaaatgctatgcgggccgttgcaggatgcgcctccgctgcccgccgcgcagccctggtatcatcgtcaggctgcggagcagcgtgatgtggcactgattggcggcggcgtcgccagtgccaccctggcgctggcgctgctgcgtcgcggctggcgggtaacgctttattgcgccgatgaggcgcccgcgctgggcgcatccggcaaccgtcagggagcgctctatccgctgctcaatcagcacgacccggcacttgccacttttttcccctcggccttcagctttgcgcggcggctgtatgatcaattaaccgtcacctatgagcatcactggagcggtgtgctgcagctgggctgggatgagaaaagccgtaagaagatcgatcagatgctggcgatggacctgcctgaaatcatcgcctgtggcgtcgatgtggcagaagctgaaaaactggcaaatgttgaacatggctgtggcggcattttctatccgcaaggcggctggctctcaccggcagagctgaccaccgcgatgctggcgcatggcgagacccagggattgcgcattcactggctgcaccgggtgagcgcgctttcccgggaggatgatcactggacgctgacgttcagcgatcgtccggctgtgcgtcatccgaccgtcgtactggcaaacggtcatgcgattgccgactttgcgcaaagcgccccgctgccgacctatccggtggccggtcaggtaagccatgttccctccacgccgggcctcaacgcgctgcaaacggtgctctgttacgacggctatctgacgcctgtcagcccgcagtttggtacgcactgtatcggggccagctatcaccgtggcgataccgcaaccgcgtatcgggaggaggatcagcaggagaaaccgcagccgcctgctgcattgcctgcctgacagcagctgggccgaaacggtggatgtcagtgacggagaggcaagaatgggggtgcgctgcgccacccgggatcacctgccgatggtgggcggcgtgccggattatgctgctacgctggcgcagtatgctgatttaccggcacagcaggcggcaggcagcgatatcgctgacgcacccgatcttgcgggcttgtatctgtttggggcgctgggatcgcgcggcctgtgcagtgcgccgctggcggccgaagtgctggcagctcagctggcgggcgagccgcagcctctggatgccagtaccctggcagcactcaatccgaatcgttactgggtgaggaaattactgaagggaaaagccgtttagcggacgctaagggcggcacgccgccctgcaccactacgcggagagctggcgtgcctgaacaaacaggttatcccacatcccgaccactaatgcctgatcgcgcggcgaaagttctccggcagcaatggcattttgcagactgcgggtcacctgaatctgcagcgcttctggcgtatgttcgcccagttgctccacttcagcgacggccagtgtcagatgcccgcgcagataaccgctggcgaacagctcatcgtcactggcatgctcgaccatgtcgtcaatcagggccagaatacgcgcttcaaattctgcgatcatctcaattcctcttttaataatgcctttctgcatcacagatcgtccggccagggaaactgcgatgctgttaatgaaggcctgccataaaattccgccagggcggtaataaaacgcgcgggacggtcgggaatgcccgacgtcagatagctcatgacctgagcatgcactttacgctggaacgcaatgcgatccggctcacaatccccgtcgagattgtcacaactcacgttgaagggaaagcctgccgccgtacaaaacatccactccagcgcctgtggcttcacttccaccgcttcaaactgactctgggtcagcgcatcgcggccatccggacagtaccagtagccaaaatcgaccagtttgcggcgcgcttcaccggcgatgcaccagtgagagatctcatgcagggcgctggcgtagaagccgtgagcaaagaccacacggttccacggcgattcggcatcagcaggaagatagagcggttcatcatcgcctttaattagacgggtctgaaattcatcgctgaaacagcgatcaaacagcgtgatcagctgttcataatgatgagtcgggttcataacggtatcaggttttaggttacgattgcagcgtggcaagccaggccataacggcgctgccatggctgtcccacagtaatttaatgctcatgacggcagacacaatcaccaccatcgggcggatcagcttctgtccgcggctcagcaccagtcttgcgcccagacgcgcgccgcagaaagcgccgagcatcatgatcaggccggttccccacactactttgccgccgaacataaagaacagcaggctgccgaggttcgaggtgaagttgaggaccttggcatgggcggtcgctttggcaaggttgtagccgcagagcgtgacgaaagccagcgcataaaaagatcctgcacccggtccgaaaaatccgtcatagaatcccactgccccgccgccgaccagtgcaaaggccagaccatgcagacggcgcgcgcgatccacttcgccgaggcgcggcatcagcaggaaaccacagaccgatagcgattaaaaacagcggcagcatctggcgcaggaaatccgcctgcaggcgctgaatcagtatcgcgcccagcacggaacccagcagcgtcatggcaatgttcagccactgttcattcagattgaccgcaccacgccggataaagtagagactggcggaaaacgatccaccgaccgattgcagtttattggtcgccagcgcctgggccggagagaggcccgccgccagcaacgaaggtaccgtaagtaatcccccgccacccgcgattgaatcaataaaaccggcgagcatggcgattaaaaacagcagcccgacgagcagcgggctgaccacaaaccaatccatggaatcccttacagtagatgtttatccagcagggcctgacaggcaggcggtaatggcggcggctcacgtttcaccggcgcgcccgaaccaggctgtttcggcaggaaccagctctgcagctctgcgccacagccatcaccagcaggcggtgcaggctgatcttcacagccaatactgcccgccgggcagcgcaggcgcacatgcatatgggcccggtgagcaaaccacgggcgcactttacgcagccagtcacgatcgttacctgcatcggcacaaagctgctttttaatcgccggattgacgaagatccgtgtcacatcatcatctttggcggccagtttaatcaggctatcaatttctggctgccagtgacgcgcaatcacatttttgtcacccggcccgaccagatcgagcggctgcggcttcagcagttgctgggcgctccagcgggttttcggcagttgcagccagatatcgacatccagcccggtctgatggctggcgtgaccgctgctgaaacgtccgcctgctgccatgcccatgtcaccaatcagcacgttgcccagttgcaggttatgcacctgcgtactgagccgctgaataaactgaatcagatcgggatgaccaaagtagcgccgctgatcctgacgcatcacctgatagtgcggtgaattcagcggcagcgcctcggcgccaacaatacagccgttggcaaagccaccgattgactgcggtgcgccggtgatcggctgctggatgcgttgccacggcgtcgccgccaggctggaggcgctgatcaacagcgcactcagggtaagcagaagagccttcatggtatcaccagcgcggtacggagctgttaacgtcaccgtttctgcgcccgctggcgcagcagatgatccatcaggacgatcgccatcatcgcctcggcgatcggcactgcgcggatcccgacgcagggatcgtggcggcctttggtgatcatctccacttcttcgccgtcgcgggtaatggttttacccggcacggtgatgctggaggttggtttcatcgccagattggcgctgatggtctggccgctgctgatgccgcccagaatccccccggcgtggttgctctggaaaccatcgtggcggatctcgtcgcgatgctggctgccgcgctggttaaccaccgcaaagccgtcgccgatttcaacgcctttaacggcattaatactcatcagcgcatgcgccagatcggcatccagtcggtcaaataccggctcgcccaggcctggcggcacgtgatctgccatgaccgtgactttagcgccaatggagtcgccctcttttttcaggccgcgcatcagttcatccagcgcctccagcttgtccgcatccgggcagaagaacggattctcttccacgatgctccagtctttcagctcacaggcgatgtcaccaatctgtgacagatagccgcgcaccacgacaccgtgtttcatctgcaggtatttcttggcaatcgcaccggccgccacgcgcatcgcggtttcgcgcgccgacgagcgtccaccgccacggtagtcgcgctgaccatatttctgctcgtaggtgtaatcagcatggcccggacggaagagatctttgatagcgccgtaatcctgcgaacgctgatcggtattttcaatcagcaggccaatcgaagtaccggtagtcacaccctcaaagacgccggacaaaattttcacctgatccggctcgcggcgctgcgtggtatagcgcgatgtgccaggacggcggcgatcaagatcatgctgaatatccgcttcggtcagcggaatacctggcggcacaccatcaacgatacagcccagcgcaagcccatgggactcgccaaaggtagttactcgaaaaaattgcccgatgctgtttccggccatgctgtttccttctcagggttcggcgggcgatgcttcgccccacttttagtctttgtaaaaagagaaatggtgttttgcgtcgacaatctgctggcgcgtcagcgtaaagacgccatcgccgccgttgtcgaattccagccaggtaaagggcacgtcgggatactgttcgatcatgtgcaccatgctgttgcccacttcgcagaccaggacgccctgctcgctgagataatctggtgcacaggccagaatgcggcgtaccagcttcaggccgtcgctgcctgccgccagccccagctccggttcgtggcgatattcgttcggcagatcatccatatcttccgcatcaacatacggcggattggtgacgatcagatcatatttcagcggtggcaattcgcggaacaggtcagcgcgaatcggcgtaacctgatgaatcagaccatgttcttcaatgttctgctcggcaaccgccagcgcaccggtagagatatccaccgcgtccacttccgcttccgggaaggcataggcgcaggcaatcgcgatgcagccgctgccggtacacatatccagaatatgatgaggtggcgtgctgaccagaccggcaaagcggttctcaatcagttcgccaatcggtgaacgcggcaccagcacgcgctcatcaacaaagaactcgtggccgcagaaccaggctttattggtcagataggcgaccggaatgcgctcgttaacgcgacgaatgacgcgctcaacgatcagaagacgttcgctggcggtcagacgcgcattgcgcatatcttcaggaatatccagcggcagccagagtgacggcaggaccagttgaacggcttcgtcccagggattgtctgtgccatgtccgtaccagattccggcagcggaaaagcggcttaccgcccagcgcagcatgtcctgaatggtgtgcagttcgttcactgcctcatcgacgaaaattttgtccacgtagccctccgcaggccttttgctaaatcggccagtagtgtgccatgaagccggggagaattcagcgcagcgaggtgaaaaagctgacatttaatgacgcttaacggtaaggtatcggctctgctgtgtgacagccttttctgatatgactgacctgccatgagtaaaaaaacaccactaagcccggatgaccaggcgctgtttcgccagttaatgacgggtacgcgccagttaaaacaggacacgtttgtccacaaagcgccggttaaaacccgccacatcccggtaaagcgtctgctttcagagcaggcggacaacagtcattacttttcggatgagttccagccgctgctctcaacggaaggtgccacccgttacgtgcgcgccgatgtcagccattttgagctgaagaaattacgccgtggcgactatacgccggagattttcctcgatctgcacggcttaacgcagcagcaggccaagcaggaactgggggcactgatcgccgcctgccgccgtgaacatctgttctgcgccagcgtcatgaccggtcatggaaagcatattctgaagcagcagacgccgctgtggctggcccagcatccgtgggtgatggcttttcatcaggcacccaaaatgttcggcggtgacgccgcgctgctggttttgattgagattgaggagtggcaaccgcctgaattgccctgagaggggccggaattatcggcccacagacgtcagattgctttagccagctttttgggactgacctgccacagcagtttaccggcactcgctgcgggatcgaattccacgcaggcaatagcggaagtggcgaacattggcggtgcttcctgcgggcacagttcagagactaaataccccaccaacggtaaatgtgaaatcaccagagccgatttcacgccttcattcgccagggcctgcagatagcacccgaccatctccggatcgccgcccggcgttaattccggcagaacgtcctggctttccggcaggggaaaggcttcacgcacggtcgcgagcgtttgctgcgcgcgtaaatagggactcaccaggacacgctcaatgtccggcgtctggctgttaagccagttggccatctgacgtgattcattgcagccacataaggttaaaggcctgactgaatcactggctgcttccagagccgcatcgccgtgacgcatgataaaaacttgcataaagcaccgctgttgtttgtcgacatcgcccgacgcgtagcgcctgactcttcactctgcgaatgaacgctgtgttttaccctaatggctttagtatagtcaaccggttgtttattaaataagcacttctcagaatcatgctgcgccgcacactctggcggcgcttttctaagccgctgaatcggattagttattccattttcagcagaaatgtaaaatttcgtctattttgcagccgcctgaatcagcgcctcacagggtgtgaatcgttcgccatgctgctgcgcaagccgggttaatctgttgaccacttccgccgcgcccagtttgtccatgtagtggaacgggccgcctaagaaaggcggaaagccgatgccaaacaccgcaccgatattcccatcgcgggcgcagcgaaccacctgctcatcaagacagcgagccgcttcgttcagcatcatcatcacgcagcgttcagcaatctgcgcttcactctgcctggcctgcggcgagactttcagcaacgtatacagcgaagcgtccggttttttacgctgccagcgcggctggtcatagcgataaaagcctttgctgtttttacgtcccttgcggccatctttcagcaccgcatcaaaagcggctggcgcggcaaagcgttcaccataagcctgatacaggatgggactgattttgctgccaacgtcgataccgacctcatccagcagctgaatcgggccgaccgggaaaccaaacttcaccagcgcccgatcaatatggtcaatcggctcgccctccagcaggcagcgtatcgcttcatttatatagggcgtcaggatgcggttaacatagaagcccggcttgtccgccaccacaatcggagttttaccctggctgcgcgccagcgccacaatcgtcaccagcgtcgcggtagaggtattcagatgaggaatcacctccaccagcggcattttctctaccggactgaaatagtgcagcccgatgacgtttctcaggacgctgggcgccggcggcgatcgcctcaatcggcagcgaagaggtatttgaggcaaacagcgtatgcggctgacagtgtgcctccacttcgctgaccatctgctgcttcagggctaaatcttcgaatacggcttcaattaccacgtcgcgctgtgagaagccctgataatcgatgccgcccgtgatacgtgccatctgctgctgacgctgtgccggagtgagctggcggcgtttaacctttttgctcagcagttcccagctggttttcagcgcatggttcaccccttccaggctgatatctttaatgcgtaccggcaacccggcgttgattgcggtgacgctggcgatgccgccgcccatcaggccgccgccgaggataccaacacgcttaacggtgccgggttccgcttcaccgccccgctcctttttcatagccgtagtcgcaaaaaagatcccgcgcagcgcaacagattctggcgtcatcgccagctcaccaaaagcgcgtgcttcagcctcatgtccggcccgactgccctgctccagcccgatgcgcaccacctcaataatgcgttttgctgccggatagttaccctgcgttttggctgcggtctgtcgggtcgccagcgcaaacagcgcctgacggccaaccggaccatgtagcagacgatcgcgcagcggcagcgttcgtccactaaccttgccctttttcacccgggcaatggcggtctccagcagaatcgcctgcggcaccgcgtcatcgaccacgcccagcttacgggcctgtttcgcccgcagggctttgccagtaagaatcagtggcagcgcctgctgcacgccgattaagcgtggcagccgctgagtgccgccagagcctggcagtaagccgagttgcacttccggcaaaccgaggcgggttttatcatccagcgagcagatacgggcatcacaggccagcgccagttccagtccgccgccgaggcaggcgccgtggatcgccgcgaccaccgggaacggcagtgcgtcgagcgcagccattacttcctggccctgttttgccagcgcttcggcttcctgcgcgctcttacagcggtcaatcatgctgatgtctgcgcccgcgatgaagttgtccgctttgccggaaatcagcaccaggccagccagttgcggatcgcgtcgcgcttccgcaatgatggcggtgatctgcccggcaaattccgatttcagggtgttcatcttctcaccagggacatcgatcgtaatgatgccgacgtgatccagtcgcatcttcagatgaaacgcattctgctccattattcggcctccagaatcattgccgcacccaggccgcctgccgcgcaggccgtgaccagtcctaacccgccaccgcgacggcgtaattcattcagcgtctgggtgatcatgcgcgcacccgtggcggcaaaaggatgaccataggcgatcgatccgcccagcacgttaaagcgctcttcattcacttcgcccagcgcgtgtgggcgattcagcacctcacgggcaaagcgctcgtcgcgaaacatgtgcaggttgctcagcgtctgggcagcaaaagcttcatgcatatcgatcagcgtcagatcggccagggttatgccggcgcgatccagtgccagtggtgaagcgtacgccgggcccagcagcatatcctgctgcacaccaatggcggtaaaggcgtagctgcgcagatagcccagcggcctgatgcccagttcacgggcgcggccctcgcgcatcagaatcactgccgccgcgccgtcggtgagaggcgtgctgttggccgcggtgacgctgccgtgctggcgatcaaatgccggacgcagtcgggcgtaatcctccgctttggcgttcatccgcacgttattgtcctgatcgatggcgcttttccacggcggcacaaaggctgccatgacttcctgattcagtaccccggattgccaggcccttgcggcatgctgatgggatcgcagcgccagcgcatcctgtgcttcgcgcgtgatgccgtgactcttagccatctgctccgcagtgtcgcccatgcgcaggccggtcgaatactccgccactgcgggcgggaccggcagcagatcacgcggacgcagacgccgcaggatgtgcagtttttgaccgaagctgcgggctttattgagatccaccagcgcgcgggccagcgttttactgaccccaatcggcaacaccgacgaagagtctgcgccaccggcgataccagcagagatggtgcccgccagcagactttctgccacattcgctaccgcctgaaagctggtggcgcaggcacggctgacgctgtaggcatcggtatgcacactcagcccgctgcttaatacaatttcacgcgcaatgttcggcgcttccggcatctgcaccacctgcccaaagaccagttgctcgatcacctcagccggcagttcactgcgcgccattaattcgctgaccaccatgcgtcccagctcaatggcgggaatgccatggaagccggtcgcctggcgtaagaaaggggtgcgtaatccgtgggttattgcgatgcgttcaccatcacgcgtcagcagcggctgcgctttgctcattgttctcacctgtggctgggactgtggcatcattgcctgaagaggtctgacctgatcagtgttaaccacaagcgggtgagccgccaatatcggaagggaaaaagtgcgaagagaaacacgaaaatgaaaaacgccgcagtgacgcggcgtaatgggacttaacgcaaaccgagctgaaaaatcatggtttcagcctggcaactgaaggtgaaatcgatatccagctgcactccctgatccacttcgctgaagcgcgattcaatcagacagggttctgattcaacctcgcgggcacgttcggtcagttgcgctaatttcgcttccgcatcggcacgctgagcaaaccattctgaccagctggcggtgcaatcagtgttatccattaccgtgccgacatcaacacaacaacaggctgcggtttcggtcgcactgcattttttaatggcatcagtcatttcattctccagaccagcaattgcataggttgagcgattttatggacgaaatcttacctgctcgctgaaagatgcgccacgcacctgttgctaagtgacgaatatcacaataaaaattgatccagaacaaactggaatggttatgctgtccaggatcaggggctttttgttatgcagatcgaattttaagcgatcaaacctgaaatattttaaaaacaatattgcaacatgcacacaggtcggacctatactctccgcactggtctgatatgtgcgctttacatcagtccctacaatccgccgtcctttgttacgcgacgttatagcgttaaataataattcacatgaggttgtggtcatgaaccataaaaacctgtttgcaaagtcagccgtggcggctgcagtggcgcttgtctcttcccacgtttacgctgctgggtttcagttaaatgaattctcttcgattggtttaggtcgcgcatattcaggcgaaggggcaatgggtgataccgcggcgtctgccagccgtaacccggcgacaatggcgttaatggatcgcccggaattttctatcggggctgtctatattgcgccggatgtaaatatcagtggtcgcagtcccagtggccgcagcctggatgcgaataatattgcccctaatcagtgggtacccaatattcactacgtccagcccatcaacgatcagtggtggattggcgcctctgcaacctcaaactacggcttagcaacagagtttaataatggctacaccgctggcggttacggcggtaaaactgacctgatgaccggcaatttaaatctcagcaccgcttatcggtttaatgaacattttagtgcaggcatcggttttgatgcggtttacgctaaagccaaaattgagcgttatgccggtgagtcaggcgcgcggctgggggttccggctgatacgcaggttgcccatctgaaaggcgatgagtggggctacggctggaatgctggcatcctgtatgaagtggatgaaaataaccgcttcggctttacctatcgttcagaagtgaaagttgattttgatggcgattacaaaagtaatctctcatcccggctgaatgcggtgaataatccggaagtgtcaggcgtaccttttggcaccaacggcaccaccgttcctggcgcgttaacgctgaatctgccagagatgtgggaagtgtcaggctggcataaagtggccccgcagtgggcggttcactacagcatggcttacaccagctggagccagttccaggagctgaaagccactggctctaacggccagacgctgttctataaagatgaaagcttccacgatgcctaccgcattgcactgggcacaacctattcctacgacaagaactggacgttccgtaccggtattgcgtttgatgacagcccggttccggccgataagcgctctatctccatcccagaccaggatcgtttatggctgagtgccggtacatcctatgcctttaatgatgatgcctcggttgatttaggcatctcttatatgcacggacagaaagtgacggtgaaagaaggtccttatacctttacctctgaaggcaaggcctggctctacggcgcgaactttaactacaagttctgattggatagcacgattaaaaagggcgactctggtgagtcgcccttttttgtggacgtggatcgcttaatggctcagggagcatacgccctgcgcaaagaggcaaaaaccgccatctctggcggcgcatcgcgggcgattactcggcgtcaatatccttaaggtcatcctgaatcgcggctgcgttaggattatcttccggcttgagcttgccgccgcgcgccaggaagtcgtgacgctggaagtaagcgttacggatgaaggcgtacggatcgctctgctgtttcaggattgcatcagagtccagcagctgcgcgcgggtctcaatcccttcaagcgtccatttaccaatcgacattggccaggtcagccagccaagtatcggataaagcgtatcaacgtagtcgccgccatcctgacgcaccgtgaagctgccgtaagcaggcaactcaacgtaaggcccgtagccgacgccatagtgaccgagcgtggtaccgaatcggtgcggctcttcacgcgccagttccggattcgccttaccggcaacgtcaatgaaaccgcccagtcccagcacgctgttcaggaagaaacgggtgaagtgaatacctgcatcacgtccgttaccgatcaggatggcgttgaccatgctggcaggttcttccaggttgccgaggaaattgctcaggccggtacgtgccggcaccggcacataatcacgccaggccacagcgaccggacgcaatacatacggatccagcacgttgtagttaaagttaaacatcgtgcggttaaagccttcgaacggatcgctgcgctgagcaggatcgctattcgccggctttgaactggcacaacctaccagaaggacgctggcgacagccaggctggtcaggcgataattcattccaatctccctgtgcggatgaaaaaggtctacccatcgttcaggtcacagcccggtatcgtatcgacttacccgatgagcatagctgactttgtgccagaggcagcaggcaatggcacgcatcatcctgaacgcggtcagttgatgcgttcagggaagctgctgattaatctctaccgcgatcggctgatgcccatcccagggcgtcactgcgctcaggcccagccagtcacccggccggggattggcgctgccgtcgcgggagatacgcacccggacctcgacctgatgctgcgccgaaagcaggcgatccggcatcatggcgttgctgtcatccagcgtcagcgacagcgggaagtgactgagcggcatccgcttaacagccaccggcatcggtgaagcaccgtcagaaaccgaaatatacaacactccgtcctgcggtaacattttttctgccttaggtgccagcgtcacggtcagtgccagttgacgactctgttgcccggcggcacttctggccttttcgatgctgcgggcgatcatcgcgtgtcgcgaatcaccggccggcaacagacccagcagggtctgccatgcgtcgatagcctgaccatattgctgctgtccgtaagcattaaatgccagcaggctcagcgtacgcaggttttgcggatccgcttttagcaatgcctgcagcagcagtgacgcctgacggttatcctgcgggtcgggggatcgcgtcaggacttcggcataatcctgttttagcgccagatcgttgggagcaagctgtagcgcatgctcaaatgcctggctggccgtatcggtattattcagcaccatgccgagccgtcccagcatcgtccagtcagccagattatccggttccgtttgcaacgcggtacgcaatccgagctgtaaacgcgccagctcctccatgctcagcggtttagcgccagggtccatcagtcgggcacgcagctcaggatacgcctgctgcacctgcttccagcccgtgagctgtgccaggccaccggttttcaggtaagttcccagcgataccccaatcagcacgatcaggcccggcagcaaaatccagcggctgctgctgtgtgatttcatcgtctgtgccggtggaatatccgccagcagtgtctgctgtaactcccgctccatcagcggacgctcagcgacgacgccctgatcttcatcctgtgccagctcatctattcgctgatggtagaagcgctgattaaggcgatcgcgatcgcctgtgctggcctgacgttgccgccagcccgccgccaggaaacagcgtacaggccgccagcagtaacagaaaaagggtgatccaaaatgcactcattacggcttcctgtctgacttcagtagcgcattaagacgctgttgctcatcttcatccagctcactgcgggttttgcgctgacggctgcgcaggataatcaccgcgccgcccagcagcgcaaacagcgccggaccagcccacaaaaccaaagttgagggcgtgaccggtggcgaatagctgacaaagttgccatagcgcgccaccatgtagtcgatgatctgctggcgactctggccctgcttcatcagctgatagactttcagccgcatatcggcggcaatcatggcgtttgagtcggcgatgctgttgttctgacacttcggacagcgcagtgaagcggtcaggtcgcggtattgttcttcctgggccaccgagtcaaattgcagcgtgtcgatgcttgcccacaggttgatgctgaacagcaggccgcacagcagtaacagcgttctcatgatcccgcctccacgctgtatttcacccacaagggtttcacttcctgatcccagacgcgcgcattgagatcgcccgcgtggcgataacggatgatccccttaccgtcgatcagaaaggtttccggcgcgccatagacgccgagatccagtcccagcatgccgttgccatcatagaggctcagcgcgtaggggttgcccagcgtattcagccagttaaccgccttgtgacgatcgtctttgtagttcagcccgacgacgcgtatgccctgctccgccagcgtattaagatactgatgctcggcgcgacaggtcggacaccaggtcgcccagacgttcagcaatatcggtttaccatctgtcagcacgcgctggtcgtaggttttgcctggctgatcgagtgcttccagccggaacagcggcaccggcttgccgattagagcggattcgagacgggtcggatcgtcgccatcggcattacgtgtcagctgccacagcagcgccgctgccagcaacagaaacagcatcaggggaataaacaggattttcttgttcatgtccgctcctcaattcccgcttttttgcgcgaacgataacggggatcaaacaggcagaacagcccacccagcgccatcagcgcgccaccgaaccagatccagcggacaaagggtttgtagtagatgcgcacggcccagccgccatcctccagctcttcgcccagcgccgcatagagatcgcggctgaaacccccatcaatcgccgcttcggtcatcatggtgcgggcggccgtataaaagcgtttctctgcctgcagcgtcgcttcatgtttgccgttgcgcgtgacatcgatgatgcccatgccaccgctgtagttaggcccctgcagattctgcacgccgcggaagacaaagtgatagtgatgaatatcgatgctatcacccgccttcatccgcacatcgcgttccacgctgtactgggtgctgaatgcaataccgatcaccgtcacccctaccccaagatggcccagtaccatgccccagtgactgcgcgacaggtgacgtaaaccggcaaagaacggatgacggtgagtggcgcgctcatgcagttccagcagcgtcagcacgataatccagagtgacatcagcaggccaaccacggtcatcgcctcaatgcgatcctgcagccaccagggaatgatgacggaacaggccagggtcacgatcagcgccagcgccagccgctttgccagcttctgcggctcatcgcgacgccagcgcaccagcggtccgatccccatcagcaaagcaaacggcgccatcagccagctgaacatagtattgaagaacggctcaccgaccgaaatgctgcccaggcccagttgcttgtgcaccagcggcaacaacgtgccgagcagaaccaccagcatcgcggcaatcagcagcacgttattacccagcaaaaacgattcgcgcgaccaggtttcattctgcacccggccacgtacctgcccgcctttaatcgcgtagagcaggagcgaactgccgataacaatcaccagaaacgcgaggataaacatcccgcgtgccggatccgaggcgaaggaatgcaccgacaccagtaccccggatcgcaccaggaacgtccccagcaggctcagcgaaaacgcggtaatcgccagcagcacggtccaggccttaaaggtgcctcgcttttcagtgaccgccagcgagtgcatcagggcggtgcctgccagccacggcataaacgacgcattttcaaccgggtcccagaaccaccagccgccccagcccagttcgtaataggcccaggccgagccaaggacaataccaatcgtcagaaagacccaggccgccgtggtccagggacgcgaccagcgcgcccaggccgtatccagccgtccggccatcagcgaggcgatagcaaaggcaaacgccaccgaaaagccgacatagcccatatagagcagcggcggatggaagatcaggccgatatcctgcagcatcggattcaggtcatgcccgtctatcggaaagtccggcagcgtgcggccaaatggattcgaggtcagcaggataaacagcaggaagccgagattgatcatgcccatgaccgccagcacgcgtgccagcgcatcctgcggcattccgcgactgaatatcgccaccgctaatgtccaggtgctgagcagcaacacccacagcagcagcgatccttcatgcgcgccccaggtggcagcaatgcgatagtaaaccggcagcaggctgttggagtttgtaacgacataggcaacggtgaaatcgttgctgataaaggcccagaccagcagcgcaaaagccgccgcgatgcagataaacagaccgcaggccagcggacgcgccatcgccatcaggcgggcatcctggcgcactgcgccccacagtggatagctgctcagcagtagggagagtcccagtgccaggcagagcagaaaagtaccaatctcgggcatcatgatgatttatttcccgcctgatacagcgactgcgggccggtgtgattactcttcatcgcgtcttcaatctccggcggcgtatatttctcatcatgtttcgccaggacttctttggcgaccacctggttgcccgccgccagcacgccctgtgcgacgacgccctgcccttcacggaacagatccggcaggatgccttcaaaactgacgctgaccacgccgcgggcatcataaagtttgaacgacacggcaagcgtattcggatcgcgccggacgctgccgggcatcaccatgccgccgacgcgcagccgctggcccgcttcgggcttctcgtgcgcctcgcctttgccgtaaaggatttcacctggggtatagaacagatcgatgtttgagcgcagcgcatacatcaccagcgcggtagccaggccgaggccgagcagaatcgccactgccgcatagaggcggttgcgtcgacgggtattcacaatgtctctcctgccgcttcagccgcggcttttttagatttcgctgcccggatgcggcgttcccgcgcgtcgcgctggcggatctcagccagcaggcggcggcgcagcaacagggtatgcagcgtcagcccgacaagcggaatcagcgtgcaggcaactgccagccagacatagaaggcgtagccccccatctcaaagaaggcgtgccaggaggaaaaggcgggtgtcatgcctgctctccccgcttcgccacatcaatcgcccagggacggtgacgtttcggttaacagaatcaggttgcgcagccgcatcagggtcagcgtgataaacaccagcagataaccgatgattgcccagcgcagcggcgttcgcatcactggcgcaatcgcctgctggagaatgcccgacgaaccctgatgcagggtattccaccactgcactgagaagtgaatgatcggcagattaactacgccgaccagaatgagaacacccgcggcccgccctgcggtgcggcggtcatcaaaagcgtgccagagcgcaatcacgcccatatagaggaacagcagcaccagctccgaagtgaggcgcgcatcccagatccaccaggtcccccacatcggcttgccccatgcggatccggtgaccagcgcaataaaggtaaagaccgcgcccaccggtgccatggcggcggaaaccagatcggccattttcatctgccacaccaggccgataaaggcggcgatggccatcgaggcataaatgcccatcgaccacatcgcggcgggcacatgaatgtacatgatgcggaaactgtcgccctgctgatagtcagcgggagcaaatccaaagccccaggcccagcccagcagcaacgccgccagccctgagatggcgaaccacggcaccagtcgccccgaaaactgatagagccgttcgggcctggccagctgatgtaacgctttccacatatcaaatgctcacattaacgataaaagagtgttgccgcgtcttttacgcgcggttatttcaacggctgttattgcaaagtaattcttagcgctgccgccgtggcaaacggggagagcgtggcgctgcccagcagcatcgcgccgagaatcgccagatagccattaatcggcaacccctgactggccgcctccatcgccgcactggcgaagatcaagaccggaatggccagcggcagcaccagcaggctaagcattacgccaccgcgccgtaaacccaccgtgagacctacaccaatggcgccgagaaaactcagggttggcgtgccgagcagcagcgtcagggccatcgcccgccagccattaaaatccagtgacagcagcagcgcggccagcggcgacaggattatcagcggcacgcctgtgaccagccagtgcgccactactttgccgataaccgttaccgggagcggcgtcggcagcagtaccagttgctccagcgaaccgtcgctgaagtcatcgcgaaacagccgctccagcgccagcagcgacgccagcagcgcggcaacccaggctacgcccggtgcaatgcgcgccagctgttgcgggtcaggtccgatgcccagcggaaacagggtaataacaatcaggaaaaaccagagcggattaaccacatccgccccgctgcgaaaggcgatgcgtaattcacgctggatgaggcgaaacagcatcagcctgcctccccgtcgccgaggcgaattttgcgcacccgcgcagcatccgcgggcaaatcctgatgggttgtcaggatcactgcgccaccgttatcggcatgccgggcgaatttcgccattaattttttaacacccgctttgtcgatggcggtcagcggctcgtcgagaatccatatgcgggcctgactgagccatagccgcgccagcgctacccgacgctgctggcccgccgataaccggctaaccggcacctcttcgtcgcccgtgagatcgacgctttccagcgcagcaaagatctgcgcatcactgcaatcaggatggtagaaacgcagattttccagcggtgtaagcacgcctttgacaccgggatgatggcccagatagagcatcgcctgatgccaggcttcgcgctgccgcaggattggctgctgctgccagcgtatttcaccctgttcaggacggctcaggccagccagcaggcgtaagagtgaggtcttaccggcaccattggggccttcaatctgcacaatgtcgcctgcagagacgcgaaatgagagctgccggaacagcgcacgttcgtcgtatgcacaagtgagcgtaatgatttccaacatcgaggggggaatcgcaccagctaaaagtggccgggatattaccacaatgttgctgtgggccgaagtgtgagccaccgctcagtttcgatgccatgggtttattcgtgcggtatcgcccgcagtctgaataaaaatgcagttccgaaaaacgttgttacgcttattcgcatcgatcgttacattatcggcaaataaaaaacggctacgcttattacgcgacagcactatcaccaggagaaaatatgaagccttcatcaggtaatgaacagggtcctaacgacgtcgagagtgaagagaaggataagggcactgacatcgaagtcgatgaggaggctttaccctcccgcgccgccgccatccatgaagagatccgccaggatggggagaaggagctggagcgcgatggtatggcgctgctctggtcagccattgcggcgggcttatccatgggcgcctcgctgatggcgaaggggatatttcaggtgcatctggatggcgtaccaggggcgtttctgcttgaaaacctgggttatacctttggttttgttatcgtcatcatggcgcgccagcagctgtttaccgaaaataccgtcacggcagtcctgccggtgatgcacaaaccaacctggagtaatggcgctctgctattacgtttatggggcatcgtcttgctgggtaacctgatcgggacggcgctgggtgcgctggcgtttaatgagatgccgatatttgacgaagctacccgtcaggcgtttaccaacatcagtatgaaggtaatggaaaatacgcccggcgagatgtttgccaatgcggtgatctccggctggattatcgccaccatggtctggatgttcccctcggcggggggtgccaaactgctggtgattgtgatgatgacctggctggttgcgctgggtgatctggcgcatatcgtggtgggatcggtggaagtgctctatctggtctttaatggcagcatcagctggtatgaattcttctggccgtttgccctgccgacgctgctcggcaacattaccggcggcacgctgatttttgccctgatcagccacgcgcagatccgcaacgacatgagcgaagcggccgtggctaaagccaaggctgagaagaagaagcaggagaaacgtcgccagcgcgaagagcaggaaaaggctgagtaaatccagggcaggcagagcagattgaaccgctctgtctgcctttctggtctgtttgctgaaggcgatttgccaggcgggcgtctgaaaaacgtttactggaagtggctgctgtaaagagggagtgaagatttaagagtcggggtgccgcttcagtctggatgacatcccggacttcagtacagctgtttccgctttctgcacgtaacgttagcgcgtgcagaaaaccggaattgctggcggaatgagcaaacggacggcgacgtagtgaatctcacggcctgtttgcgctatactgcgcgccgctgtcctcttagttaaatggactaaaagaataatcttatcaatccattgattccattcaagaagaacctctaaatcataaaaaaaatgtacactattatgtactcattcattttctgatttgttgctcaaaatccaatgcaccctgtaggaattttattaagattaaaggtaaattgattttgaccgataagtattaccaattagatcccgcatgcaacttgctgtagagtcgcgtgaccttgacaatggacgaagtcaattaatgacaacaacagtttatgacagaatggcaaaagctgtcacaagtgattcaagatggtcatgtagacttgatcacttaggatatgagggtcatatcctttatgtcgacgatgttggattcggaaagcttgctctccgtgaagacacagtcatggtgttagcaggcaacggttatctgattgagttgtggaagaaatggcttctcgtctcagaacttgaccctgaagcagaaatgccaccgactgagattccaggtcagatgccttttgccatttacatcattgagatgtctacgaacgatgttctctttgatgaaggtcacaaacatactattttcgatccagacgcaaatgaggttcttgcagctttctcaggttcaggcagtgcatttgctgctgacaactggattgattcgacgtgtgcaagaacagcaatagactatgctatatgcatggaccctttttcaggcggtactgtaaggtttgttgattttccaagcctaaaaaacgacattgaaaccagcctagaaaccattcaggaagttgtgaacatcatgttagataggggatttattatggacactaaaaagccaggtgctaccccagtatcaatcagtgcgcaggaagtagctgaagtacgtcagttgctcgctaatggcgcgctaaccccatcagcccctgttggaaagggtgctaaaccttgggatgatgcttctaaggaaaagttgaaaaaagctattcagcatattcgtgatgctgaagctaagcgaaaagaagaagcagaagcctaaaaaaaacccggcactcgccgggttttttacgagctcaataagatttcattcgtaggtaactgtaacgtctaaataatcggtcttagtggctcgtaaacggagacaatctcagcggtcaccttccccagcacgatgatcccgtccatgccctctccgtcgattgtctcaccttccaaagtaatgatacccgttcggaacagccttcccagttgcgggaaactcgcctatctggaatgcgaccttatctcccggcactggcttcacagacttgtcagccagcacgaatccgtccggcgtctcaatcaggatcatgttattacggtgaggcatcagtacatcgttcaggtcgatgcggcgctcagtgtagtctgacgctggtgatggaaatcccatagctacctcacgtatcccatgttgcgtaacgaccaggtcttattctcggtctcctcggtaaccagctcgaagaagaaattctggtaacgcctaatccaccggttgcactctgccagcgtccacacgtgattcaggtcatccagccgcttctggaacgccgcagtggtgacaatctgccgccctctgccgtccttcgttatcgctccagtgaacgccgcaagtatgtcactctctctcgccatgataaattctcctctgataaatactgtatagataaacagtaatatcgatcgttagatttgatcaaggcggagcggcgcacagatttgtaaaggggttgatggcgaaggatttttagttggcggacacttcgggtgactactaatctcaaattacacctgcagcccgctgagactggcgcggtacactctgccccgtcgccggggcttttttattctaagcgattgtgggggaagggttattatcatcattttaaaggcttttctattcctgcggctgctcatgagatatgattacccataagcacaggttaacattcaattaatacaagcggagcttttaggtgtccaatcctagtaaaatatttgccctggatggcttacggggtgtggcagcaatcttcgtaatcttttcccacattactcttctgatatgcccataccttcaccttggtgcttcatttgacgcgaacccaaaaagctgggcaacgcatctattcaatagcccttttacctttttctttaagggcacgtcagcggttatgctgttttttgtaatgagtggatttgtgctctcttattcgatgataagaagaggcgcccgtaaaggattcttactccgagcagttataaagcgatacttcagattaaacatccccgttgcatcatctattattttatgtgtgattttgatggggcttggagcgtttccagcaagtctggttggaccgcgatatgatttatacaatgcctataccgcttcattcgaggcgcttacgccagttaaagatgctatttacggctctatatttcttggtaatggcacgttcaattacgttctctggacgattaacatagagttttttggctcaatcatggtttatgcattattggcgttaatgagctcacggttaacgatgctgcggattgtttgccttgtcatttctgtttgtggaattcatagcggcgtgccatttgtatgggggattggtctgtttgcggtgggagtatttctggcgacatttgatgtcgttcataagggggctaccataagaaaggctgggtcatacattctgctaatcgcaggtgtttacctctacgggtttaactcggaaagtgcttcctacgcgctcgtaaatcatgtgcttgattatgcaaacgagaaagggcttcagcttacaaaaggtttcattgtgagcataataggaacgatcatgataatgacctgcttcgtaatcagcatgcagccattaaagtttcttgagcttaggtttttccagtggcttggacgcctgtcattttctgtttatttaatccacactattatattggctattatagctccattggtcataacgcgatttagttttagcctgacatccataatgatttgcgctatcgcggtagtacccataacactcgcagtgtcctgtcttttctcgagatacatagacgaggtagctatcagtaaatcaggtccgatagctaccagcatcttggcaatattcaaaaagaatacagagttaacttagagcgataaggtaagttattgttcaggtgatttggggagtgaaacttttccatcccccttggaaatgtatgctcttaatgcctttctataggatgtccatgttgcaagctcttcccgagcatcctcctctgcagtggaggaataatcttcgtcctcaataatctggttaagagatgttatttttactgaggcgcgatcgtatgatgacgatgcatcctgaatgtttttgttagcctgctcttcaggggttagctggactaccggagccgaaaatgtccatttaccttttgcgtctttctttgccgaataccctggaccaacaatctctccctcgccgatttcataggtttcaaattcctgaaaaatgtcaccctctccattccataacactgcattgacgacaagtccgtctttaatcaaagcgtaagctgacattatgcatactcccaaataataaccacgccattggcgccacttccacctgaaaagccagcccggttaaatgcatatgaaccgccaccacctgctccataaccgaaagcagcatagattggagctccgttgttagctgggcttaaaaccggcaaacccagcatggcggccccgccgatccccggtaatacactccccgtactcagtgcggcaccgttagctgatgcccctccgcgcatattgacaatattgccaccagtagcgatgccacccaatgatccagtcaccgaatatggaggtgttgtttgattctgacccagacctcccgcccctccatttgcgataattgttgaaccaaatgaagatagcccgccatcagtcccgttagttggagccagatttccccctggcccgcccgtgccaacagtgatggatattccacctgagaagccagaagttaatcgagatttagcgtatccacccgctgcaccaccgttaccgatagcaacggtgcctgtgccagcgccaccaatcccgcctgctccgccgcccgcgccctgcacctcaacaactattgatttggttccaggtgtcggcgtgtaggtgccggatgcagtgaatagctggacattcaggagacgtccaggcccaaccaaagtattcattgctgcgagcaactgtgctttgttagttttattgagcgtcaggcccgccgcttctataactcgggcgatttcttcctgaactgcatcaaagaagtccgcgtccagggctgtaggtaattctccggtttgagggttaccgccggtaaagccatttttacccgcgccaaatttatccacctgcgcggtagatgtgtcaatacgatgcatgtttactccgggtatctgaaaataacgtaagtgtgtgagggggccagcttgttaaggacgcactccgcaacggtgtcaccccacattctcaggctgtccgtacagttgctgatggccgtcatcggcgttatctgcgtgtaggcgggcatattcacctgccagtagtagcgccattcatcgctgtaaagtgagtcggtgcaaacggacaggcagttaaactggcttttgttgtagcgggtgatagtgacgcccgtgtaacccagcgcctcaagctgggccaagtagaacgcctcattgatgccgcccgccagatttatcttcgcatccaaccgctggcgtctctgctgcagggtctgcacgcctgcaggtgcgcagctgtccggcagcccactgatgctttcataacggtcaatcagctctgtcactgatcgtgggtcagtctccagcatgagcgaatcgccgcggctgtgtactgcagaaagtgaaggtgccataccggtcagtagcaggtcgtcactgtcccacgccgggccacgcggcagcagagcgccaagcatctgccggtactgcgccgttaagtccatgagattgcccccaccacacccaactcgcctttcccgatggtgatatcagcaacagggctgaccagcgtatgactgtactcacccgttgcgatgctaatagcttcgctgatgcgggacggcttcagcacgttttcaggaccgccatcgcgcagcatcattgagcgcaactcagcctctacggcatagcgcactgctgcggtgttcgggttgagtcgaatctggaaattaacgatgtgaggcgtgggagcaaaaacgtagatatcggctccggccaccggtgcaagcggttcgatgtatgcctttacagctgcgacggtagcagcgtcagggatcggattaatgaggtcgctgttcgccaccataacgcctaccgttccccgaccgctccagtgcctgtatgtccatgcgcgtgttacgccagccacttctttagcccagacttcataatcaccgtcagcgccgccctgcggggtccagtaccaccgctcaatgacgcgggcacgccagacttctaaatcttcaatgtcagcgccaccctgaatgctgtccgccacaccagctgaggtcagtccggtaatcgggctaaccaggcgcattgccagcccgtcatcagtgttacctgctttacctgccgtatcgcagacaactggcacgcgcagaaacgccacccgccgaggtcgctttagctgtcgtggtgaatgaaacgagatcatcacgctgaattgtgacaccggcaggaacagggatgccgctcgttgccacgtcccagcgcacataaccggttgctgctgtagccgcttttcgcgggcatctcttcatgttggcgtggcgtgtcagccagtcctcatccgcaaggtccggcaaaaggttgcgcgccagatagtcgatgtagccatacacggtatgcaccgccgccgcctggacccgtccataaacttctgcatcggtacggcgcaatgcggccagtgtggtatctgcagccaagcgggtgagaatatcgttgcggacggtggtgattaactgagggagtgtcgggcgggtaaatccactgtcagccattaagttcactccataaatcgtcaaaggaaaatgccgtgcggttaccgtctttctggctgataactactgaagcactgagtgtattaatcccggtccgctcggccttcacgtccacccgaaccgcaacgccgtcatccaccagccactgaagcgcctggctaatatattcgcgggctttgagcggcgttttattggtgagcgtctgccgactgagaagatatagacgtgagccgatgcggtcattttgcacggtcgggaagctgtcaccccaccagccgttttcctgttccgggctgtcgtcaggctcagcctttcgccaggagaacagtgagataattaccgcgcgtgtaagaggatcgggcggccacgtcacgtcacgcggcactccattaattacaataatcatgacgccaccattttctgcgtgggcgcgtcggtagtgccgccgcccgatccgttctctttatgtgtgtgaccgttataggagacgcgcatggctgacatggtcaggccggaagaatcacacttatctttgatctcgcctgtcgattcgatgtccatttcgaaccgggcttttggcgcattggtaaacgtgattggcttgcctgcgccattaacaactatcccagcacgggtcagcgtgaccgactgtccctgatcgtcatataccgccacttcaccaagcttcagacctttaatgcggtaacgccggtcagagacaaccagcactaccccgtgtgacctgtcaccgtcaaagtaagcggccacggcctcagccccgatgagcggcgcagccgtaaatccgtaaggctccatatgctcaatatcgcttttgccctcgccacccgccatttcaacctgcagcatctggcatttcgttgctgtattcagtccgcgaacgacagcacgcgccaataggttcgacaacgcacgccccatacctgaaatcgggttagccatcagaaatcatcctcttctttctttttctgccgcttgccgggtttcgccggctcaggaagataagcatcaggcggcccgacgcggatttcggtcacggtgccgttttcatcctgttggtaggtcacctcagcgatcaccatctgacggttgttaaaacccagaacgggatcaaagacgatcacctgcaggtttggcagccagagtgagccgtcaccctgccgccagccctgtacggtataggtcacctcatcggtgcgtgcagcacgctggcgcatctcaaattctgcgcgtgcgctgcaggttgccgtggtggcgttgccggtctggcggataatcatcgggcggtagcgcttcaggccgccatcgatggtctttgagcggatagccgtagttgtggcctcgccaaagtcgtcgtcgttacccttgcgctgaccggacacctgatagtcgctgaaccggtcccggatgctcttttccgtgtcgcaggaaagaatattttcacccagcaccagtgcggtgtgtgcctgctgactgccgatgccgccgattaccagattgccctgcgcgttgtcatatgccagcgcctgctgcagtccgagcattttgttcagtacgtccatgaccgtttcaccctggtcggcctgaattccctgaagtgcaccggatgcgccgcccgcatccaccaccataatgctgaacggcttcgccagctctgcagccacctgcgccagagaaacgcccggcatactgtgacggcgtggctgagcaatcgataaggtcagccgttttgctgcgccctgaaatcccggtgctgatgctacgtgcgtcgtaccggaccggcgtagcctcaacgtagccggtcagcaccttatcggtgcctatcagcacctcaaccagatcgccgtttttaatgcgggtactgcgcaccgcctgatcggtatcgccgggccagctgcgggtaatctcaacggcgaagtcgcgggcaatacgctcaatccctgcggcgatcctgaccgaagtccagcctccccactcctgaccgttcacacgtaaaataactgtgttgttcatcgtaccggcaccctcagtgactgaaccggcacgaagccgggatggcgaatgccgttacgagcggtgatgtcaccggcacgggatgcagagtcgtaccagtcggcggccagcaccagcgcgggcataacctgcgaaggtgtgcgctccgtcatgcgctcgacctgctccagccgtgcagagatatcgcggttaacgtctgtacgcacggtgaccagcgcctgataaaggccgtcatctgaaacgcgctccatctcaaggtcaatcgcttcattaaggctgtcgcgaacctgtgcaaggtcatcccatgaaattacggtgccgttatccagagaggtggtaacgccggaagaagcagaaacggccgctgtcgctgtggtgcctgaatcagaagccgcattaccggaatcaggccgtatgttgctgacggcaggatgtgataccacgactggctgctgcgagtcctgctggcgcgtaatggtacgatttgcaggctgcggcaggctggtaaccgttgcggccgcctcgctaatggccgtggtgcgtaccgcctgcgcaacgtaattgcgctgcgtggtctgcgcctgtgctgtcttgctttcggttttccagacgccgcgcggagccagaccggaatcaaccgtgacaccggtcagccctttaatcatcgacatcagatcggaagcgttaccattaaggcgagaaacctgcccgccacatgatctgaagccggttaacaaaattcataccgctggacggcgggcttagcagcaccgacaaatcaccctgcatcagacgtgatgcggcgctgataccagaatcaacatactgaaaggcactggttacggtattgaacataccggttgcctcatccagcacaccgtcctgcaggaagtcaggcatgccatccataccaaaggcaccgaatgccgatgaaattgcatcgtccaggaatgaaactgacgatgtgagtttctgtccggttgccagtccagcggtgggaaacgataattcaccggactcaacgaagctgaagctgacgcggcacatacgcccttcgctctgtgaatggctgacgcgaacggcatcatctactaccacggtcatctcgccgtagtaaggatgaaccagcgtgcatgatcccggcttttcaatggcttgaatcaggcggttacgctgctcaaagaaatcatcgccaatcagataagcctgaacgctgaagcggcgcgtcgcgcggcccaaatcttccgcccacggtttgtcgcgattggggtactcatgcacctgcacgcgacgcccaaaggttgcttcgtcgctgtccaccttaaacgcgatgccacgcagtgaggcatcctgcagattatctttccaggtcatggcttactccgggcataaaaaaacccgccggagcgggttggtgtttatttcaggtgtatctgtatcgaataggagtcgccagttctaacgaataaagaatcagctttttgatcgtaagactcaaaccgctgaacactcttaagcttctccagcttatttccgaaaattgtaatgctggttcctgtcagatattcaaaagccttaccagccagcgcaacgttaacctgattcatcgacttatcttcgtttgcgaagaagtgaatttttaccctgttagggcatggcggctcataaacggtaatgtaaagttgaggttcatactcagctttgatgttatcaccgaacgcctcttcatccgtctgatcctttcggaatgaatactgatgccttagcgtgccgccatctttgaacacttgcaccttctcaggttttttcccgattgccttaatgaaatctttctcattaaaagcggggtaacactcactggcagataccccactgacaaaaaataatgccattaaaagcggaaaaaaacgcatgaaggctactcctcaattcgaattagaaaaccgattataacccacatcaagatcaaaccatggaagagcgccacctactggctcaacgcgcattccgggaggagcgttttcgaaagaaactttaagctctcccttttgtgatgttgcatcgtcacgcattaatggaccgctcatgctttccggatttagcggaacgctaccacccttcaactgctgctcattgttataccagccgccagccttccacctcttcttaagtgactcccagaatgattccgtgccatctttctgggtagtcgcatcagagatttcttccagctttttaaacatgtaaagtgcgaccgctattgaaaccgtcagagcgctcaactttcctattttggtaagaacagcgagtagcccacttgctttagttgtggctgtggtgagcgatccaataacctgaagcgtgaataacccggccatcaccccaccaatcccggtgatgattccgttcatgccacccagcgcctctgccaggccgtcgattttagtccagactttctctacaacaggaccgaacttatcccaatcagaaatcaagagaccaattcccagcgctgcaagtctaaggaatatgcccatcggagaaagcttcagtccctgccccagaatacccagcgcaaagttaattcccagcagccccaacttcattccgacaaaaccggctgcgatgccaaatgcacctcgaataaccttcgggtttttgtcagcaaactcagtaaagcgctctgacatgtcacccagccagcccaccagccttttagcatcaccagcaaaagccccgccgattgccgcaagaccattgaccgctgtaccggtcaatgactcccagatattggaaagtgtgcttagctgagcattaacacgcttattaaggtccgcctgctttcccattttctcctgaatctggtcatagccggttttacctttatcgattagcgcatttaacacctgaagtgtttccgcatcatcgccaaatatctgtttgatgatggtggtcttttgcttggtagttaatgactgaagcttattcagttgcttgaaaagattatccaagccgccgaactcacccttgccatcggtaaaatctaactgaataccttttcgacttagcagcttgttggctgccttcatctttttaccatcaaagcccgcctggaatacttttcggagggcgttaccggaagcctccccctccatccccatctgatccatcatcactgaaatgggggccaaagcacgagccgctgtgaggccatctttgctaaccatcttcagaattgagctggtcttagaaaagaaagagagcatgttggtatcatcgacgcccaggtaaaaagctttttggatcgtgtcgaataatcccatcatgtcttctgaagccgtgccggtagcatcctgcatttttgcagcaaattctgccgcggcttcaggtgttttctttagctgaaccgccagataagcggaagcctcaccaacaccactcaggatgttctgagccggaataccctgcctgacaagcatctgcatcatgttctggaaatcagcagtagtgccgggcagtttattacccaggccaatggccagcttattaattttttcgaagtcagagccaaccgcgccgctggcgtccatcatggcaactttcaggcctgtcgcggcgtcttcctgtttggcaaaggcaaccagcgaacctgtcagcccggcagcaagaccgccggccatagccatgccgcccctgcccgcttcctctgcatctttacggaaccggcgcaggttcttttgcatgcggccaagcgcaggcgaaagtctgtcaacgccggtaatgagcgccttcagttcaaattcagccattggcttttcgctcccgttctatccggttcgcctggtcgataagcaattgcaggctttttaagtcctcgctcaggacttccagaggatttatgcgccaataactggcgcaatcgaagtacagattaagcagctctttagctgtcaggcctgaaggaaaaaaccggcaactacccagccagcagcattcaggtctgatggcgacatgtcatcaactgagctgggtggaatgccgcccagctggctgatgtatttagcgacgacatgagccagcagcttcactgactcatcctgattcatctgatacggatagcccagctcacgcacatccttaccggttggatcgcgtagttccagcacatgaatagtctcaccatgtgccgtaataggttttgaaagctgaagttcactcactggaagaatccttctgtgccgtggaattcgaggtcaaccgtaccctcttccgggttgtaattggcctcaccaaacagaaaagcttcagacagcacgtacaccatgccgttagccatttccgaagtaatggtcatttggtctgagtcagtcagtttgctgatcgggaagtttttaggcactttaaaagtgccttttgtgtacggcgctcggtgcgtctctttgtaatccacgtcaccggccaggccgatcacgtcatcacgcaccttggtgttcatcggcacctcaatgccgccggtcagcgacaactgctggccatccaccttgaaatacgttgtacccgcaatctttgccattacgcggtctcctcgctgtattgcagacggaactgattaagcagcgcaaagacgcgcagctggttgacgtaatccggtgggaacagtacatccacgcgagtcgggtcgctgacgttgcgctctaccaccagatgctgcttgaagagttcgaagttctccacgatccccgcccgttccatcgtgcgatagctggcgcacatctcacccttcagcactgcaggcgtcacaatggcctgccccggaccgaagcgcgttccgtcattcgccagcttatgacgcggatacttgctggtaatgatgcttttcagctgacggataacgtaggcgctggtatgcagcgtctcgctgtccaggtagctgttatccgccacgccataggcgtttttctgataggtagtaatgtcgcgctgaatgcgcagcacaccgctctcagcgtaagccgtagcgataccgtgcttcagaagcgactgctgctcggtcagggtaaagcggcttcctgccggtgccggtaatgcgccggtcagctcaccggtctgcgtagggcgggccgggtcagtgcggataaacacggcgttgcgtgcggtgcgcagtgcgaccagctcatcagcagcggtctgaacggcaggctcataaccggctacggtaatgtgctggttgttcatggtgtcgccaaatgcaaccaggtctgacagcgtgccgattttcgccgtgtaaacatgaccgtaaagcccacgtgcatagccccagcgaccggaagaatcgttcatctccagcgccagtgtcgccagggaggcggaatcactgaacggcgtgccgatgaagtcaaacggctcatcgcccatcgcggccacggtcgcagccagtgacggtgaacccgtaccgcccgccatggcggcaatcgcaacgttaacgccgtcaggtgtggtttcacttcccacggtgccgtggtagttcagcgccagaggaatgctgttgccggtaatgcctttgtgacgtgcagtaagtgtcacggctccagccgcagcagcggcgatcaccggcaggtcggcgctgccgttaatggcagcggccagcgttgcagccacggctgcaggagcgtcgccggtcactacagcggcctgaacacgatctgcgccgatatacaggctgagtgaacctgatgcctgcgcattgccggtcagcgtcacggtgcctttggcagtttcgccttccggctcggttaccgcgataacccacagctcaccaaatggatcaacagcacgataacgcgccaccatgcgggccagctggctgccacgccctgcaaccttacccgcaagcgccgctgacggcatgatggtcagtttgtttttaacgatggtgctgtcggctgaagcgaggccgatcagcagtgacgggccgatgctctgcgtggtattcgcttcgctgttgtccatctccgcccagaacagcggcacacggaggtctgacggaatagtggggaacgataacgacattattcaccgccctttttcttggcgtcagcggcgggcttttcttcttccgcgctgacttcttcgacatcaccatccgcaatgcggcggtgccagtagctgctctcttcgacgttccggccttctgaaggcagcagatcgccccggacagggtcaggaactgaccgtccgcgcttgggtctgagttgcatgatttactcgctgaggttgattttggtgtggtgttcgataatgccgtcaggaccattgcccggattgatgtagtcaacgtcgatttcgaccgttttcagctcgtccagggcgtcgagatcatcctgctgacgcgtgtcctcttcggtgatttcccgcgtcagcatgaattcaaactggtaataaaggcggccccggtccatatccagaagctgaccgccggaatacgccaccggccctgcgtctggatcaggctcccagcccagcagcgccttccagatttgctgccgcacgtcatgcacggcgtcataccctgccgcctgaccgcgctcgtcgcgcgtattgtccagcaccacgacaaccgcaaagccttcagttacgttctgccagtagtcagtcagggacttctgctcagcggtgacttcttcggtcggcaccacatacgccgcaggcagcttcatcttcccggtttcggggatagacttaaattcagccgccccggctacgttgcccgcgaacatcggacatcgcgcccggagagcggcgatcaccagtgatagcttcatttctttttcctttcaggacgcagggaggtacgcagcgcacgggtcagcacatagcgcgtccacgttttgcgcgcctcaagcacttcggtcatgtagtttttacgcggagcaacgcgccagccattaccgccggatttccctttgtgatggctctttttgcgcttagacccacgcttcacgccgtagaacagaaacgccgggtaaaagtcaccctcgataaggcggttaccctcaccacgcttctggtttggcgcaatgcgcaccatcaagcccggacggctttttgatgcgcggggaacgtaatagccaatggaccgcgccagcctgccgcttctgaatcccggatactcatccggcgcagagcgaccgcgacgcataaccagacggcgggcatcgcgcatatgcacctgaccaatctgaataaaggcgcggcgcatttttgcacggttaaaagtgaggtcttttggctgctgaaaatcaacgtgcagaagcggcttagccatacatctctccgtcgctttccacagccctcagctcctcgcactccatcagcaggtaacgaccggcagagttgaggtcgcgaaggcgcttgacgcgatacacataaccatcgtaaaccacctcaaaatctgacgtgatgccacgacggtaacggatggtcatgtagtgggttatggtgtcatcagcctgaacagattcgtgataggtagtggcacccacctgccggactttcgcccacacgtccttttcattctgatagaccggctctgtgccgtagtccgccgccgcctggtcgatgcgctggcgcaggtgaatgcgcttatttagctcaccgggatcgggcagcgtgtaaacagcgctggtatttgatgagcgtcgctgcatgctaataccccgacaccggcagacgccgcgaatagagcaggaaactcaaacgcctgcggcgtctccgtcatctccagctctgacactgaactgcgatgctcataccagtgactgaccagcatcagcagcgcaaggcggatatcttcggttatcaccatgccgtccgtatcaagaggcgcaacgtctgccaccgttttataaagattgcgattgaggtaagtcaccgcctttgcctcggctgccagcgcaaaaagctcaagcagccgatcctcttccgtgaagtcgctatcaagacggcactgctgttttatttcttcaagtgtcagcagcatgacaacgccttattttttggctttttccttcgcctcagctgccgctttcgcgctggcttcagcatccgctttttcctgcgcttcagcagcggcctttgctttggcctcttcttcagccttcgctaacgcttcagcttcggcttttttcttcgcctcagctgccgctttctccgctgcactgtcatccacctcactggcatagcccagcttaatcagctcacgaccatgctgctcggtggtctcaatggtgttaccttcagaaacgactgtaccgccaaaatagtttggtttaatcagaagcagtttcatgcttttctccttcaaagcggctcgaaagccgcccggtgacgtttagcttgctgccggcactgtaaagctgccgtagatgaatgcttcagggcgtttgacagccagcgccagacgctcttcacagcggattgagatcatgttcttctcaaagtcgtctgagttttcggtggaaatgaccacgttggcatcttcgcgatcaaacaactgcgccgcagcattaaacgcacccgttaggaatttaccctggaacgctgctgtttcagtggccacgacaggcaggccccacagagtcggaccggtcagcgcggaagggttagccaggatgtaacggcccagcgtatctttggtcagctcgatcttcgcccaatcaatgaagtgaagaacgtggccagatgccgggaaccgtgccagctgcgcctgcagcattgccagacgcagatcatcaatgccgttctgcttttcaactgcaaatgcagcagcaaatttggacgcctgcggcacgatgcctttcaggtgcgcaccggtgccatcgccaaacagaatctcctgctcttcgacatacttcaggccgtagcgcatctctgcatcaatagtcgattgcaactgagcgaaatcatccagaatctgcttggatgctttgaacatgtgcgcgatcgtagtgaccggcgtaatctgagtcgcaaacgttatatcgctgtaaggcttagcagtaccttctgccacagctttggcggcattggtaaagccggtctgctgaacccagaaaattgcaggtgaagatgtgcggcccggcgcaatcagatcgcggataaacaggcgctgtttgggcgcagtgtcgataccgggaatgcgctgaggttcaactacgccggttgccacgtcagttgacagcagcgctgcattaacaggaacgctgacacgcttaccaccttcaacgctggccgagaacgctttaagcgcttcgctgctgatcacggtctggcctacggtttcgatggtctttttcgcgttagccaggggcatctgcgcaacgtgctgctccagctcgcccactgatgccttgagagctttgttcgcttcattcagcgcattgaactcagtcgcgattttgtctaccgcttccttggtctgcgctgacagttgaccagagtttcttagcttctttcagtgcgtcttcagctttctgactgaaggtgccggacacctcttccagctttgcagatacttttttcagtaactcatttacatctgacatggtgattccttattagccgaacgcggccagcgcgtttttaagttgagcaatattttcggggttgatttcgtcggtagcgcccggcataccttcaggggtggcagcagcgcctgacttgctgccagttaatgctttgagaagttttcgacgctcagagcgaggagcatcggtttttgccagcatcgcgtccagcttgcgcagcgcagctgcagggctgtcatcgtcatcagcaatctcatctgccgccagcaggcgatcggcaaaacctttttcaaccgcatcactgccgccgatataggtttccgcattcatcattgcctcaatggcttcggcgtccagacctgttcgcgcgccataaatatcgttcatggccttatcgaagggctccatgtcagaagccacctgtgcaagatcgtgacggtttcctaccgcgtacacccagcagttatgaatcatgatgaaagcgccgcggccaatctgaacctcgtccccagccatcgcgataatggaggcagcagaagcagccaggcccagcaccttaacagtgactttcccttcgtactcacggagcaggttgtaaatcgccaggccttcaaacatgtcaccgcccggcgaattgatgttcaccgtcacgtcagcaccaccaatggcacgcagcgctgccgcgatgcggctggcggtaacgccatcgccgtaccagtcagcgccaatcacatcgaaaacagagatgctgttgtcatcactttttgcggctttaatgccgccgttccagcgctccatggcagatgacggcatatcgcgtttttcgcgcgcagaaggccgcccctccggcgctcgcggaaggcttttcagggtcattgattaatcctgtgtgtcggagggtgatggcacctgagtgccagaagtgttttgcggcgtcactgagcgatccgggaaaagccagctttcaagcgctgcccttgccttctctccgcccgagtcgccatctttacccagcatttcaagcggcgtgaggttaagctggacggtatagatatcacctccatcaatcggaggaagattctccaggcggcgcacgtcattgcgcgacatccatccgttttgcaacgcggtggtgtaataagctgagcgtccagcgctgtcagcacgcagcaggccttcaacggcaaattctgcaaagtaatcttcatcgccattgagaagacagcgtgagatttcctgctcaatatttatcagctgaggtcgcagggtgttggttaggaactgcatattcatcccttcaacacttgacgaccagctgctctgtttcgtcgtgtgtccgaccataaaaggcggaacgcggaaccagcgacagatttcttcaatactgaacgagcgtgactcaagcatctgagccgcttcagggtccatggtgatgccgttaaatttcagatcgttttcaaggatcatcatttttccggcgtttttcgagccctgaaacattgtcaggttgtcccgcagacgtttgcgctgctccggcgtcagggttttatcagttgaaaagaagccagcagactgaatgccgttgtcaaaaatttttccggcagcctgttctaccgccattgctgagccaaaaacttcacgaccggtcataattggcatcagaccacagactccatcaagcccgaagccacgtatgtgcatcatgcttttaaccgggatgatgcgtttaacgccattctcggtgtaggtgtactgaagttcgccactgtccaggcgcttaaccaccatgcactgaggcaggagtgggatgagggaaaccagcttattccctatcattttcttttcaacgaaagcatttccgcgaaggcagatgctcgctaccaccataagcataaagcgtgatggcgtcatttcgctgttcgggcgacggcataaaacctgataagcggggtgatccttcgccagctttctggagccatcggactcgcgcagataaaccttcatcggcagagttgaaactgactcgcttaacaggcgaacacaggcccatgcagctgacaggccgattgctttttctgctgtcactgtttgtccgctgctacttttaccaagccagtcagcgaaaaactctccggttgtgaggcttattggtacgcccagccagttgagtaatgcgcttttcacccggccaggctgcttattttccttcatcagatacctaccatgatcgggtcatcaaaaaagtcatcaggattaccgctctccaccagcaccgcatcctctgctgcaccgattgccatagcggaagccaccacgccatcaatacggccggtgcttttctttttggcaaatatgcggttgtccttctggtcagcctcgagcaccgcagaggctgcattccagcgcaggcagggattaggccggatgatgagcacccggttattcaggtgctcttcgaaaagctcaattgatcgtggcatccacagcccggactcctgcgccttgtaaaagccctgaccatgcggaacaaggtcaacgctcacagactcgctttcgagttcaggctccagatacttgatgcggtactggtcaaacgcgatgcactttatatcgtatctggccgccagctcaccgatgcgcaccgccacaaaaccgtagttgaccgccttacccggcggcgcgtgaataaagccgttacgcagccaggcgtcataggggacgtggtcagttttcgcccgctcaagcaaagaatctttcggcgtccagaactcaaccaaaagctttttagattttggaaagtaaagcgccagcgccgtcaggtcacgggagccggacaggtccaaaccgccataacactcttcacccgctaaatcctccgggtcaaaatcctgttcgcagttcatccaggtgtcgctgtcaatccacggatcggacgcttctacccactggcagaagttcaggcggcgaacgatgctctcttttgacggcatgccgcgcgcctgtgtcacctgctctcgcaggtacttatccgtgaaggtctgacccagagacggattagctttgccccagcaggtttcatccttaaacgggtcgtcaccctcatccagtgaacagatgaagctgaaaaaactgtcatcaaccaggtcaccggcagcaaccttgcgcccgtactcgtgatactcataacaaacgctggttttatcgtggccgctgttggtgatcaggaacatcagcgcctgacggcggccttttgtaccggcacgcatcatctccacaacggcatttgttttgtgctcatgcacttcgtcaatcagtgcgccgtgcggacgcggccctgactgaccatcatcggaactgatcggcttgaagaatgagcccgtctgcaggaaacgcaaggttccacacgttcaggccggtgccggatttggtaatgcgctgtgccagcgcgggcgactgatcgaccatcgtcaccgcatcgcggaacaggatcatcgcctggtctttttttgttgccgccgcgtaaacttccgcgcggggctctttgtctgccatcagcaggtaaagaccaactccgcccgccagtggcgatttacccgagcccttaccggactcgatatagctcatgcgaaagcgtcgcgttccgtcttctgccttccagccgaacagggagccaacaatgaaacactgccacggcagcaggatgaaaggtttaccctcatgctcaccgccattcagcttcagaacctgagcaaaaaagttaataacgcgcgttacagcttccacatcccagaacagaccacgccccggaccctcttccagatcgcgaaggtgacgggcgcatgccgcgcggatgtctggtccggcaataaccgcaccgctggtaacgtccattgcatactgcgttgccgggtcaaccgaagaactggttgagcgggtcttcttctttttctccaccattcacgttcacctttgaccgggcagccggtgtcaggccgaactctaccaggtagcttttaaatcgccggtctgcatcagccagcattgaaacagccgggttggctttaatcagaaatccgccttcggtctggaccgtgtaggttctgccctcttcagcaattgtgatccgaagctgaagaatgtcggcgtaaatatcacagagcctttccagcgccagcacatcggcaacggtcagcacgcccatcccgtcgagcaggacagtcagctttccccacgcaacctttccccaatcagtgaggtgtgacggcgggctggggatttctctcgcaggtgcaggctctttgtcgttgagttttcgcttacccggattgccggtaacgaccttaaggtgggtcggttttggtcgtcttccggccataaaaacctcccagaaaaaaacttttcatttcgcggttgtgcataaaaaggggggcgggcggtcaggaggtcgctaccccctgaactctgctcccgccctccccgatggtgatgataatcgttctcatctggcctgatgacccacctgaacacaatgataaatgatattcattctcatttgtgccaatgggatgacgggtcgagcggcatgccgtttctcatcgcatccgatgacgtgaccgcgcttctcttcacgctgtttggtcgagtcgtgatgctgcttgcagaggggttgccagttggccttgtcccagaagagcttctgagctttcgctatctcgtcctgtttgccaccattaatcgcttccttcagtcgatgtggcttgatgtggtcaacgaccgaagctgcgactgctctgccctggcgatggcacatgacgcagagaggatgagatttaaggaaggataaccgtgacttttcccaccggctggaatagattcgtgggttattcatctctaaccacctgatgatttaaaattttggaaagtgttttaattaactcatttatgtcttctatttttacaacggtggaacatatgcaaagctcaataggtagaaggttagaacattctttccaaagttttatttcaaaggattatgagagtgctttagttcattttttccctgctttagataaaaccgccaaaatcagaagaccaaaagaaggcgtcggatcaaggataaaatcttttctttcagacgaagaagaatttatctccttcgtcgctataggtgcattaatgaaaaactgcgctgctttcggagtgactttcccaacagcaatttataagtttggccgaacgtcagttatgcatgaaggggagctagatccccgcctgcaaattaccactggttcaaccttgagtattggtgaggtttggtcattgcctgaatcttatattagcgccatgataattgccgtaatggcagcaaaagaaaacgcaaatgagcgatttgagcgcaacggtttggtaaatattcatggtgtagaattcaacacgtctgatatttggggaaataaaaatctcatcaaaagtaaaacaaatatgccagacttatgagttcacattaaataaatcttacctacagtatttcattatcaggcgcactcgcaaatgcgccttgtgatgaactcagcaatctgagtctggacgggctacagcacgacacgcagccatgcaggcacgctgcatatccttatgtgcttcccgcaaccattcatgcgcttcccagttttcctgtgaattctgtaggcttgggtcgctctgcatatcgttacgatgctccatcaacagagcaataaactggcggctcaggtctttgaactgattcatcttgccgatttcgccataagagagcgttcgatagcccttaacggtgctgccgtcctgcggttttgcttcgctcatgtatttacctatctggttgactcgattttacgaatggcggcgcgatcaatgttgcattgccccagagcgccatataactcagcgttgaggcttacgctgtcaccgaacgtcatatcctgtgatggcgctggcacgtcaatctggctggtaagctcagccgggaggtttagctgaggttgttttactgtccggtactccaccagcggcttttgctgcgtcacgcaaccggtcagcagcatcagggggaacaggagcaacagcacacttatccgccgcaaggtaacgcttaatttcattctgtagtttccggttctgctgggctgttacggcacgctgctctgtgacctgactcattacatcgttttgctgcttaacggctgttaccagctcagtgacacttgatgccaggccatcgttcttggagcgcagatcgttaatctgctcgtctttgctgtttgccagcttctcaagcctgtcgttcgttgctttcagctgtgagttactggcgtttagtccccacagcgcgacgcagataagaccaatgatgaccaggcctgaattgtttcggataaagccgattacgttgaacatagaatccccttagattttgataagcgggatttccggtcgtccagaccattggtgccaccgttaatgattctggtgatgcggataacatcatcagaatcagccagctcgtttaatccgtgattcttccaccatgccgccgcagacattgcagcaaatcgatagcccagcaataaatcagggtttgccactacatcagcgcccagctgtttcaccagtgcctcatagttcgctttgccggtaatctgaatcagtccccgaccgcgatagcggtaaccatcacctgaatcaacatcaccattaccgttaaggtttgcgtaaatgatgctggcgatcatcttctgattagccacatgcatcgcattacgaccataggcgcgggcctgtttctgcagtgatgcgcttaccaaacattgcggtcagcgcgttctcgctgtagttcagcccctcttccaccttcaggaacccggctgactcatgccctgtctgtgccagaaagtgagcctgccgtaagggcgtgcttatctggaaggctgagaggcttgccgctatatggggataccatgcatcacgcagcgcattactcacgccggtcgcaagctgaaaactattggctgtcagcattactgtctcccaatcgcttatctatctggcggcgtatcttcgtagacacgtagtccacaccgaggaagccaaggaagaccgcagcaacccgcgtaatgtcttcactgaaatgccagttgaacaccgaaccgattacctgaagacttggctgcaggaagaaggcgaagacgctgcacatcgctgcatcaagcagacggcgtgaccatgcgtctttaccaacgtaagttgctctcagaatcgccatgactccggcaagacccgcatagccggtttcgtttttgtgggcgtaaagccaggcaatcaggcttgcccagaacccaacgtctttgtccggcatgcgtttcatcctcacctccgttaattggcaggtgctgtcagtagtcagaagaaaaatgcgcaacaccacggcgtcagaagtgtgtgtggagactgattggtgtgcgcaaaaacgaaaaaaggccgctctgtggcgacctctttgtgtgggaaccctgacgcgaaagcggtaaaagccttgcccgtcggcaacagggttaattcttttatcccataaaggggataatgttttcgccatcccttgcaggggataaggcaataaaaaagccccatcagctggtgaggctgcggggctttcggacatccacttaatatgcaactgacccgctaaaggcgaaccagataaatctttttagtgcggaagactcataaaattcccactatgaggagatattaatccattcccggacaaaagcaacagttatctttggctggggaatctttcatttcctgttattttctgaaaggtctggtcagcgtgagactcttcctgctctaacttagccaccagcgcatcaaagaacggccgccagttgcggttccacgtcctttcctgcaggtcagggatgagtacgctgatcgccctgaaggcctttgtacccggtgaacgggtaaatcccctgccaccgcagcgctcacaattcttttcgacaatggtgttggtgagcctggacttttcaatgtcacgcacacggcctgtaccattgcaccggcatcgctctgtcacggctcccttgccgtgacatgtcacgcacatcttttccagcgtctccagccggtattttggcggaacgtaattatcgttgtcaggtgttgaacagccaggatggatcataacgtgttcaatgctgttggtgatgccacgaccgtcacagtcagggcatgagtgggtgcttgatgctgagcggacataatcttcatatgccagcttggacaggactcttatacacgatggcagctttgacccagcggctttaagaacgagttttggggtaatgcgtcgtgcatggaccatcagcaggccgattacacgatccttatcttcttcactgacgccggacttagccagaaacggcggcaattcccattggtgactttgactgacacatcccgatagcggccatcaggtctgtacctgtaagcccttcactgcccgttgcacgggaagagtcactgatctgcagactcttcggattgaaatgcttcagcgccgattctattttcatgctcaccttctccacacactttattttttatctgtcccaataacgccgactgcaatcgcgaaatccaggaacctgaatagcagctcaacctgactgccgtatttcgactcaaaaagttttgggtcgcgatgtaactcgtcgtgatgcgccctgcaaagcggtatcacgaataaatcatgggcctttgtccccattcccccctgaccgtgcccgatgatgtgatgaggatcgtccgcctgtctgccgcaacaagcgcagctctgtgacttaacccatcgtgtgtacttctcactctcccagcgcttacgcttggggcgcttcatgaatgattctggtgattccgggtccgcacggaggctgattatctttttgacgacctgtgcagcatcctgaattacctcgcgtgccggacgcgccggaataattctggcctctttgagttcgccagcctgaataacctcttttggcatacgcagaacgcgcctggccggtgcctccggtatgagatcaatcaggtcattcagtgaggcccaccaacacagttccggtaatgtcagctggtggtaaccgctgagcgccatctggctgcatgcagccctgattatccagagggcggtattgcctttggcgatgttctccaggctaccgggaacgccgttttccctgaattcattatcgtggctgtagcaaagtgacaccaggccgttttcgatttctgacactgtgaactcatggtgatgccatgcttcgggctggtcccactgacagcagccaaatgactggacgaaagatgccagcgcaataggcccaccagccgccgctatcacacgctcgtgaccgaagaagggaatcagcgagggttcatcaagtagcggctgtgtgccgtcattcagccgccctgatggcaggtctgccatgtccattgtcggagtactgatcacaacgcgagacttaaacagcttcatcagttccggtcccggcctgaatagcacaatccctgtgcgcggcgctatttcaggtgtaagtaatgccctcactcagcaccgcctgcagccttatacgccgtccatagcccgccaatccactgaatgcccttcgcggtgaagcgggattggctaaatgcatagtttgaatcgttggtggttccggttcttacctcaaaccgacccgcttcgatatgctggctgtagggtgttagcacgccgctgagccggtacataatccgactctcaatcaggaacaggcgtaattcaggctctttggcttcaagaagttttgccaactggcggaatgtcattgaacctgaagccgtaacataacggtcaacgaaacgcgacctttggcgcggcctcagtcagctggatttgcaggcgctctttctcttcctccatctcagcggctaagcggagtgcttcggcaaatgtctgtggaatcttagcgggctggcctttctccagctcctgccagcggtcaacgaggcgggccgtgaactctggtgagagctgagcaaccacaacaatactgtctcgtttgccgtcttcaccttcaaaattgtaagtctcaactttaacagcgtggcctaagttattgattctttcgacaaacgccattggcggtcttcggataacgtcgcggtcagccaatctttcaatgctgcgcttaacgtcgctgtgacggctgctgacaagttcggctatttcgatgctggtaatgccgggaatggcattgaaaggacgtgatggcacgaggccaccagaaatctggttaagcatgtttctctccacacactggaacaacatttttaaatggccccgccccatcacctgcaagtgagcgggaccaaccttggcacggcgactgcaatcaccagtacagcactcactatacccaattttactggtcatgtaaccagttgcggacctatgccgctaccggctgaaactcactgattaccacctcagatttaccgcccttggttaccggcccccactctaccgagaatcgttttatctggctgtcatcgccccatataccggcatgtgtgaggctatcgaacaaggctttgaggtagttatctaggtcgcgctggcgcttgtctggcgggaacagcagcacggtaacctgcacgttcactgtaatcggctgtggtcggcgcttaagctgctgaagaacggcggcaaatgcgttggagcggaaacagcgcccggaggcgctgatcaatactccctttctggtgttacgccagtacgtgttaacgcttggcgggaacgggaggattaacttcatgcggcactctctcccacatcagggatagtcatctgaccaaccacctcgcggactgcctgacgcagcatgcggatgtttgaccagcagtcgcggtcggtttgctttaccagcgcgataaactcctgaaccgtgcacggctggtcctggcgaatctctgacaataccgctgagaagcgcatcagttgctcagtggcaacgtctgaatcatcgtgctgctctgacagccacaacttcagttcaagatcgtcctgatgctgcttgatgaggcgcactgcactggcaatagtctctgccggaactgttacgcaggtaggattctcaacggagtctgcagcccaggtgtgcgcccacttggattcactgtaggtgtactcagctttcattttgaacgcggcaataacgcaggcccaaacctcaacaccgctttgctcaaggatttcgtgcttcagcagtggcagatcatcgccatagtctttttcagactgaacaccttcttcgctatcggccttcaggtgctcacgctgctcaccgtcttgaggttcgggccacttgcgggccttgttgacgctgagcttcagttccatcgcggcgttaagctcttcctcggtaataccagcgcggcgcattgcatcccacagcagaaactgaaggtcagcccattcggacaggtcatcgggcgcttcagctgcttccatcgcttcttttgccaggtgcttcaggggtccgaccggcccaacgtcgccgaaagtttcctgtgaccatgccgcgtgctctgcacggattttttcgcgcagttttaccggcgatacgatagctgctgagcgagtcagtttctttttgccagccgcttttgccttctgcatctgctcctgagctaccgaagatgctttcacgccatgctcacgctgcagggctactgctgtggtagcggccacttcgccagacttcaccatctcaatcagcggctcgccaacagtcagcaactggagatgctgttcaacgtcggtgatagaacgcttaaccttggcggcaatctccgctggctctaagccctgattaacgagtcgctgataggctgctgctcgctccagcggcaaaagggcgcggccctgactgctggtgaccatgaatgccacgctgtcagcttcactacccacgaaatccttacactcaaggcgcagcgtatagcctgcttcctgtgccagtttcgcaccgtagtagcggtgatggccgtcgataatcttgatgcccttctccgtgaccttaacagccagcggaggcacatgctcaccagcgataaaggcgtcccggaattcctcgacatgggtctgatcgatatcacggatgttgtaattagtttcgacatatagctcatcaacgcccagcaggtaggttttacgggtggtgatgtcggtatcgctgtttttcttgtcgtcgtaaatgcgcgctaaagtactcatgctgtggtcatctcccatgtcaggacaaaaatcagtgcggcaatcatcactactgctgtgcggatggcctgatagaaaatctcgttgcgctcgtagtggctcttcaggtgcgctctcataacaaatccctgttcacactggctgaaatgatgcggccggtatcaagtccgccatagctgccgcagttgagtgagcccttcacagcgcagcggtcgcagttctctttggcttcgttgcgtgaggcgtcgaacttcgccaccagcattgcttcacgccatacctgagctgcacgcagccagaaccctttactctccagtttcggcggccagcttcgccttgtgactgtatctctcgctctcaaccggcaacgggtcggtgttgatcgagtagctccagtcgctggcacgctttagcagacccttagtgaacagcggtttgataaagcgcttaactgacgtctcatgcaggccggtaagcttgcagaggtcgcggaccttcagcgggccgttacgggtaatcagttcaagaatttttgattcgtggttgatcatgatttgtcccccgttaaccgcgaaagccgtgaggcactgagctatcaggctgaggaatcacagtgatatcccgctgcatgttgcgcttcagggcattccactcagagcgtggcgggcgaccggctttgtcccatttggtcgctgactggagatagccaggcaggttgccggggatgaacagcgtcttgggccgcatgtactggtattcctcggtgccttcccagtgggcgtgtttgtaatccacaaccagacaaagctcctccaccgtgaatttgtctttcagccgggatttgatgtgacccatcgacgactgcgcctcggtatgctttgcgccggtaattttgttgaggtgacgtaaaacctgacgtgatcgattgataattgaccactcatcgtctggttgcgacgcaacctgacaaaagggttttttatctgatggatcatgttttgaatttactgacggatcgtcgccagattctggcgggtcaaaactgttatttttgctggattctgacgggtgaaaatttgatgcgtcaaaattcggtgcatcagattttgatgcgtcatattttgatgtgtcagattctgacgcctcagattctgacaggtgagcagcagctgattcacgaagctttttaatgttcagctgatacatgttggagttattacgattacccttgcggcgtgacgtgctggtcagccagccttcactttccagcttgcggatcgaggtacgaacggtgctcggaccagcgccaatctgacgggcaatggtagcgattgacggccagcaaacaccttcatcgcttgagaagtcagccaggcgtgccatgatggcaaccatagtgatcttcatgccggatgatgcgcagccgtcccagacgaatgctgataatttaacgctcatgatttaccccaacctctctgaaatattgcctgaaccgttcgagagagctgaagcactcgccatgttcgtagttgtcacgcaggtagataacccggtcgttctctggctccaagcgaatgacccgcacagggatgccgcgcttgtcgcggaagattcggtcgagctctcgcatttggtcgccttcattcgctggttagcatcgcccacagcccagctcacaaagctgtggttaacttcttcgctgacgccgggtacattaagtacataccgcagcggctcactgctgaagcggccaccagctgagggaaggcaacggaattgcggtaatcctgattttctggttaaattgatcacgcgattagttctccacacacgttgatttagtcgcatcgaacgccgcggactgcaatcctgcggcgttcaccttttctggcgggcaaaatacgcgatacagcagcgtcagatgctcctgccacttagccatgacctgatagctgttctcttcaatctgctcacgctccgccgcatcaatcacaccgtcagctgttgctttgcgaatgtaagcagagtgcttaccgatccactcaactgactccatcaggcgctgattgatatccgcgttatcaacatcctcaatgtccaccagcggaacgttgacgctgtttgactgacgggataccgcattagcgatgtgcttggtgccgcttgcctgttgcaggaccattgcccaacccattgggaaaatctgatctccattagtgcgcaggcggttgaacagcgcatcctcggtcacgcccagccattcggcagcttctgcatatccacccggaagacttgagatagtcttttttattgctgtcaccagccatgccggttgtttttctacttgccagtgcttctgatccacgattaagcccttttgactgtggttaaaattagaaagctgtcggtatagacttgtgatcacacttacgatttgcagggaacggcttcacctcttccgctgaaatcgtcccgtcttcatggaggatcacggtgatgtcacgcttgagtgaaatcgctttaaaaatcgcgctctggtaaacgcctaaatcggttgctgcttttgtctggccaaactgttctacataatctttgagttttattctctggctcataatcatctcctaatggacaggcttaattatcaccgctagaggtaaaatagtcaacacgcgcggtgttagtgatttatcccgtgcggtgataaatttcacatatgaatgctaagaaaaagccgctcactaacgagcaaatcgaagacgcgcagagattgaaatcaatctatgagcgcaaaaaagctgagttgggtatttcccaagagtcagtggcggacgctttgggcgtaggtcaatcagctgtcgcatctttgctaaatggcgtaaacgctttgaatcccagcaatgcctcagcattagccaaatttttgaaggtgagtgttggcgagttcagtcctaaaattgctgctgagatcgctgatatgtatcagtcgataggtgaagaaagcattaggtcgaatcactatgaatatcccctgttcacttatgtccaggcaggtgatttttctgaggttggtagctttacttccagagatgcaaaggcatgggttccaacaacgaagaaggccagcgataaagcgtttctggcttgaagttaaaggtcactcaatgactgcgccgcagggtgttcgtccaagcttcccggaaggtatgctgattcttattgacccggcagaaccggttgagacaggcgatttctgtgtggcatctgctaatgcagactcagaagtaactttcaagaagtatgagaaggatgctggggtgagctatctggtaccgcttaatccttcctacagaatactggattgcgaccacagctgccgcatcataggcaaagtggttaaggctcagtggcccgaagagacgtttgagtgaagattttgcggcatttgccaatatgatgtggtaccagtaacaacattccaacaagccgcttgacccggcaaccgtgccgggtttttatgcatacagcacctgcaacttttttctaatcatgcccctcccagccaatcctgcagcccgccactgagcggtttttttgcccggaatattagaaaccatcccgccctgatgactaaagttttcactaactttgacgatgatctgactgagcaaatcgatgctcaaatgcttctctattgaattctttgtaatgattagcccgcgtccggcgggctttttttatgtctgcaataaaaagcctgccgcttacgcttgtcatacatttgttggcttctaacctttagcgtgttgtgagacggctagtgctcctaccactggctgatgagatgcacggctggctcgtcaggcatcttgtttacaacgtttagaggccgtttaagagtttcacaatctccaccgcaacttatgcctgctacccgcctcgggtgcaggtattttttttgctcgtgacaatgcttaccggcactccccatggcaatttaagctttcatctctaatcggggtttcctgcaaaaggtgctgtgcgtaacaaattattgaacatctatttcctaaatatcagaatatgagtactctctctggcgtcagctagcgctgacagatggtttgccccatttgaacgaattgacgcccgtgtaacgcgggtttttttgtgcctaacgatccagcactttcgcagcaacttccattgctttgacaagcaactcagagcgggccgggttctttgatgccagcgccgtttctgagagcatctgctatcactatctgcttcgactcaaccccataatcgtgaagtgtgaacactacgccaccgacaaccctgcacatctcgtcatagagctcatctgattgcttagtcataaagcctccgctcacaaaacacccaaaagccacattagcacacaccaaaattgattattttgcgttcaaaaaaattttaatagcaggccaatcaacaacataaacaccgctagaaatataatatctctagcggtgttgactgatttatcacttccggcaataatgagtccatcaacagcgaacaggcaggacgcccacgaagtagccgcccgaggcgtaagaagatcgggatgattcgctaagcaagttgcagtggtgtgagggcggtgctgtgaaaatgattaagaacatgtcgaatacaacggttcgggacctgattacctttctgcgtctcttcccggatgctgatgtgatctgctgtggtgatgcaggtgtggtgagtgtgcagtgtgatgttgaaaacgtagttcgcggtccagcgttttaagagtactgaattgctgtgttggcggttactcatgagggtttgtttaaccgccctttttcacaacgataagggcatttgcaaagcgggtgttttcgaacgctttagagacgtggagtaagtgtccttttcgttgtggtgaatgcggctagcgcacgcggaagactgactacgaaacgcgtacagtctaagagtttccgctttggtgtttgtcagtctgaccagagcaccgggaggcacccggcaccgcagcaacctttcaagtgtgtggagtaatcgggctgtgggttattgcagtagctcaccagccaacttaaacgaatcccaaaagttttttattgccatcactggcaagggattcatgcaaccaaaaatcgtgtgtggagacagaaatgagtaacgaaaacaatatagctaacagtctggcaacagcaattgcagctcactgctcagagtttgaaaaatcacctgaattcgctgacatggtgcgcaagcacgtcaccagcctgtatgaagaagccattaaagacacgttccgctggggcgagttcccgaaggcggtgaagaaggctctggaaggcgcgttacctgccaacatcagcgagctggtcgatctgccgcgttacaacctcctgatggcaaaagagctggctgcgacgtgggaaggtaacgccgtttctgagcgactggttacttcgatgcgcgagcatgtggtgggatttgtgaagtcgcacgaggtgccgaaattcatcaaggcatcacagctatggcaagcctactgcgatcagcacgaggaagaggctgcccaatacggctgggagagtccgcaggttgtcattgatgacgaacgggatggcttcttttacatcggctttgagaaggagcctacgaccgaaggctcatcattccgaagcaaccgcaagaccagcgcttaccagtgcgaggtgttccttgggttccatcttcgggttgatcgaagtgaacgcccaccagtcccgttggaagaagatggtcaccctctttacagcctattcgctggcaatctggacggcgacgcgctcggcaaaaggcctgttcagttccgaactgaattcgaaaagttggtagcggcgctttattacggagacagcctgctcgtgctcgacactgatgatgcagacgaaatttgttatccaggagtctactgagatgcaaaagcctgatgatcatatcaccgttggcatcattaccctgccctacagccatatcctcaacggctgggtcatgcctgacggttcagtaatcactaatcctattaaggcgcagaacgaagcagagcgccttaacagcaccatcaccattcactgagggcgatgacatgcatcacttcaaatcgaataaagaagtcgtcgctgccggtcaccagttcgctaaaaacatcgggatggatacacctctgatcgaaatggcaaagatggtgaccgagctttcatcgcgtctcgatgttgccaccgttcgcgccaatctgatggctgcagaagttctgcgcatcaatagcgtgctgcctgacaccattaccgcgcttcaggctgcaggtgcagacctgacgctgattgatgacctgaacgcagcgctggccaccccagcatgtgatcagtggattcgcacactgcgcggtgaaactctcggcgaagcccgccgtgctgtaactacgttgggtaaccaccagcagcctggcatttcacacgcgatcaacattatttcccaaatggaaatggatttgattcgcacacgtactgtaacgctgagggtggtgtcatgaaaaaggtcgcacaattccggcgcagcagcggggctaatgccggattcagtgaaaagttagcctggcagttatcaaaaggcccggcaactggccgcgagctggcagaacgtctcggtatgaccctgagtgagttcaaccgtttagttcttcacataatgcgcagaggtggcgaaacgctgcaggttgaagccactaatcaaatctgtctgggcggtggctctattgaccgtacttacaccttggtcagaaatccgcgccgtgttgctcgaccgccacgcaagccaatggtgatcaaccacaggaatgactcctctgaagaggcaaggaagcgccacagtgaagcagctaaacgccgcgcccgcctgattgccagcgggctttatctggaatgcatgggttaaggagacgattcaatgagcattaaccccttagaagttcaacgcgaccaatatggctattggtctcaccctgattacctagcattttgtgatggtcgtgaattcatttctaccgcagagtttaatcagtggatgtctgagcatggcttgcagtggaaagttgagtatcgtgatgaagacatgatcgatcccaccgtagatggttgcgatatctctgcatggcaacctgaaagccctgaaggtgaaggctggtttgttggctccatccatgacactgaagacggtgcagtatgcatttggctccgcgccgttaaggatggtgagtgatgaaaaccattatccgcatcgaccagatgaagctggttactgcaatcagctttgaagtttctcgccaatatcccggtgtgacagtagatgctgaccagttcaatgccattatcgcggcagccaatagcgtgaaggctgcttacgatggcactgaagttgaagctgtggaagaggatgaagaagatgcgtgagcgcccaatcatctttaacgccgacatggttcgtgcagttctcgacggcagaaagacgcagacgcgccggatcgtaaacggtgtgccatccagtcacgatttccacggctgggttttaagtagtaccagcacgaaagacgaaggcaaagcctgctgggctattggaaagtcaccgctgctgaaccagccaatccgtgttcgttgtccgttcggtgaagttggtgaccgcctgtgggtaaaagaaacgtggtctgttgtgagccacgcattcgatgatgatggcctgatgattgattacgttcctgaccgcccggcaaaggcggtacatgagaagccattcggcagaggttattactctggtcacgctatttacgctgctgacggcggttttacgtggggtgacgatgatggctgcgttgatggccgatcatgttggaagccatcaatccacatgccgcgctgggcttcccgcataacgctggagattaccggcgttcgtgtggagcggttgaacagtatcaatgagcatgacgctatcgctgaaggtttggctgaaataagcaaagacgggcgaacctataaatacggcgttcctgatcgtgacggctaccccggcactgatgattttggctggccgtggcatgagtgggagcgttacccaattagcgcttacagcaagctatggaaatccatctatggcgatgaaagttggcaggctaacccgtgggtgtgggtcattgagtttaagcgcgtggaggtggagtgatggcgctgactcacggagaaatcaactcgattgcggcaaaatggctaaaacgcccactgagtaacaacgggccaggttgtcaggttgcactgactgaggttggtggtcttttcggaggagagcgtgcggatgctttcggctaccgctggggatatgacggcggctcagttgttgttgagagcaaagtaagccgctctgacttccttgctgaccgtgccaaaccccacagaaacggcaccagccctggcatggggacataccgctattacatttgcccggaaggtctgattaatatccctgacctgccccacggatgggggcttttgtgggtaaatcagcgtgggcacgtaaaattgaaggctggccatgtgtgctgtcacaaggtcggaggttacggaccggcgcgtgatatggcgctgtttctggcagcacccggctgatttacgctttgagttagacatgatggctcactcactggtcaggtttggcgatccagaagaggccaaagagatggtgcgcagtgctaatcgggaatacaaccgggccgctgcggaagtaaataggctacgggaagagatcaaacagtaccggacggatgcttaccgcctgaaactgtatgaatctcaatatggggacttgtccaatgcctaaatcccccgccgaacgcaaagccgcgcagcgtgccagacaggccgctgccggtggtaaaaagctggagctgacgctggatagtcaggaactggagatgctggcgcataactgcgccgcacgccgccccggtcgtgaaccgtatgagctgaacgagtacatagcgctgttaatccggaaggatgccgctgagctggagcagcaacttgaggtgctggcccgccagcagtgcggaaagtgcaaagagcacctgccggtgcagtcatgtccctgccagggtgaagcagcatgctgggccaccagcggctggcacgaattgaaactgaagatcggcacaccgtgacttgtcacgaccagaaacctgatgcaggaatgcatgcggcaacaaggatggctattattctgtgacactttcaacgatgaaatggaaggatattaatattcacatcataggaaatcatcattttttataaatctgattctgtcgggattagtgcgtcaatgatagcaatcatctataatcgctaattatcggagtcttaatgttgatagacacagttaatatcaagggcgggggtataaagaaatgactatcatagtggcattatgcagtttaattttagcctgtgcatcgcttaagtttaattatgacttgcaaactaggcaaacgctgaacctttatattcaaaggtgcaacgatgccacaaaggataacgtattaaagtcatcaagggaaagccttggaacagtaataacaagctgttgcaaagcacatgaatacataaaaagctactcaccgccactatttttgagatacgtatctcttaaaaaattagaaactcaaaagaccgagctgaagaattacatgtgggatttacttccattcgctgtttgggaagaaattatccacaaagaaaaattagccgagttcttggaaaataatgggaattcggttagagataagcgtgttcttgtaaatcaatacaaagatctttctagggatttttcagatcagataaaatctgctggctagcagattgttagccacccagtggattttgtatggctaaaataaatccaaaatttattaattttgaaaatcctgatgcagcaggaatgtgtggagaacaatatgcaccacgactttatgagtgaaaaagaagttatggccgaaattggtaaggcgagaacagcactctggcggctgcgtaagcagcatggctttcctgcgccagtgctaacgcatccggcgcgttatagccgcagagcggtggagaaatggatttgtgatggcgggattaaccgagctgtttgacgtgccagaatattttatctgcgtacgcctcatatgcctttctttgatcttccagccagtcgtgtttgttgtacacagccatgacaccgccaagttcatgccccagcattttctcagtgacatggggcatgatcccttcacttgataagttagtcaccaaagaaacggcggaagtcgtgggtgcgccattcaggaatatcaatcgtctctctcagcttacgcatatacagattcgatgaagagcggtcgatggctttatcaagctcctgccccggaaacaaaaccttattgccactgttaagaaggcgctcaaccataggcttcatttgttcgaagatcggacgcctgatgatgttccccatctttgaatgttcggacggcgtggtccatatccaatctgtggtgttaaattcagcagcattagccaggcgaagctcagacaaacgagcaccccaaagcaacagcatctgatgcagtagcctgttggatgtaacgatcttgctgttctcaagcgccagccagatttttgccagctcgctgtaggtcagaacgcgatcaccaacatcaggcttcttaccgatatttttgacactgagttttgtaatttcacatgagggtatcagctgtcggctgatgcaccagtgaatgacggagcggagttgaagcaacagaaacgcgggcttttttcttgttcagcttttcttgtttatcaaaaaactgcacccaggctgatacagggatgttagcaacgggcacatcctcaaactcgttgtacatggtgttgtacacaaccgatttgtacagcacctgggtattgtgtttgaggcctttaacgtatttttcccaccagttatcgagacactctttcagagtcagctcaccagtacttacggcaaaataggtttttgggttgacccccttcgtgtacaatccacgcatctcaccaacggcaatgcgggcatctttcaatgatgttgaagggtagcgaccgacagtgagacgcacaggctttccattccagcggtagcggtgctgaaatgtaatcgtgccagatggagtgatgcgaacgctcagaccgtcaccatcggtgagttccgctggtccgttgtaagctttgccattgatgcttcttaatttggtgtcactcagcgccacaataatttcctgtacacaattcctaaaggcattctgtactcaatgtgtactcattggcaagtgaacgaagcaatgttaaagatgaatagcgggaaaccgagcgaaacaaaatagagcataaggcttgtaaaaaactgaggttttacgataggatgcgaaccgtcggaacaacttcaaaacttccgcgaacaacgtcctcttagttaaatggatataacgagcccctcctaagggctagttgcaggttcgattcctgcaggggacaccagacctgccctgtacttaaacccgccctatcaattaaaactcttaataatcaatatcaagccattactgacggctatccccctttgccctttttcttctcagaatcaataatcatttgccggccctggctatgttctttaggcaaatccatcaacaccagtgaatgagttgtgattatgacctgccaggtctgggttattagctggatacctgtgctttaaatatcttttttattttaatgaatcctgttttatttctgcataacgggcaatcagttgcttcagatgcatctccagctgagctctgacagccgcaggcaaaggttcgcctgctggattttgtgacaatacccttagctgctcttcagccggtatggattgattaaaggactgcatagcggaaaaaacgactgacttcagctcactgaccgtcaggtattttcctttctgcacatccagtttcgttcagcctgtcactcagtttttgtagtgtcgccattccctgagaccagccattcagctgttctgttggcaatgcggcagcattaagttgttgctgccactgttggattagtggcttagcctgctccggccaaagtacccggacctgttccagcaactgtcgactgtattcaatattccagtcaggaggcaatttacccagccgggcaagctgctgctgtgtttgtgttattaaaacctgtggtaacggagcttgctgacgccacatatccagttgttcaggcgtgagagatgcaggcaatggagccagtgaggctgcaagctgagtctgcaacgggactggccgattaagaaactgccagctccatagtgtgactgtgcttaccaccagcatggtacacatcccggcagcgaagaatttccatttttttacctgattgggcattgccgccattgcttctgcattcgcctggtgttccggcagtgccgcataaacccacttcactacgcttgctgacgtatcttcaggcggactaccagcaaggtccctcgtggatgctgcggcactattcatcgcggtggcaggcaacctgatacctggctgaatgtccggcctggtgctggttatgccatcgctgtgttccagcctggcagcactgttgtgcatcaaggtacgtaacgtatcgagctggctcagatgcttaagctccaggccctgcagcacctcacccagagcggtaagctgttgctccgcccgatacagctggctgaggtcgctgtgatttagcgggagcgagcgaatcagttgctgtaaacgctgactcagactgctgaggattttcatgcgggcatggacaggctgcggccagagtgcgccccactgatggcttatcagtgcctcgagtatcgccagaccttcattgagccccaataaaccagccagttgcgttcgggccagcgtgtaccaggacagcgtctgtagctccacaccattctgctcaaacagtgagagacagcgtttttcggcataacgccagttcacatccgggcgagccggatgtgtcagcttactcagttcatcacgcagggcggcataatccggtagcgtgcgcgggtcaccaccggttttgattttatgtggggggatgtgattcatgaccagttgtccattttgacgcgtacggaaatatggaggattaacgcttatgcgggcatattcagaggaacgggtactgcaataccagcagttatggcagaagcgccagaatcagactaaaaaaggtgctttcatcaaaactctgtccgggacgggataatgctcccggcggagtaaaggaccagtcactgaaatgacctgcccgcatgaaaaggcgccccacagacgtcacactgccttctgcatgaagagtcacttccacgcatcctgtcacgccctgaccgtacaaaaataccggtgtaaattttacagagcgatcgtcgtaacgcagggtgatagcggcaatctcaaaagtcctgtcctccaccagcagatccgtaacagcaacggtaaatgtttccacattcaatccggtacccacccagccacgcatccatctgctcctgaagctgcaccattcgcaggcgaaactctgcaatatcggcctgagtcttgctggtagataagatcggggctggctctctggcctgtagtttttcgaggaactgtgattttactgacatggtattaactggccttacagccgggttgctgtgtcgagatactgctgttgcttcaggtgtcgcaggagaacccgcccttctggcataaactctgtgccatagcgtacgaggccaacaccgttaagttccgcatcaatggcgtagcgcaactcaccggggatgttctgttccagcaggacaacggctatttttctcaggcgtggctcatatctgagcagaacagccgacagagcacccatcagttcatgggcagtccccggcatgccctgcaggattttggtcatatccggcaggccatagtccggcagatgcgccagcgtgccagcacggcagttaaggatccgttgcatgttatcgagcacggacaaaatcacctgattttgttcactgaactgatggagatcgaggccgccggtgaagttgccgtagagtgtttcatacaatgaaggacgggataactcactcatctttcagcgcctgaagtgtcagccggttgttccccgcctcaatgacgcgtgctttatccggatcgagatcgtcacgactcagcaccacacgccaggtgttgttctcctggtccggtgacataaacatcccggccaccgccacatactgcgcactctcttccatcggcatatcaaccgtcactgccccacccggctgcaggcggatgtctttctccgccaccaggtctgctttgatggcctgactgtcagccttaaacagtgacggatagtccgtcatgtcgaatgttttccggtctttgagctggtaaatacgcaccaccgtcgacagcgccaccccgcctgcattgctgttaacggcctcgcgggcgcggatatccagatgcagggtttttacctgcttgtaaaaaatcgatttggtcacggcaacggtgccgtccgtcactttctgggtcagcccacagccagcgagcatcagtgtgatgcccgcggccagtgcaaccagaggaaatttaccagcggtaatcgccatcttcatcggtctccctgcggtgaatattttcctgtacccgctcatagcggccaagattgatggttatggttttggggtgcatgacggtgttcgctgcattcagcggccgcatcacggcggtacggcccagttgcacggcacctgcctgcggtttactgctgatggtcgcgtcaggcagcagacttcggtcgacacacagctgtaaccgcacatcgaggcgggagccaagatagacatgcagcagcgccattaaatccgtgtgaagctccccgcccggtaaccagccctgtacttcagccgggtcagaggtagtcaggcgcatcagcacccggctgttcacgtcggtggcatagctgcccatcaccggacggtttgtcagggtgacgggctggctgacgctcatggtcaggggctttttcagcggcgcgcggcgtttatcgtggtgccagattttcgcctgtgtgttgggtgccagcaggcgcaccagcgaggccatgccttctgcggtacgccccggcagcaacatgaccggcagcagtgccagaaagcgtgaagccggagtcgcgatactgtccgtgcagccgttaatcccgagcccggcaagtcccagcaggtactgcgaggtgttgtccttaccgccttcttcgaaagtcgccgggtatgagtatttacgccagatacggtagtactgggcaatcagccggtggttgaagatatcgaggaaatccgcggtggcctcatacccttcccgtcgctgggtaatgtcatcgatatagtgcgtcggcagcggggactccacgccgtagagtcccataaaggtgatgcgcacagtcggcggcagatgcgaatgctcagactgctcaatacctttaatttctgaagccggaaaacccatccccgggtgtggccgaaaacgtaccggttcatgacgtacctgccaggtactgcccgtaaccggtttgtccggctggttctgctccagcaactggcagaagcggtaaaagttgatatatggcagccggtcccccagttgcgctatcagccgggcaggcgcggactgtgattctctttccaccggatgcattttccttctggctgaacaatgagggtgagctggttaaactggttcatatcggcatacagagcaaagaaccggtttagcatttcaccgaacaggtgaatatcgccctcgccggtgaagccgttgctgtcgagggtcacttcgatatccagcccccgcagcaggtagccctgctcaaaacgttgcaggcggtggtgctccacctgctgaatcgcctccagacgccgggtattcagttcatctccctgccagttatagagtgccagcgtcccgcgcagcacttcggcagtactcatcatattcagaaacccggagccgaggtggctcaatacccgccagtggaaacggtcttccgcaggcgggtaaaccggcagcgtgggcttacagaggttgcgtactgaaagcggtgtactgaccacctgctcactgcggtcgagcagcgtgctctgaagtgcccggcgcggtaactgaccgttggtgccggtgatttgcagcgacacggcttcacgctcaaacaggcggtcatcttcccactggtgcccgcccagaatcagccaggtgtcatacagcccggtgacaccccgcttaacgcgggtgtggtaatagcggggtggcgcatgacggcgcatcatcccgcccttgtggcggaagctgctgaacggcacgtattcggcatcactggtgcggtttgaaccggtaaccgaatccaccgaataaatctcagtatgcccgtcctggagccgcttaggacgcagcaggtactcactttcaagcccggtgatggtgagagggtcagcctccagcgtaaacaggttaatcaccggcacgcagtggaggcgaaccgcatcatcggtgaccggcaggtctgatcgccacggcgtgctgaagaccacttcgatgtcgaagtactcagccccggcaggcggcgtaatgtcgtccagaccgttgaggtggacaaacataaacttgttgcggaaggtgaaatactccagcagcagctggtagccactgaatgcggtgtcgcctttcggccacagcccatcctcttcggcaaacccgcccggtgagaaatacccgtcaagccggatacggtcgatctgcccgggcaggcgcatatacagagcggcctgccttctggtcagcatcaggtgcagctggctgctgacgggcgcgtcagccccaagatagaggctcaggtgactgaggtcagcatgggaccagtctgcctgggtgctgcaggcaaagcgcatccgcagcagcgaacgcccgtcaggctcagtggtcatagtcacccctgagatgttcagcgggttgagcatcacatcccgggtagtacggtagcgacagaccgtatttttaggccccaccgggcgggaatacacttccagacccgctggcatcacttccgccatcttcacggcctgaagcgcaggtgtgaacgccactactgagagtgaaggaatggtgcgcaggtagtgtggccagagcatgctgaccagcccttcggtcagttccggcaggtcgtcgtcaatcttctcgcgcagccgccccatcgaaaaagcaaaaccttcaaatagacgttcgacatagggatcaggtgtgccggccttatccagatccagcatcgcggcccgatccggatgggtctgagcaaattctttggccgcttcacggaggtagcgcatttccgcgtcgtaataacgcagggtcaaatcttccatttatttctgttcctgtggatttaaccgcaaagcacggcggcacgggcgggatcgacggcgatcagcccggcaagtaactggtctattaccgacgtaaggcgggtcttatcagcctcactgcgaccggctttcaggcgcaggagtttcagatgacgggcctgtacctcaaacagcagctctggctcccagtcattgagggtcacttctctggcgcgctcacccagttctgcaaacaggtgcaccgccaggtcattcttaccgtactgctcagcaatgcggcccattagcagtcgcaacagccattgctggcgcgcggtggcgatgccgggccgggtctgcaaccagcccagcgccgcatccgggccttcactgtcggccagcgctacggcttccggctccagcgacagaatgtcatcgttaccggcggtgaccggggctgatggcgtgtcattaccccaaccgccgacggtgtccagcacgctctgctggatccagttcagcgtcacttcgtccgcaaacggcgtgccgtcactgaacgccagcgtctccagcccggacaggcgcgacagcagccctttcagatcagccgtgacaatgtcggccagcgtttccttgccggatttcgtcagcgcctggtggatgtaccactgtaaatccagccacaggtggttggcaccgcgggaaaacgtgctgtctgctgtatccagcatttcagcccagttctgctgcaggtagaggcgtttgagtaacgcgcgctgatccgcccttggtggctcgatgcgtgtacgcccctgcgcatccggggccgggatagcccgcagggtgtcatgacgcagacttttcatcagatggtgtgctgacagccagccgtccggctgctcacgcagatattcggtgagggtgcgggcctgggccagcaaatcctggccggaagtgatacgcccgatagccggtgcatcgttgtgactggcaggtgaaggggtttcgctggtactggcgttctgcggtaccacggcatccacaccccccgctttgtgcaaacgactttccagggcaccgtacagcgcattgagttcaggacgggtttcatcgggctcattctcaataagctgtgatatcagcagcagcgcaccagtggttcgcatcgcatcgatcctgaccacttccgggtacagggaaagcgagtcggtcatgcgcgaccctgccagccattccagtgccgccttacagctgcggtcacgctgcgggtgcagctgtggtccaaagcgctccagcaaaccggccagcagttcgagcccttccgccagcccctgctcaccttcgcggtgcagcttcgcccagcagtagtacgtcgccacacggatatctttggcggtcgtggtcagcagcttctctgccagccggtagatgagctcggtatccgcgccggagagcttgttgacctcctcgcgcatctgctggaagtcgtcgttatagcccggatcctcgcccacgggtgatgaaccggacagcggctgcagccagctgccccactgcgccacacgctcacgggtttctaaaagtaatggttcctgctctgcctggcaggcactgagtaaggcattgagtgtgctcatcagtacgcctccccgtcgtcactggccgtatctgtcgccgggtctgacggtatgacgccggtggtgctgaagatagtttccggcaggcgaaaattacgcagcttcagcagcgccaatggcccctcgcccgcttcggtacgcagggtgtaattgagcatacggccatcctgcgctttccagctcagactgtaactgctgtcgacacccgggtaagcacttacgacggctttatcaagcaggcgtatccagccccatgctcccggaatttcggcatattgacgggtgccagcctggatactaacccagctcaggttcgcgccagggacttcggtatccgcaggccacgaaaagcgcttccacgctggcagttggttcaaataggtcagcttctggctgtcgataatcatatccgtctgcatcacgccagcggcggtgcccgggcgcagctcgaagttcatgccggcattgccttcggtgaaggccacatccgagatatgactcagggtgttgatggcgttgaggaacgccggattaaaggccaggccctgcgagttgatgctgtccggcacccagtggttgccctctttgtgcagcacgcctttgaggcggatttgcaggaactgcgcgatacgcccgaaatctgcgttgaggtatttggccagcagcggcagagaaacatcactgctggagttgttgaacggataacggccaccaaaggcactgttccactcagccaccaccgcctgctgccactgtgcattgaggctgtcggccgccggggtcagcacctgctgccaggcctgctccattgggttcacaaacaccgtgcgcccaaagccgctccactcctgaccgagactcgcggcaatcaggctgccgtagtcgcgggtttcggtcagatccacagccttgccctggaatacggtctgggcaatggtctgggccatagcctgcgggtcagcagcattggtcacctgctgcagtcgcagacgcacctgcgtcacgcgggtcagaaacgactgcagactcaactcctgtgcgcccgtgcggatcttgtccatcagcgccagcaccgggccaaaggtcgcatccagcgggccatgaaccccgacactctggtcaatggcatctttgttgtcaccaccgagcaggttcttcgctgacttcaccagcgagtcggaaatcgcttcgccagtttgacccgtgcgcccctgcacattgagggtgttcatcaacgccaccagaggtgactgacgcacatcagccatcagagtcagctggtcaatagagtccgacagcgtggtggcccggttccagcgcaggctgttgagaaactccagccaggctccgccgaagtcagcgaagtagcgctcggtcagacgttttttcagtgcttccggcgaggtttcgttctgtttattcacctgacgcttactgtcagtcagcacccagtcaagctcgtcccggcgcgccttcaccaccttctcgatggcgggctgcacggcctgctcccaggcctgacgggtgaacatgcccggcacgatttccgtagtgctgaacagacgggatgcatcggtatcgccggtcatgtcttcaaggcgcatatcgacatacagatgcgccacctgggagagcatcttctggtacagggtcgactcactgttacgtaagcccatcaggcgaaccagcagggaacgcgcctggctgaccatgttctcatctgcccgcaatttccactcagggtgcgcaaccagctgcgcaccatagaacgacagcagtgacggcgccacgccctgccagacaccgtctttcacgccatcgcgttttggccagtcatgcaacagcgtcgggctgaaccaggccgcgtccatatgttccggacgcgccagcatcaggtagagcttgagctggtcataggtggcttttgccatctgctcacgcagtgggctacccggcggcaacgcgttaaaggcgctgacttgcttttgaagatgggttgcggccgcatcccgcaacagcggcagtacactgtcctgatagcgtggccagagtgctgccagcagggcattattctggcttaggccggccttctcgaaccacggcacgccatgctcagagcggtactgcagacgagccagggttttctggagttcagacagcgcgtgcaggcgctgctccagcggctgattctgtcgggcggcaagtgcggtctggatattcgcgccgtcaatctggctgcggttggtgacatacgcgatgctcatccatgcagcccagcccaccatcgccagggcgacaactgacgcaatcactttgcgccatggaatgcccggcttgcgcggacgcagtccggcaggaagcgtgcggacagactcaggcaaaacatcccagcgcttatccatgccccagtgatgtgttacgacacgttcggcaccggcagagggctgactaaacaccacaccagccagcggcagcgggcggtacggattgagcatcaccgacagcggtgcagtcacactttctggttcgcgaatgagctggtcagccagcgtcagtaagaagttatgtttcacctcaccgcaggtctgctgcagaccctgtgaagtcaaatccggcgtcagggcagagagttgttctgccagcccttcggtacgacaaccgacaggtaacaggcagccggtagcctgcgtaatgcgcccttcctgcttatcggcgcgcgggtgcagggaccagacatacagcgggagtttccagccaagcgtttccatacgcgcgctaatggcatgagacagggagtccatggtgctttcagacggtaccggcagcggctgttccagtcccggtgctgagagctggtcaaaggccgaggtgacccacaccagcccatccaccggacggcggcgcagtttgcgcagcgcggtcagccaggcgctgtctgctggcgtattgaggtcaccgccccacagcaatagcgtgccgcgatcttcctgccagagctggctggtgaggccgggtgtgagctgctccacttctgcagcagtaccagttatcagcaggatacgtgttttacggccccagcgccgaccgtagaggttacgcatggcgaggcggatggagtcgacggtgacattgcgtggggcggtctgtttgacacgtccttcatcggcaggcaggacacttttacgctttgcctgaaaacgcgaccactgttgtttaatcgcaagacaaatgattttgccatggcggacaagcagcagaaggattatcaccgccataaataccagcagcttaaggccaatactggtcagtccgaacgaatccccctttttccagatagccaatccgatcgcgacagcaatcagcgcagtaatactgatgcgtccccagttaccacgccacactgagttatccttcgccattcatcagattccctgtagttacggtatttacaaatcgctgctctttgtcacccgaaagcatcaggcaatcttcttttgtgagcatagctatatcactgacgacggcggccataatccacggtgagaaaggaccgctgagcccggcatatttctccagccaatggcactgctggggtttccagcggccttcatattgttttgcactggccagcagagtggaaaaatcatcaccccactccatgctgtcacccactattgcacgcgcagcgatagcctgtgattgggtcgagaaaaaggtatcaagctcttcactcagcatttgggttgattcaagcgacataggccgaagaaggcgagcgtgatggttaagctgatacttcgttgctacatcatcagaggtcagcattaaagccgagagcgaatcactgtactcattccctccctgagtctggtgaactaacagaagctcaacatccagaaccggggatttaagacgtttcgcccacccaatcgaaggttcggtctttaagaattgtcagtaacggtacgggaaacgcctgtccaactaactggagccagcatgctgaaaattctctctgcaatgtcttatcaggatcgtgtgaatccgtcagtaaggttgcgtggaaagggaggtcagttaagcgctgtaattctgatatgtccaggcccccaatcaatgctgaaaaagcatcttcgcccacaggtaacgttattccccgagaaagagagctaccctgctcaagatctttgggggcctgcagaaatgtggatggcgtcaattcatgaggcaggataacccggctatgcagaaccgccagataacgcccggcccaggaaatccattgctgctgtgcataatctgcttcatcagattcaaactggtgacgatccattgcgtggttatacatccagccgcgaatacaaatcgtcacgaaccagataaaaagagggcttccggcaacaatccagaggttaaatttttgcaattcatccagaaactgattggcgtggagtacaaagagcaacactccagcaataacagcaataaggcctgcaatcagccagatgaccagtgacggctcatcaggttctgcagaaattgtagctttctgacgctcccagctcataacttatcctactgaacaatccggcgcactggagataacatggcaaccacattcacattcgcagccatccacaacaacaggcttcccatcagagatccattctggtgacccttctataatggcattaataccatgcccttcaacagggcaattaatttcatcgccaacgagggctacattctttccgttcacgattatggtcgaagatgcagatataacctcaccgccgtgagtagttttatctcctagcaatacaaatcctttggacatatcacacctaacaaattagtttatatgttttaattgagtcgacggaaatgaatccatccgtttttaatttgaggaacaatatcatcatcgagaaatgcagaacaaacaccgagttcaccgactgcaaaaaccgttgcaggataagataaacctatcccttcccgtccttttggatctggctcttcataatcaggaataccattctccctataagcattaatatccaagtattgattacagtccacattaaaactattgtcatcaattaatgacaacggaaccacttcatcctttttaagccttatccgtttccctaagaattcctcaccaacaaatatatggtctgtggcatcctctgtgaccattcgaatagtgcttgtagaaataatcatatccccctcagtaaatctagcgccagcccatccaaccgtattaagatcagacccaacacttttttgataaaaatatacgattgggataccccccttaactttaatatatatttcattatcatcagtaaacttatgaacaggcgttaatatatattcacccatcaattttctaggttcgttagctaaaacaccatactctttcacggcaccatgatctttataaacccaatatccataatacagaccgtcttttaccttaatagtattgcaaaatgcaaaaaaaggaacgacagcaataaaaaacaatattttattcattgtacaatctccacatggaatgctggctcaccacgattttcaaatggactgatatatttcacttttcctggattatcttttacatattttgtaatagccttatcaaaagcccgctgcaaagtgacaggtaataatcttttacttatatcaaatacatttctctgagcatacgattcaagcgaaacacaatgttttgaaacaagacgtccatctttttgtaaagaattgactttatcaatcatggcttttttaacctgattctccttacttttatctatgccacccacagcgatacctacttgtacaacctcccgacccgcagcagcataataatcaagctgggattgtacacccttgttgcacatattgttgtacattgcttccacttgctcttcgggagtgcgtagggtgctagtgatagtaattttatggacacctgcagatttcattattcctttaataacatcaattgaatgagcagaaaccaatctctgtaatttttcagatatatcagttcgaaacttgactagaggttcaaagtcgttaacaacagaaatttcttttgcctttccctctgaagtagtctgatgcttctctggttcatttttactcctgcgagcaacggacttatccgtcgtcgtcgttttaatatgaattacattatttttcttttccgagtctgctgacttgcttcctttaggtaaaacaatatggcttcttgaatactcaatggctgctttagcattagcattttcaactccgatgcttttgagaatctctttcctggtctgctcagaaacatagcggctaacatatccatggttttgattactatcaggtatttttaatttcgcaccaatgcgcaacatgttgacgttatggatcttattaattcttgccaatttctctactgatacacgatatttcttcgctattgctgataaagtgtcgcctttcttaacggtataagttagagtcttatgcttttcattggtatttttttcaacagttgctttggctaattctttgtaattatcagcaagaatagcaaacacaatttctgaacctgcgatagcattgactgatttagtcatcccgtttgcatcagtcacgcctttgataaaaactagagctttctcatagtctgacactaaatttgggcatgttgaaatgggaaatggaaaaattgcagcaatataatttttgtttttgaatgctgtattatttccggtagacagtttaaatatagtattaacttcagtcttttttagtaacccttccacaactgataaatgcttagttatataaagcgcccacttctcgccatctgcacttttctcacgtgtaccatcgagatattttcctaaactataggcaccatcatgatgcaacaaataaagccattcccagtattcactttgatctgatgtgtaactctccatcaccttcgatttgttaagtaaaaaggaataaataaccgcatagcatcctttttcagcgtcaaaaacttcctcattacgaagatctagctgaaaaccaagaatgtcttcagattgtgtcaatgcatcgttgataaaaccaaccgtttccttgtgctaaaccagccgcactagtagtccccgctgccgcatcgggattaaatccagactcaaccttagtagttaataatatataagatatctctttataacttaatccatagcggacagctatggtaattatcatatctataatagtatcctggacatctttattagcatctcctattgtacgactgttacctcttagctttcgggatgtatctatatctggatagattgagattaaagaaaatggtttaatctggtcatcaaaatatgcctttccctttttggcatttaaatactcatataaatcagacataccatacctcagcgattgctaataaagtctatgcttgtattatcgtaggggtttttcatttctcgagatctaagctcagaaagcttgttgcctgtaataaagttccctgaaagatcaataaatggggcatcaatatatgacaacaatgatccctttacgctctcatcttcatccagcccaagatggtatccgatcacaatattttcattgtcatagcatttcatagtggagggagcccaatcaccaggcttaactacattattgaaggaataaccctgtttttccaggagagctttttggctgttcgggatgtatggcaaagaaaactctttattattcgtgccgttctttatttccaagtggtaatttttgcatatattctccgttgggcttttttgattcacctggcattcagcactgacctttaccaaagctgagccacattgcatttgtgctgatttagcattccatgtgccacttgcaaaagaaaaagatggagtcagcaacatacataacaaaattttaaacttaaaagtaatatcacgcacttttatttccctcacaatcactgcattgacagccatcgtcctggaatgacatatctgaaaatgatgtgcaatgtactctgtccacaatattttcactatcgtaccaataatcactttgaatcatttcaagttcaaaagactcattcgggtttgatgagtaaacaggaaatgtttcaccgtttctcgtctgttctaccaaataatttctgcccattactcgatgtcaacatgtatgccgcggcagcaactggaactcctgcaacagacgatgcagtaaacttcccactatatcccgatggaaactggggcataacactactcatacttacactgcccattttctgcgcattggcacatttccacaggatattaccttcacagcccagaataatattcttaccctgcaactggatgaacgaaccctccagatttttaagcacgacatctttcgcagccgtgatttctacccgcccatctgtgctggttacggtcacatcctttttggctatcgcctcaagcgcatcatcctgagcctggatttctacttttcccttagtcgcaaagagtttcatcccggccttacgggccagcatactcacggcttcacctgctgctacggtaaatcgtttaagagcgctaatgtctgtattctgttgcgacatgatcccaacactggcactacccgacgccatgcgaaccgcctgtgggctggtgatgctcacgccttctggtgcattcaacaccattcctggctgcacaagatatttgagggcattagtcaacttcacctggctctgaatatccgcgggtagcgcctgcgcagtttcagctgcgtctgacatgcttcgcgcaatactcagtgcattctcgagctgggcaatcgcctcctgcatagagagcatattgtccccggcaaacggctgtttatctgcagtgataaacaccccggcaccaccccggatggacacataccgatcggtacgcaactccgcaccttcaccgcgcagttcgcgggaagcatccacgttgtgacctaaattaagctgcgtcttacccccgtactctgtactgagcttgatgtgttcctcgccgcgcttatcctccatccgcagcttgttcaggccagctgtgcggataacatttcgggtgctgttggcttcagtgacatggtcaacgtggcgcgagtcatgcagcgcgtgcgcaatatacggacgatctggatcaccttcgtggaacgcaatggcgacttccgtgccctgtatcagcgggaagtggaagccgtacttatcaccaccgtaaggcctggcaaaacgcaccggcatgctttccatgccctgttttttatcatcacggtcggcatcaaacttcacccggtacatgccggatgcatcctgccaggcgtagatgtcgttatctttagcgctggtcactcgtgccgtcagggtgccgctgaccaccgggcgctttttagcagcaggacgccagcagcggttctcgtaatacggcatcccttcccacatcacgatcagggcatctttacggctggctatatagcccgttcgggtgatgattatgccgttgtccgtttctgatggcagtgtaggtgttaccacactttcactgatggtcagcacctgggccggagaaagcagggcatcattgctgcacccgctgataatcgtctgtccggaaagaaaacgctcatgctcaaggcgtgcccagaaattgccggtttccgctgaaggtgtgattttgtcgccacgttcaagatgacgcggtagatagtgataaacctcaccgtaggtaacaccgtcaccgtcgccgcaggtcatgtccgccggtacagaggtcaggacattctgggcttcacggtgattgtaatcactggcggtgacagagcgctcaaccacgtttctgtcggacgttaaccccccagatcgagtccgctgcactgtcactcattcccgatgggctgctgagcggcagagacttaccgaacgtccatgcgctctgcttgtctgcgaaatgcaccacttcggtctgggtatcgggttgcagggtaaagaagtagaaaatccccacttcggccagcagacgctcaatgaacgcgaggtcattttccttgtactggttaatctgttcacgcttcggatagtcggcttttagggtgaactcatactcccagcctttcaggccatgctcctgcaacacttcggcgacaacttccggtaccgacttattgacaaaaaagcggtgggtacggaattgcttgcgcagcaaagacaagaacggctcaataataatctggtacgttgcctggtcacgtgaaccactgatacgcttaaattgcgtcaccacaccatgcaccactttcagcccggtcaaccccatcagagacccggttcccatggtcagcgtggcaggcttagtcagcagttgcgctgagctgatattctggtcactgctggtaaagataacctgatagtagtaaagctcactcatgaactccttaccgctgaaactttccacatccagtgatgctgtacaggatggaatatccaggcggtagcggttcagcccgctttcagttaatgcagacagggtgttcttgagcgtatctgtcagactcatgatattgactccatgggataacctgcagtccatgactttcttgccggcgggcaaattgcaggtttaatcggggtactcagcgagtacgaaaaagcgtgattatggctccggccccgagggcactggcgaaggttttaatcagcaacacggtcatttcaaaattgtttatgccgtattcgccatcgccactaatggggataaagcgcttaacaaacgtgtaaataaaagcatccggaagaaagagtacgcttatcacgaccaacgcaataaaggtgaatgttctcattatcttatattgaccagctactcggaaacttgaattgatccatatggccttgctatttctcgatcggtcagaggaaaattgtatacctgcccattattcacccccacgccaacgacaaatttccgtggctcatcttcatgtttctttgaaatcaatacatactcaaaaataagcttccccttatccggaaaatgataaaaagaaggtggaatgcataattttccattaacgatcgtgaggcctggagagaaattaaaatccttctccttcgaaggtgttcctcgtggatttatccccatgtcagcaggttgataatcctgagcatctggaatatctaaacatacattttccccctgcttgctgacagatgtggtttcatgaggaatcatcctgtctcccgggccaggacatcctgtcagcacggaaaggaaaaagaaggtgaatattcctttcaggcataaatcaaagcatcggattatcatcatatagaaaccgaatgttactattcagtatagtgtttagcgtgccgtcgctggcacatggtattcccgtgtcgtcaacgatacatcccgggccttaccgttgatcatttcaaatccggtgacaaagctccttggatggttacttttactcttagactgcaatacaacctcaacaataaatggggcttttgacgtatcaggaaaatggtaaaacgaaggactaatacataattgaccatcaataattcgtaaattcgggttttcggtaaactgcctttctttaaacgatttattcctgaggttgatagagatgaaaacaggctgataatccttactatctgggacgtaataacaaactgcattattcttcatccagacgctggctgtttcagctgggtaatatttcatcccaccccacgggcatccggttaatgtaaaggcagaagtgacagctaaaataagaaacagtactgaatgccaccactttatttttaccatggaaaccctctcaatgaatttctatacatttctcggatgattgattcagatgcatcaccatcaagagtaacgatctcccagcccctgagacgcaaccaaccatcatagccatgagcctctagtgtaaaattatctgcaataatctgcgcctgctgctccatcggatattcacttaacaggcgaccatcaagagtgtaacgataactcaccatccaactgaccaatcctctcataataatattcatgcctttcattcgttgccagacatgccccatttcatggatgaacatatgttgaagatcgtcagttgtctgggagaaatcgtcgcagtattggtcacgaaaataaatctccccatttggggtcatagccgtattcttatcctgtagattgaaagggagataactctctctgtggatccatactttcgaataatcaatggtggataaaaatacagagtgtgccatctgtatctcacccgtcgtaagtagcctgacaccaccttctttaatcctgtactcatcctgcgtttcatcagtcatgtgtaaattccagtacaatcccttcttcatcatcccatccaagccgcagcgactgcggtttctgcttcgccgccatatgagtcagcaactgctgactcagtaccggcagaatttgttgattgagcagactgtcgacgttacgtgcaccggtgtccggcagcaggcaggcggcgaccagcgcgtcatacaggctctcatcaatctgcgtggtcaggccgtagtgacgatgtaagcgcttgctgacctgtgcgagcttcatttccacgatggtgcgcatggcaggctcactcagcgggcggtaaatcacggtctggaagcgcgccagcagcgcgggctggaagtggttgcgcaggatcgggcgcagcagcgcgtgcaggtcaccttcggtggcgtccggctgctcatccagcagctgcatcaggtgatcgctgccgaggttcgaggtcatcaggataactgtgttacggaagtcgatttcacgcccttcgccatcacgcataaagccgcggtcaaagacctgatagaacaggttcatcacgtcgcggtgcgccttttccacttcatcgagcagcaccacgctgtacggacgcttgcgcacggcttcggtgagaataccgccctggccgtaaccgacatagcccggcggggagcctttcagctgcgacaccgtgtgcggttttcctggtactcggacaggttgatggtgatgagtgacttctcgccaccgtacagcacatccgccagcgccagcgcggtttcggtcttgccgacgccgctcgggccgaccagcagaaagacaccctgcggaccattttctgaggtgaggcctgttttcgccgcacgcaggcgctgagcgatggcggtcagaggaacattctggcctaccactcgctggccaatttcgttttccagggtcagcaggtcggtctgttcgtctttcatcagtgacgacagcggcacgccggtccagtcggcaatcacggtggcaacggtgcgtacgtccacatcaacggaaagcagcgggttgctgtgctgcatgcccttcagctcctgttgcagcgtgcgcgtctcgctacgacgggagatgtcctgccggctttccagcagttgtccggtgagtttcagttcctgaccgtactgggtttgaagctcgtcgagtgcaacgatgagatcgttctcttcctgctcaatggcggtcaggcgttcaccatgactctgagtgccgacggcgatatcttcctgcagcgcctgcttctccatttcaagagaggtaatctgcgagcgaatgcgggtcagctgttccggcacggtgtcgaggctcatgcgcacgcgcgcagcggcggtatccagcaggtcaacggccttgtccggcagctggcgacctgtcaggtagcgacgggacagcgtgaccgcagcgcgcaccgcatcgtcagtgatgtgtacattgtggtgttcggcatagcgggatttgaggccacgcagcatcagacacgccgtctcatcgtccggctcgtccaccaacacccgctggaatcggcgctccagcgcggcatcgcgctcgaagtactgcttgtattcggaccaggttgtcgcagcaatggtgcgcagttcgccgcgagccagcgctggcttcagcaggttggccgcatcggctccgcccacctggttaccggcaccaatgatggtatgcgcttcgtcgataaacagcagaaccggcaccggcgactgctgaaccgcatcgatgacgtttttcaggcgttgttcaaattcacctttcacgcctgcgcccgcctgcaacagaccgaggtcaagggtgcgcaggatgaccggtttgagggattcaggtacgttgccctcggcaatacgcagcgccagaccttcgaccagagccgttttaccgacacccggttcaccgaccagaatcgggttgttcttacgacggcgcgagagaatgtcgaccatctggcggatttcggtatcacggccgaacacggggtcaatcttgccctccttcgctttggcggtgacatccagagtgaatttatccagcgcgttctgcagcgccaggttcagctccccgacgttcagctctgcatcgaccggacggccgacaaattccacgtcaccaccgtggttctgcgccagtccggcttcctgctgcacttccggacgttcatccgactgcccatcaagcagcggacgcatacgttccagctgactctggcccagcgtcagcagcggccacagcccgtcacagcgaaccagtttctgtttgtaaaccagcgccatcagtagatggatgctgcggatttgttcctcgccgttaagggaagcaatcagccaggcttcctgcatcagcgtctgaatggcatcagacaactgtggacgttgacgtactgaacgcggctgtttatccagccaggcaagcaaatcctgccaaagctggtccatatcccactcatagcggcgggccagcaccgtcaggtcaccttccccctgttcgagcagcttcagcagccagtgctccggcaaaatttccgcatgggcgcgggtctggcagagcgacgccgccccttccatcgcacgggcacagtaagggttcagacgtcgcaacaggatggctgggttttccatgaatctctctctttgtcggttcctggacacgctaccgcccatcgctgttcccgttaaggggaccaaagcgcatacggtcaggctggcagtttgtggttttctttgctgaaagcccgcgagctgcagacgttcagcaaaacagcggaaaggtcatccccctccgcttaaaaacgaggattacgctaaagagttcgtgtcgcaggaaggcggcaagttcgtaagtctccgggaacatagataactatgtgaccggagcgagcgaacgcagccaacgcacctgtggcgcgaaatatgacgcgtaatcaggcggtggcgcgttcgttccagctatcggaatgaatgatgttgccgtctttgtaggtccaggtgattttttcgtaacgcagttcaatgcgctcaaggtggttgtgcttctctttggaaggatccttgatgtcatacatttcaggattcactttcaccactttcacgttttccagtttggtgttgaagtactccacttcctggcccgcgtcgttgattttgtaccacctgaattccgcagacttgagggtctgaccggtggtcacagccttgtacaggtacgggctggacgagtcgatttccttggtgaacaggaacggggtgtggatacgggtaccggtcagcttgccggtgttgttgtcagtcgggatgtacaggttatgctcctgagcgacaacttcgatgctgccttcacgatcctgaacgtccacagaccctttaatgtccgcgccgccgtcgtctttcagccaaagataaacaggaattgccatggaattactctccattgtgttgtgatgcgccatcatcctgcgatgacgcctgggtgtggcccggtatctgacaggcattggcctgcggtaccagactgatttcgacacggcggttgagcgcgcgcccatccggggtgtcattggttgcgatcggacggctctcgccatagccctgcaccgcaaaacagctttccggtacatcaccggtatcacgcatccagttgcgcactgcttcggcacgcttgagtgaaagcgtctggttaagttttggattgccggtgttatcggtatgcccggcgaccacaatcagccagcccggcttcgctttgataccgaccagggagttgaccagcattttggtggagccagccttcagcacggatttgccggagtcgaacagcgacatgctgtcgaggcgaatggttttcggacccttaatgattttcttaatgaccgggggaggcggtggaggtggagcccagtcgctgacggcggcctcaacaggtggaaccaggcgcagcccctgatacagccccaggcgataacgcagtggctccccgcgacgctgccagtcgtccagcaatgcgccatcggctcgcaggcgctgctgcgcacgcagtttcggggcagcaggcttatccgccagttggtgatataacgcaaggtgatcgcccacattacgaatgagacgctggttgttcatccaggacgccagcatggcaagtgccaggaaactcccgcccagtaatccggcatagcgccagaacaccattctgcgactgacaccgcgtcggcgcggtaacgctggcagcagcagctcaggcagcggcagtggctctgtcgtcacaacggcatccggtggcagcgccgtcacggaagtaatgtgctgttgccagagattccccgcgataccgctcaccggcaccatgcacatgccctgtacgcaaggcttaatcaccggcagctcgccctggcgtaccgacagcaggtcattcaccgcactgttctgccaggcaagcaggctgtccagccacagaccctgactcagacgagaaagtctcccgtcagatccactctcccgggtccactccgtcaatgacacattgccctgaccgggctgatacacctgaataccgcttcgctggcttactgtggtaaaccagacgggttcggcctccgcgcaggccactgggggcgatacccaggtcacggtccacagcggggggatcgtgccaaatgccgcacggcactggacgacagcccgctgccagccccgaagattctgggtaaaatcatccccggagatgtgctgttcaggtaccaccgccagcatgacggaaatttgcgacgccagggccgggcgcaccaggctcaggtgctgtgccaggattggcagctgttctgcatccttcacccacagataccagccctgccgggtttcccggtgacggaaaccggacacaaacagcggggcgttgtcgccgcagacgaggatcaccgccccctgaaaatcttccggcggcaggttttcatccacaatctcccggacagcggtcgcccgcgccccggaggcccgacgctgacgccagaacatcaccccggacaccagaacaaccagcagactgagcgccgcgcggctgcccgtggacagtggccagaatcccagaatgagccacagcgccagtacggcacccagggcagttaacagacttcggtacgcatcccgcatcgcttacaccggcctgacagtctggctcaccagctcggtaagcgaagacgaaaggaagaaccacagcgccactagggcgacagcggccacaacccatgtcagccagtaccagcgacgatcgctgcgcaggcgtgatacccgggcaacaatgggggcgtcctgtgccagcatgaaggccggcacccgttccgcgagcgcacgaacgatatcttcccgacgctcatcatcctgggcgcgatactgacccacaaagcccagctgcaaagtgcggtacatgcaggtcagaacggcggcgtcaggggcggtttctttcaacaggttgcggatccgttcccacagctcctcaccggcattgagggtaccaaagaagtgggcctgcagcggatcacgacgccacgtcaggtaaccatcatcagtggttccgcgattcatcacgctctcatcaagcagtgcacacagggcatacaccatatggtcacggctgatgtcgctgtaacctgcctccgtgagcgccgttttcgcctcctgcaccagacggcaggcacggcgataaagcccttccccgtcccggacttcctgaccgccccgcagctggctggccatcagccagcccgggtagaaaatacgttctatctggctgagttcggatttattcatgagcgcaggaccgcaaagagttccagatttacatcccccagtgagcgcggggtgtagaaggtgcagctgcccatctcaagcattgcccgtgccgcctccgtactcagatccagcgagaaatactggttctcaagacgtaaagggatagcggccggaacatgggccagcggcttgatagccatcccgctcagggccacattcaccacatccgacacatcgtcaaagctgcccgctttacacagctgcgggaatttcgtctgtagttcatgattcggcatggaggatcgaacggagagatagaagtctgccccttcgcgcaggcgcgcatcgtgcagggcacctttccagatctgatcctgatgctccaggtggatactcaccacccgcgacggcaggctcgcttccagaagcttgtcgagcagtgccagcaacggcggaaatatccgttccggtgcatcgtgctgataagcaggaatatccccggcgtcgtgctcaagtgagaaagtcagcaggctgccggccaggcgggtcagttcgcggtacagcagttccgggtgacgagacggggtctgcaacaattccgtcagtacgggttcagcgctattcagggcgttgagcagccagaacagggagacatcggcgaccgcaaagtcggccatccgctcattactttcacggcgcatggccatcaaacgcttcctgcgtgcctgcaggcgcaccagcaggtcattcagttcggtagtaagccacggactggccacaacggacatcatcggcgggataaaagccgggtcccggctccactgcccctgcgcattacgcaccagacgggctaccggacaggtcaggtatgccgtgttttcctggctggacagacgcagggtcagcgcatgacgcaggatcgcgagttccccgctttcatggccggccagttcctgcacgacgatacgctccgctttccagcggcgcggccgctcactgtcctgaccgttatcgaggttgccaccgccggcgctcagcagtggcagcgcgacaaccacgtcaacagcctcactgccggcggcaacagacaaatcacagaccggaggaagcgtgtctgccaggtcggtatcaacaagggtcccgtcctgaaagcgcaccaccagacgtgttgcattcaggcgcgagagcgcaagcactgcatcatcaaattctgccgcaaccacgccccagggatgagaaatacccatccgggcgaccatgtctgcaacacgttcattccaacgggcctgctgctggaattgttgcggggccagagcggccccatcttcccaaagtgggcggtaaattttcatccctgctctccctcgcctcaggatttagctttcggcatctgggaaaccagcgacagattgacgtccatcccttccacctggaagtgcggcacggcatagagcttcacacggaagaaacccgggttgtcctcgatatcctccaccgtcactttcgcgtcgcgcagcgggtgagaagcctgcagctcgtcgcccggatcggtcatttcagtcaccagactacgaacccaggtgttcagctcaagctccagcagacgacggtccttggtggtcccgatattttcccgctgtataagcttcaggtagtgggcaatacgcgacagcaggaagatgtacggcagacgcgcattgatgcggctgttggctgtcgcatctgcggtgtcatacagggctggtttctgggtcgagttcgccgagaagaagcacgcgtagtcgcggtttttgtagtaggagagcggaatgaagccgaggttggcgaattcaaattcgcgggtttccgggatcatcacttcagaggggattttcacctgattgccggtgccgaggtcatacaggtggataggcagatcctgaacggcaccaccggcctgcgggccacggatttgcacacaccagccgttattgataaagctgcgcaccatgttggatgcaaaggcgaaggatgcgttggcccagaggtatttgtcgtgatccgggcctttcacttcttcaacatagttgaagctgcgcacgggtacggtatccgggccatacggcaggcggcccagcacacgcggcatcaccagaccgatatagcgggaatcatccgtctcacgaaacgatttccacttgatgtactcggcacggtcaaagtagttaccgatatcttttatagccgccacttcctccatcgaatccttgaggaaaaatttagggccggcggagccgataaacggcatatgcgcagcagcagagactttagagatgttgcgcagaagcgttacatcctgagcggaagcatcaaactcgtaggcggaaatcagcgcggcaatcggctctccacccggggtgtcatactcatcaatataggtatgtttatacagtccgctctggataatttccgggcagtcttcgaagtcctgtcgcaggtcttctttggacatatccagcagttcaaccttcacgtttctgacggaaatcggttttatcgaccagggatttcacgccgcgccacagactttctaccgcctggaagtcctcatggtgcatgacagcatcaagctgacggctaatctggtagtccagctcagcgatatgatggtcaatcaggtttttgtcgagtttttcaacttttgagcccgcttttgtcaggcactccaggaacacctgcatcccggccgttaaacgctcatccgcagtcgcatccgacatcgcctgcgcatcctgccagatatccagtgcactgagttcggagaccgggttcagattgatttttttaaacagagacgcataaaccccaccagcggccggacgttccagcaccacactctcgccacccgcggcattctcattttttacagacatcaacatcttccttattaatccgttaaaacatcctgaccgttatggctgtttaggggccagagcagacaactcagatctgagttctgcgcttaatgccgggtcgagcagaattttttcaagctctttccggaaagcctgattgtccagcaggttagcttttaaatcgcgaagcagattacgcatggaaagcatcgccttcagctgagggatctgccgggaaacctgctcaggggtgaaatccttcatgctctggaatgtcagattgatattgtcttcgctaccgtcaccggcaagcgtgtttttaacggtgagatttacttttggggaatattcggaaagtactgagtcaaagttatttttgttcagattaacttttttgcgttcagagagtggcgcggactcctgaccattactgaagtcgcccgccaccagtaatttcagggggagttcggttttcttgctcgccccgcccgtatgcaaatcaagttttaaattgatacgtgcctcgggtatttcggactgaaaggaagagttagacatggctgtccctgttctatggagtgatagaaaccgccacagccagtgtcaaatattaagaatggcttaccctgccataaaacattcctgctattaaacattcaatgaaaagcaggacctgcggtcagaagcgagtacattccatttactggcgatatgacgcgatgaaagagcgtaaatcctgaatttatttttcagataaacacccatggcgcgagtttagaaatagtgggtcagctaaaggaaatgataatatgtaaccatatgtaacaaagtaatcttgccagaaaatatcttatactgatctgatatataagatttttcttaagattgcggctgtagggcgcatgatagctgggactaaaaaatgtttcagtgaatagttcattgcgggattgagcagagaaattacccaatgctaaaaagtgcggttcatgctttttttacaggatagcggcagaaagtgaaaacgagaaccagcccaaacgggttagtttttataataagttatgttaatgatttgtggcactgttatacgctgctaatgtgcctgttgccgctaagaagttcatcgactttcccgacgacacgccgagggcgtcataccataaacctgccggaaacgatggctgaagtgggctgaagagtggtaaccacactgaagggcaatatcggtcagcgtaagatcgggccgctcaagcaacatccttgcacgatccatacgacggcgcatcacgaactggtgtggtgcctcgccagtggtatgacgaaacattctggcaaagtgaaactcactcaatgccgcttcctgcgccagcacagacagggttaaaggctgatcgagatgggtttcaataaattccagaacccgccgtaatacagcgggagccagtccaccccgcacctggggcagttgccacttaacttcgctgtagtgctgcagcagatgggtcagcaagagtgttgatgcgctgctcagcgtcagctggctggcgggctgttgccagtcgctgctcagcagaaagtgtcgatagagctgggtaatgcggtcatcaacagaaaagattttctcatgcaggtttaactgcgccggactgcggtcccagacccgttcggccagttgccgcagctggttctcgctgcaatagagatgaacaaaggcgagatcggcacgcagatcccaggttgattccgtgcctgccggcatcagacagaagcggtccggtgcgccaccgttacgccagccattcggagttttatgccaggtatcgtagccgcccgccacgtaaaggctcagcgtgtgatggtcgctgaggtttgtcacgcgatcgccactattaaaccaggctgccagctgaatgccgctgtgaagctgcacctgatcgcgcagttgtgctttgtgtcgttgcagcatgtcaaaggtctggaagcgactcatcggggtatcagttcagataaacagagtgccagtttacggattgcgcgggacagaaaacagagcacatcgggacagagagtaaaaatgcgcaagattttgcaaaccctgcgcaatccgctgcaagaccaaagagcgttgcgggcgcagactcggcgttttgcggtggagaatctggtaatgaacctgtttttgtatctctcagtcgtgctgatctggggcacgacctggatagcgatttatgcgcaacagtctgcaggcatcagcgccgtaaccgtcgctgtcttctggcgttttttgctggcctcgctggtcatgttattactgcttaagctgataaagcgtctgcacaggctgacgctgcaggatcacctcttctgtgtgctgcagggctgttgcgtttttggcttcaactttgtctgcttctattacgcctctggctatatcagcagcggactggagtcggtcattttctctatggcggtgatgtataacgccattaatagctggatatttttccgtcagcgcccttccgcacgtcttattccggcgatagtgctcggcatggcgggcattgttgcgttgttctggcacgatctgcgcagcactcaggcctcggccggcttgatgtggggcattgggttaagtgcgctgggcacactgggattttcattcggcaatatgatcagtcagcggcatcagcgtctgcaacgtgacgtgctgacaaccaacagttacggcatgttatacggtgcgctgatcatggcactggtctcgctgctgcagggtgtttcgctgcagccgacatggaatacacagtggtttggggcattgatctatctggctatcgtgggatcggtgatgggattcggggcctattttacgctggtgggacgcatcggagccagtcgggctgcctatacaaccgttctgtttccgctggtggcgctggcactctctacccgttatgaaggatatgagtggcatgccagcgccatccctggccttgtcatgattttactgggcaatatcgtgatgtttgcccgttggccggcaagtcgtcgccggataatcatctgacgcggaggcgggctgaggcccgcgtccggatgggcgttatgcccactgctgctgaaggagtttctgtggtttattgatcgctttacgcgcaatccagtagagcagaacacgctcatcgtcactatcacgatcggccatcgacagcagttttaatgccagtgtcgatttggtcacaggctgttgttctgtactgagttcaatcaccgcctgaccgataatgcagcaaacttcatcctcactggtgctggattcatatgtccggtctttcatatttcctcctgataagtgaactcttagcctggcaaataatctgtaaacctgctcacagaatcatctgattgaaacattatcttacggctaattacgcttacttattaagttgccgctttgcttacttttgacgcgacgttgccaaccccctccgatgccattcataccgcctgaatggcatttcattccccgatccgttccgttcatgcctttactgcccacgcgcgcgaatcactgctttattctgaccgcagtttccagattcccggacgggagagataaattatgaaccagactcaacaggcttcttaccagcgtgctcgctggcttacattgttcggaacggtaatcactcagttcgcactggggtcagtctacacgtggagtttgttcaacggtcagctgtcacagaagctggatgcaacagtcagtcaggtcgctttttcgtttggtctgctgagtctggggctggctattgcctcctcgctggccggtaaattacaggaacgttttggcgtacgccgcgtcactatcggggcgggtgtgctgatggcgctgggtttctggcttaccgcgcatgctaataacctgatgatgctctatttcagcgccgggctgctggtgggtctggcggatggcgcaggttacctgatgacgctctcaaactgcgtgaagtggtttccggagcgcaaagggatgatctctgcctgtgcgattggcgcttacggtctgggcagtctgggattcaaatttatctgcggggcgctgctggcgacggtgggtctggagcagacctttatgatctggggcgtgctcgcgatgtcgatgattatcctcggtgcactgctgatgcgtgatgccccccttcaggataccgggagcagcacgaatggtcagcaacatgcgcgggattacacgctggcacagtcggtgcgtctgcctcagtactggatgctggcgctgatgttcctgacagcctgcatgagcggtctctatgtgataggcgttgccaaagatatcggcgaagggctggtgcatctgactacgcagactgctgccagtgcagtaacggtgattgcgattgccaacctgagtggtcgtctggtgctgggcatactgtctgacaaaatgatgcgcatccgggttatttcactggcgcaaatcgtgtcgctgatcgggatgagcgtgctgctgtttacccgaatgaatgagatcactttcttcctgtcactcgcctgtgtagccttcagctttggcggtaccatcacggtattcccgtcgctggtcagtgactttttcggcctcaacaacctgacaaaaaactatggtctgctctatctcggatttggtatcggtagtgtgctgggctcactggtcgcctcgctgtttggcgggttcaccgtcaccttcagcctgattatgacgctgctggtcatctccctgttcctgtcactcaccatccgcttaccacagagttctgttacagcaacacctgtattgcaacgtcattaaccatcacgacgggccgcgccagagcggcccgttcacgtttagccgcggaatcgcggctctgccatgcccgccaccgagacgtccaccgcaaagatatcgcctgactgcggatagcgtgccagctcctcttcggtgcgatcttcccgtgaactggtaataaacagcgttttaagatcggcgccaccaaaggccaccatggttggccacttcaccggcagcaggatctcatcgacgatttcgctgctctggggatcgatgcgtactacgcgtccgccatcaaactgtgcggaccagtaaaatccttcgctatccactgcggcaccatccggcaatccacctttagcgtcgaaacggcggaacagagtgcgttcgcccggttcgccctgcgcatttaatggatagcgatagagcgcttcattcggcgtgtcactgtgatacatccagcgctggtcgggagagaaggccagcccgttggaaattttaatgtctcgcgctttgacctccagcttcaggtcaggcgtcacgcggcacagcagcccgccatttttgtcctgcggttcccacaggctgccgcaccagaaattcccccagggatcgacgcggccatcattaaatcggctttgcgcagcctcaccgggattttctgcgatctttttctctggcttaccctgcgcatccagcagccagacaccgccacgcaatgcagctatcagaccgccctgctcacgcagaccgatgcatcccacctcttccgcctgcgggaaggtttgcagttcaccgctgaccggatcaaaacggtgaatggcgggtgccagaatatcgacacagtacagcacctgttcttccactgaccagagcgggcattcgcccagttcagcctgtaaagccagaatatttttaacgtcatgcgccatgtttctctcccattgaactgacatgctaataatgtagttgtaaaaactttcaaatgagaattattttcgcttgattttgagactattctctttgatagtatttactattcagttcattcttatttctttattattctccgctgcaaaacgcagcactctgaaatattccgtcataccttcttaaataactctacaaagcctgcatcttcactccacttttccagcgtagtgtcatagtcattggaaaagaggagaagcttccgatgaagagattaattaaagtcgcttcggtggttgcgctgatgaccttattaagtggttgtatcatcagccccagacacgacaatggctggcaccgcgggggtggcggcggatatcatggaggctactatggaggttatcacggtgggtatcatggcggtcaccatcgccgctaacgggcaaagatgtcacacagcataaaataaaagcattaaactttaagggcgggataattatcccgcccgttttatttagctttttacagcataattacactggaaccacgctttctgcagtcccggaatatgactctcctgcgcaggtaacgcctcgactttatcaaagcctttattactgcagtaattcgccagatcaatattcattgcatcacgattgacctttaccgggtcaaaacggtactgcacggtatttgagcctggatcttcatctacacgttcaaatgccccgggtttgctggcagtacatccactcagcaaaatcagcgccagtgcgccggttattagttttttcattaagttatcctcacgttgccgcgcagtttatgacgcagcatgccgcgcatccataggattaatgcgcgaaagttcaaaacttgagaagcttttaccgattaatgtaatacgattaaacggctatcactatcatgcacggcgtgacaagatgcattcagacaaaacgaagactgcaccacaccaggaaatgccaaaaataaaaatctgttcctctcttccctgcccgcgcttagcgggctttttttcgcccgccattccgctgctccgctgccgcttactggccagtcagtgcaatcattctacgtaacaggttagcagcgcgcttgtcaggtaatgccagaatcgcgctgtagagatcaatcgacatggcacacagcgatgagcgatcaaccgccgtgtcggcaggcatattcagctgctgcagcttatccccccactgctgatagagccgggcgacaattttttgcagatcatcctgcgccagcgccttatccagtggctgatcgggcagtggactgttcagcagcaactgctccatggcatccgcctctttgcgattcagcgacggcggcagcgtggtcagcagattgatgccgccactcacctgcggatagagataacggaagcagaggcccggatcgatttggttcagcgcccgcatctcttcaactgagacgctgatatagttgaccaccgccgcgtcagttccgcgcatcagccgctgattaatcacctcaatcagccagccacgtagctcgcccgtcgccttctcagccggctcccccgcacggatgcgccgggtcagctcctgggtcagcaacagccataacgccggtttcctgagtctgcagcacccgataaccgggcatctttgccagttgatttaccgcctgctcacgctgactggcctgcaactgatgcggcgcaacccagctgaaccagagcagattcgccagtatcaggggcagcagaaagatgatcagcccctgccacaaacgcagccgggtggttttgatcagcacaataacaatcagcgccagcagcgcaaacgcggccagcgtaataaaaagcagagcattcatgcggcgggattaatccttacgcacatcgatcagcacaggacagtgagcgcgctcaataaccgatgcgctgaccgagccttttaacagccgattcaaagaggagagatggcgacgtcccatgataatcatgctggccttgagctgttgcgactgggcaacgatagtatctgccgcgtcacccgccagaatcatgccccgcgcattaatccccgcgcgcaataacggagccagtgcatggcgcaccaccatttctgccgtattctgctcatcctgcgcggccacaaaatcggccggatcttcacccgcatcgatttccattggctgattacaggaggagtaagcgggatcgacgcagcacagcacgaccacatcggcgcgatgcgccagcgcttcttcaatggttaaggcgaccactttttccgctaccggagagtgatcaatggccatcagcagggttttcatcgaatgcttatccttctatcgcggcgactttgccgatttcacgcaccagtgcctctttacacttcagcatctcgtcacgaaaacgggcttcgtgtcgcagaaaacgtgcagagggcaccagcaaagagacagaaaagcgaccaaacagcgtatccagcgcaaacgccatggtagagataccttccagcgtttcaccgcgatccacggcgataccggtttcgcgcacttccctgataagttgcagcaactgaggcagcgttttcaccgtcatatcggttaactcctgccaggcgtcgccaacgatcgtccgtacatctttttcacactccagcgccagcaacgcccgtccaccggaggtgctgtagagcggcagattgagtcccatatgcggaaccacccgaagctcacgcgacgccaccacgtggtgaataatcgccagctgactgccgctggcgcgcgccagcgagacggtttcattggtgtcggaagagagtttttccagcagcggactgaccagatcaaccacatcggtatgtacgctggagatcagttttaacagcgccggccccagacgcaatccgcccgccccgctgctgcgcaccagctctgcgctgtcgagcgcggcaacaatacgctgcaccgttgagcgcggcagttcgaccgcctgagcgatctcaccgaggctcatgccgccgggctgttcgccaagcgcattaagaatttttgccgcacgggcgatgacctgtataccgcccgttttttcatcctcgcggctggagggttgatgtgccatagcgtcgtcctgtttgagctgccttactgtagcgcgaatgccgcactttttacagcctgtaccacattgcaatacagtataccgggatgtaatattacgacctgtatcacatcgcagtacactgcatcataataacgagatcgcctgcaatgaacgctaagcctgccaccgcgccggcccctcatccttttacactgcgactggcactgggattagtcggcgtgctcatcgccgccctgacctccgggctgaacgatcgcgtcagtgatatcgcgctggccgatatccgtgccgcgattggcatcagttacgatcagggtagctggattatctctggctatcaggcggcagaagtagccgccatgatgattgcgccctggtttgccgtcaccctgtcgctgcggcgttttacgttaggcgtgtcggcgggatttatgctgactggcattctgctgccgctggtgcgggatccgacgctgtttatcagcctgcgcgtattgcagggcctgtttggcggcgccttaccgccaatgctgatgacggtcgccctgcgctttctgccgccgccctttaaactttttggcctggcgggctatgccctgaccgcgacgtttggccccaatatggcggcctcgctggcctcgttgtggaccgatcacgtcagctggatgatggtgttctggcaggtcgtgccgttgatgctgatcgctatgctgctgacaggatggggattgccccaggatccgctgcgaccggaacgctttcagcagatcgatctgttcggcatggtgactggctgcagtggtgttgcgctgctgattctggtgctgacccagggtgagcgcctcgactggctgaactcgccactgattaccggtatgttgctcaccgcgctgccgctgctgctggttttcctgattaatgagtggtttcacccgctgccgctgtttaaattgcagatgctccgacggccaaatctggcgcatggcttgctgggcctggcctgcgtgctcatccttgggctttctggctccgcgctgccttcggcctattttgctcaggtcagcggctttcgcacccttgagtttgccccgctggcgctggcggtgggcctgccgcagctgctgatcgcaccgctgattgcggccctgctgaatatccgctggatcgactgccgctggatgctgacggcgggcgtcggcctgctgctgacctcctgtctgctgggcacacagatcaccagtgactgggcgagacagaacttctggctgctgcagatcctgcaggcgttcggacaaccgatgatcattttgccgatactgatgagcgccaccagcgttgtggccccgccagaaggcccgtttgcctcggcgatgtttaatacggtgcgcggcttttccagcatcgctgcctctacgctggttgaggttttcctttcgcatcgtgagcagtttcactccagtgtgctgattaatcaggcggccagtcgcagctggctgatgacagcgccgacggccagtcaggccagcagcagcttgccgctgttgccggatggcagcatcagcgccgccgataatctcagcggattcgctaccctggtcaggcatcaggccacgatccttggtctgagcgacagctggctgatgctgaccggctttgccgcctgcctgttattgcttaccgccatcctgccaaaacgggtgtggccgcctcaaactttgattcaaaacccttcccggaataactgaatatgcgtgctttcgaaatgaaaagaaccctgctgctgagtctgttgctgctggtgttactggccatcgcttttgtggtctggtcactgatgaccggcaacgatcaccgcaccaacgacgcttacgtcaatgcggactacaccctggtggcaccgaaagtctcgggctacatcagccacgtgcaggtgcaggataatcagcaggtcaaagcgggtcagctgctggcgacgctggacgatcgtgactatcgtgtggcactggaaagtgcggaggctgacctgcaggtgagccaggcgaaactgctgagcagccaggcacagctggagcagcagcagtcggtgattgatcagcagaaagccagcgtggcggccagtgaagcctctgcacagtatgccggtcagagcgccgatcgttataaccgcctctataaaagcggtaccgtggcagccgacgatcagcagaaagccagctcaaaccagcgctcggcgctggcagccgtgcatcagagtcaggccgcgctggcgtcagcagtaaaacaggtgggagtgctacaggcggcggtgcgttcagcagaagcagacgttgcagcggcgaaggccagcgtcgatcaggccaggctgaatctctcctacacccgcattactgcgcccgttgacggcatggtaggtcagcgctcggtgcggaccggcgcgtacgtatcagccggcacccgtctgctggcggtggtgccactgcagcaaacctacataaccgctaactatcttgagacgcagttaagcgatgtgcgtcccggccagcgggtgcggatccgggtggacgccctgccgggcgagacctttaccggtcatgtggacagcatcgcaccggccaccggcgcaactttttcggcgatctctcccgataacgccaccggcaactacactaaagtcgttcaacgtctgccggtgaaaattgtgctggatggcgaccaacagcatctggctcagttacgtgtaggcatgtcggcgatccctgaaatcgaagtgccttaaaattgtgagcaatatctcagaacggacctatttcatttggggaggattacgcgtaaattagcgctcgatcctgttctgagttattcagatcaacccggaagagagcagaccatgactgtaaatggcgatctcttttccacatctgttcgcgttgcactggtttgggatcgccatcatcgtaaccgctcagaggagttgctttgtgaaatatgccttgatgggaatatcttttttcgcgttactttggttcggaacctttgttctgctgctgaagtaatggcgtgacagtgcagccacggggcgacccctgagtcgcccctgctggctgtcagcgttcttcttccatttttatgctgcctggcaatatgccatcggcacgaaacatcgctttaattccccgtaccgcctgacgaatacgatcgctgtttctctatcagcgcaaaacgcacgtgcgtgtcgccatagtcgccaaaaccaataccgggcgagacacagactttcgcctcctgcagcagttgcttagcgaactccagcgacccaagatgtgcgtaatgatccggtatttttgcccagacgtacattgaggctttcgggttatccaccatccagcccgcttcatgcaatcctttgaccagcacatcacggcggcgtttgtactgctctgcgatgtcgcgcacgcactgttgatccccttccagcgccgcaatcgccgccacctgcagtggcgtaaaggtgccgtagtcatgataacttttgattcgcgccagcgcggcgaccagctctttgttgcccaccatgaaaccgatacgccagcccgccatgttgtagctttttgacagggtaaagaattcgacggcgacatcacgcgcgcccggcacctgcataatcgatggcgctttccagccatcgtaaacgatgtcggcataggccagatcgtggatcaccagcacgttgtactgcttcgccagcgcaatcacccgttcgaaaaagtcgagctccacacactgtgcggtggggttggacgggaagccaaggatcatcatttttggcttgggatagctctcgcgaatggcgcgttccagctcattgaagaagtcgacacccgccaccagcggcaccgagcgtacctgcgccccggcaatcaccgcaccgtagatatggatcggatagctgggattgggcaccagcacggtatcaccgtgatccagcgtcgccagcatcaggtgcgccagcccctctttggaaccgatggtgacaatcgcctctgattcaggatcgatctcaacctgatagcgatcggtgtaccagcgcgagatcgcccggcgcaggcgcggaataccgcgagaagtggaataaccgtgggtatcgtcacgctgcgccacctggcataatttttcgacgatgtgcggcggagtcgggccatccgggttgcccattgaaaagtcgatgatatcttcgccgcgccgacgcgcagccatcttcagttcagcggtgatgttgaaaacgtaagggggtaaacgttcgatacgcgagaaacgacggggtgtgctgttatcagccatgatgtcctctggattacgtaagcgcccggaccgtccgagcgacgcgggtcactgtggtgacccgttacgaacataacgtggcgaggatcattttgtcgagggtggcggaaaatatttttatttttgcggattcagccgccccagcagccaatcgttcacccagcagccgttcagcagataattatcccgtagcgtgccctcaagctgaaagccgtttttctccagaatacggcgtgacgcccagtttcccttcaatcaccatcgctttgagtttgtggaaatcggcttcaagcaaaaactgacacagcgccgccagggcttcgctgccatatccctgaccgcagtggcgatgcagcagcatatagcccacctccgcctgacggtatggctcccattcggggctgcagccaaacaggccaatcggctcaccgttgtcacgacgtcgcgcaaccaggcagagcatatgaaaactgctcgcctgccagggggccagacgctcggtgaagcgctggcggatatccgcttcatcggggatttcgctcacccaggtcatggtgttgcgatcttcatggacggcacgaaacagttgccagtcttctggctgtaatttactcagggttaatctggcggtgacaagttgcatctgatgctcccgatgggcgcggttttccagcggtcactggcgcacctcatcgcgcaacatagcaaaacggcaccttagcgaccagcctctgcagggcgaaaaaactgttcccctttaatgcactcaacctttcctctttttgcagatatgccgtaaaaattgatctgaaacactaactcccgccgtgattgatcgggacgctagcggttcgcgatcacattttttatcatagaggcactttccattgccgacgagtcgcctgtgtcctcccacttcacgatgttactggcagtatttgaccgcgccgccctgatgctgatctgcctgttctttctgacacgcacccgcccgtttcgtcagctgctgcaaaaagatgaacacacccgtgcggagaaagtggcggttactgccatcttttccctgtttgcgctgttcagtacctggtcgggtgtcgatgtcgatggttcactgctgaatgtgcgggtcatcgccgtgatggcgggtggcattctctttggcccctgggtcgggatcgccaccggggttattgccggtctgcaccgttttctgatcgatattcacggcgtaacctccgtgccctgcctgattacaagcatcattgccggtatcgttgcgggcggtattaatcgccgggtactgaaagagcaccgctggcgtgccggtatcgtcggcggcatgctctgtgaagccctgacgatgttgttgattgttgtgtgggcgcgccccacctcactcgggctggcgattgtgtcggaaattgccctgccgatgatcctcggtgcctccagtatcggtatcattgtgctgctggtgcagagcgttgagggtgagaaagaggcgattgctgcccgccaggccaagctggcgctggagatcgccaataaaaccctgccgctgtttccgtcaggtgaacagcgactcgctgcgcaacatctgtgacattatccgacgggagatcaaagccgatgcggtggcgatgaccgataaaaaacagattctggcctacgtcggctatggcgaacacaattataaacatggggatgatggcatcagccccaccacggcgcagtcgatcgccagcggtaaaattatcattaagaacaacgatgaagcgcatcgcaccaaagatattcactccatgatcgtgatcccgctgtgggagaaaggcaaagtcaccggcacgctgaaaatctactatcgccgcgcacaccgtattaccggctcgctgaaggagatggcgatcggcctgtcacaaatcatctcaacccagcttgaagtatcgcgtgccgagcagttgcgcgagatggctaataaagcggaacttcgtgcgctgcaaagtaaaataaatcctcatttcctgttcaacgccctgaatgctatctcctcttctatccggctcaatcccgataccgcccgccagctggtgatcaacctgtcacgctatctgcgctacaacctggaactgaacgacgatgagctaatcgacatccgtaaagagctgtggcaggtgaaagattacatcgccatcgagcaggcccggtttggcgataagctgacgatgatctatgacgtcgatgaggatctccattttctgctgccgagtctgctgatccagcctctggtggagaatgccattgtccatggcatccagccctgtaaaggcaaaggcgtggtgacgctgagcgtccgggatctgggcgatcaggtgcggatctcggtgcgggataccggccagggcatcagtgacgaagtgatagcacgggtggcacgcaacgagatgcccggtaataaaatcggcctgctcaatgtgcatcatcgggtaaaacttttgtcgggtcagggattgaatatcgtgcggcatcagccgggcaccgagatttcctttacgctgagtaagaatggccagcgcctggcggagaatctgttatgaaagccattattgtggaagatgaattcctggcgcagcaggagctgagctggatgattcagcatcacagcaaaatcgagatcgaagcctgttttgacgatggtctggacgtgctgaagtacctgcaacagcatcgggttgatgtgattttcctcgatatcaacatcccctcactggatggcatgctgctggcacagaatatccatcagtttgcccacaagccactgattgtctttattaccgcgtggaaagagcatgcggtagaagcgtttgagctggaggcgtttgactacattctcaagccctatcaggagtcgcggattgttaccatgctgaacaagctcgaagccacagcgcaggcgcagcaggcggtcagccatctcagcgccacgcccgcgccgcagacagtcaacctgatcaaagatgagcgcattatcgtcactgccgtgaatgatatttactacgttgaggcgcatgagaagctgacctttgtttatacccggcgcgaatcctacgtgatgtcgatgaatattaccgagttctgttcacgcctgccggaacagcaatttttccgctgccaccgctctttctgcgtcagcctcagcaagattcgtgaaatcgagccgtggtttaacaacacctatctgctgaagctgcgcgatctggagtttcaggtgccggtcagccgcagtaaggtgaagcagtttcgacagctgatgcgcctgtagcgcaggagggttaaaggcctgttcagaaaggggggtggcgaagcaggagagcagcagcaaaaaatccgggggttttcccgatcctgccccgctgaagcaggcgatcgggaaaatcgctcgcgcgcagaatggcagtgcgcgcgaggtaaagcagaatcagatttcgcgacccagcgtctggcgcagatgcgcgcccgcgcccagcaggccaggctggtcgtgcgtaatcatataaaccgggatgctggcaacatagtcgcggaagcggcctttatcttcaaacgccgcacggaaacccgacgacttaaagaaactccaggaagcgtggcacgatgccaccggcaatatagacaccaccaaaggtgccaagattcagcgccaggttgccgccgaaacggcccatgatgacgcagaacattgacagcgcgcgacggcagtcggtgcagctgtcatccagcgcacgctggctgacatctttcggcttcaggttttccggcacgcgattatccactttaacaatcgcacgatagaggttaaccagaccggcacctgacagcacacgttccgctgaaacatggcccagctcttcgcgcagcacttccaggatctgatcttcttcttcgctgttggcagcgaagtcgacatgaccgccctcacctggcaggctgacccagcgcttgtccacatgcaccagatggctgacgcctaatccggtgccggcaccataaatcgcgataggtttatctttgactggctctgtaccgccaaactgaatcacgttttcggcggtcagcatcgggatcgccatagataccgcagtgaagtcgttaatgatttccaggtgttcaaaaccgatgttctctttgagcttgcgcgtggaaaacgcccagtcatggttggtcatttcaacccagtcatcggtaatcgggcaggcaatggcaatacagccatctttaacgtcctgctgttgttcatcaagatagtggcggatgacggcttcgaggctgtcgtattctgatgttgagaatgttttggcctgggtgatgctgccgctttccacctcacacagggcgaggcgtgcgttagtaccgccgacatcgccgaccaaggcataggttgtcattcttctgttgctccgcttggggtcttaagagttggaggacactataaaattctgcccataaaacaacaacgctcaccggtgcgattggtgagcgtcttactcaggtgtgctacagcctaaccgcgatagtccaccctgcacagcggcaactatctgaatcttagccgccgttgcgttgattcaggcaggcggtgacttttcgtagcagtggcggcaaatcctctttctgcatgacgacttcaaccagagagagccacttcggctctgagagtcgcgccatcacttcctctaactgcaccgtttcactgatacgccagctctgcgcctggccctgcaggctaagggcgtgcggtaaggccgtccagttccactgggcaatatcattgtaacgttgtgttgcgccgtgaatcgcccgttcgacggtatagccttcattattcagcaaaaagagtatcagtcgctgctggtcacgcagcatcgaacccagttcctgaattgtcagctgcgccgaaccgtctccgatgatcaggataacccggcgatcaggatcggcagtctgcgcgccaaatgctgccggaagagtatagccgattgatccccataatggctgaaccaccagctgcgcctgcgagggcaatcttaacgcggcggccccaaaggcggctgtcccctgctcggccagaataaggtcgccgggttgcaggaatgcctgcatagcctgccagaaaacgcctgctggctgatcaccgccgccggttctgcaggctgcgcggcgggcggcgtggcgccgggttgccactgctggccatagcgttcaaacagcggcagcagctcgctcagcgcatccgccatcgacagcggcgcaaaattttcaccgcccacgctggcgctgaggggctgcagatcaatcagtcgctcagggttaaactgctgcgtgaagccagcagtaatggtgtcggtaaatcgcaccccgacgcagatcgccacatccacctgctcgatctgttcgcacacctgccctgcgctggcctcaccggcataggtaccgacgtaacccggctgctgttcatccagaacccccttgcccatcagcaggctggcacagggaatcgtacgctgttcacgcagcgcggccagtgcggactgctgctgccagcgcagcgcaagaaaatcggccagcagtgaaacccgctgcgccggtgccagcaaacgttccgccgcgtcgctgaaagcgcgacgcgcagcgggcgaagaggattgatgactgttcaggggctgcgcgggtggctgcacctccatggctgccacgtcgacggccatcgacaaatagccgggacgacgggcctgcagcgcactgacgatcacccgatcaatctcagccgtggcgttgtcggcggtaagctgtgccgttgccgcactgacttctgtggccatgcgaataaaatgctggaaatcgccatcgcccagcgaatgatgaacacaatccccctgcaactgggcctgcgtcgcaggcgcgccaacgatatggatcaccggcagatactcggcataactgcccgcaatgccattaatcgcgctgagctcgcccacaccaaacgtggtcaatagcgctcccgcgccgttgcagcgtgcataaccgtctgccgcataggctgcgttaagctcattagcgcagcctacccagctgatggccggatgggcgatgacgtggtcaagaaattgcaggttatagtcgcccggcacgccaaacagatgctttacaccaatctcctgcagacgggtcagcaggtaatctccaacagtaaaagtggacattgcgcattcctttcagggatgagtcgggttaagtatctgacagaggatgaaattagcgaggcgtgccgctattttagccagccgcaatggctggaaaggcgacgttacgctggcggaatattctgtaaaaatgcgaattgcagcgcgctgtcactgagtgtaaccgtatacactgatagacttttggcacatatccccgtttttacccaggagcgctgaatgtcccttttccctcatcccgatcgctatcaacagatggaatatcgccgcagcggccgcagcggaatcaaactgcccgccatttcgctgggactgtggcataactttggtgacagtacccgggtcgataacagccgtgagctgctgcgtcatgcgtttgaccttggcatcacgcacttcgacttagccaacaattacggtcccccccctggctcagcagaagagaacttcgggcgtattctgcgggaagattttcgtgcccatcgtgatgagctgatcatctccactaaagcgggctataccatgtggcaggggccttatggggattggggttcgcgtaaatatctggtcgccagtctggatcagagcctgaagcgaatggggctggagtatgtggatattttctatcatcaccgtcccgatccggaaaccccgctggaagagacgatgcgcgcgctggatcatgtggtgcgccagggcaaagcgctttacgctgccctttcaaactatccggccgatctcgccgccgaagcgatagctatcctgcgcgatctcggcaccccttgtctgattcaccagccgcgctattcgatgtttgaacgcacacctgagcaaggattgattcagacgctgggcgatgcgggcgtcggctgtatcgccttctctccgctggcaggcggcgtgctcaccgatcgctatctgcagggcattccggaagattcgcgcgcggccagcggcagcaagtttcctgaatgagaaccagctgacggatgagaagatggagaaggtccgcaagcttaatgctattgcgcagcagcgcgaacagaagctggcgcagatggcgctggcgtgggtgctgcgcgatgagcgtgtgacttcagtactgatcggagccagcaaaacagcccagatcgatgacgcggtggcgatgctcgctcgccgtcagttcagcgacagcgagttagctgcgattgacgcggcactactgtaacggttttagcgcccggctgacgccgggcgttttctgcgccagaatagtctcaaacccctttctctccccaatttcctcacaatcttccgacacaatgatgcggtaacaacagcaatacgcaggcataatcgctgcgccgcaacagcgtcagactgttgatgaggagaagaaaatgaaaagagcccttatttttgctgccctgctggccctgttgtcgccgctggcacaccacacagcccaggcctccagtgcctctattactctggcccccggcgtcaccctgaatcttggcgatcgcgatcgccgtggctattactgggatggtggtcgctggcgtgaaccgcgctggtggaacgaccgctattcttacaacgaacgccgctggtggcgacacgaagagtggcgtcgtcagcagcagtgggagcgcgaacgccgctggcatgagcgcgaccgtgagcgtcgctggcatgagcgcgaccgtgagcgtcgctgggaacatcagtatcgccgcgatcgtgatcgtggctgggatcatcatgaccgtcgtgggcctgaccatcgcggtccagaccatcacggacacgatcgccattaataaaaacgcccggcagaaccgggcgcttttatttattgattaggtcaggcctgattgctgccagacggagccagcacaggaaacccggtcagatcggaaagacgcaaaagatgtcatccctgacatgctcggcccgcgcgattacgcacctcatccctgaggtgcgcccgtagccgggccaacgcgttgcgttgttcaaaaacgctcccggcgtttttgtccctggcgcgggacgctttcctcctctgaccggattccctgtgctttaagctaattcgcggctgaaagatatctgacttgagtttgtcagttgtctgcaatgcccggcatagccgggcgttttcttgtttaccataaccgctacagccccagcgcttcacccaccagcaggtaaagattcagcgtaatcaccagcagcacgatcagtcgcccggtattctgcatcagacgcgagttaaccatatcatcgcccatcagctcgcggttgccggtaaaggagagcagcggaatcaacgccagcgcaataccgaaactcagcagcacctgactcatcaccagcacccttgtcgggtcccagcctgcccagatgacaataaaggagggcagcatggtgacggtttcggcgcacccacaggggaatatggaagtggataaagccctgcatcaccacctgccccgccagcgtaccgaccaccgttgaagataatccggcggccaccaggctcagaccaaacaccgtcgccgccgcctgacctaacagcggttgcagcgtcagataggcctgatcgagttcagcgattttactgtgcccgctgaagtgaaacgccgctgcggcagtcgccatcattgccaggttaacaaatccggcgatggtcatggcaatcgccacatccagtttagttgaggagtaccgctgacctttgctgtcctcacttttgccctgcgtcagcgcggagtgcaggtaaatcacgtgcggcataatggtcgcacccagcacacccgccgccaggaatacagcatccgacgttggtaacgcgggcagcgccataccgatcaccagctctttgacactgggctgggagaaaaagagttcgacgatataggccgccgccacaaacagcagaagtccgccaatcaccagctccagcggcttttgcccccggctctgtaacatcaatatcaggaacgtggcgatgcctgtcagcaccgcgccctgcatcaatgaaatgccgagcagcagtttgaaccccagcgcggcaccgataaattccgccaggtcagtggccatggcgataatttccgcctgcacccagtaaaaccagacggcaggccggggaaaacgatcgcggatgtgttcagcgaggtttttgccggtagcgatacccagcttggctgacatcagctgaatcagcatggccatgatgttggcccataccaccacccacagcaatttgtagccgtaagcagcgcccgcctgaatgttggtcgcaaagttgcccggatcgatatagccgatagcggcgataaaagcgggccccagtagtgcgagtttgacttttctgactccgcgagcggcgcgctcggcggtacgactttcaaacatatccggtaccctgtctgaacatttgcctgccccggcagcttaggggttagcaggtgcaagtgaaattcgtttattgttatcggtgtaatagatgctgctataaagtatagccattgctatacattacagtaaaggatgtgattgctaaaaatgtgagcaatagtgtcactttacgcccggtgtaaaattcagacaataattatgtggttatctgaagtgaagtatttgtaaacaggacgtgatctctggaacttttctggaaaatataacgatagcgaatacttatattgtggttcagatctcgtttttaagtaacgcgttacatagaatacgcaacaaaatacaaccctcctcaaatttggagcaaccatgtcccatattttgcaatttcttttagcactggtggtggtcgggatactcgccttgctggttagtcacgatcgtaaaagcattcgcattcgctacattatacagctactggtgattgaaattgtgctcgcctggttcttcctgaactcagaagcgggactcggtttcgtcaaaggattcgcgggcttctttgaccatctgctgaagtatgccgctgagggtactaacttcgtctttggcaacatgagcgacaaaggtctggccttcttcttccttaacgtattgtgccctatcgtctttatctctgcgctgatcggtattctgcagcatttccgtatcctgccatgggtgattcgcggtatcggtaccgtactgtcgaaagtgaatggcatgggaaaactggaatctttcaacgccgtgagttctctgatactgggacaatcagaaaacttcatcgcctataaagatatcctgggccaaatgtcacagcgccgcatgtacaccatggccgcgaccgcgatgtcgaccgtatcgatgtcgatcgtcggcgcctacatgaccatgctgcagccgaagtatgtggtcgccgcgctggtactcaacatgttcagcacctttatcgtgctgtcgctgatcaacccttatcgcgttgagaacgaagaagatctgcagttgcaggatctgcacaaaggccagagcttctttgagatgctgggcgagtatatcctggccggtttccgcgtcgcgattatcgttgccgccatgctgattggttttatcgcgctgatttcaggtctgaatgcgctgtttgatctgatcttcggcatctccttccagggcgttctcggctttgtcttctatccgtttgcctgggtgatgggcgtgcctgctggtgaagcgttgcaggtcggcagtattatggcgaccaagctggtatcgaatgagtttgttgccatgatggatctgcagaaaatcgcgggtcagctgtcgccacattcagaaggtattctttctgtgttcctggtctcgttcgctaacttctcttctatcggcatcgtggccggtgcgattaaaggtctgaacgaagaacagggcaacgtggtttcccgctttggtctgaagctgctgtacggctctacgctggtgagcgtgctttccgccgctatcgccggtctggttctggcgttctaagcacggttctgcgcactactctaagcatcaaagggcgagcaggtctcgcccttctctttctgctctatccttgctctgcttcccgctgatttccctttcccgcgttaactctttcattgcacatgtcacagctgcattcagatagtgcacaacaggcggcacagcgtcccgcaaacagcatcggatgtcatagcaggttatgccggttgataacgcaattaagcgtgcgcagcagcgcgtatggcaaagcaatagcgttgggatccgcagaaactggcgaataagagattaatcagaaaggattttgacaacggcgtgtcagaaaatggtggagataagcgggatcgaaccgctgacctcttgcatgccatgcaagcgctctcccagctgagctatacccccacatctggaatcgtttttcagtgccaaacttttgggaagaagtttggtggagctaagcgggatcgaaccgctgacctcctgcatgccatgcaggcgctctcccagctgagctatagccccgaaccgaaaaactgtcgcgttaagcgacggacggcataatatgaaaccccctccggggtgtcaacggcaaaatgacattctctgtttgatcgctgaaaaaggcggcaacctgcgaagtttcagcagcatgctgcaggggaaaatcgtgtctgttcacacaggaccgttttttaactgttattcagtctgccgtcaggttaattcacggttaaatatgttataggaattttcttgtcttcggctttttcgcatgcaaaacttagcccgctaatttagtggtacccgggaccctctcccgcgcaccacgcgtccaccaggcgttatcgtcccattaatcataaaaaaactactgagatactatgtcgctgcatacacctaaagaaatcgcacaactggcgatccagtcaggcgtggctaaaagccgtgcacctgtcagcatccttctgattctcggctttatggcgggcgcatttattgcgaccggcttcctgctggatcttcacgtgatcaacacccttcccgctgaatggggctcttttggtggcctgttaggtgccgcggtcttcccggtggggatcatcatgaccgtgctggcgggtggtgaactgctgaccggtaatatgatgaccttaccggtggcctggttcgcccgtcgcatcagctttatgagcgtggcgcgcaactggttctgggttaccttggctaactttctcggcagcgtggctgtcgcctggttctttggtcacatgctgggtatgaccgagggcgattacctgaagaagaccgttgctatcgcttctgcaaaagtccacgctgatttcctgcacgcctttatttccggtatcggctgtaactggctggtttgcctggcggtatggctggcctttgccagtaaagatgtggtcggcaagatcttcggcatgtggttcccggtgatggcatttgtggccattggcttccagcacgttgtcgctaacatgtttattattccggccgccatttttgccggtcagatgagctgggcagagtacttccctaattttattgccgtcttctcaggcaatgccgtgggtggtgccgtgttcgttggtctggcctatttccttgcattccgccctgccgctgaacccgccagtaatcctcagtaatgatgttttgccttttgtcgagagacaaaaggcaatttcagcttcagttactttcacccgttacgttttgctgtaatatgtcctgctaatgtattaatcagggactgcatcgtgaaaaaggaatggcttacccccgaagagctggctgcagagacgggttacagtcggcaaacggtgaataaatggatcaagcgggaaaactggacgaccacgccgaagcccggtgtgcaaggcggtaaagcccgattgattcacattgatgagcgcgtgaaaagttttattcagtcgacccgtaaccttaacgagccgacggcaacttatggcactccgtctaattcattacctgcgttattaataagttccgtccagcaaatgactcaggacgagcaggatcaattcactgcactaatcttacgcgaaggtatcaagggcgttttgcagcgactgggaatcagcgaagagtaaggtgtatttatcagggaaggtatgatgaaaaaggaatggttaacacccgaagaactcgcctcagagacgggcctgagccgacagacagtgaacaaatggattaagcgcgaaaactggaccaccctgcccagacccggcattcagggcggcaaggcgcgattgattcatgtcgatgatcgcgtagaaaaatttatccattcgacgcgtagcctgcacgaaacccgccgcaatgtatagggttccggcagattcactgacggcactgttagtaaatgcggttccgcaaatgagtcaggctgaacaggagcagctgtcagcgctgatattacggataggaattaaaggcatgttgcagcgtctggatatcactgaagagtaaaaaccggaagcgcgaagcttccggttctgtttattaagcctgcgcttcccgctcactgataaaggccagcgcctgctcaatacgtgcaatgctgcggctgcggcctatcgcttccacggtcacatccagtccgggtgactgaccggcaccggtcactgcaacgcgcagcggcatgcccactttccccatcccgacttccagctcatctgcggtgctctgaatagcctgatgtacgttttcagccgtccactcttcgatcgcggccagcttatcgcgtaccacttccagcggctgacgtgctaccggacgaagatgtttcttcgcggcatcggcatcaaattctgcaaagtcttcatagaagtagcggcaggatgcagccatctctttcaatgtcttgcagcgctcgcctaacagaccaaccagcttcgccagttccggccccgtgcgggtatcaattttctgctcttcaatatgccactgcagatgtgtcgccacatattctggcggcagcgtattgatgtagtgatggttcagccactgcagtttctcagtgttgaacgcactggcagacttactgaccgcatccagggtaaagagctcagccatttcggccacgctgaagatttcctgatcgccatgtgaccagcccagacgaaccaggtagttgagcagcgcttctggcaggtagccatcatcacgatactgcatcacccctaccgcgccatgacgcttggagagctttttgccgtcatcgcccaggatcattgagacgtgggcatagaccggaacctgcgcgccaattgctttgaggatgttgatctgacgtggcgtgttgttaatgtggtcttcaccgcgaatcacatgggtgatgcccatatcccagtcatccacgacgacgcagaagttgtaggttggcgaaccatcggtgcggcggatgatcagatcatccagctcctggttgctgaactcaatcgggccacggatctggtcgtcaaagatgaccgaaccttcctgcggattgcggaaacgcacaacgcacggctcatcatctgcatgatgttcatggctgtcacggcagcggccgtcgtaacgcggcttttcgttgttggccatctgctcttcacgcagcgcttccagacgttctttagagcagtagcatttataggctgtgcccgcttccagcatttcatcaatgaccgcgttgtaacgatcaaaacgttttgtctggtagtaagggccttcattccagtcgaggctcagccagttcatgccatccatgatggcttcgatagcttccggcgtggagcgctccagatcggtatcttcaatgcgcagcacgaaactcgccctggttgtgacgggcaaagagccaggagtaaagtgcggtacgggcgccacctacatgcagatagccagtcgggctgggcgcgaagcgtgttttgattttcattgagtattgccttagatgcgcgggttctctgtctggatgacaaaaaacaggttagacgcgaaaaaacagtgggcacattctagcatctgacggtgaatcctcaatgcatgcccgccggttgccgcccgggaaaaggggcttttctgccagtaaaaccagcacattggctaaaagcgcgacagggtgtttaaaaataaaccgaacgcacatttatgttttaaaaagcgttgactcaaaatcaactatccctataatgcgactccacacagcgggggtgattagctcagttggtagagcatctcccttacaaggagggggtcggcggttcgaacccgtcatcacccaccactcttaacagcgtggcccgcagtgaacaggtatgaagatatgggtgattagctcagttggtagagcatctcccttacaaggagggggtcggcggttcgaacccgtcatcacccaccatatcttgcctgttagtagtactgaagtacgaagtgggtgattagctcagttggtagagcatctcccttacaaggagggggtcggcggttcgaacccgtcatcacccaccacttcgggtcgttagctcagttggtagagcagttgacttttaatcaattggtcgcaggttcgaatcctgcacgacccaccaattcagaataaagcgcctttaaggcgcttttttcgtttccggggcacggactttaccgtgcaggctgagaaacctgctgcaggttcgactgaatcgcagggagcgattcaggctgatgcgacagcatcacccgcagggcgaggcccacgacgggccgaggctatcctgcacgacccaccaattcagaataaagcgccctaaggcgcttttttcgtttctgctattgagagatttcctgtgctacagggtaaaactgctttttccagctatttcagactttaaacaacgtgctggatcaggtagcaagggcgaagctgccctttgctaaggtactggataagctctcaccttttcgcaaccttaacaatttcagctctcaagtcgtttcacagcgtgccgataacgtatctgacaacttacagggagaaaaatgatgtcttcaatttccggaattctaagcagtgcagtcagtggcggtgacagcggtggcggcagtgttgcctcgcaggtcgcggcgctgaataaacagattcagaacgtcttaacgcaagtcaaagagctggccgacaacaaagaactgactgacgaacagaagtctgaaatgcagcagatgtatcagtcacaaatcaccatgctgcaggcacagattgctcagctggaacagaagcaggccgagcaggatcagccaaagagtgacagctcgtctgtcagtgagagcaaagcagacgggattaaccgccctaccgacaccaacaaaattgatgtctacatctaaaatgcgggcctggcctcgcgttgttgcgccagcagcgtcgcctgctggcgcacctcctgccagattgcttcggcagcaggcgtcagcgaacggtttttacgcttgatcagcgtaaggctgcgattgatttccggatatagacgccgcacggttaatgcgcgatcagccggcaacggtaacgccagcgcgggcagaatactgatgccgatccccacctgcaccatcggaaacagcgtagcgggatgaccaatctcctgaacgacttcagccctgatattctgctgctgcatcgccgcatcaatgaggacccgactgcccgaagcgtagtcctgaagcaccatggtgcggccatccagcattgaccattctgccctttccacctgcgccagcggatcatcatcacggcatagcagcaggaaaggctcatcaagaatcgcgatgctgtcaaaatcgctgtcgctgagtggcccaatcacaatcccgaaatcgacttcggcgttacgcacactttgcagcacccactgctgggcgcgatcgtgcagtatcactttgatgtcaggaaagtgttgctggctggcggccagacattgcggcatcagatgagcggaaatggtctggctggctgccaccctgacggtaccactgcgctgttcgccaaaactgcggatatccagcagcgtggtatgaatctcctccagcaggcgctccatgcgtgacgccagctgttttcccgcttcagtcagcatcacctcccgggtggttcgatccagcaaccgcacgccggtttccgcttccagctctttaatactgtggcttaccgccgactgactcagacctatcgcctgccccgcctggctgaatccgccatagtgtgccaccgcaataaaggtttcgtagctgacgcagggtgtaattcatcgattctgctcatagattaattcaataaatcaattttatttctaaacaggtttcacgcacaatcgcgctattgaaaaatttaccggaatttaacaatgggatttttaaaactcgatccgatgatggttaaactcatcatcaccgtgctgctggcctctttcctgccagccagagggatctacgttgatatattcagctatctcgcgacggcagcgatagcactgctgttctttatgcatggtgccaagctgtcgcgtgaaaagatcatctcaggcagcagtcactggcggttgcatctgtggattatgttcagcacctttgtgctgtttccggtgctgggtctgttgctggtctggtggcatccggttaatgtcggcccggaaatttataccggctttatctacctctgtatcctgcctgcgaccgtgcaatccgctatcgcgtttacctccatggcgggcggtaacgttgcggcagcggtatgcagcgcctctgcatcaagcctgctgggtgtgtttatttcgccgttgctggtgaacctggtgatggatattcacagcagcgcgcccagcgatggactggagcagatcgggaagattatgctgcaactgatggtgcctttcgtgctgggacacctctcacggcgctggatcgggggctgggttgaaaagcaccgcagcctgattggcaaaaccgaccagacctccattctgctggtggtctactccgccttcagtgaagcggtggttaatggcatctggcatcgcgttgggttgattacgctgctgtggattgtggcaggctcaatcattctgctgaccgccgtgctgattatcaacctgctggcctcgcgtctgttccgctttaaacgcgccgatgagattgtggtgctgttttgtggttcgaagaagagtctggcgaatggcgtgccgatggcgaatatcctgttcccggccagtaccgtggggattattgtgctgccgctgatgattttccatcaggtacagctgatggtctgctcatttattgccggacgttataagaagaccaatgagaagcagcaggctgtgcaggtcaaagattcggtgatggagtctcagaaatagatcggctgcccgccagtgcgggcagcgttacttgcgggtctgaagcggtttaactaacccttccagaccctcaatttttattgtcagggtgagttgcatgagatcacccagcagaccagacggaaagtccccactgcgggcaaaccacagcagataaggctcaggcagatcgatcagcatccgccccttatatttgccaaacggcataggcgtattggctatcgccaccagctgatgttcatccatctgaggctcccagcaagcggatcatttccgcttcatcaatcacttcaatgccaagctccgctgctttcgccagctttgaaccagccgcttcaccggcaatcagcaaatcagttttctttgagacactgccgctgacttttgcgcccagcgcgatcagctgcgctttggcatcatcgcggttcatctgcgacagtgagccggtcagcaccaccgttttaccggcgaaacggactgtcgatctcttcggctctcaccaccaccacctgcggccagtgaataccgatatcctcgaccagctggcggataacctcacggttgctttcctcttccatgaagttgcgcacgtgtgccgcaacgactttgccgacatccggcaccgcaatcagcgcctcaagatcggcatccatgaccttctgcaactcaccaaaatggttagccagattggcagcggtggcttcacccacttcacgaatgcccagtgcatagaggaaacgcgccagcgtagtcgatttcgctttctccagcgcgtcgacaacgttttgcgccgatttcggccccatgcgatccagtccggtcagtttgcccgccgtgagacggaacagatccgcaggtgtgttgacgtactctttctccaccagctggtcgataatcttatcgcccatgccatcaacatccagtgcccggcgcgagacaaaatgcttcagcgcctctttgcgctgagcaccgcagattaaaccgcccgtgcagcgcgtgaccgattccccttcgacccgttcaacctcggaaccacaaaccggacagtgtgccgggaacaggacttcacgcgtctgttcagggcgctcggccatcaccacgttgaccacctgcgggatcacatcaccggcgcggcgaataacgacccgatccccgatgcgtaatcccagccgctcgatttcatccgcgttatgcagcgtggcattgctgacgataacgcccgcgacctgcaccggctcaaggcgagccaccggtgtgatagccccggtgcggccaacctgaaattcgacgtcccgcacccaggtcagttgttcctgtgccgggaatttaaaggcaatcgcccagcgcggcgcgcgcgccacaaagcccagtttttcctgcagttcctgtgaatcgactttgatcaccacgccatcaatatcaaaacccagattcggacgctgttgctcaatatcacgatagaaggccagggcttcttctgcgttgtgcaccagcttaatgcggtcgctgaccggcaggccccaggctttaaactgttgcagacgccccatgtgactgtgcggcatctcaccgccttccagcaggccaaaaccgtagcagaagaaggtcagcggacgtttggcggtaatgcgcggatccagctgacgcagagaaccggctgctgcattgcgcggattagcaaagactttgccatcagtccggcgtgcttcctcattcagcttttcaaagccgcgctgcgtcataaatatttcgccacgcacttccagccgtgccggaatgttgtcgcctttaagccgcagcgggatagcgcgaatggtgcggacattggcggtaatgttctcgccggttgtgccgtcaccgcgcgttgcggcctggaccagcagaccattttcatacatcaggctgaccgcagcgccatcgagcttgagttcacagcagtaggttatgtcgtcactgcttttcaggcgatcctgcacccgcttgttgaaagccataaacgtggcttcatcaaaggcgttatcaagcgacagcatcgggacttcatggcgcacctgctcgaagaccgtcagcggcgcggcacccacgcgttgtgtcggcgagtctggcgtaatgagatccgggtgttcctcctccagctgacgcaattcgcgcatcagacgatcgtattcagcatccggcacttccggcgcatccataacgtgatagagatattcatgatggcgcaacgtggtgcgcagtttcggtgatgtgatcctggacggatttcataaagccccatcagataaaaaacccccgacaggcgggggtttgtttttaacaattcagatagcgtttagcgcaggtctcagacgccaaccacatcgcggatacgcgctttgtaagtttccagcttctgtggtgtcatcatgcgacgctcatcatccagcaccacgccacctacatcatcagcgatacgctgagccgactgcagcatcagcttgaagttctgattcgcatcgccataagaaggcaccatcataaagatagagatgccaggcgtgctgaaatcggtcatcaggtcaggattgaatgagcccggcttaaccatattggccagactgaacaataccgggccgctgccagccgggctgagatgacgatggaaaatgttcatttcaccaaactggaagcccgcctgaagaataccctgcagtagtgcctcaccgttcagttcaccgcccgagtgtgcggcaacatgcagcaccagtaccgcttctttcggtttttccgctggcgctttagcagcaggctgtgctggcgccggtgtcacttcaggctgcggctcaggttctgcctggtactgcggtgctggctgtacagattccagcggatcgagatccagcagcgggtcggcctgaacgggcggcgcgacaaaagtgggtgcgggctgctgacgaaccggttcagggcgcgactgcggagcaggctgcggtgccgtgttaaaaagcgggtcgctttcaggttcgggttgcggtgcgggtcgtggcgcaggctgacgcacaggctcagcgggcgcaggcttacgcggcgcttctggctgtggctcgcgaatctcatcgaaacgcggttcctgatgtacgttgcgatcagaacgaacgcgaacctcgccgacgccatcatcctcgtcgtcaatcaggtcctgctcatcattttcatcacgttgttttagacgtttgtgcgggcgatcgcggaacactgacgaacgctctttacggctggtccacagcccgtgaagaaggagcgctataatggcgatcgcgccaacaacgattaatatcagacgcaaatcctgcatcattgtattctctgttgttccaataccttgccaccgcggcaaactttatcctctaactgtatttgccctgctacacaagtgcaagtctgtgcactattttctgacaaataagataggcaacccacgctttttcgctgtttttttacccaaacggcacctggcctggagaaaaagccaggttatagtgggcgcgccttaacatcttcaggagaactggctttatggcccttgagaattccgtctcaaattttaacggcatgcactactttagccagggctggaaactggtacgtctgcctggcattcgccgctttgtggtgatgccgttgctgatcaatatcgtgatgctgggtggcgctttcatctggttgttctatcgtctcggtgactggatcccgcggctgatggcccatattccggactggctgcagtggctgagctatctgttatggccgctgtcggtgattgcgattgtgctggtgtttagctacttcttttcgaccctggcaaacttaattgccgctccgttttgcggcctgctggccgagcagctggaaggccgcctgacaggcaagcctctgccggacagcggctgggctggaatgatcaaggatgtgccgcgcattatgaagcgcgagatgcaaaaactgggttattacctgccccgcgcgctgggactgctgctgctctactttattcctggctttggccagaccgttgcgccggtgctgtggttcctgttcagcgcctggatgttgtccatccagtattgcgactatccgttcgataaccacaaagtgccgtttcagcagatgcgcaacgccctgcgtcaacacaaaacggccaatatgcagtttggcgcgctaatcagtctgttcaccatgatcccggttctgaacctggtgatcatgccggttgccgtctgcggtgccaccgccatgtgggtcgatcgctaccggtcaacgctggcacgtcatgagttgcgttaaattcatcagcgcgccttatgctctttttagcagggcttattgccgggcgacatatagatatacgatttctttccttccgccaccaggcagaaaaggtatgctcatagggttcccaataattcatacagttaaggacaggctatgagtaagatctatgaagacaactctttgacaattggtcatacgccattggttcgactgaaccgcatcggtaacggccgcatccttgcgaaagttgaatcccgtaacccgagcttcagcgtaaaatgccgtatcggtgccaatatgatttgggacgcagaaaaacgcggtattctgaaaccgggtgttgaactggttgaaccgaccagcggcaacaccggtattgctctggcctatgtcgccgcagcgcgcggttataaattaacgctgacgatgccagaaaccatgtcagtggagcgccgtaagttgctgaaggcgctgggcgcgacgctgatattgaccgaaggcaccaaaggcatgaaaggtgccatcagtaaagctgaagaggttgttgccagcaatccggataaatatgtgctgctgcagcagttcagcaacccggccaacccggaaatccatgaaaagaccaccggcccggaaatctgggaagacacggacggcgaagtggatgtctttattgccggtgtcggcactggcggtacgctgaccggcgtcagccgctacatcaaaaacaccaaaggcaaaaaagatctgattaccgtcgcggttgagccgaccgattccccggtgattgctcaggcgctggcgggcgatgagatcaagcccggcccacacaaaattcagggtatcggcgcaggctttatcccgggcaaccttgagctgaatctggtggaccgcgtcgtggccatcaccaatgaagaagcgatcagtacggcgcgtcggctgatggaagaggaaggtattctggccggtatctcatccggtgctgccgttgccgcggcgctgaagctgcaggaagatgaagccttcgccaacaaaaatattgtggtgatcctcccctcctccggtgaacgctatctgagtaccgccttgtttgccgatctcttcactgaaaaagagcttcagtagcagaggccgatagtccgaaaatggagaaaaaagcacccaatcgggtgcttttttgtggtgcagatctcactttcatcacccggcagattgatttcagtgacgccgctctggtatttagactgccaattatttcgatgcctgaaattaatccgcgtttgaagtggatcaagctgaatcgatttacggattcagtgaaacggcgaatcacggcataattaaccggtgacgtgtagaatcggttttgagacgcaacggactgtagatttgacgcatgcgcgtctttggtcagcatgaagctatacccgcgcacctacacaggctaaagtaaaggctccaggctagactttagatccataacactcatcctgataacgttggggaaatagaatgttccagcaagaagttaccattactgcaccaaacggtctgcacactcgcccagctgcgcaattcgttaaagaagccaaagctttccagtcagaaattaccgtgacctctaacggtaaatcagcgagcgcgaagagcctgttcaagctgcagacactgggtttaacccagggaaacggttgtgaccctttccgcggaaggtgaagacgagcagaaagcagttgagcatctggtcaaactgatggctgaactggagtaatctccgctcagctctccagcaaatcgactcctctgcgccattgagtgcaaacatcttgatcgcggacaacctgtccgcgttattgctttcgtagagtacgtgtcccgcgacaatggcaccgcacagagtcccatcagccatcgtgattaaaaggtagcgttatgatttcaggcattttagcatcaccaggtatcgctttcggcaaagcactgctgctgaaagaagacgagatcgtcatcaaccgcaagaaaatttctgatgaccaggttgagcaggaagttcagcgcttcctcgatggccgcagcaaagcggcattacaactggaagcgattcgcgtcaaagcgggtgaaaccctcggtgaagagaaagcagcaatcttcgaaggccacattatgttgctggaagatgaagagctggagcaggaaatcatcgacctgatcaaaaaagatcacgcttctgccgatgctgctgcttactcggtcatcgatggccaggcgaaagcactggaggagttagatgacgaatatctgaaagagcgtgcggctgacgtacgtgacatcggtaagcgtctgctgcaaaacatcctcggtctgcatatcgttgacctgagcgctattccggacgaatccattctggtggcaaaagatttaacgccgtcagaaaccgcacagctgaacctgaagaaggtgctgggctttatcaccgatctgggtggccgtacctcacatacctcaatcatggcgcgctcgctggagatcccagccattgtcggtaccggcaatgtgaccgtcacggttaaaaatggcgatttcctgattctggatggcgttaacaatgcgattcacgtcaacccttcagaagcgattcaggaagagctgaaagccgtacagaaccagtatctgtcggaaaaacatgaattagctaagctgaaagatctgccagccgttacgctggatggtcatcaggttgaagtctgcgccaacatcggtactgtgcgcgatatcgccggtgctgaacgtaacggcgctgaaggcgtgggtctctaccgcaccgaattcctgtttatggatcgtgactcactgccaagcgaagaagagcagttccaggcgtacaaagccgtcgctgaagccatgggttcacaggccgttatcgtgcgtaccatggacatcggcggcgacaaagacctgccttacatgaacctgccaaaagaagagaaacccgttcctcggctggcgcgctatccgtatcgccatggaccgcaaagagattctgcatgcgcaactgcgtgccatcctgcgcgcctcctctttcggtaaactgcgcatcatgttcccgatgattatttcggttgaagaagttcgcagcctgaaagcggaactggaactgctgaaagcgcagttgcgtgaagaaggtaaagcctttgatgagagcatcgaagtcggcatcatggtggaaaccccggcttcagccgtgattgctcatcatctggcgaaggaagtcgacttcttcagtattgggacaaacgatctgacgcagtatactctggcggtcgatcgtggtaatgatttgatctcgcacctgtacaacccaatggcgccgtctgtgcttaacttaatcaagcaagtcattgatgcatctcacgctgaaggtaaatggaccggcatgtgtggtgagctggcaggtgatgaacgtgctacactactgttactgggaatggggctggacgagttcagcatgagtgccatttctatccctggcatcaagaaaatcattcgtaatactaattttgaagatgcgaaggcattggcggagcaggcactggctcaaccgacagcggaagatttaatgaacctggtaaacaagttcattaaggaaaaaacgctctgctaatccgcatgatgctggccccaaattactgcttaggagaagatcatgggtttgttttctaaactttttggcgaaaaaacggatagcgctgggacaattgacatcgtagcgcctctgtcaggcgaaatcgtgaacattgaagacgtaccagatgtggtgtttgcagaaaaaatcgtgggcgacgggattgcgatcaagcccagcggcaacaaaatggttgctcctgttgatggcactatcggtaagatttttgaaaccaatcacgctttttcgatcgaatcagacaatggcattgagctgtttgtccacttcggtatcgatacggttgaactgaaaggtgaaggcttcaaacgcatcgctgaagaaggccagaaggtcaaaaaaggcgacgtggttatcgagttcgacctgccgttgctggaagagaaagcgaaatcaaccctgacaccggttgtcatctccaacatggatgaaatcaaggaattgattaagctgactggccaggtcaccgtcggcgaaacgccggtgattcgcatcagaaagtaagcattcgttcataacataacggcacccgcgggtgccgttatcgtttctgctttctgcctgttcagggctgccagtgcggcagacgcagcgtcagttccagtccgccttctggccggtttcttgcctcgacctcaccatgatgcgccagcaccaccttgcgcacgatagccagtcccagaccataacctttgcccatcagcggcgaattcacccgcacaaacgggtcaaagatgctggagagtttatcctcatcgacacccggcccctgatcgcgcacctgaatcaccagccactgctgttctgtgcgcagatgaacatcaatccgctgccctggctgagagaagcgcagcgcattgcgcaatacattctctgctccgcgccgtatcagctctgcattgccccgcacggtgtaatcggcccgctcgtcgacctgcaactctacctgcacgcctgggatctgcgcttcataacggacatcggtaataaccgcctgcagcaagccggtcagatcaaaatattgctcatccgggatgctttcatgctcagcccgcgacagtgtcagtagttcaccgatcatcttgtccagccgacgcgcctcttcatcaatgcgatcaagcgaactgttcacactctctggcgtctgtctggccagcccggtcgccagctgcagtcgcgccagcggtgaacggagctcatgtgagatatcatgcaacagttcttcacgggcgcgcaccagggtatcgagccgctcgaccatagcgtcaaaggcttcagcgacgtttgagatctcgtcgtggcgcttacgcatgatcggaaacagccgcacgcttaaatcgccctcagccacgcgggaaaatccttcccgcagctgacgcataggtcgcgtcagattccaggccagcagcagactgaacagcaatcccaccgagccggcgaagacaaacatcggctcaggaatattcagaaatttgcgcggcatcatgttcagcgtgctgtctttacgcatgccatccaggtcgtagcgcagctgataggctttgccatccgcgccgcgaacccagcgcaacacctcttcaggaaagcgccctctgatatccaggttgccgctgttttctgattgggacggctttgtctgttgggtgacgtggaagaactgccgatcgctgttatcccagtctgagagcatcgcattcagcgcatcaggcccgccccgctccagcacggacgcggcggaggtcatctgcagatccacaatacgacggatagctacgagttcaggcggttcatgccgtttaccggagagcgtaaagccgagccagataagctggctcataatgacgaaaacgatccagaagccgataaagatcttccagaacatgcgtccacggtaactctgcttcatcgaatacggtagccgatgctgcgaacggtttcgatgttgatgctgtcagcggttaatgcactgagcttctgacgaatgttactgatatgcacatcgacgctgcggtcataggcttcacgcgggcgaccgagtcccttttcggagagctcatcttttgacaccactctgtccggcgcacgcagcagcagatccagcagattaaattccgacgccgtcagatcaaaggttttaccctgccattcgctgatgcgggtggcgggattaagcatcagctctccccagcgcagcggctctctggcgtctggctgtggcgcctgctcttcgaaacggcgcaatacggcgcgcagacgcgccaccagttcacggggatagcagggcttgggcatatagtcatccgcgcccatctcaagaccgatcacgcgatcaatattatcgcctttggcggtcagcataatcactggtatccggctgttctggcgcacctgacgcaacacatcaatgccgctcatgtcaggcagcataatgtccaggatcatggcggtgaactctcccgataacgcgccctgcacgccagcgctgccggtcagaaccagctgggcatcaaacccttccccgatcaggtactgacttaacatcgtgcctaattcaacatcatcatcaacaagcaaaattttcatggttatctctctggagaattgccgctattttgtcctgtgctgaacattcgcgcagcctgatttacgcgatccttacagattcagtctgtctggcactgaaaattggggttaaaaaaaggcctgtgggcagtaaatgcacgcacaggcctgattccgtattggcagaggttactgatgatagagtccggtagagagataacggtcaccgcgatcgcaggcgatcgccaccaccacgctgccaggattggcctgcgcaatgcgcagcgcacccgccaccgcgccgcctgaactgacgccacagaaaatgccttcacggcgtgccagcgcgcgcatcgtctcttccgcttccttttgcgtcatatccatcacatcatccaccagatcgggacggtagatccccggcagataggccagcggccagcgacgaatacccggaatactgctgccttcgctgggctgcaaaccgatcacctgcacgcccgtattaagctctttcagataacgccccacgccggtaatggtgccggtggtgcccatgctggagacaaaatgagtcatgcgctggttcgactgctgccacaattccgggccagtggtctgatagtggcccagcggattatcgggattattaaactggtccagcacccggccttcaccgcgcgccgccatcgcctgcgccagatcgcgtgcgccctccatgccctgttcacgtggcaccaggattaactctgcgccataggcgcgcatcgcgtcctgccgctcctgactcatgttgtcgggcatcagcaggcgaagtcggtagcctttcatcgccgcgatcatcgccagcgcaattccggtgttgccgctggtagcttcaatcagctgatcgccaggtgaaatatcaccacgcagctctgcctgattgatcatcgaccaggccgcgcgatcttttaccgaacctgccggattattgccttccagcttgagccagacctcgctgccgttggcgggcgtcaggcgctgcaacttaatcagcggggtattgccgatggtattttcgagagtcgtcacggtgcggttcctggcatcttacaaaccagatgcgaaaaaaaggcgggaatgacactcccgcccggtgttgaagagaaaatatcaggcgctttgtgcaaaggcaactgcgcgcagtggcgtatcgcccttatagagacgcgcctgctgtaagccaacaaacagacgctcgccgcgaatcggcgctgtctgctcaccttcaaacaccaccgaaaccggctcgctctgccagccggcaggctggacgaccagctgccagaagtgtccacgcgggctcacttccagtacctgtaccggcagcggggtttccagactgctgcggcgtgatacgtcgatttcccacggacgcaggaacagctcaaccgcaccctgatgtgccgaggtatagcccagcggccagtggtacgcgccgacgtggaactgtgatccctgaatctccccatcaaagcggttcacttcacccaggaattccagcacaaaacgggtcgccggatcgcgccacacatcatctggcgtgccgacctgttcaatgttgccctggctcatcaccaccacgcgatccgcgacttccatcgcctcttcctggtcgtgggtgacaaatacactggtgaatttcagctcttcatgcagctgacgcagccagcggcgcagctctttacgcacctgagcatccagcgcgccaaagggttcgtccagcagcagaatctgtggttcaaccgctaacgcacgcgccagcgccacacgctgtttctgaccgcccgacagctgtgccgggaagcgattcgccagatgagccagctgcaccatctccagcagacgggtaacacgctgtttgatctccgccgttgaaggacgctcacgacgtggcagcacggtcaggccaaaggcgatgttgtcgaataccgtcatatgacggaacagcgcgtagtgctggaagacaaaaccgacctgacgatcgcgcgcatgcaggcggctgacatcgttgccatgaaaacggatatgaccgctgtttctgatgctccagcccggcaataatgcgcagcagcgtggttttacccgagcctgatgggccaagcagcgccaccatttcacccgaggcaatatccagagagatatcgttcagcaccgatgtgcgaccaaaggatttgttgatcttgttaatctcaatgctcatgatttccctcctgttgcaggcgtttgtgctgttgctctaaacgccactgcacaatgcttttcagaaacagcgtcacaattgccatcagggttaacagggcggccgcggtgaacgcgccaacggtgttgtagtcctgatgcaataattcaacctgaagcggtaacgtgtaggtctcaccgcgaatcgatcccgataccaccgagaccgcaccaaattcaccaatcgcacgggcgttggtcagcacgatgccatacagcagcgcccagcgaatgttcggcagcgttacgcggcggaacatctgccagccagaggcacccagcagcaccgccgcttcatcttcgtgactgccctgactcagcatcaccgggaccagttcgcgcaccacaaacggacaggtcacaaacaccgtcgccagcaccatgccaggccaggcaaacataatctggatgttatgcgcatccagccagccgcctgccgggccattaacgccccagaacagcagatacatcagaccggccacgaccggcgacacggcaaaaggaatatcaaacagggtcagcagcaactgacgacccggaaaggtaaagcgcgtcaccagccaggcgagcagcgtgccgaacaccaggttaaccggtacggtgatcaacgccaccatcacggtcagccagatggcgtgcagcatgtccgggtctgccagattgctgagagcgacaatcagcccctgattcagcgcttcccagaagatggaggccatcggcaccaccagcagcagaatcgagatcagcgcgccgatactaatcagcagccacttaccccagttcactggctgacgtgcagcgtgattaatctgtgaaacctcagccattagtgacctcccagacgacggccaaagcggctctgtaatgtgttaatcgcaaataacagaatcagcgatgccgccaggatcaccgaggcgatggcgctggccgccggatagtcgaactcctgcagccggacaaaaatcatcagcgaggtgacttccgttttccaggcgatgttaccggcaataaagatcaccgcaccaaattcacccaggctgcgggtaaaggagagcgccgtttccggccagcagcgccggtgccacttccggcaacacgacgcggcggaagctctgccacggcgtggcacccagcgtttcggccgcctcttcatactccgggcctaactcttccagcaccggctgtacggtacgcaccacaaacggaatgctggtaaaggccatggcgatggcgataccaatccaggtgtaagagattttgatgtcgaactgagcgaaccactgtccataccagccgttgaccgaaaagagtccggccagggtcagacccgccaccgccgtaggcagtgcaaacggcagatccatcaggccatccagcagcgtccgccccggaaaacggtaacgggtcaggatccatgccatcagcatgccgaacaccgcattaaacagtgaggcgacgcctgcagagagcagcgttactttataggcggcaatcagctgcggattggtcaccacatcccagtactgttgcagcgtcatctgcgacagctgcatgatcaccgcgctgataggcagcagcagaatcagacaggtaaagagcagactggtgccaaggctgagaccaaagccgggcaacacgcgtttctggctggctgcaaacattatccgcgccccgccgctaacaacttatcaagctcaccgccgctgacgaagtgcgtcttcatcaccttatcccagccgccaaacgcctcttccacccggaacaggttggtctgcgggaaacgatctttctgctccgccatcagctgtgcattgttcacgcgatagtagtagtgagtaataatattctgcgcttcaggtgtatagagatagttcagataagcgctggccgcatcagcggttttattggtggcgacgtttttatccacccatgccaccggaaactccgccagaatgttggttttcggcaccaccacttcatactcatctttgccgtactggttgcggatgttattcacttcggactcaaagctaattaatacgtcgcccaggccacgctcagcaaaggtcgtggtggcaccgcgaccaccggtgtcgaatacttcaacgtttttcagaaattgcgtcataaaggcacgggttttggcctgatcgcccccgtccgctttctccgctgcgccccaggcggccagataggtgtagcggccattacctgaggttttcggattcgggaaaatcagcttcacatcactgcgggtcaaatctgaccagtcgtgaatctgttttggattccctttgcgcaccagaaacgccatggtggagtagaaaggcgagctgttattcggcagacggcttttccagtctgcggcaatcaggttgcctttatcgtgcagcacctgcacatccgtaacctgattgtatgtgacgacatccgcgcgcagtccctgcaggattgccagcgcctgcttcgatgaaccggcgtgcgacatcttaatggtcagtggatcgccgggatggctggcatcccactgcttaacgaagggagcattcagggcgacaaacagctcccgcgaaacatcgtaagagctattgaggagttcagtggcattggctgcgccggccaggctcagcgacaacgcgataccgctcacgatttttttcatcgcttgtaatgtcatttggcaccctgaaaaagtttgatgcggatctcacccgctgaggcaccagtttatttataactcagtgaaaaccagtaacggttttatatatcgtttgatgatttcaaagtcgaaaaaagcataagacgacggcactgtttatgcaaaaatcagcaaaagccgataggtaggaggaaccccgtgccgtgcgcgccggcaaaggttttgagaggctcagcggccgcctgacgggcggcgcgctgaagacgagggattaacgctgccagacaatcttgctgattttccagcttttcagcgtatcgtccgagggcattaatccctccggtccatgccagtcaccatgataaacataggtcagatgctgactgccaggtgcgcggcacgccacgtcacgcgcatcggtgccgctggctaaggtgcagttgtcgaaggctttgctgaacttattactgaagagatcacccactttgctgccatcgctgctggcgattgcgctgtccatgacctcaatacgttcgacctgcgactgcccgtaaatcaccagcttaacgttgccatcatccagcgcctgccagaaagagaccacctgaccgtttctggctgcgcatgccctgacgcaggctatagtcaccgttcagtccggcattaatcgcgtcctctttcatggcggtcgaggcagttaacccacccacaccctgttcagtcgcggtcagcgaggaaccgaaccagttccacggcagcgccgaagaccagtgatacgtcagcggattccaccagcttgcctgctggctgctgtcagcgccggaacccgaactggcacagccgctcagtacaaccgcggcaatcagtagcgtggaacgaacagctttcatgagaactcctgtaaatgcgatgccggaaaggcggaactgattggagtcgcaaagcgacaaaaagtttagtgaagatgatgttcgggcagaaagcagtcgcgacagcggcggctggattgcagccagatcagcgccagcaggtcaaagagcgtcagcaacaatggcagcggtgaggtgagcagatcgccctgcacaaactgcattccctgccagagcagattcaccagcagcgacagcgccagcacgctgcgccagtgctgccagagtcgcagcaggcgggtgcgatacccggtcagcagcaggcccgccagcgccggtaaacccagcgcaaggccgatccagaacgcctgacgatccggatagaacagcgccagcagatcgttgccctgctgccgagacgcaccggccatcaccagcagcagccaggtccgtgcctggagtaacaggatcagccaaaaaagaaacggcagccgcagctgccctctggcgtcatactcgtccggcagatagcccggtgacggcttagtattcacgatcttcgatcagacgtttaccaaacagcagcgcatcgaccggctcataatcgagcttctcatagaacgccactacctgatcattctcttcgcggatcatcagatgcagtttcggacagccgcgcgcgataagcttcttctccagacggttcatcagcgcattcgcaaagccgcgtccctgatagtcgggatgcacggccagatagtaagccgcgccgcgatggccatcatagccgcccatcagtgtgcccacgaccacgccgcccacttcagcgaccagaaagagatcggggtcgtgattcattttgcgttcgatatccagctcaggatcgttccatggccgtaacaaatcgcaacgttcccataaggtgatcacttcttcaaaatcttcctggcggaaggcgcggatttccatcttctttacctgcaaataagcacaatttgctgattatcacgcattctctgccgcacgcaaccctccatgacgggcgacaaataaaaaagcgcaaatttactgttcgcgacctgcaatacaaagtaatgccctgaaatggttctgtgatcgcaggcagcagccccttaggctataacaccggcaagattcctgttatcggacccgcacatgcacctgcttaaacgtttgattcatcgccgtcagttactgctttccgggctggctctggccattttatcgccgcgcgcggttcaggctaaagagcagtctgcgcttactggtgccaatcgtcactcgcgccctgccccgcccgctaagaacgggaaacgtatcgtgatgatcgaccccggtcacggcggcatcgactctggtgccgttggcgaagagggttccgaagagaaacacatcgtgctggagattgccggtaacgtgcaacgtcagctacagagccatccgcgcatagaagtgcgtctgacccgcgacagcgaccactttattccgctctatcagcgggtggagatcgcccaccagcacggcgccgatctctttatgtcgattcatgccgacggttttaccagtcccgatgccagcggtgcctcggtgtttgcgctctctaatcgcggtgccagcagctcgatggcgcgttatctgtcacagcgggagaacgatgcggataagctgggtggcgtgaaagcgcagcagcaggatcactatctgcagcagatcctgttcgatctggtgcagacagacaccatcaaaaacagcctgacgctgggcaagcatgtactggatcagatccgcccggttcatcatcttcacagccagcacaccgagcaggctgcctttgcggtactcaagtcaccgtcgatcccctcggtgctggtcgaaacctcctttattaccaatccgcgtgaagagcaattgctcggcaccaccgcgtttcgtcagaaaatcgcctcggctattgccagcggcatcgtcaattactttgatgagtttgatcgccgcaacgcctgatgcgtgtcgccggttcaggccgtgcgactcgccgcactcatgcaagcggcgcggttttgcgtataatcgcgtcagactttgacaaaccataagcgaaaaaatggctgatatttcccgcgtaaaagcgttcctgctcgcattgcaggatgagatttgtaaccagctggcggctgaagatggcggcgcagcgtttgccgaagatagctggcagcgtcctggcggcggcggcggtcagagccgcgtgctgcgcaacggcgcggtgtttgagcaggcgggcgtcaacttttcgcacgtgcatggcgatcagatgccggcatccgccactgcacaccggccggagctggcgggtcgcagctttgaagcaatgggcgtgtcgctggtgatccacccgaacaacccttatgtacctaccagccacgccaacgtgcgcttttttatcgcggagaaaccgggtgccgatccggtctggtggtttggtggcggatttgacctgacccctttttatggcttcgaagaagatgcgctgcactggcaccagactgccgctgacctctgccagccttttggcgaggatgtctatccgcgctataaaaagtggtgtgatgactatttctatctgaagcatcgtgatgagcagcgcggcattggcggcctgttttttgacgatctcaatacgcccgactttgagcagagcttcagctttatgcaggcggttggccgcggctttatggatgcctatcggccgattgtggcgcgccgtaaagcgcacccgtggggcgatcgtgagcgtcagttccagctctaccgccgtggccgctatgtggagtttaatctggtgtgggaccgcggcacgctgtttggtctgcagaccggcggtcgcactgaatcgatcctgatgtcgatgcccccgctggtgcgctgggaatatgattatcagcccgatgccgactcacctgaagccgccctctatcgcgatttcctgccggtgaagaactggctgaacctgccagtctgatcgtttctgccgctgcagcgcgggtctcaacccgcgctgcgcttacctctcgcctgatcggcctcttcttttttacagggcacagattgctacagtgtggcctgcgtcattcctcctgactgctatgcttatgggtggaatatggcgcaccccacggttaacaccgcatgacggctccttcgcaccgcctcgcagcgcaacaatcagagaaaccgcatgttcatcagaaactctctgttgcaatgttatgggttcgcgtttcccggtagcagaacatgccacagaccggctgcgaggcctgaggtgccccctgttcgctttcatttttcttttcaaggagtttagagatgaaccagctagaagccctaaaacagttcaccaccgtggtggcggacagtggtgatatcgaatcgattcgtaattaccatccggaagacgccaccaccaacccctcactcattctgaaagcgtccggtctcgaagggtataagcacctgatggatgacgcgattgagtacgccaaaaaacagggcggcagcaaagagacgcagattatcaacgccagcgacaaagtggcgatcaaccttggtatggaaatcctgaaaagcataccgggccgtgtttcgaccgaagtggatgcgcgcctctccttcgatcgtggcatgtgtgtgaccaaagcagaaaaactgattcggatgtatgaagagcacggtatcgatcgctcacgcgtactgattaagctggcctcgacctgggaaggcatccgcgcagcggaagagctggaaaaaaacggcattcagtgcaacctgacactgctcttctcctttgctcaggcgcgtgcctgtgccgaagcgggcgtgttcctgatctccccgttcgttggccgcatctacgactggtataactcgcgcaaacccatggacccctacgtggcggatgaagatccgggcgtgaaatccgtgcgtcgcatctacgattactacaaaaagcaccgttacagcaccatcatcatgggtgccagcttccgtaaagtggagcagattatcgcactggcaggctgcgaccgcctgaccctgtcacctaacctgctggaagagttgcagaacagtgatgcgccgcttgagcgcaaactggaaccttcaactgaaggtttccatcagccgtcgccgctctccgaggcggagttccgttgggaacataatcaggatccaatggcagttgaaaaactctctgacggcatccgccagttcgcggttgaccagcagaagctggaagatgtgctcgccgcacgcctgtagtctttattttagtcgggcgggactttcccgccctgatgcataacaagggagaactttatgtcctcacgcagagagttggcaaacgcgattcgtgcactgagcatggatgcggtacagaaggcaaattcaggccaccccggtgcgccaatgggaatggccgatatcgccgaagtgttgtggcgcgacttcctccagcataatccgaccaatcccgcctggcttgatcgcgaccgctttatcctctccaacggccacggctcgatgctgctttatagcctgctgcacctgagcggttatgacctgccgattgaagagctgaaaaatttccgtcagctgcactctaaaacgccaggtcacccggaaatcggctacaccccaggcgttgaaaccaccaccggcccgctgggtcagggactggctaacgccgtgggcttagccattgcagaaacgcacgctggccgcgcagtttaaccgtccggatcatgagattgtcgatcaccacacctatgtgtttatgggcgatggctgtctgatggaaggcatctcgcacgaagtctgttcactggcggggaccctgggtctcggcaaactgatcggcttctatgaccataacggtatctcgatcgatggcgagaccgaaggctggtttactgacgacacccataaacgttttgagtcctacaactggcatgtgattggcgatatcgacggccatgacgctgatgccattcgtgaggcgatcaaagaagcgcagagtgtcaccgataagccttcacttattatctgccgcaccattatcggtttcggttcgccgaacaaagccggtaaagaggagtcgcacggcgcggcgctgggtgaggcagaagttgccctgacccgcaaacagctcggctggaactatccggcgtttgagatcccggctgaaatctaccagcagtgggatgctaaagcggcgggtgctgaacgtgaaaaagcctgggatgcaaaatttgcggcttacaaagaagcccatccagagctggcgaaagagtatgagcgccggatgaatggcgaaatgcccgccaactgggaaaccgaagcgacccgtttcattcaggagttgcaggctaacccgcagaaaatcgccagccgtaaagcgtcacaaaactcgctggaagcctatggcaaaatgctgccggagttcctcggcggttctgctgacctggcaccgagtaacctcaccatctggtctggttctaaatcgatcaaagaggatccggccggtaactatattcactacggcgtgcgtgaatttggtatgacggcgattggtaacggtatcgcgcaccatggcggtttcgttccctacaccgcaaccttcctgatgtttgtcgaatatgcgcgtaacgccgcgcgtatggctgcgctgatgaaggcacgacagattctggtctacacccatgactccatcggtctgggcgaagatggcccgacgcaccagccggtagagcagatcgccagcctgcgtctgacaccaaacatgagcgtatggcgtccgtgcgatcaggtcgaaaccgctgtagcgtggaaagccgccgtcgaacgtcatcacggcccgacagcgctgatcctctcgcgtcagaatctgctacagccggaacgtaccccggagcagatcgaaaacatcaaacgcggcggctacgtgctgaaggattgcgacggcacaccagaagtgattctgatcgcaaccggttcagagattgagatcaccctgggtgcagcggataagctcacttcaggcggtcacaaggtgcgggtggtttcactgccttctactgacctgtttgatgcgcaggatgccgcttaccgcgaatccgtactgccgagcggcgtgaaagcgcgtgtggcggtagaagcgggtattgctgactactggttcaagtatgtcggtctggacggtgcgattgtcggtatgaccacctttggtgaatccgccccggccagtcagctgttcccggagtttggcttcacggttgagaatatcgtcagccacgctgaagcattactcaagccagtttaatgcttatgcccttcccggctcaccgggaagggccatttctacttatagcctgatacataaaaaaaactccattcccctcttcccgccctgcgcaaactcattactatagagccgtcatacttaatgctgcctgtgcgctgactgtccgtctgttcctgctgttgttctgccaggataacgcggttctgtcctgatgcatcccgatgagtgaaggcagatttcctccgattttatagcgaagccacttccgttgaacatgcgcacaccctatttactggccctgatggtttcactgcttccattaaaaagcatggcgcaggtcgcgcccgatccgctgctggcctctcagattgttgatcgctatgcggaacatatcttttacggcagcggtgcaaccggcatggcactggtggcgattgatggcaatcagcgggtgttcgccagctttggtgaaacccgtcccggcaacaatatccgtccgcagaaagattcgctgattcgcatcgcctcgctgagtaagctgatgaccagtgaagtgatggtgaagctggctgagcgcggacagattcgcctcgacgatcccctgagtaaatatgcgccgccgggttcacgcgtgcccacctacaatggtcagcccattcgcctgatcaacctctcgacccacaccagcggactgccgcgcgaacagccaggcggcaaagcgcagcgtccggtatttgtctggccgacccgtggtgaacgctgggcgtggctgtcgcgcgctaacctcaaagcggcaccgggcagcagtgccgcctactctaacctgggctacgatctgctgggtgatgcactgtcgcgcgccaccggcaaaccctatccggcgctgtttcagcagctgattacccgcccgctcggcatgaaggacacgacgtttacgccgtcgcctgagcagtgcggacgcctgatggtggcggaaaaaggggccagtccgtgcaataacaccctggcggcgattggcagcggcggcgtttactccacgccggatgatatgggccgctggatgcagcagttccttaactcttcggttaaccaccgcacgccgcagatcgatcgactgcagacgctgatctatcgtcgcgatcagctgagcaaagtagaaggcatggatgtgccaggcaaagcggatgcgctggggatgggctgggtctttatggggccgaaaaatggtcgccctggcattattcagaaaaccggcggcggcggcggtttcatcacctatatggcgatggtgccgcagcataacgtgggggtatttgtggtggtgactcgctcgccgctgacccgctttacgccaatgagcgacggcgtgaataatatgctggccgaactggtcggtaatcagcttggctcaccgatgatggtgcaggcgattcgttaacgctgctgtacgccaccatcagactggctgacccacagggttggccagtcatcactgctgtgccaggcatcacaggtcgactcttccgcatactccgctaacacaaaacgcgtgccatcaaactgccagcgtgtggcactgccgcagtcacccaatccacgtcctttaccaaaggtgtagagctggccgctggccgcatcatattcggcgttaatcagctcaagctgtcgatcactggcacctggcggggtaaacggcagagttaaggtgatgccgcgcgcgacatacggctggctgcgcgtcacttcaaacgccagatcgatcacgttataagcccccatttcacaactcaccagcagcagcgcgcgctgatcggtgagtggcgccacgctgacttcacggcgcagtggatcgagtgagcaggagtcggtattgacccgccaggtgccgtaatcaattaatccgctggtctcatcgcgcgtcaatgccgcgggtggctccacagcaggcggcagtggcggcagcgcaggcggcggcggaacatcccagctggcgcgatcgccacgtttaacccatgcgctcatgctgttgacccgcccctgggtgtcatccatcagcaacagcgcggccttcatgccgcgcagggagatcagcgcattgggatcgaaagtgagctgaagggttttcgcctccatcaccagatcaagaaactcatcaattgcgatggcattgctggtggcgagatgatgcggttcaaccgtccagtgtttgaggtcgggtttcagacggcgctgatccagtagcaggttatcctgaagcgaaccgccaggcagcgcgccactgtaggcactgccgtagtcgattcgcagcaaggggcgatcgttgacgcccgcatgccgcgaaatcgtcatcactaaccctttgtcgcccggaatattgcgcgccacgcaaaaggcttcattgttgcaggtgatttgccagtcgttgaatgacttttgcaacggttccgcctgaacacaggcaacccacagagacggcaacagccacagcgatttcatccaatacgacattaagaaaatcgatccccgaatacccagagtggagaggatagcgcatcaacgggcctgccagggttcccattctgtgaacctgtgcaaaaagcgcagttaactgcttaaaaagcgtgcatgaaaagtggattatgcttcactttccacgctcaacgccgtcacgctgcaacaggctaactgcatgattttttatggtatcagccagccagcaatctgcgcatgctgcaacagcatgacggttttgccgtcgcgaatgcggccatcggcgaccattgccagtgcatcagggaaaggcagttccagcacgtcgatcgactcatcttcaacgccgccgcccgcattgtcgcgcagcgattcattatattccgctgcgaaaaagtggatcaattcagtgacgccgcccggcgacatatagcaggcatagagtttctccacctcgcccaccgcataaccggtctcttcaatcgcctctttgcgaatgcaatcttccggagagtcgtcgtccagcaagccggcacaggcttcaattaacatgccgccctcgttaccgttgacgtaagtggcgatacggaactggcgcgtcaggaccacgctgttcttttcgcggttatagagcaggatggtcgccccgtttccacgatcgtagacttcacgtttatggcggataacctcgccacggccatcggtgatctcataggtgtagttacgcagcacaaaccagttttcggacaggagcttatctttgatgatgttgatcttaaacgacatgaggactccgctaccgcataaagggagcctttcatcataggggcaagcttgcgggaaaactatcttaattctcgcggtgaatgaggcggtttacgccaaaaaaaagccagcccgaaggctggcctgattgctgcagcgcttatcagcgtgaggtgtcgtcagccagtcgggtcggctgaggctcctcttcgtgatgatcctgttcggtctcagctatggcgtgaacacgcttacgcacgccaaaccatcccagcaccagcagtaccgcgatcagcggaatggaggcgatggtgtaagtcccgttcgggtagtcaaacgccatcagcaccagcacgctgaacaggaacagcagcgtcagccatgaggtaaacggcgcgcctggcagcttgaagctgacatcatccgccttgccctctttaatcgctttgcgcagacgcagctgacaaaccacgataaaggcccaggaggagataatccccagcgaggcgacgttcaggacgatctcaaacacctgagaaggcacatagtagttaagcaccacaccaatcacatagacggcgatggtcaccagaataccggcataaggcacctgctgaccgttcatcttagacatgaatttcggtgcagagccacccatcgacatggagcgcagaatacgcccggttgagtagaggcccgagttcaggctggagagcgcggcactcagcaccacgatattcatgatgctgccaacgtaaggcacgcccagcttcgagaagaaggtaacaaacggactctgacccgcctgataggcgttccacggcagcagcagcaccagcaggaccacggagccaacgtagaacaggccgatacgccagatcacgctattgatcgctttcggcagcatggttttcgggtctttacattcgccggccgccgtacctaccagttcgatagaggcaaaggcgaacaccacaccctgaatcagcaccagcgcaggcagtaagccgtgcgggaacatgccaccgttatcggtgatcagatggaagccggtactgttgccatccagcggtttgccggtgccaaggaataccacgcccaccaccaggaagatcactatcgccagcactttcaccagcgcgaaccagaactccatctcggcaaaccactttacgccgatcatgttcatggtgccgacaatcgccagcgcgcccagggcgaagacccactgtggcacatcaccaaacgcgccccagtagtgcatgtagagcgcgacggcggtgatatcgacgatgccggtcattgcccagttgacgaagtacatccagcccgccacgtaggaggctttctcacccaggaattcacgggcgtaggagacgaagctgccgctgctgggacggtgtaacaccagttcgcccagcgcacgcagaataaagaaggagaagatgccacacaccagatagatgatggctaaggcggggccagcagcctgcaaacggccacctgcgcccaggaacaaaccggtaccgatggcaccgccgatcgcaatcatctgtacgtgacggttacccatcgccttctggtagccggcgtcatgagagttgagccagcgtcgtttcgcagcgcgcatctcgcctggggttttgtttttagatttcatagcattcctgtttgtcctgactatcagtcgtcgcccccatttcaggcgtaatgccctgtgaaatggggtattttcctctgtgcgtttgcctgtgagtgagtgccagacagcgcgggaatttacggcgatgaatcctacccgttctgcaagaacgaagcaaaatataccgggcagatgcacaggctgatttgtaagaatccatcctgatgcacaaaaacaaaaaaaccggccattttcaggccggtaaaagctacagggatggaaacaggagggttgggttagcgataaatctctgcggtgccgctccacaggctggaatcgcctgggttatcgacaccgataacgcggtaatggctggcgcccatctcttccgctttttgcgacagctggcgattcgcatcgtccagcgagccgcgaacgccggagaccgaaacgctaccgatgctctgcatactctgcgcctgcgactgatcgaccggcgcggcggcgaaagtggcaaatgaggcggtagccagtaatgcgcccgccaggacagcattcagctttttcattggatgctccttaatctgtgatcggggttgagttgatgactgaatgaattattagcgctgcaatgaaaagcaacatcgggacgatgtaaacctgttccttttttaagcgttgaacagcagcacgtcctgggaactgtcagttgcggtcattttatgtgcgatgtgtaacgtcctgtgcgataaacagggaatggatcatttgcgttacgttaatgcgctcttataattcccgcactttcaacagggccattcatgtgattgttaaacgttccgtaactcaaagcatcgctcaggcgctcagcgccattgtcctgctgtcgctgctcaccaccggtctggcattggtcacgctcctgagcagccagcgcgacgcggaggcgatcaatctggcgggttcactgcgcatgcagagctatcgcatggcctgggatgccagccgtcagccgcaaaatctggctcatcatctggcgcgctatcagcaaacgctggatgccccggtgctgcagaaactcgatcggccctgggtaccccgtgaagtaagtgttcgctatcaacggctgcgtgccgcctggccctcgctgcagcaacagttgcaacagggcgataccgtggcttatcagcagcaggtgccgatctacgtcggtgaaatcgatcgctttgtgctgggtctgcagcgctataccgagttgaaaatgcatctggtggccgccagcagcctggtgggggtcattgcgattgtggcgctggcactgatgacgattcgctttacccgactgcaggtggtgcgcccgcttaatgcgctggttaccgccagtcgctatgttgagagcggtaactttgcttttccgccgctgcacgttgagcagcagaatgaactgcgggtgctgtcgcatgccttcagcggcatggcggcacggctgcattcgcactaccagctgctggaaagcacggtgcgcgccaaaacagaagatttaacccaggcgaatcgcacgctgtcgctactctatgacagctcacaaatgctgaccgccagcccgctgcatccggcactgtttgaagccgtgttaaccaatgtactgacgcgcgagaaactgacggcgatccggctcgacagcgaccagtttcagtttcgtgccggtgatgatcaggcagccggtcagtggcaacgtctgccgttacagcaggacgagcagcagattggcgagctgcgctggcagacagctggtgcctcgcctccggatgaactgatgcgcagcctggcggcgatgctgggacgggctatctggatctggcaggcacagcagcagtatcagcagatgctgctgattgaagagcgcacgaccatcgcccgggaattacatgactcgctggcgcagtcgctctcttttttacgcattcagctgaccctgctgcgccgcgccgttgataaagacgatagcgccgcccataccattatcgcggacttcgatcaggcgctggccgaggcctatcgtcagctgcgtgagctgctgaccaccttccgtctgaccattgaacaggcggatctggtggcggccatgcaggcgatgatcgcctcgctgcaggagaagagcagcgcagagatacactttaactatcagaccggcctgcagagtctggaagcacaacagcaggtgcatgtgttgcagatcgtccgtgaggcgctgctgaatgcgattcgtcacgccagtgcgcaggttatccgggtggattatcagcacagtgaaaaaggtgagcacttactgacgattacggatgatggcgtggggatgaacagcactgacgaaccgccgggccattacggcctgactattatggcggagcgcgctcagcgcctgagcggccatctgaccctccacgcacagccacggggtaccagggtggagttgcgctttccaccgcaaccggcgcgcccgctggaatagcaggccagagctaatcttaattcattaaaataatctatcggtttgcgaccgcgggctattcgatacagaacagggtgttgtccctgaacaataccgtctgatctgccgcagtctgaaacctatgaaacggagaaaatatgcaacagcccgcattaacattgatgattgtggatgaccacccgctgatgcgccgcggtgtccgtcagctgctggcgctggatccccggctggaggtaatcgccgaagccagcaacggcactgaagcgctggcggaggctcgccatcaggaaccggacatcattctgctcgacctgaatatgaaaggcatgtccggattggatacgctgaaggcgctgcgccatgaagggatcagttcgcgcattctggtgctgaccgtttctgacgcccgcagcgatatttttgccatggtggatgccggtgctgacggctatctgctcaaggacagcgagccggagatcctgctggggcatatcctgcaggcatcgcggggcgaaaaggtcttcagcgagggcgtcacccgctatctggctaatcgccagcacagtgccgatcctctgcgtcagctcaccgagcgcgaacgggatgtgctgcaggaggtggcgcgtggcctgtcgaataaagaggttgccgctattctgcatatctctgaagagacggtgaaagtgcacattcgtaacctgctgcggaaactggatgtccgctcacgcgtcgccgccacggtgatgtggcttgaaagccgcaaatagccaacgaatttacattttctcctcaatttctccacgatttcccccgctgccgcacgtagagtaaacggcggcggagaatcatggcaaagacccgccgagtttcctgccagagcgcccgttgctggtgggcctgaccaacgataaaagtagtgaggagtgtcgatttaatgtcgaatttctttatcgaccgccctatctttgcctgggttctggcgattctgctgtgcctgtgtggcacgctttcgattatttcgctgcctattgaacagtaccccgatctggcaccgcccaacgtgcgcatcaccgctaactatccgggcgcatccgcccagacgctggaaaacaccgttacccaggtgatcgagcagaacatgaccggcatcgataatctgatgtacatgtcctctaacagcagcaacaccggccaggcacagatcaccctcacctttaccgccgggaccaatcccgatgaagcccgtcagcaggtacagaaccagctgcaatccgcactgcgcaaattgccacaggcggtgcagtcgcagggtgtgaccgtcaataaaaccggtgacagtaatattctgatggtggcattcgtttcaaccgacggcagcatggataagcaggatatttcagactatgtcgccagtaatattcaggatccgctaagccgtattgatggcgtcggccaggttgacgcttacggctcgcaatatgcgatgcgtatctggctcgatcccaataaactgatcgcctattcgctgaccacggaagatgtggtcagtgcgatccagtcgcagaacacccaggttgccgtgggtcaggtgggtggcctgccgtcggtagagaaacaggcgcttaacgctacggtcaacgcccagtcgatgctgcagacccctgagcagttccgggcgattaccctgaagaacaatcccgatggttcggtggtgacgctgggcgatgtcgccagcgtggcgctgggcgctgagaagtatgattatctgagtcgttacaacggccagcccgcgtcaggcctgggggtgaagctggcgtccggtgccaacgagatgaacaccgataagctggtgcgggcgcgcattgaggagctgtcccactacttcccacacggtctggaagcaaaaatcgcctatgaaacctcccctttcgttaaagcgtcaatcaccgatgtggtgaagacgttgctggaggcgattgtgctggtatttggcgtgatgtacctgtttatgcagaacttccgtgccaccttaattcctactattgcagtgccggtggtgctgttcggcaccttcagcgtgctctatgcctgcgggttcagcatcaataccctgaccatgtttgccatggtgctggcaatcgggctgctggtggatgatgccatcgtggtggtggaaaacgttgaacgtatcatgcatgaagagggactctcgccgcgtgccgccacccgaaaatcgatgggccagattcagggcgcgctggtgggtatcgcgctggtgctctctgcggtgtttgtgccgatggcgtttttcggcggcaccgtcggcgccatctaccgtcagttctcaattaccattgtgtcggcgatggtgctgtcggtgctggtggcgatgatcctgacaccggcgctctgtgccacgctgctcaaacccgtggcgcagggcgagcagcctgagcgtcgcggcttcttcggctggttcaatcgtcactttaatcgcaatgctgaccgctacgagcgcggggtcgcgggtatcctgcgtaagggcggtcgctggttgctgctctatctcggcatcatcggcctgatggcctttctgtttctgcgtctgccgacgtcgtttctgccgctggaagatcgcggcgtattcctgacgcaggttcagcttccggcaggcgcgacgcttgagcaaactgccagcgtcgtcgccaaagttgaaaactattatctcaccgaggagaaggccaacgtgctgtcggtcttctccaccatcggcgcaggtccgggcggcaatggacaaaacgtggcgcgtctgtttgtgcggcttaaagactgggaagcgcggcccggtgccgatcgcacctcgttcgcgattatcgagcgcgcgacgaaggcattccagaagatcaaagagggccgggtgattgccagcagcccgccagccatcaccggcatgggcagcagctccggctttgacctgcaactgcaggatcacgcgggcgtcggtcatacccaactgatggcgatgcgtgacaaactgctggagatggcgggcaatgacaacgcgctgtcgcgggtacggcacaatggactggatgacagcccgcagctgcagatcgatgttgatgcacgtaaagcgcaggcgctgggcgtgtcgctggataccatcaacgacaccctgaccaccgcgtggggttccagctacgtgaatgacttcctggatcgtggccgggtgaagaaggtctatgtgcaggctgccgctgaattccgcatgctgccagacgacatcaacaaatggtacgtgcgcaatagcagcggcaaaatggtgcccttctccgcgtttgccaccagccgctgggagaccggttccccacgtcttgaacgctacaacggctattcatcgctggagattgtcggcgaagcggccagtggcgtcagcagtggcacggcgatggatgagatggaaaaactggttaatgccctgcccctgggcgtcgggtttccagtggaccggtgcctcttatcaggagcggctctccggttcgcaggcgccggcactttatgcgatttcgctgctggtggtctttctctgcctggccgcgctgtatgaaagctggtcgatcccgttctcggtgatgctggtagtgccgctgggcgtggtcggggcgctaatcgccacctggatgcgtgggctggaaaatgacgtctatttccaggttggcctgctgacggtagtggggttatccgccaaaaacgccatcctgattgtagaatttgctaatgagatcaacagccggggacgcgagctggtggaatctacgctggaggcatcgcgtcagcgcctgcggccgattctgatgacctcgctggcctttatctttggtgtactgcccatggcgatcagcagcggtgcaggctccggcagccagcatgccgtgggaaccggtgtgatgggcggaatgatctctgccacactgctggcgatcttttttgtgccgctgttctttgtactggtacgccgccgtttcccgctcaaagagaagccgctcgactaagtagaggcgcaaataaaaagcggtcactgatatcagtggccgccttatttctgtgtgtggtaagaattccagcaagcgggattaacctgctttttcttcgcgcgttacttgttgcgtaacatcgcttcgataaattctttccaggttcccatttcggtgtcaatcataatgccctctcttattgtgctggcaatgttacgctctttttttatacaggtgaatacgtttacacctgttatatctatcggcatacgccataaaaacatgaatgttgctggttttgcaagctgacgcacacttcagcaactccttaaccccgttgaaaataatttattttaaacccagcggtagactattttatcaacatggcgaaattcctaagctcttattgataagcagggtaatggttagctgcgaaattgatagcgtttacccgatgccggacgatgaccttgctgccgtgctctgtggcccgattcccgcgcctgtgcagatgccgcaacggatcacactatggtaaactcgcactttggctgcttttttcagctttcacttctcacaggacaataaggatcgggcaatgagcacgcagtgggtgatgttcgggattaaaaattgcgacaccataaaaaaagcccggcgctttttaacagacgcaggcgttgactatcacttccacgactaccgtgcggatggcctgaacgatgccctgctgcaggagtttatcgattcactgggttatcaggctctgcttaacacccggggcaccacctggcgtaaattgcctgagagtgatcgcgacgcggttaccgatgccagcagcgccaaagcgctgatgctggcgcatcccgccatgattaagcgtccgctgttgcgcgccccggatggcgccctgctcgccggtttcagcgaagccacctatcagaatgctatccaggagaagtcataatatgttttgcccggtcattgagctgacgcagcagcttattcgtcgcccctctctcagccccgatgatgccggatgtcaggctctgctgatcgcccgtcttgaagccattggctttaagattgaaacgatgaacatcgacgacaccctgaatttctgggccacccgtggcgaaggtgaaacgctggcgtttgccggtcacaccgatgtggtgccgcctggcgatgccagccgctggattaatccgccatttgaacccaccatccgcgacggcatgctgtttggccgcggcgcggccgacatgaaaggatcgctggcggcaatggtggtggctgccgaacgttttgttgcagtgcgtcccaatcaccgagggcgactcgcctttatgattacctctgatgaagaggccagcggggccaacggcacggttaaagtggttgagcggctgatggcccgccgcgaaacggctcgactattgcctggtcggcgagccctccagcacggaagtggtgggtgatgtggtgaaaaatggccgtcgcggctcaatcactgctaacctgatggtgcatggcgtgcagggccacgtcgcctatccgcatctggcggataacccggttcaccgggcgatgccagcgctgaacgagctggtcgcgaccgagtgggatcagggaaatgagttcttcccggcgaccagcatgcagattgccaacgtccaggcgggcaccggcagtaacaatgtgatccccggcgagctgtttgtgcagtttaacttccgcttcagcaccgaactcaccgatgagatgattcgtcagcgggtcgcagagctgctggatcgtcaccagttgcgttacaccattgagtggaaactctctggccagcccttcctgaccacgcgcggtaagctggttgatgccgtcgtgaaagctgtagcgcactataatgaaattaagccgcagctgctgaccacgggcggaacctccgatggccgctttattgcccggatgggtgcacaggtggtggaactggggccagtgaatgccaccattcataaaatcaatgagtgtgtgaaagcctccgacctgcagatgctgagccggatgtaccaacgcatcatggaacaactgatcgcctgacggcggttttaaggagcagcaaatggaatttattaaagattactggtggatcctggtgatcctgctgatggttggcgtgctgatgaacgtttataaagatctgaaacgcatcgatcataaaaaatttatggataacaaacctgacctgccgccgcatcgtgattttaacgataaatgggatgacgacgacaactggccgaagaagaagtaaacgaaaaagcccctgctatgcaggggcttttttatggttcttcacaaagtcagctctcatcagcgttaagatcgagcttgcgcaggggcttttttacatcatcacgataacatcatcgtcacccggttttgcgccgcttaacgcctcatcaaagtagcgttttggcaccgtataacgcagatgattcagcgccagctccatgctgcggtgatcgatggcgtgttccagatcgtcaacgatatccagggtaacatcgccaccgcaggcggtcagccgatgctccgcctgctgcgcatggtgcagcgggacctgctcatcataatcaccgtggatcaggtgaatggtagtgcgggtactggccttctccggcagggtaataaaccggccattaaacaccaccgcgcggcccgccagatccggatgcgccttaaccccttccagcaccatactgccgccctgcgaaaagccgattaaggctgtcgcttccggccgcacaccgctctttttttgccagtgacgcacagacccaacaaactgcggcatggccgcatcaacccgctgctggacggtctgatcgtgcaggtcggtttcgccgaaccactgacgactcgcaccaggcgagccgacggacaccaccagcgcgtcgggaaacgttcgggcaaaccagttgccaatctcgcccattgaatccgggttatcgccaacgccatggtagagcagaaacagctgtgctgtggtggcaggctgttgaacgattacatatttcagtgtcatgttgacctcctgtgttcactctacgccgcctggcataaaatcatatgaggataatttgaaccagctggtcgaattatttcaacggcaggtgcagcaaggctgcatcaacgcccagtgtctggagggccgctgccgcctgctgacgcagcgctgcgactagcgctttgcgcccgctcactcccgcctgctgggccagttcgcccagggctgtgggtgtggcaaccgccgcagccagcagcggtaaagaggctgaactggcctgcaccagacgctgcaacaccggcaggctcgcttccagtggccgctgcgcccaggcaaaacccgccgccagacgaatatcctgcgcggtcaatccgtcgtcagtaacctgatcaaactgcagttccagtgcgatatgctggcgcaacagcggccagtctcgcgccagctgttctgccgcgcggtgctgcaatgcctcacccgcagcagaacagggcaacatggccatcgccgcgtagcagccgctgctggcttcgcgctgactgccaatccgcaccaggctaaagccacaggcgcgccagaacgcccagagagattcagtgtagccgaagctgacggagaggtagtcatatccggctgccgcactggccgctgccgcaaccagctgctgtccggttcccagacgacgccgctccgccgccacggcaatacggctgatgcgcagcgagcgcaatgtcgccgcctcagccagaccagcgtgggctgccagcgactgcgccaccagattcccgcggggtcgccgggtacccgcccagaccgcctgtgccagtgcaggttcaagaccgccctcttccaccagccagagcgcgccctgtaacgccgacgcgtcgcctgcccgccacagctgcatgcccggagcatccagcaggcggcgcagatcaagcggtgaggtacgataatgcgcactggtcagcagacgatacgcggcctccagcgcgctgaaatcgtggcgctcaacacgatgaggcgttacaggagaatcgggtgcggtcgcgtcggcatcgtcaaacagtagcgcctggttcagccactgctccagcggatcgaaacgcgaccagcgcagcggctcatcgagcgtaaaatagtgtgcatcaggaagcccggcgcagaacttaaggataaacccgcgcccgcttccttcgtagccctgtacggtggtggtgagcaatacgcggggatatcgactgaccagcgcctgaagcagcggtgccgggatcgccgccgcttcatccacaatcagccattccgcctgcggtggcgtctccagcgccagcagcgcatcgggtgccataaagtgaaaagcgtcagcggcgaaggtgctcagcacctccgttgaggctttggccggagccgtcaccagacaatgtccgttcaatcgcgccagcatacccgccagcgccgatttaccgcgtccgcggggcgcggtcagcacggcaacccccgatggcagcctcatcagctgatcgagtatcgcctgctgctgctgcggtgcctgacagtgccactgcggccagtccggctgcgccggaaaccggcatggctgatgctgccgctccaccagcacctggtcatccgctaatatcagctgttgcaggtggtgaacaaaataaggggtggcgatgggttcagcgacatcggcccagcgcaggctgtcgctgtcaggctgctgcgcccactgttcccagggcggcaccagcagtaacagccagctaccggcggtgagcgtgccagccagcgcagcgaaagcgtcggcatgaaagccctgacgggcgtcaaacagagcatgacgaaattcacggccaagcagcgtgcgcaccgcagcaggctgtttgtgcaggaccggcgttttatactgacccggccctttatccgaagcagagaaacagcggttccgggctcaacgccagccagtcgccggtcagcgtttcacgccacgccgcagcccgtagtaaacaccaggccgggtcgccgctgatcaccgccagacgacgcacaccggcctgctgcataagctgcgtaagaggctgcagactcatcagttgctggcgaaggtgttgcactgtcctggattgccaccatcaaacccgcgcttgaaccaggtgtagcgctgctcagacgtgccgtgggtgaagctgtccggcactacgcggccctgacctttctgctgcaggcggtcatcgccaattgcctcggcggcattcagcgcttcctgcagatcgcccgcttcaaggatattttcctgctgcatatagtgtccccagacaccggcaaaacagtccgcctgcagttccattttgacggagagctgattaacctgcgtctggctggcaccctgctgcatttcacgcactttcggttcaatgcccagtagtttctggacatggtggccaacttcatgcgcgacgacgtagccctgggcgaagtcaccgtccgcgccgagtttggttttcatctcgtcataaaaagagaggtcgatgtagacggtctgatcggcaggacagtagaacggccccatgactgactgtccggtaccacagccggtgcgggttgcgccgcgatacatcaccagcttcggcggcacatactgtttgttcatctgctggaacagtttgccccaggtatcttccgtggtggccagaatcaccttcgtgaatttcgcagcctcatcatcattggcgctgacgctgcgctgttgctgctggctggtcggtgcaacttcgccgcctgtcagcagtgcggtcaggtcgtaaccgtaataacccgcgatggccacgacaatcagcagcacaataccgcctttaccgcgcggcagacgaatctggcggcctccgccgcctaaaccggacgattgatcgcgacggtcttctacattgtcgctttcgcgacgcccttgccagcgcatgctgtgttccctcagtcattttttcagatggcatgattttagttgtgtgaagcagcaatcaccagctttaccctgaaatgaaaaaaggagagccggggctctcctttttctttctgcgcggcaggcaaactcagtcgagcttcacgcccagccgctgtgcaaccgcttcataggcttccaccacgccgccgaggctctggcggaaacggtctttatccattttatccagcgtctctttgtcccacaggcgcgcaccgtctggcgaaaactcatcgcccagcgtcacttcgccgttaaacagaccaaactccagtttgaagtcgaccagaatcagacccgcatcgtcgaatagtttgctcagcacctcgttggctttaaaggtcagctcctgcatccgcgccaggttctgtttgctgacccagccaaaggtttcgcagtaggattcattgaccatcgggtcatgctttgcatcatctttcaggaaaagatcaaacagcggcggattgagcacaatgccctcttccacgcccagacgttttaccagtgagcctgcggcgcggttacgtaccacgcactctaccggcaccatctccagcttcttcaccagcgcttcagtatctgacagcagcgcttccatctgggtcggaatacccgcttcctgcaatttagtcatgataaaatggttaaacttgttgttaaccattcccttgcgatcaaattgctcgattcgggcaccatcacctgctgacgtatcgttgcggaattcgagtatcagcagatccgggttatcggtgctgtatacggttttcgctttaccgcgatacaactcagctcgcttttgcatcttgttcactccagacttgaaataacgggtgttcagcggccagtgccgctgcggcgattgccttgacgcaatcgtttacttcgccgcgcgctattatgccaaaaacaaaataaaaaggccggagaatctccggcctgtggcaactttatttgttcagcgccgcctggaacacggccaccagcgcatcgtttctgcgactgggtcagcacatgccctttcgggtcgatgaattgcagactggtgcggttgtcgagatcgccgacctgcactttgtaatcaccgtttggtaattccggatctttcgcaccgactgaatcccagtcgctgctgctcagtgacttgtaggtcaccttcatgctgccggttgagcgggtcgtgtcggtcacttccatcccgacgcgtttcattgcatcaggcagacgctgccatgccacgttgtatggcgtacgcaggatcagcagtggcaggccggtatcatctgcaccgctctgcacatcaatggccccattcacccgaccagaggccgcgttttcactcgccgtatcaatcttgtccataccggtgctgatgtcattcagcatctgcgcggtgtaacgctggatctgcacaggtgaggtaatggttttaccatcctgctgcagctccagcagacgaacggttaactgctgctgatagctctgcgactgcacgctgatctggtagcgaccacgatactgctgatcttcatcagcacggttccactgcacccagtccgtcgtcagctgctggcctgcgtcattacgtgaggcaatcgggaatttgtatgactgcaccacgttgacgacctgcgaccagactgagccgcggctgttatcaatcatcagcgcgccggtattgttgctgaactgtgcgcgggtgccgttcatcagcgccagcggctgggctggcggacggatgtcgagctgcttgccggtgggtgcctgactggtcgtgcgcggcacgtcgaaatcaccacgctgcaccggcaggatcattccggcaggcgctttcagttcatttaactgactggcttcaagataagattcgtcaccgctgacctggcgcttataacgctgatcgcttgaacaggccgacaacagcatcagggtagaaagccccaccactgtggctactgttgaccgctttactgagtaattcattcaaactccctaaattatcgcaaacccgctttcaccagcgcctgctccactttcggctggccggctgcagtcagtggcgtcattggcagacgcagcgtgtcgttagcgattaatcctagctgtttcgcagcccatttcaccgggataggattgggttcacagaaaagcgtctggtgcagatgcatcagacgctgattcaggcggcgtgcctcgacgaaattgccctgctgtgcgagttgacacagttcgaccatttcgcgcgcagccacgttggccgtcaccgaaataacgcctttgccgcccagttgcataaagtccagcgcagtcgcgtcatcgccactcaccagaatgaaatcttcattaaccagctcttggatctgactaacccgcgataagttcccggttgcctctttgattccgataatatttttgatttcggccaggcgggcaacggtttccggcagcatgtcacaaccggtacgcgagggaacgttatacagcatctgtggcaggctggtgctattcgcaatcgctttaaagtgctggaacagcccttcctgcgtcggacggttgtaatatggggtcacggtcaggcaacccacaacgccggaattttcaaaacgcttagtcagagagatgccttcagcggtggcgtttgccccggttccggcaatcaccggaatacggccatcggccagctccagggtcagcatcaccacatcaccatgttcttcatggctcagggtagcagattcgcctgtggtgccgacggaaacgatcgccgcggtgccgctggcgacgtgataatcaatcagttttttcagactcgaccggcagacattaccgctgtcatccattggcgtaacgagtgcaacaatacttcccgtaaacattggcgatcccctcgacaaacaagtgcttcatggtacgttttacacttagggaaaagcaagccagccacgccattcccgcgcttgtcagcagttttttttatgtttaccttatggttattagcgaaagcagaggaaaagccattttgccgcaatctcagccccatcatctggtgatcaccgcgctcggtgttgaccgtccgggtatcgtcaacaccattacccgacacgtcagcagctgcggttgcaatattgaagatagccgtcttgccatgcttggggatgagttcacctttatcatgctgctgtcgggcagctggaacgcgatcacactgattgaatcgaccctgccactgaaaggggcagagctggaactgctgatcgtcatgaagcgcaccaatgcccggctccgtccgccgatgcccgacaccgcgttcattcaggttgaggtggctgattcgccgcatattattgaacgctttaccgatcttatcgataagcatcagatgaatgtggccgaactggtgtcgcgcattacaccagcgcaacacaatttgccccctacgctctatattcaaatgaccgctcacagtccgacgcgaaccagtggcaccccgtttgagcaggcgtttaataccctgtgtcaggagctgaatgctcagggaaacgctgcgcctttacagtgtgtcagatgccgacagcagcgaatctgtcagcgcggtacgctaagctttggtcaattaaccggagttatttctccacattactgccactgaaaggtgaccggctatgtggtgaaataccccctgatggtaattttccctctggccgtttctgaccggatggtgtattacccacagcctgaataagaaaatggagagatgtaatgaatccactgaaagccggagatactgcacccgcatttagcctgcccgatcaggacggcgaacacgtgaatctgaccgacttccagggacagcgcgttctggtgtacttttacccgaaagcgatgacaccaggctgcaccgtgcaggcgtgcggtctgcgtgacaacatggatgagttgaaaaaagcgggcgtggaagtgctgggcatcagcaccgacaaaccggaaaaactgtcaaagtttgtcgaaaaagagctgctgaactttaccctgctctccgatgaaaaccatgaagtctgccaggcgtttggcgtctggggtgaaaaaacgtttatggggaaaacctatgacggcattcatcgcatcagctttctgatagatgccgagggcaggatcgaaaaagtgtttgataacttcaagacctcgaatcaccacgacatggtgctggattacgtcaagtcagcctgatgttgaggggcgcggtagccttaacgccgcgccctgcttagctgcctcttccccgcccgtttttatcctgccgttgcgaaacactgtgagttaacgcgattacgcggcggccacgataacgcagttgcgcccggcatttttcgcttcatagagcgccgcatccgcctgttttaaactgccttccagcccgacatcctgcgaaccattccaggccgcgacgccgatagacaaggtaatgcgacccacgtcggtgagccaggcttctgcaatgcccagtcgcacgcgctcggcgataatctgcgcctcatccagcgccgttcccggcagcagcatcagaaactcctctccaccgttgcggcacaccacatcagactgacgggcgctggcacgcagcgtgctcgccacctgctgaatcacccggtcgcccacatcgtggccccagctatcgttgacgtttttaaagtgatcgatatccagcgccagcaccgagaaaggctgacgtagcgtgcggtagtactccagtaccgcattaagaccacgccgattcagcaactgagtcagggggtcggtctgggcttccgaactcagacgaccgattttgtcctgcaccagtccgatgccggtgagcagcgcgcgcttgacctgcgccgcctcaaaataccaggcactgatgccgccaatctcttttgatacgccctgcgcatccatccggctggctttgcgggccagctggaacagtggtcgggcaatcagccgtgccagccctaacgcaaccagcagggtcagcagtgcgaacggcaccgagtttttcaggactttcattaacaggcctgaaagcgggttcagcgtgacgttaatcggcttcagcgccaccaccgtccagccggtagtcgggacgacggcatagcccgccagctgcgtcgactcacctgcacccgcaagcatcagcgagccattggtctgctcgtcacgcggactgacgatggcgggcagaactttaccaatcagctgacgattctggtgatacaacacctcattattactgtcgagcacatagaccgtggtgccatcacggtagaattgttcacccagtagcgcattcagaatactttttttcttcagatagatcgtgccgccgatgtagcccagatagtcgccatcgggactccagattggccaggagacaaacaccagcagattattggctgcagaaagggtcggtttactgatgatcggctgccgcagcgtcagcgcttcgcgggaggcgtcgctggtgacacgcatccctttcagcgtcagggattcgggcgagatcgctttgatcgcgccctgctcatccaccacggccaccgagttgaaactggtggtctgctcgcgcagacgattgacttcgctattcagcagcccttcattattaaagtcacggcttagctgattggcgctgtagtgcaactgtgactgcgccagctggaagaaaatttcactggttgaagccagcttggcggcataggcccggttagcctcaagcgtggtgtcaatcagcacctggcgctgcacccgccaggtggcgtagagcgtattcgcgagcgtgataacaatgctgacaatcaccagcagggcgatcagattgcgcaagtcggccttgggccgaaagagctttagcatggcgtcgccgccctggagaagagtgtcatgtcgtgaatgcctgattatttttttaatgtatgccagaagccctgatagccgggcttaagtctacactgtgtcggcatttttgagcagcattaagacaaatatcaccccgcttaatacagatttagctggcactaatcgattaacccctgactatcgtaaaatggccagggtcccgaaaaatggccaatcgcgcactgatgcgtgaccattccctgccctggctgccagcaatgcagcaaaaagccgggcggctccagaataaagtgagccggcccctccggatgcagatccagagccacctgatgcgacacgcctggcgcgacacaggccagggttccggcaaagcgggtctgcaggctgcgatgcagatgaccacagagcacccgctcaacctgcggatggcgggcaatgatcgcctcaagtgcctctggatgacgtaaccgttgccgatccatatgcgcaatgccacaggcaaaagggggatgatgcagcatcaccagcgtgggctgatccgtggcctcgcgcagtgcctgatccagccattgcaactgctgctcatctacctccccccacggctgttgcggtacgctggagtccagggccagcagcctgacgccgcccacgctaagctgccagttcagggtcggtcccgcctgcaggtaggtgtgagcagggaaggcagcacgcagtgcctcgcgatcgtcgtgattgcccgccatcagataaaagggcaactggaggcgctgcagggcttcgcgcagcgtctgatactcttccggcctgccaaaatcgaccaggtcgccggtaatcaccaccacatcggggcgcggctgcagcgcgttaagggtatcgataacctgcagtaaagcggcatgggtatcgacctgtttataagagagacgaccaaaagccttgatatgcagatcgctgatttgcgcgatgactgtgggttgaacagacacaacagactccttagcaactaaattccagcgcggcctggcgggtcagcgaccagctgatgcgctgtcccgcctgccagatttcgcgggcatgacgctcgacctgaatggggttatccagcccgatatcgatcagtaagcgctgcgaggcgccaagaaacgtactgcccaccaccacaccgcgctgggcatagcgggtgtcgtcagccagcagcacatcttccgggcggcaaaaacgcaggggatgaccgtcgggatcgtgcgcaatgcagtttatggcgcccacaaaatccgctacaaagcgggaggccgggcgctgataaattccctgaggagtatcgagctgcaccagacggccctgctccatcaccgcgatgcgatcgcccagcgccatcgcctcctgctgatcgtgggtgacgtaaaccgcagtgatcgccagccgcttgagcagcgcgccgatctccagccgcagccgatcgcgcagcctggcgtcaagcgctgccagcggctcatcgaacaacaggactttgggccgggcggccagcgcacgtgccagcgccacccgctgcttctgcccgccggacaatttatcaatcgcccggtgggacagatgtgtcaggtcaaccagtgccagcatctccgcgacccgcgcatcacgctcggcacgtggcacgccctgcaccttcagaccataggcgacgtttctgcgccacgttgagcgtcgggaacagcgcgtagttctgaaacaccatgccaacgttgcgtttctcaatcggcagcgcggtgacgttacgcttgtcaaaccagatctctcccgggggatcgctgctatccagaccgctgataatacgcagcagcgtggttttgccacagcctgacggccccagcaataccagtgtttcaccggcgtgaacctgcaggtcgagcggatgcagcgcgacctgctgattaaagcgacgcgagcagtggctcagcgtcacgttgacggcctcattcatacggtttcctctctctgctgccgcgaagattgccgttccagccagtgattacaggcgttgagcaacagcagcagcggtaaaatcatcataataaagatcagggtataggcggacccgacttccagccgcatcgaggtgtagctgtcggccagaccgaccggcagggttttggtcagtggcgtgtgcagcatccaggtaatgttgaactcccccaccgacagggtgatcaccataaatgcgcccgccagaatgccgttgcggcagttcgggacgaccacggtaaagaagcggcgccagaagcccgcccccaggctggcggcagcttcttcaaggcgcggcagatcaattgcctgcatcaccgacagcaccggtcggatcataaagggcaaggtaaagagcacatggccgatcaggatgaagagccagctgtcgcgcaacgcgctgaactgaccataaagcagaatgatgcccagtgcggtggccaggcccggcaatgcgactggcagcatcaggcactcctcaatgcggctggcccagcgtgacggtgatttcagtaagccccaggcggccggcacgccagcgataaccgtcaccgccagacaactcagagcgatcagcagcgacagccagaaggtgtcggcatacatctgccacacctgttccacccacttcagcgtcaggccgctgcgcaggccagtgaaatagttctgcgtgacgcccgccagcattgagagcacaaccggcacaatcataaacagcgcggtgaggctggtgatcaccacctgcagccagaacagcccccggcgtttcatgccttttccttacggcgggcagccagtccgttcgccagcatcagcgccagccaggccaccgcccccatcaccaccgaaagcgccgccgcagtggcaaagttggcgtaattagtgaactcaccataaatggtcagcggcagcaccgcgagctctgtgccaagggtaaatgcggtgccaaaggcacccatgctggtggcgaagcagagcgcgccgcaggagagcagcgccggtttcagcccaggaatgatgacgtcaatgatgatgcgccactggctggcacccagcgatcgggcggcctcttccagcgaacggtccagcttttcactggccgccaccagcgtcacgatggcgcgcggcagcgaaaaatagagatagccaataaataagccgctaagcgaataggccaggatccagcgctcatgaaacaggctgagactgagttgcgccagaacaccctgacgccccgccagcatgaccatcagaaaccccaccaccacgcccggaaaggccagcggaaaggtcagcagcgccagcagcgtgcctcgcccggtaaagcgctgccgtgccagaaagcagcccaccaccgcagcaatcagcagcgtcaccagtgtgaccgctgccgagagcagcacggtattcagcaggctttgcagatattgcggctggctgattaccgtccagtagccgctgtggtgagttgtacgatcttccgtcataccgatctgcaacagacgagcaaacggcaacagccagaaggcagcaaagaacagcagcgcaggcagcagcatccacggccagtttgcccccagcggccgaaggcggtggcgaaactgagtcgccagcagcaaacggattgatctctgagagtgacatcagcggatctcgctcaggtaacgggcggagaagctcttctgcgcgtcggccatctgctgataatcaaccgtgtgagcgcgcgcatagtcgctgtcaggcagaaaatatttcttcgcttcgggtgacatcgcgcccgcccggaccggacgcagccaggcattagcccagatcgcctgaccggcatctgacagcacgaaatcgatcactttcttaccgttggccggatgcggcgcatttttcaccaggctgatgacgtaaggcaccgtgaccgtcccctcgctggggatcacaaattccacattggcgtgatctttgtagcgggcgcgataggcgttgaagtcgtagtcgatcagaatcgggatttcgcctgaaatcagccgggcataggcggtctgcttaggcacaatcggctggttgcgttgcagcgctttgaaccagttgatagccggggtgaagtcatgaagactgccgcctttcgcctgattcaccgcgacggctgcaacgtagccgacaaaggcgctggccggatcaagataacccaccatgcctttatattccggcttcagcagatcgtcccaggagcgcggcaccggcgcgccacccagcgcatcaacattgaccataaagcccatggtaccggagtgcagcgccacccacttgccagcaggatctttcatgcctgccgggatctgatcccagtttgccggtttgtaagcgctgaccacgtctgcactgactgcctgaatgccgaagctgacgccgtaatagaccacgtcggcgaccggattgcttttctcggcgaccagctgcgccagcgcctgacccgaatttttattgtcctgcggcacatgaatgcccgtcgttttttcgatcgcctggagctgtgtcgcccagtcggcccactctggcgggcagttgtagcagatagcattttcagccgcctgcgcccacgatgaggcaagcgtgcatccggccagcagcgcagcgctggcgataggtttgaagttaacggtgagtgacatgatgttcccctgaaaaagagccatgaaatgccggggcgacactctccccgaaacgtaaatgatgagccagcagatgggttttaccgccgacgggattcagaagcaggtcaatggcgcgcgcgcccattagcgcaatcggctgcaccacgctggccagtgaaggtgaaagctgttcgcccagctcaatgccatcgaagccgaccacggagagctgattcggaacgctgacgccggcacgcgcagcggcgcccagcaggctgatagccagcagatcgttactgcaaatcaccgccgtcagcggcgaaggtgaattaatcagcggcagcaacggatggaaatcggactggatatggctgggcatctcaatcatcgcctgcggcgtcagaccggcctgctgcatggcatcgcagtagccgagatagcgcagacgggcgcggtcagattgctgcataggacccgcagccatcacgatgtggcggtggcccagtgacaccagatgggcggtcgcttcggcaatggctttgcggttatctacgcacagcgcgggccattcgtgctgttgcggtacgttgtgggtcagcacgaagggcatcttcgccgccgccagtgtcggcagcagcgcactgctgtcggcatctgccaccgtcagtaccagaccggcgacacgctggtgcagcatatgttcgacaatggccgcttcccgctcagcctgataatcactggttgctaccagcagcccatatcccgccagacgagcctgctgctccatcgcctgtaattgcatggcaaaaaccggattgagcagtgaaggcaacaggacgccaagcgtggtggagtgctgggtgcggagctgacgggcaatatgattcgggcggaaaccgatctgttccgaggcggcaagcaccttttgcagcgtgcccggttttagcagatgagggtcagaaaaggcgcgcgcagcggttgcgcgggagacccctgccagtctggctacgctgattaaatcggtcatgactgcctcgtgtattgtcgatgagatcgatctcattgcgacaacactagcggcgtttctatgacaggggcatcacagcaatttgacgggcagatgacagcggcagtgacgccgctgtgggggaattaaagcatcaggaaggcgtaaccgctgttttccagggtcgcaacggtggtgccgctggagatggtgtgagtgaccatcgggtcgatccagttgcgctcaagctgatgaaacgccactgactgatcgcagatagtgacctgaacgcccgcttttttcagttcgctgatcagcttcaggttcgggttatcgacgccgtaggctttgctgaactggtcattattcagcgctgatgaaaccgcgtcgccgttaattgacaccacaaatttcagctggtcgagtggcacacctgccgcataatagaggttggtgacgcgcgctacgcgctccagaccgagattcggcttatgaatatccccttcactgcggttgatctgaaatactattttattactcaggcccgctgtcgtgccgggtttaaatgcaggcgtatcgacataatgtatttttccgtagccttcaatcgctggcgtactccagaaatcagcaggttcggatttattatccgccattttcccgctgaccttatcgaataattccggcaactgtaaaacattgcctccgataaatcccgctacggctgccatcaccactaaagctgctggacgcattaactcttctcccgatcgtttaaaacatcaattacattgccagccacgcgtatccctggttttgcagggttgatacggtggtcggactggaaagtgcatggactacagatttatcaatccagttattgggatagtgatggaatgccacggactgatcgcagaccgagactttcactcccgcctgattcagctcattaatcagcttcaggtttggattttcgatgccataaaactttttaaaatgggcattatccagcatggcaggggtcgcgtcgccggtgaccgaaacgacaaacttcagctgatcggccggaatgccggaggcgatatataaattcaccacgcgcgccacacgctccagtcccagattgggcgcggtcatcgcgccatcgcttcgggtaatctggaaaacaattttattgctcaggcccgccaccggtttaaacgcggcgtcgggctcataatgaattttgccgtaaccttcaatcgctggtgtgctccagaatcccggggcttcctgtggctcggttgcaaaatggcgtgtcactttgtcataaatctcgccactctgtgtgacagccgcgccaacgactccgccaataatggcgattaacgcgtatgaaacaactgaacgcataacacttctctccggcaaataatgtctggcagattcaggactgaatcaggtcggctatctatatcacagcgcaggcataattctcgcctgcgtaaattcaggtcagcgcgcggctgataactgctgaaattattcaccttccgtattaatcgaaaagtttcattatgaggaaaaaaaggtcttaatcagaatggacctgactctttgtgctcttttcacttcctgtgacattaacagcaataaataacagccaggcgtagctggaataagcaggataaaggcgggagctacgatttaatttatcaatggcgaagaggagattcacggctcagagagggctattttttcagagtagacctggaaaaactcatgccatagtcagtttttttgagtgaatttacataactttaaaaaaatccgctcacaggctaaatctgcgcggcagcagattctgctttattctgccgaagcgcattgggaataaatgaataaggcgttacttaaccgctcacaaacccggcgatactccgccggtttttattcgtttaaccgcggtttaagttggcaggatgttcagtttttttcgtcaaaatgggtgatcttgcacaaattacgtcggtcgtttgccagaaaacgacatttcattcttttgatgctctggttaagatagtcacgaaaccgtcgttatctgcgaaaaatggaacattcccgctgcgcacctgtccattttcagggcctctctacaggattaaggcatgttgaaccggttaaagaaaacgctgatcgccgcgctccttccgacgctcattttcactactctgtcacctgcttatgccgatgtcagtgattcacttcccgatattggcactacggccggttcgacgctgtcgattaatcaggaactgcagatgggcgacttttatgtgcgccagctgcgtgccagtgcgccgctgatcaacgatccgctgcttaatcagtatattaatcagctgggtcagcgactggtgtcgcatgccgactcagtgaaaaccccgttccacttctttctgattcagaacgatgagctcaacgcctttgccttttttggtggcaacgtggtgctgcactcagcgctgttccgctataccgaaaatgaaagccagctggcgtcagtaatggcgcatgagatctcacacgttacccagcgccatctggcgcgcgcaatggaagatcagaagcgcaatgcgccactgacatgggtcggtgcgctgggctctattctgctggcgatggccaatccgcaggcaggcatggcagcactgaccggcaccctggcgggaactcagcagggaattatcagttttacccagggtaatgagcaggaagccgaccgcatcggaattcaggtactgcagcgcgccgggtttgatcctcaggcgatgccgaactttttacagaagctggccgatcagagccgtttctcctcgaagcctcctgaaattctgctgacgcatcccctgcccgacagccgtctggcggatgcccgcaaccgcgctaaccagatgcggccggtggtggtgcaatctacagaagatttctatctggcaaaggtgcgttcactgggcatgtactcaaccgggcgtaatcagctcaccgacgaaactgctgagccagtatgccagcggcaattctcgtgagcagctggcgtcacaatatggcaaagccatacagtttttgcaggcgaaaagctttgccgatgcgaagcggattatgacgccgctgctggcgaaacagccgaataacgtctggttcctggatcttatgtcggacatcgatatcggcctgaatcagccacaacaggcgatcgccctgctcagcgccgccaccagtgcaaaaaacagcccggtggtgcagctcaacctggccaatgcctacgttgaagcgaaacagtatgccaatgccagccgcattctgaatcgctacacctgggctaataaagatgatcccaacggctgggatttgctggcccaggcgtctgcacagcagggactgaatgatgaagagttatcggcgcgggcagagagtctggcgctgaatggccagctcgatcaggcgattaccgcgctaggcagcgccagcgcacaggtgccgctcggcagcctgaaacaggcgcgctacgatgcccgtatcgatcagctgcgccagttacaacagcgctttaagcagtatcagaaaggctgagcattcacgctgcgaatagaggagagtctgagatggtgacgatttaccacaacccgcgctgcagcaagagccgcgagacgctggcgctgctgaacgcccgcgggatagagccggaagtggtgctctatctgcaaatgccgcccgatcgcgagacgctgcaaatcctgttacagaaactgggaatgcagagtgcacagcagttgatgcggactaaagaggcgatctatagcgaactggcactcagcgacaaaagcgaaagtgcgctgctggatgcgctggtggaacatccggtgctgattgaaaggccgatagtgatcaatggcgacaaggcgcggatcgggcgtccgcccgaagcggtgctcgacctgttttaaaggccgagtgtctctttcacaaacggaatggtgagtttacgctgggcgctgatcgaggcgcgatcaagccgatccagcgtatcaaacagggtgcgcatttcacgatccagtcgcttcagcaggaagcgccccacatcttccggcagctcaaatccgcgtaacccggcgcgcagttgcagcgcctgtaatttgtcttcgtcggagagaggctgcaggcgatagatctgcccccagtccagccgcgaggcgagatcgggcagttgcagattaagctggcgtggtggacgatcgccgctaataaacagccgcgtattgccggtttccagaatacggttatagagatcgaagatcgccatttcccattcaggctcgcctgcaatgcactcgatgttatcgatgcagaccagtgacagctgctccatcccttccagtacttccggtacaaaccaggtgcgtttatccagcggaacgtaaccgaccgcttcgctgcgcgctgacatctcggcgcacgcggcgtgcagcaaatggctccgccctccgccttcgcgtgaccagaagtagagatagctgccatgttgttggttgagagcgcctttcagcgcggcaatcagcgacgggttttcccccggccagaagctggagaaggtttcatcgtcaggtaaatagagtggcaatgacaattgtgccggcgtgttcagaagcacctcagcaagagaacaagcaaaaaatcgggggaagtctaacacagttttcagaaagagatgaatggggcgtccctgccccgatcctgtcaggcttgctgcgatcacggctcgcgcgattcttcagcctccagcaccacttcttccggacgcaacagcgagatcacacggaagatcagcgctaatccaacccctacgattgtcgccagcgccatgcctttcagctccgcagcaccgatatgtaccttcgcaccgctgacgccgatgatcaggatcaccgaggtcaggatcagattttgcgctttgttgtaatcgactttggactcgatcaacacccggataccggatgcgccgatcacgccatacagcagcagcgacacgccgcccattaccggtaccgggatcgcctggatcaccgccgccagtttgccgacacaggagagcaggatcgccagaatcgccgcgccgccaatcacccaggtactgtagacgcgggtaattgccatcacaccgatgttttcgccgtaggtggtgttaggcgttgaaccaaagaagccggagatgaccgttgataagccgttggcgaacatcgaacgatgcaggccagggtcgcgaatcagatctttctttacgatgttggcggtgaccaccagatgaccgatatgctcggcaatcaccaccagcgccgcaggcaggatcgtcagcatcgccacccactcaaagcgcggggtatagaaggttggcagcgcaaaccagggggctttgatcacgccgctccagtcaacaatgcccataaatgcagagagcagataacccgctaccaccccgaccagaatcgggatgatcgccaggaagccacgaaacagcacggaaccgaataccgtcactgccagcgtgaccagcgaaatcagcacggttgtactgtcgggcgcactgccttccgcgggcagcaaacccgccatattagcggctacccctgccagctccagaccgatgacggcgacaatcgcgcccatcgccgccgggggaaacatcacatcgagccagccggtgcccgcgcgtttgacaatcagcgccaccagacagaacagcacgccgcacaggataaatccgcccagcgcgacctcataacccagcggcagcaatagcagtaccggcgagataaaggcaaaactggaaccgaggtaagcgggaattttgcctttacagataaagaggtagatcagcgtgcctacgccgttaaataacagcaccgtcgccgggttgatgtggaacagaatcggtaccagtaccgtggcaccaaacatggcgaacaggtgttgcaggctgagtggaatggtttgcagtaacggcggtcgttcactgacgccaatggcgcgacgagtcatcatttatccccttgtgttatttatcccccagggcgcgcgactctggcacagcagcaggcacgtcggtgagcctcgcagccacaccaaacccgttcggggatcttttttttgccaaaaaaaagccgactctctggtcggctgtgcgattatttggttccgaaaatcttgtccccggcatcgccgagcccgggaatgatgtaacccttctcattcagtccctgatccactgacgcggtgtagagctcaacgtcaggatgcgctttctccagcgcggcaatcccttctggcgcggcaaccagtaccagcactttaatgctggtgcagcccgctttcttcagcaggtcgatggtggcgatcatggaaccgccggtcgccagcataggatcgacgaccagcgccaggcgctcttcgatgttagagaccagcttctggaaataaggaaccggctccagtgtctcttcatcacggtaaacacccaccacgctgatacgggcgctgggaacgtgctccagcaccccttccatcatgcccaggccggcacgcagaatcggcaccaccgtgatttttttgcctttgatctgatcgatctctaccgggccgttccagccctcaatggttacgcgctctgtttccagatcggcggtcgcttcgtaggtcagcaggctgcccacttcagacgccagctcgcgaaaacgctttgtactgatatcatgctcacgcatcaagcccagtttatgtttgaccagcgggtgtctgacttccacgatcttcattggtgttctcccggaatgagttgagctaaaaaaaaatcgcgggattataccgccttttacgctccgcgccacctgctcttgcgcaaagccgcgggttttaacgggacaaatagaggattaatgaaaatcgcccgatgcgcaatcccggactcgcaaacgtttgcctgcactgatagaattgccgcgctttattttaaaccaccaaccgcaactcgcgtggggacctcgcagtgaccgacaaaacctctctcagttacaaagacgccggtgttgatattgatgctggtaacgctctggttgaccgtattaaaggcgtagtgaaaaagacgcgtcgcccggaagtgatgggtggactgggcggttttggtgcgctttgcgcgctgccgcagaaataccgtgaaccggtgctggtctccggcaccgatggcgttggcaccaagctgcgtctggcgatggatctcaaacgtcacgatgccattggtgttgacctggtggcgatgtgcgtcaacgacctggtagtacagggcgccgagcccctcttcttcctcgactactacgctaccggcaaactggatgtggataccgcctctgcggtgatcaccggcatcgccgaaggttgtctgcagtcgggttgtgcgctggtgggcggtgaaaccgctgagatgccaggcatgtatcacggtgaagattacgatgtggccggtttctgtgttggcgtggtggaaaagtcagagatcattgatggcagcaaggtgcaggatggcgacgtacttatcgccctcggctccagcggcccgcactccaacggctattcgctggtgcgtaagattctggaagtcagcaacaccgatccgctggatgaacagctggaaggcaaaccgcttgccgatcatctgctggaaccgacccgcatctacgtgaaaaatatcctgagcctgattgagcaggtcgatgtgcacgctatcgcacacctgaccggcggcggcttctgggagaatattccgcgcgtgctgcccgataacactcaggcggtgatcgacgagaagagctggcagtggccggccgtcttcagctggttacagcaggcgggcaacgtcagccgtttcgagatgtaccgtacctttaactgcggcgtcggcatgatcatcgccctgagtccggcagacgcggacaacgcgattgcgctgatgcaggctgcgggcgagaaagcctggaagcttggcgtgattaaagcgtctgatgccgaagagcgtgtggtcatcaacggatgaaaaagctggttgtactgatttccggcaacggaagtaaccttcagtccatccttgacgcctgtgcaagcgggcggattcacggcagcgtggctgccgtattcagcaaccgcgccgccgcttatggcctgacgcgggcgcaggaggcaggtattcctgcccactcgcttgccgccagcgacttcactgaccgcgaagccttcgatcgccagctcatcgctgaaatcgaagcctacagtccagacctgattgtgctggccggctatatgcgcattctcagcagcgcgtttcgtggcccattttcacgatcgcctgctgaatatccacccttccctgttgccgaaatatccgggtctgcatacgcatcgtcaggcgctggaaaatggcgatagcgaacatggcacctccgtacatttcgtcactgacgagctggatggaggtccggtgatcctgcaggccaaagtcccggtttttcccggcgacagcgaagcggagattacggagcgggtgcagcatcaggagcatgccatctatccgatggtaatcggctggtttgttgagggtcgtctggcgatgcgtgacggcaaggcctggctggatggcgaaccgctgccgccgcagggttatgctaacgactgacccgacaggggaagccggggcttcccctgaagtgctggcggtcggggtaaaggctcagggaaccattgagccgtctgacataacaacctgctctgctcccgttactgacttaaccgtagcgccccgtaatataatcttcggtccgtcgctgttttggcgcggtaaagatacggtcagtctcatcaaactccactaacgcgccctgatgcataaacgcggtgtaatctgacacgcgagaagcctgctgcatgttgtgcgtcaccagcaccagtgtgaaatgctgcttgagcgtagtcatcagctcttcaatcaccagcgttgagatgggatcgagcgcggaggtcggctcatccagcagcagaacttccggttcaatcgcaatggcgcgggcaatcaccagccgctgctgctgtccggtagagagcgtcagcgcattctgtgacagctgatctttgacctcactccacagcgccgccgcgcgcagcgcacgttcacaggcttcgttcagcacccgccgatcgcgtacaccctgtaaacgcagcccgtagaccacattttcatagatcgattttggaaaaggattggggcgctgaaacaccatgccgacccgacgacgcagcgccgagagatcctgctcaggtcgcaggatcggctgcgatcccagcaacacctcaccctcgacccggcaatgatcaatcacatcattcatgcgattaaagcagcgcagcagcgtcgatttgccacagccggagggaccaatcagcgcggtaatcttgtttttcggcacctgcagcgaaatagcctgcagcgcctggcgctcgccataccacagcgatagctggttaacggtcagcgcgatatccgtgtcggacgtcatagtcatagcctgttattgagtcataaggcgatagcgttcacgcagacggtgacgcaggcccatcgccagcagattaagcgacagaataatcagcaccagcagcagcgcggtggcgaacaccagtggccggtcagcttcaatattcggactctgaaacgccagatcgtaaatctggaagcccagatgcataaatttgcgatccagatgcagataaggaaacaccgcgtcgacgggcagttccggcaccatttttaccacgccaaccagcatcagcggcgcggtttcaccagcggcacgcgccaccgccagaatcaggccggtcagcatggcaggcaccgccatcggcagcaccacgttccacagggtttccgcctgagtcgcgcccagcgccagcgacccctgccgcaggctgttgggaatgcgggatagtccctcttcggtcgccacaatcaccaccggcagcgttagtaacgccagagtcagcgacgcccacagcaaaccaggtgtcccgaaggtgggattgggcagcgcgctggcgaagaagagctggtctatcgtgccgcccaccagccagacaaagaagcccagaccaaatacgccatagacgattgaaggaacgcctgccagattgaccaccgcgatgcgcaccagtctggtcagcgcattgcgtccggcatattcatgcagccagatggcggcgatgacacccagcggcatcacgaccaccgacatcagcagcaccatcagcacggtgccaaagatcgccgggaacgccccggattcactctcgccttcagcgggtgaatcactgacgaaacgccacagctgatgcagaaaatgcagcgttttgccggtcagcgtcatcgcgtttcggcttccagctgtcaacgatttcggtcagcgggatcgcatgttcggtgccatgcacatcccgcaggattaacagatcgcgctgactctgctgttgcagcgaagccagtgtctcgctcagctgattaaaccggcgctgcaaagcggcctgattggcctgatattctgactcggcctgcaaatcaaagcgcccggcagcacggtttgtggccgcctgctcatcaagctgctcacgctggctgttgaggcgcgccatatcgacccggcgaatctgattagcctgccgcaccagcatctgcacctgtccgagccgctgatgcagcagtgcatcgggatcctgcgcagtcagctcttcattatcctcacgcaggccgacaaaccagccgtatgcctgaccgtggctgcggcgctgcagcaccatgatgtccgctggctggctgacctgcgccgccgtgcgactgtaaaccacccggaaatcgggtgcgtcccagtcacggttaccggttttaatcagataacgattaacctgtccgccgctgttgccctgctcatctgccggggccggaaagcgccgctgatgttccagagtttcacccagcaggcgcgtctcgcccccttcaggctggctaaacgtgtagagatcgacgcgctgcggccagaaagcgcgccccccctgccaggccagtaacccaatcagcagcgtaaaggccagcaggcagacggctacggcaccggcggttagccagcgccagcgatcgttctgtcgcatcgctttcatgcctgctcctcgtgctggctgtagcgctggcgcagccgctgacggatcagctcggcaaccgtgttgatcaccagcgtaaacagcagcagcatcagggcgctaagaaacagcacgcgataatgggcactccccgccgccgcttccggcatctcaatggcgatattggcggacagcgcgcgcaggccgctgaacaggccaccttcactttgcggcgtgttgccggtcgccatcagcaaaatcatggtttctcctacggcacgccccagaccaatcatcagggcggcaaaaataccggcggaagcacccggcagcacgacgcgggtcagggtttgccacggcgtcgcgcccagtgccagcgagccctgccccagtgcagccggcacgctgaacagcgcatcctcagagagggtaaagatcagcggtaccagcgcaaagcccatcgccagcgcggctaccagcagattgcgctgttcgtaatgcggcagccagtcgcccgcatccggtatcaacagcgtgggcagccacagcgtcagcagcgtgaccagcagcaacagcggcagcagaatcagcacttcacgacccggctgacgccagcgcggcggtaaacgcgcgctgaatacgccgcacagcagcagcgtgcccgccagcgtcagcggcagcagcagcacacccaccagcgcctgaccaatatgcggcgcgagccagatcccggcaaccagccccaccactacgctcggcagcgcgcccatcatttcgattgccggtttaacccagcgtcgcaggcctggcgccataaaccaggcggtgtacatcgccgccgccagcgccagcggtgtggcaaacagcagcgctaaactcgccgctttcagcgtacccatcaccatcggcatcaggctgaacttggcctgataactgtcacccgccgcggtcgattgccagatccagtccggtccgggataattttcataccagattttttgccagaaattgcgccaggtgacgtccggccacggattatcaagccgcagagtctgccagcttcccgcccgttcaatcagcaggctgtcgccacgcggcgaaaactgagcctgcacaatgccaggttccagctgacgctgcagtatcgggccattctgcttgctggcgaacagccttaacagcccctgtttgctgagcgtcgcaaacacgcggcgttgtgattccgtcaccagaatggtctcgccgtcgctgttggcaaaggtacgaatgcgctgcaggcgcggcccctgttcgctggcgatagcaaaccactgcgtgacgccgctgccatcctggatcagcaggcttctgccgcccaccagcagatgcagactttttggccgctgcggcagggtgtgcgtttcgcgcaatagtgcacggtcatcgtcaagttgccagacccgcagcagattgccttcggtggtgtagagcagatcgccggccggcgagagcgccagcagatccagctggcgttgcggcagcgggataaccgaggcctggcgatcggtgccaagcgtcagcacccggagtccggcctcagtaagtgcggctatacgccactgacccgcatggcgcgtcgccagcgccatcttcgtcactgcgccatcaggcagatgaaacggtttatctcccagcggaaaacgccactgctggtcggcggttggctgcatcagtgtcagcgcaccctgcatattcagcagtagcgtctgctcatcggcactccgcactatttcgccgggcggcggggtcagcgccagtgccggttccgcaggctgaccatccagcggaataaaacgcgccgcaccgcgctcgctgatgcgccagccgaccttcccctgattgccaatcgctaatgctggcgcacgatcccagagttgctggctggccgcaatctgcaggcccggcgcattaaacagcggtaataccacgccaatcagccagcagaagagcagcagcatcaatagcaggatcgccacgccacagcaggtgaccagccggcgtgtcagacggtcaacggcacgacgcttacgatcgctgaattggacaggaatgtggtttgcgctcatgcggttccgctagcaggccaaaataagccgctatgttgcccgtagccgattgataagacaactcctggcgttggacaacgctgccatactctcgccataatgttggtggatactggatcttcagtcctgcaaccgctaaatggagtgagaatgggtcaggtaaagctttatattgaaaaagaattaagctggttatcctttaatgaacgggttttgcaggaagcagcagacaaaagcaatccactgattgagcggatgcgctttctgggtatctactccaataatctcgacgaattctataaagtgcgtttcgccgacctcaaacgccgcattctgattggtgaagagcagggttccgccagtacgccacgccatctgtttaagaaaattcagcagcgggtaatgaagtccgatcaggagtttgatgcgttatataacgatctgctgctggagatggcacgtaaccagatcttcctgatcaatgaacgtcagctctcatccaatcagcaggcgtggctgcgccactacttcaagcacgaactgcgtcagcatatctcgccgattctgatcacccatgaaacggatctgaccgaattccttaaagatgactacacctacctggcggtagaaattatccgcggtgacaatattcagtatgcgctgctggaaattccgtccgacaaagtcccgcgtttcatcaatttaccggctgagccaccgcgccgccgtaaaccgatgatcctgctggataacatcctgcgctactgcctggatgacatttttaaaggcttctacgactacgacgcgctcaacgcctattcaatgaaaatgacgcgtgacgccgagtacgacctggtcacggagatggagtcgagcctgctggagctgatgtcctccagtctgaagcagcgactgacggcggaaccggtgcgtttcgtctaccagcgcgatatgcccgacacgatggtgtcgctgctgtgccacaagctttctatctcaaacctggactccatcctgccaggcggccgctaccacaacttcaaagactttatcggcttcccgaaacgtcggcaaaaacaacctggtgaaccgcccgctgccgcagattcgccacatcggctttgatggtttccgcaacggctttgatgcgattcgtaatcgcgacgtgctgctctactacccgtaccacacctttgagcatgtgctggagctgctgcgtcaggcgtcgttcgaccccagcgtgctggcgataaaaatcaacatctaccgcgttgctaaacactcccgcatcatggatgcgatgattcatgccgcctataacggtaaaaaagtcacggtggtggtggagctgcaggcgcgctttgatgaagaagcgaatatttactgggcgaaacgcctgactgaagcgggcgtgcatgtcattttctccgcaccaggcctgaagatccacgccaagctgttcctgatttcacgccgcgaaggcgaagagattgtgcgctacgcgcatatcggtaccggcaactttaacgagaaaaccgcgcgtctctatacggactactcgttgctgaccgcggatgcgcgcatcaccaatgaagtgcgtcgggtgttcaactttattgagaatccctatcggcccgtgacgttcgatcatctgatggtctcgccgcagaactcgcgccggatgctgtatgagctaatcgacaccgaaattgctaatgcgcagcagaataagccctgcggcattactctgaaaatcaacaatctggtggacaaaggtctggttgatcggctttatacagcctccagcgtaggggtgaaggtcaatcttctggtgcgcggaatgtgctcattaatccctgacttgcccgggatcagtgaaaatattcgtgtcatcagtattgttgaccgttatctggaacacgatcgcgtctatatttttgagaatggcggcgaaaagaaggtgttcctctcctccgctgactggatgacacgtaacattgattaccgtatcgaagtggcagtggcgattctcgatccccacatccggcagcgcatactcgacattattgctattcagttgagtgatacggtgaaagcccgcatcgtcgataaagagttgagtaaccattacgttcagcgcggcaatcgtcgtaaagtgcgatcgcagctggccatttatgattacatcaagaaactggaacaacctgaataaatcctatgccaatttctcataaaagtacgccaaaaccccaggagtttgcggcgattgacctgggctcgaacagtttccatatggtgattgcgcgggttgtcgatggtgcgatgcaggtactgggccgccttaagcagcgcgtccatctggctgacgggctggatgcccggcacaacctcagcgaggaagcgatggagcgggggttagcctgcctggccctgttcgccgagcgcctgcaggggttcagtccgagcaacgtgacgattgtcggtacccacacgctgcgcgaggcggtcaacgccgaaaccttcctgcaacgtgcggccgaggtgatcccttatccgatcgaggtgatttcgggccatgaagaggctcgcctgatctttatgggcgttgaacatacccagccggagaaaggccgcaagctggtgatcgatatcggcggcggatcaaccgagctggtcattggcgaggattttgaaccgcaactggttgagagccgacgtatgggttgcgtcagtttcgcccagctctatttcccgaaaggtgaaatcagccgtgaaaacttccgtcgcgcccgtttagcggccgcacagaagctggaaacgctggcgtggcaatatcgtctgcatggctggcaatatgcgctgggcgcgtccggcaccatcaaagccgcctgcgaagtgctgctggcgatggatgaaaaagagaagctgattacgcctgagcgcctcgaaaagctttatgacgaagtgatgaaacacaaatcctttgctgcactcagcctgccgggtctgtcggaagagcgtaaaggtgtgtttgtacccgggctggcgattctttgcggcgtatttgatgcgctggccattcgcgaattgcgcctctccgacggtgcgctgcgtgaaggcgtgctctatgagatggagggccgtttccgccatcaggatattcgcagccgtactgcacagagtctggcgaaccattacgctatcgacagcgatcaggcacgacgcgtgctcgacaccaccgagcagctttatctgcagtggcgcgagcagaatcagaaactggcgaatccacaactggccgcgctgctgaaatgggcagcgatgctgcacgaagtgggcctgaccattaatcacagcggcctgcaacgccattcagcctatattctgcaaaacactaacctgccgggcttcaatcaggatcagcagatgctgctggcggcgctggtcagattccatcgtaaagcgataaagcttgatgaactgccgcgcgtgacgctgttcaagaaaaagcagtttgtgccgctgattttcctgctgcgcctgggtaccctgctgaataatcagcgacaggccaccacgcgtccggaggcgttaaccctgaaatgcgatgacggccactggacgctgaccttcccggcgggctatttcacgcagaacaacctggttcagctcgatcttgaacgggagcaggtttactggaatgacgtcacgggatggaaactgatcctcgaagaagaagtctgacaacacgggcgcctggcgcccgtttaactgaaatgatgaatatgacacaaccaaccgcacccctttcaggcgaaaactattttgccgaaacctatggtttaacgccgccccactccgaagtggttgcggcgctgccccagctcaacgtcggcaaggcgcttgaccttggctgtggcgtgggacgcaatacgctgtttctgaatcagcacggttttgacgtcacggcgtgggatcataatccgcaaagcctggcgcgcctgcaggagattattgcgcaggaaaatctcatcggcatacataccgagcagcgcgacctgaacaacacgcgctttaatggcggctttaactttgtgctgtcgaccgtggtgatgatgttcctgcagccgcagaccattccgcagctgattgccgacatgcaggcctgtacggtcagagacggttttaacctgatcgtggcggcgatgaacacggacgatatgccctgcccggctgatttctcctttgcgtttaaatcaggtgagctcagccactactaccgcaactggcacatcgtgaagtacaacgagcaccccggtcagctgcatcgcacagatgaaaatggcaaccgcatcacctgtcggtttgcgacgctgctggcgcaaaaagcgagttactgatctttatctgctgtttttttcaacagcgattgatttcatcaggcgactgtgactaaatattgcagtcgccccagatggggtcattacaggaaccaccccgcgtgaacagcgctatttctccccgaagacgtcaaaaaaccggcaccatgacccgcattgtgttgctgattagttttatcattctttttagtcgcctgatttttatcctgcctgctgccttcgagcatcatcagcaacagaaagctattcctgaaccggttgccataacatcaggcgatacgcgataacgaataacgaataacgacctttcgcctgaaacgcacctgatacgtaaatgttatccagctaactggactcttttttgcatccctttttcaggcgaaacgctacacttcgtgctggtgctttcagacttaagggatccaatgtgtctgcctctcactctcaacgtttaagtgaaatacgtcatcgcattctgacgctgctgctcagcgagcacgatctggttgatgccctgctggagaaatcgggcgatctcaatcctgaacagcaacgtgaaaatgcggcccagcgtgacgcgctggagcaggacattctgcaactgcatgccgctgacctcgcggatattctcgaagccctgcccgaagaagaacgtcaggcgctgtggcggctggtgccgaacgagcggcgcggccatgtgctggttgaagcgtctgaaacggtctgggccagcctcaccgaagagatgagcgaccgcgatatcctgcgcgctatccagccgctggatatcgacgatcaggtctggctggcgcgttatctgccacgtgacctgaccggacgcctgctggcaacggtggagcccgccctgcgcgcccgcatgctcgatatggtgcagcttgaccgtgaccgcgtaggccgggtgatggatttcaatatcctgacggtgcgtgaagatgtcacgcttgcaacggtgcaacgctttctgcgcaagcgcaaaagcatgccgggcggtaccgataaactctttatcaccaataaagataatcagctgctgggcgaactgctgctgacggacatcctgcttaacaaacccaaaaccctggtgagcgacgtgatgaacgcccgccctaccaccttccagctcaatgataaggccgaagacgctgccagcgcctttgaacgttataacctcatttcagccgccgttaccgacgccaggggcaagctgattggccgcgtgaccattgaagacatcatcgacctggtgaatgccgaaaacgaaagcaacattcgtaaaatggggggtatcagtcaggaagaggatgtgttcgcgccggtgcgtaaatcggtacgtaaacgctgggcctggctggcgattaacctctgtaccgcctttgtcgcctccagggttatcgggctgtttgaagggacgatttcgcaaatcgtggcgctggccacgctgatgccgatcgtcgcgggtatcggcggcaataccggtaatcagactatcaccatgattgtgcgggcgctggccttacatcaggttgaaccgggcaacttttcgtttttgatcgtccgcgaacttggcgtggcgctaatcaacggcctgttctggggcggcatcatgggcggcatcacctggctgatgtatgacaatatggcgctgggcggcgttatgatgctggccatggcgcttaatctgctgctggccgcgctgatgggcgtgctggtgccgctggtcatgactaaaatgaatcgcgatcccgccgtcggctccagcgtattgatcaccgcccttactgacaccggcggcttctttattttcctggggctggcgacgatcttcctgctgccgcactaatcgtcaggcttgcagaccgtaacgttgcagcgacccgttaagattgcgctgccgcgttaccagtgccagctctcgggtcgccgcaggcagcgtatagttaccacgctgactcagccactccagcacatccgctaagtgccagatggcggttttaccgtcatgcaccggcagcggaaacggcgggcggtggctgagcatcagcttacgcatattctgacgcgtcatgccgatgatctccgcaacatccgtcaatcccacaaaatcgggtgcggcttccaccagcgtggcccccggtatagcacgcagcacatcctcttctgcctgcttcaatacatccgttgcagagtcggactcccgggtgaactccagtgcaattctgcccggcatgcccaggccgattagcgcatcatcacagcctgccgctgccagcgtttccagcagttcatccaccggcgcatgcccttccggcaggctgaaccgtaatgtgaaacaatattccatatgcttctccttgtgctgcatcaggacttcagatagtgacagttgtcgaccacgcgtcgcagcgcgcgggcatgctgatgtgcgttttttggtgtgctccagatacaggtcagacaaaactccccacatcggcacatcaacagatttttcggacagtacatttttccccaggcgtgatggcctcccgtgacgaccagccagccatgggattcggcgtaacgtaacgccgtttcgatctctttgttgggatgccgcttccttgccatgtttttccctatcctgacgccgaattgataagttgtcaactgacaacccgataaaattatcttagtgcggctcagcatgcgcagactttttctcgcagtaaaacagtcagggtataaactggaaaacgtcacacaaaaaacgatcagcgccagaagtcatctggcagccgaaacgataatcaacggaggcaatatgtttaaagcagaggattttgttcagtcgaaaaccggcggcccgaaaatgcaggtgctgcgcgtagaaggcgacaccttatggtgtgcacgcgttgatgatgcggcgaaaaaagagatcgaagtgaaagcagagagcgtcaatctctatcacgaagagggtgactttggcgtgtgctgaggtgaaacggcccctgacggggccagactgtcagggcttatcctgctgaaggttgtcatttcccagaccgccaataaacggcagacgcagccggaacggtgtgaaatcgactcccatgttcagacccagcagattgacttcaagtccctcttctgcacccagcgtcacgcccgccacgcccagaatcgacacctgcaggccgcgcccggatggcggcagcccgaccggacgccacagtggccggtaatcttttcccagcgcgttagcgggcagatcaagccttaaagcgggtacttcgcggccaatatgcgccaggaaggtattgctgtttggtccaggccaggcgcgataggttgtcggccacggataggatttaatggcggcttcaatctgcgggatcatcgcttctgcttccggtccgcgatgttccaccagcagccgcggttttgcgccataccagtagccatcaggcaggttggtgttgcgccggactttatcgccgctgccccagctaatcacttcgtagcgagtgaaacgcgtttcacctgcgcgcttgaagatgatccacggatgcaccgccaccgcccctttccagccgtaagtcggcgcagcatagacctgtacgatagccaggctatataaagcgcgcgggtcgggcgctatcccggccgaatcgcggcgggccgaccaccagccgccctgctctgtggtatcgctgtgacgcgtcgcctgcgcgatgctggctcccagcgatagcagcagtacggcaacaaaaaacaggctgaacactttaagtgagagcatgacaacattcctggtgacgtaagaatcgcgaaacgcctgttcagcaggcagtttcagtaagcggcggctttgggatacggatgatcgatgaaagcggcggataaaagcgggacacaaatgacgtcagttgcgggcttttactgcatggaggatagcgtaatttccggcaaagtgaataataaaacgccagcggcgaggcgggatgcgctgaaaagttaaaacggcgagtctgcgcacggtcagagcaataaaaaaagcccgctgaggagcgggctgcagacttatcagggattaactggctgaggccaggttattcccactcaatcgtcgctggtggcttaccgctgatgtcatacaccacgcgggagatgccgtcgacttcattgatgatgcggttagagacacgacccaggaaatcatacggcaggtgcgcccagtgtgcggtcataaagtcgatggtttccaccgcacgcagcgagacaacccagtcatatttacggccatcacccatcacgccgactgaacgtaccggcaggaagacggtgaacgcctggctgactttgttatagagatccgctttatgcagctcttcaatgaagatggcatcggcacggcgcagcaggtcgcaatactctttcttcacttcgcccagcacgcgcacgcccagacctggacccgggaaacggatggcggtagagcatgtcgtaaggcaggcccagctccagaccaatcttacgcacttcatctttgaacagctcacgcagcggctcaaccaggcccatcttcatctctttcggcaggccgccgacgttgtgatgcgatttgatgacgtgcgccttaccggttgcagaggccgcagactcaatgacatccggatagatggtgccctgtgccagccacttaacgtcctgcagcttcagcgcttcttcgtcgaagacttccacaaagacgcgaccgataattttacgtttcgcttccggctcattctcacctgccagcgcgtcgaggaagcgcgcttcgccttcaacgtgaataatgttaaggccgaagtggtcgccaaacatatccataacctgttgtgcttcgttcaggcgcagcaggccgttatctacgaacacacaggtcagacggtcgccaatggcgcgatgcagcagcattgccgtcacggaggagtcaacaccacctgacaggccgaggatcactttgtcgttgccgacctgcacacgcaggcgttcaaccgcatcttcaatgattttggctggcgtccacagggcttcacattcacagatgtcgataacgaagcgctcaagcatccgcaggccctggcgggtatgggtcacttccgggtggaactgcacgccgtagaaacgcttctcttcgttagccatgatggcgaacggacaggtttctgtgctggcaacggtcacgaagtcagccgggatcgccgtgactttgtcgccgtggctcatccagacatccagcagcggtttgccggcggcgctgatcgcatcttcaatatcgcgaaccagggcgcttggcgtcgtcacttcaacctgcgcataaccaaactcgcgctcagttgagccagcaacggtgccgcccagctgcatcgccatcgtctgcataccgtagcagacacccagcaccggcacgccagcgctgaagacatattcaggcgcacgcgggctgttcagttcggtggtgctctccgggccaccggaaaggatgatgccgcttgggttgaactggcgaatctgctcttcggtgacatcccatgcccagagttcacagtaaacgcccagctcgcgtacgcgacgtgcaaccagctgagtatattgtgagccgaaatcgagaatcagaatgcgatgcttatggatattttccgtcgtcattgagggttttccagaacggtgacttaatcaataaaagcgcccggctgaagccgggcgggaaatcgggattatgaacccatgcgatagttcggtgactctttggtgatggtcacatcatgcacgtggctctcattgatgccggcgccgctgatgcggacaaactccgccttagtgcgcaggtcatcaatggtcgggcaaccggtcaggcccatgcacgagcgcaggccgcccatctgctgatgcacgatctctttcagacggcctttataggccacgcgaccttcgataccttccggcaccagtttgtcagcggcgttatcggtctggaagtagcggtcagaagagcctttagacatcgcgcccagtgaacccataccgcgataggatttgaacgaacggccctgataaagctcgatctcgcccggtgactcttcggtccccgccagcatcgaaccgaccatgacacaggacgcaccggcggcgatcgctttcgcgatgtcaccggagaaacggataccgccatcggcaatcaccggaataccggtgccttccagcgcggtgactgcgtcagagacggcagtgatctgcggaacgcccacgccggtcacgatacgggtagtacagatagagcccgggccgatacccactttaacggcgctgacgcctgccgcaaccagcgccagtgcgccggcaccggtggctacgttgccgccgacgatttcaaggtccgggtatttggcacgggtttcacggatacgtgacagcacgccttcagagtggccgtgtgaagagtcaatcagcagcacgtcaacgcccgctgcaaccagcgcatcgatacgctcttcgttacctgcacctgcgccaactgccgcaccgacacgcagacggccctgctcatctttacaggcgttaggtttacgttcggctttctggaaatctttaacggtgatcatgcccagcagatggaagctgtcatccaccaccagcgctttctcaacgcgcttttcatgcatcctgtgcagcaccacatcgcgcgcttcgccctctttcaccgtcaccagacgatctttcggggtcatgactgcagagacaggctgtgaaagatcagtgacaaagcgcacgtcacgaccggtgatgatacccaccagttcgttgtcgcggttaaccaccggatagcccgcaaagccgttgcgctcggtcagcgctttaacgtcagccagtggggtggttggcagaacggtctgtggttcagtcaccacgccgctttcatgtttcttcaccttgcgcacttcgtccgcctggcgttcgattgacatatttttatggatgaagccaaggccgccttcctgtgccagcgcaatcgccagacccgactcggtcacggtgtccatggcagcggagagcataggaatatttaaacggatatttttggtcagctgagtgctgagatcggccgtattcggcaggacggtggagtgtgcagggacgagcagaacgtcgtcaaaagtgagtgcttctttagcgattcttaacatggcaatactccacctcgggtgattgagaatagataaaatattgccgcggcattatacaggccgtaatcgattgcctccagcattatttacgaaaaactcttgatccgcactggcagccctgtagtatcgatgaattaacctgctgatttggaatttgatcttcgtcacatgtcgctgccacccatcgccaatatttttaccgtcagccgtctcaatacgacagtgcgtcagctgctggagaaagagatgggcctggtctggatcagcgccgagatctccaacttcacgcaaccggcatccggtcactggtacttcacgctgaaagatgatggcgctcaggttcgctgtgctatgttccgcaacagtaaccgacgcgttacctttcgtccgcagcatggtcagcaggtgctggttcgcgccaacatcactctctatgagccacgcggtgactatcagctgattgccgaaagtatgcatccggcgggtgaaggcttgctgcagcagcagtttgaactgctgaaagcaaaactggccaccgaaggactgtttgatccgcagcataagcaaccgctgccggaaccggcgcgtcaggtcggggtaatcacctcttccaccggcgcggcgctgcacgatgtgttacgcgtgctgcatcgccgtgatccctccctgcccgtggtcatctacccgaccgtggttcagggcgtcgatgcgccagcggctatcgtccgcgcaattgaaatcgccaacctgcgcaacgagtgcgacgtcttaattgtcggacgcggcggcggttcgctggaagatttgtggggctttaacgatgaacgcgtggcgcgcgccatttttgccagccgcattcccatcgtcagcgcggtgggtcatgaaaccgatgtcaccattgccgacttcgttgccgatttacgtgcacccaccccttccgccgcggctgaaattgtcagccgtaaccagctggagttgctgcgtcagttgcagtcacagcaacagcggctggagatggcgatggattactacctggcacgtcagcagcggctttactcccgccttgagcatcgtctgcaacagcagcatccgcagctgcgtctggcccgtcagcagaccgccctgttccgcctgcagcagcgactgggagaagcgatggaaacccgcctgcgtcaggccacgcgtcagcaggatcgcctgtcgcatcgactcaatgcccagcagcctcagcagcggctgttcgatgcgcaaaaacagctgcaaagctggcactaccgcctgcagcagagcatgacaaaacagctgagcaccagcaaacagcactttggtcagttggtggcgcaactggaaggcgtcagcccgctggcgacgctggcgcgcggttttagcgtgaccaccgacactgccggacaggtggtgaggaaaaccgcacagctccagagcggcgacctgctccgtacccgtcttgatgatggctgggttgaaagccaggtgacgcagttactgcctgagaaaaagcgccgccgcaaaaccgtctcctgactctgctcgtcagctcacacttttacacttaacgctggccttactaatgaggtctaacccgcctgacgggtctatactttctggcacattccctgtcgccagggcgtttcagatggcttgccaacgttgttgcctcagaaaagcgccgccgcaaaaccgtctcctgactctgctcgtcagctcacacttttacacttaacgctggccttactaatgaggtctaaccagcctgacgggtctatactttctggcacattccctgtcgccagggcgtttcagatagcttgccaacgttgttgcctcagaaaagcgccgccgcaaaaccgcctcctgactctgcccatcagctcacacttttacacttaacgctggccttactaatgaggtctaaccagcctgacgggtctatactttctggcacattccctgtcgccaaggagtttcagatggcttattgcgttattcctccctatatccttcgcaaaatcatcgcgcacggttccggccaccagcaggagcaggcgcgtcgcaccctgacacacgtccagcacctgatggcggaacactggcaaaagcagccggtggcaaaaaccgcggcaggcggccacgtggatcgtgaaatttatgatgcgcaaagtcagcagaccctgccaggtaagctgattcgtcaggagggccagcccggcaatgacgacgtggcggctgaggaagcctggaactatcttggcgtaacctatgacttcttctggcaggcttatcagcgtaattcgctggataatcaggggctgaaattgctcggtaccgtgcactacggtgataaataccagaacgccttctggaacggtcagcaaatggtatttggtgatggtgacggcgaaatctttaatcgcttcaccattgcgattgacgttgtggcgcacgaaactggcgcatggcgtgacggaaaatgaagctgggttgatctactttgagcaggctggtgcgctgaatgagtcgctgtcagatgtgtttggctcgctggtgaagcagttcagtaaaaaacagcgcgccgatgaggcggactggattatcggcgaaggcctgctggcaagcggcatcaatgggcgtggtctgcgatcgatgtctgaacctggttccgcctatgatgacccgatgctgggcaaagatccgcaaccggcgcacatggatcactacgtgaaaacacgcgaagataatggcggggttcatattaattccggcatccctaaccgggctttttatctggcagcaacagcgctgggtggttatgcgtgggaacaggcgggatatgcctggtacgacacggtgtgtgacgacgaactgccacaggatgctgactttaagacctttgcccgcttcaccgttcagcatggtaaaaaacggttcaacgaatcggtcggcagtgccattgaacaggcgtggaaggaggttggcgtgctatgagtgacctgcccgaactcactgatgacgccaccatcatcgtcgcgcgtgaaggcggcatggcctttattccggggctacgcgccgaacgacgctttatgctgggcgatctgccgccgccagaaagagagcgcgtctgccatgcgctgcagcaggcgatgccgttgggcgaacctgaggagaaagccgcgcaggtgggcagtggcgatcaacgctattttcgcatccagattcagtatgccacccaccgcgaggttgggacgatagtgctgttgattccggaacaggtggcgccacctgagttgcaggcgctgtggcgcgacggtaaataagcaaaaaaaaggccgacaatgtcggccctcagactgctgataatccgatgtacatctgttagcgacaaatgagcttaaagcgaaggtaacacgttcagaagaggaaagcgtcccgcgccatggacggcgcgggccgagcagtcatggatgacgattttgcgactttccgatctgaccgtgttccctgagcatgctcggtcttacagcgaaccaggcaagacttttccgtaaaaaagggccgacaatgtcggcccttttccttaagcgttgttacttgctgtctggcagcgcgtaagcaattacataatcaccacggtccggtgactgacgtgcgccacctgccgagatcaggatgtactgctttccatctttcggtgagacgtagctcatcgggccaccctgactgcccaccggcagacgtgctttccacacctctttcccggttgaagaatcaaaggcgcgcagatagtaatcctgcgtacccgcgatgaacaccaggccgccctgcgtggccagcgtaccgcccagcgttggcatgccaaccggcattttcacgcgcatcttgataccgaatggtccggtatcctgcaccgtgccgaccggcacctgccagacgattttctgcgttttcatgtcaatcgccgacagcgtaccaaatggcggtttctgacatgggatacccagcggtgacataaagcgatttttattcacagcatatggcgtgcctttcagcggaaacggcacccataccggtgttgatcgcttcgccgccgttgctgccacgcgcaatattgctggtatcagccgggatcatctgaacccacagacccagacgcatatcattgacgaacaacaggtggttgttcggatcgaccgacatgctgccccagttcataccgcccagcgaacccgggaagctcagagacttgtcggtgtccggcacggtgaacaggccatcatagcgcatagatttgaagccaatgcggcaggccagctgatcaaacggcgtggcaccccacatgtcagactctttcagcgtctggttgccaatctgcggcatcccggtcgagtgtggctgcgttttggtgtactgctcgttcgggatatgaccctgcggcatcggcagttcttcgactttggtcagcggcttgccggtcatacggtcaagcacgaagatcatgccggttttgccgccaatcactaccgcaggtgtggttgtgccatctttttgcgggaagtcgatcaggcttggctgcatcggcaggtcaaagtcccacagatcgttatgcacggtctgataaacccacttctctttaccggtcgtggcatccagcgccagaaccgatgcgccatatttgtgatccagttcagtacggttcgcaccccagaggtcaaccgacgaactgcccattggaatgaacacggtgttcattgccgggtcataagacatcggtgcccatgagttcggcgtactgcgggtataatctttacccggcatcaatatcgcattcgggtcaacattgcctgggtcaaacgcccagcgcatctggccggtgataacgtcaaagccacgcaacacgccacccggcatatccgtctgtacgttatccgctacgcgaccgccgaccaccacagtggtgccagccagggttggcgctgaggtcagctgatattgcggatccggtgccttgcccatgcccgctttgagatcaacgatgccgtgatcgccaaagttttcacagaactcaccgttgtcagcattgatcgcaatcagacgcgcgtcgatggtgttcatcagaatacgacgctgacagctgtcaccggctggcaacactgcggcagtcacaggtgaagaccccggcttatctggctgctgcagcggtttcgtggcgtcaaagtaagccagaccacggcagcgtggccagacttccgctttggcattgatttcacgtttccagatctgcttaccgctgttggcttcaacggcgatgacgttgttgtgcggtgtgcagagataaagggtgttgccaatctgcaacggtgtctgctgatcttctgcgccgttgccggtcgggctgacaggggtatcaccggtgcggaaagtccaggccacctgcagatctttcacgttgtcgcgggtgatttgatccagcgccacaaagcggctgccctgcggagtattaccgtagttatcccagtctttctgctgtttcgctttatctaccgggatcagcggcagctcttcgcccgtgcctgcaacggtaggatgtggctggaacatctgcaccagcgtaacaaccatgcctgccgccagcagcgcagagaacgcataagagggttttgccagtgagtgcttaccttcatgcttacgcagtgaaggccagatcaggaaggcaagcagcatcagtccggcaggcaccatcaggcgtgataccagcggccagaactccaggcccgcgtcgaacagcgaccagatcagggtgccgacaaagaccagcaggaacagaaccactgccgaggatttgcgacggaagaactgaattgcggagagtacagtgacgatacccgcaattaaaaagtacccgctgccaccaagtgcaaccagtttgccgccgccaattgcaaaaaacagaccggtggcaagtagcaccagtccgagcagcacggatgctattcccagcccctttccggagcgggaggatgtttcagccataatacttactctcctgaataaacagagcgcccggacagatggccttccggacgccggcgcgttaagtcagtccgcgccgggcaccgctcggtttcaaatcgaatataaacagacccgcgtccgtgagatcgaggggccggaagaacacggatgtggcttgcccctcccacgacgcggcaggattgtaccacctggtacattacagagtgaacatctacaacccatttgttacggcgcaatagcatttttgctacaaaatgagccagtcgttgctctgaattctcagacgttttaagcgtagctgaaagcggcgtcagtgacctggcggctggaaaaggacgcgcttgcgggagataaggccatgtccgttccggcaaaaatagtccaccgcgccgcaggctttgagcacctcaagcggctgatgacacgccggacagcagggttgtgcggggtaatgcgtaccgcaggtattacagataaattcaccgtcactgagcgacagcggttgctgacatttttcgcaaataatagtcactattttctccctgctccggtttattcagagcaaaaaaaagagggccagatggccctctattcttaacgcttgttctttttcatatgcgccagcagacgcttacgtttacgctgctgcgttggtgtcagcaggttacgtttgccttcataagggttatcaccctctttgaactgaatacgaattggcgttcccatcacgttgagtgatttacggaaatagttcatcaggtagcgtttgtaagaatctggcagatccttaacctgattaccgtggattaccacgataggcgggttatagccccccgcgtgcgcgtatttgagcttaacgcgacgactgcgtaccagcggtggctggtggtcgtctgccgccatgttcatgatacgggtcagcagcgaggtgtttacacgcttcgtcgaacagtcataggcttcagtgatcgactcaaacagattgccgacgccgctgccgtgcagcgcagagataaagtgaatgcgggcgaaatcgataaagcccagacggtagtccagtgtctctttcacttcatcacgcacttcctgcgacaggccatcccatttgttgaccacaatcaccagcgaacgaccactgttgagaatgaagccaagcagcgacagatcctgatcggaaataccggcatgggcatcaatcaccagcatcaccacgttggcatcttcaatcgcctgcagcgtcttgatcaccgagaatttctctacggtatcagagattttggcacgcttacgcacgcccgccgtgtcgatcagaacgtattcacgtccatcacgctccatcggaatatagatgctgtcgcgggtagtgcccggcatatcgtagaccaccacgcggtcttcaccgagaatacggttggtaagcgttgacttacctacgttaggacggccaacaatcgccagtttgatcggcaggcccgtcgggtcgaagttttcttcttcctcggcggcttcctgctcagcaatctcgtcagcttcaagcgcagcccagtacgcctggttctcttcttcttccgtgagctcgaccgtctcaactttgtccatccatggcagcagtgcctcttctatcaggctgctcacaccacgaccatgcgatgccgcaatggcgtggatctcgcccaggcccagtgaatagaagtccacaaccgcctgatcaggatccatcccgtcagttttgttggccaccaggaaagtcgctttctggcgggaacggagatgcttagcgatttgctgatcggcggccatcatgcccgcacgcgcatcgaccataaacagcacgacatccgcttcttcaatcgccagcagtgactgctcggccatccgcgtttcaacaccctcttcggtgccgtcgataccaccggtatcaataacaataaattcgcgcccttccacttcggcgcgaccatatttgcgatcgcgagtcagtccaggaaaatccgctaccagcgcatcacgtgtgcgggttaagcggttaaatagcgtagattttcccacattgggacgcccaaccagcgcgaccacaggtaccataacaaaatgcctcaataaataattaatcgcccgaatggcgtgattataacggctctggccgtcaagttcaggcttaaggcgcaaagaataccatgcctgactaaaaacgaaacggcccctgattaaatcaggagccgtcggaaacggaggatctcacctgccagacgtgtacccgttaacgggtaatcgcataaacctcaccatctttcgactggatcagcagcttatcgctggcgaccaccggctcggtctggaagcctgagctatccagtttctgctgcgcaacaaaacgaccatccgtggtgttcagccagtgcagataaccttcactgtcgccgacaaccagatagccgttgtagagcaccggcgaagtcaggttgcgatgcagcagatcgctttgacgccagatggcgacgccgccgtcagcgttaagcgcaatcacacgatcgtcctgatcgaccagatagatgcggccggcatccacaatcagatctttcacaccgccaatttcgcgtttccacaaaatctggccggaacgcagatccagtgctgtcagattgccgttatacgccagcgcgtaaaccacgccattgacgataaccggagtggtatcgacatcgttcagacgatcgatctcagtggcaccgctgacctgggaaatacgctgctgccagaccagttgtccctggttcagcaccacggcactgacacgaccattgtcgccaccgacaatcgcgccaccaaaagcgacagccggagcagattcaccgcgcagagacaacgctggcatatccaggttgacgctccactttacggcaccgctgctctgatccaggccctgcaacatgccgttgctggtatgaaccagcaccagaccatcgctgactaccggacgtgacagggcttcaccggcgactttcgtctgccacgccaggctaccatcactgctgttgagggcataaacctggccgcgctcgctgccaacatagacccgatcgccatcagccgtcaggccacctgataacatggctgagcgatttttagagaagaagccggttttctcagagagatcgactttccatttttctttaccgtctgcggcatcgagcgctttgacgataccaaagcggtcggcagcataaaccgtattatcctgccaggcaggatgcagatttgagtagaaatcaccgacaccatcgcctaccgaggtgctccacactttctgtggcgtgaactgattttccaccttcggcaacggggccatttttactacatcttcttcgccgctaaacagcgaacaaccgctgagcaaagtgactgaaatcagtcccggcagcaggtatttacgtaattccatgcgctctctcttgactggcttagcttaagttattcatcttcatctgcatcatttgcttcaatgccggagaggcgtcagattcaacccctttactccaggcatcgcgcgcgccctgcttgtcgcctttggtcagcagcgcttcgccgcgaatatcggccacaatggctgtccagccatcacccttcacaccgtcaagggttttaagcgccgcatccgcttgattctgttgcagttgaatgcgtgccaggcgcaggttaatcaccgcctgcagattggcatctttggtatctttcagtccgttttgcagcagcgtcgcggctttatcaagctgaccggcgtcaacatactgcttcgccagatccatcgcagccagcgcaccgtaggtgttgctgttttcactggcaaaacggtttaccgcttccagcgtctccggtttgcccgcctgcatggcgctggtgagctgctgatactgcgctgatactgtcttcgccgtatcgtcctgatgactgctccagtaacgccagccgcccagcgcagcaatgccgatcactacgccaatagctaacgctttgccattgttggcaaaaaagttgcgcagcgcgtcggtctgctcgttctcattgctatacacttccacgcaatccctctcctttctatggttggtgctgtgtcacgcttactgtaacagcgagcgcaagacagcagcagcctctgcctgatccagcgtttgctgctcgccacggcgcagatctttaatcacgacctgaccggctttgacctcgtcctcgcctaacaccagtgcgacgcgagcgccccacttgtcagcacgggcaaactgtttcttgaagttgccgccgccaaagttggtcatcagcctcagtttctggcgcttcatcacgcaatttctcagccagctgcatcgcagcagactgcacgccctgacctgaagcgataacatagacatccacattgctcgtcggttcaaattcaggattaaccgcctgaaccagcagcaccagacgctccatgcccatggcaaagccaacggcaggtgttgcgcgcccaccgagctgctcaaccaggccatcatagcgaccgccaccacataccgtgccctgtgaacccaggctatcggtgacccactcaatcacggtgcgattgtaataatcaagaccgcgtaccagacgctgattgacggtgtagctgatcccggcgtcatccagcagggcacacaggccgctgaaatgttcgcgtgattcgtcatcaagatagtcgccaagctgtggcgcatcattcagtagctgctgaatatcgggatttttagtgtcgagaacgcgcatcggattggtgtacatgcggcgtttacaatcctcatccagcacctctttatgctgttcaaggaaggcgaccagcgcgtcgcggtaatgcgcgcgtgcttccagcgaaccgatagagttgagttccagacgaacgtgctcagagatacccagggctttccaccagcgggcgttcagcatgatcagttcagcatcgatgtccggtccctgcagaccaaacacttcaacgccaatctggtagaactgacgatagcggcctttctgcggacgctcatagcggaacatcgggcccatataccacaggcgctgctcctggttgtagagtaaaccgtgttcaataccggctcgcacgcaacctgcagtgccttccggacgcagcgtcaggctttcaccgttgcggtcttcgaaggtatacatctctttttcaaccacgtcggtgacttcaccgatggcgcgtttaaacagtggggtttgttccaccagcggtaagcgaatttcgctgtaaccgtagctcgccagcgtctgcttgagaacgccttcaatccgttgccagagggcggtatccgcaggcaggtagtcgttcatcccgcgaatcgcctgaatattcttcgccacgttagaatctcttaatgcaaaaaaacctgtccggcatcataccttatgaggatgaaaccgcacaggttcagtcaaaaaagtcacgcacgcaaaccgcgtacgccattatttttccagatgctgcacatcaatacggcgactggcatccagcatcgacgctttagcacgaatgcgcgcttccagctgatcgatcatgtcattgttgtcgagacgatcgcgctgacgcacaccatcctcatagaaaccactcttcttgctgccgccggtcacgcccagcgtagagagggtcgcctcgccgggtccgttgaccacgcagccgataatggagacatccatcggagtgatgaggtcttccagacgctgctccagcgcgttgaccgtgccgataacgtcgaactcctgacgtgagcaggtcggacaggcgatgaagttgatgccacgagaacggatgcgcagtgacttgaggatatcgaaaccgactttgacttcttctaccggatcggcggccagcgagatacgcagcgtatcgccgatcccttctgacagcagcagacccagtccaatcgccgatttcactgcgccagcccgcgcgccgcccgcttcggtgataccgagatgcagtggctgttcaatctgtttcgccagcagacgataagattcaaccgcgaggaaaacgtcagaggctttaacgctgactttgaattgatcgaagttaagacggtcgagatgatcgacatggcgcatggcagattccagcaacgcctgcggcgtcggctcgccatacttttcctgcagatctttttccagcgaaaccggcgttcacgccgattcgaatcggaatattgttgtcgcgcgcgcagtcgaccaccatacggatgcgctcattgttcccgatattaccgggattgatgcgcaggcagtcgacgccatactcggcgactttcagggcgatgcggtagtcaaaatgaatatctgcaaccagcgggacgtttacctgctgtttgatcagtctgaatgcttctgcggcatccatggtaggcaccgagatacgaacgatgtcgacaccgactcgctcaagggctttgatctgatttaccgtcgcctccacgtcagtggtgcgggtgttggtcatcgactggacagcgatgggtgcgccgtcaccgaccggcaccttgccgacgtaaatgcgtttggatttacgacggataatgggtgcttcgttatgcatatttcttctccacaattgcccggtacgcgatacgctgttattgcgcacccaacgtcaggcgagcaacctggttattacggataaaacgacttaaatcaacgggctgattctgatattgcacctgaacagcggaaggcgcgccaattttcagacgatacggaggcgttcctgcgaggctgagtttaccaccactgcgctgaatgccgctgaacagttttttgccggtggcatcgctcacttccagccagcagtcggcgttaaaggtcatcaccaccgcattagggtcagcagccggttcactgaccgccgctgcacctactggcatctgaggtgccgtgctggtattggtattcgtgttcgcggccgcaggtgcagccgctgagttgtccacgggcgcctggctcggtgaaaccacggcattgctggtggtatccggctgtgcggtggtcgcgctattgctgccagtggcggccggagccgcactcgctggcgcactggctgcgctgttgtcactggcggtattgctttcgtcaggcgcggcaggtgccgcgctgtcaccactggattcacccagcggaatcgactgaccgctatcaccgctgctgctgttctgatcggtcatcggcaccagatcatcctgtgactctttatgattctgccaccaccaggcaccggtcagacccaccaccacaaacaccaccagccaggtgaaaatcatcaaccagccgtcgcgtttcttgcggcgtttgcccagcgagaaactttgcatcggctcgatctttgaagcccgaatcggtgtctgtttcgccatcatcggcagcagttcctcttcaggaatgtgcaccagacgcgcgtaggagcgaatgtatccgcgcaggaacgtggaggccagatcggcaggcgatttgtcttcctcgatatcacgcacggtagaaagtttcaggcacaggcgttcagcgacgttctgctgcgtcagccccatctgctcacgggccagacgcaggcgttcacctgttgaatgtaatgcagagttttcttgagtggcttcagtattcattagctaaataacgctggtactgtatcgattgcggaaaacgtcgcgctaactggtcgccataacgtgaaacgtcagcggcatctccctgtagcgcggcgaaacgtaagtgtaacgccagacttcgtgccgttgcgggcagctgttgctggtaaatatcaagcaaaacctgcaccttcgccagatggttatctgccatctgcttttcagcttccgacagcagcgaatcagctttgcgtctgtcagcctcaatggcctggcgtagtgtcctgcgggcagcggcaatatcgccagcctgcagataacaaaatcctgccagttcaagcgcgtcattgcgtgcatcaaactgcggtgctgcgcttgcccgactaaactgttgatgcgcttcgccatactgccttaaagcgcagagaaacgcaccgtaattgttagcaacaaaaccattatccggggcctgctgctgtgccagtataaaccgtgcctgcgccgctgtctgattaccctgcttctgcgccagtcgagccagcgcaagcgagacccggtaatcctctggcgcggcggcctgtgcccgcagaaagtttcgctcagctgcggcatagtcgccacccgccagatagtgcatccctaactgcagacgcacctcttctgctccgggttcgtgatgctggctgacacacccgcttacaacaaacagcgccagtaaaactgcaggtaatccgttacgcataatcgtttccatccgcttgacgttgacaggctgcagcctgccacgcgtcatcacttcaggaaacgctctgagtcactcttctagagagccttcacagagatggcttcacccgccatttttttacgcatcgtacgcttggtacggtcgatcacctcaccggctaactgaccacaggcggcatcgatatcgtcgccacgggttttacgcacgatggtcgtaaaaccatagtccatcaggactttggagaaacgatcgatgcggctgttggagctacggccataaggcgcgcccgggaaggggttccaggggatcaggttgattttacacggtgtttctttcagtaatgcggcgagttcatgcgcatcatctgtgctgtcattgacgtgatccagcaacacgtactcgatggtcacacgtccctgattggcgttagatttgccaatgtagcgtttcaccgccgccaggaaggtttcgatattgtactttttgttgatcgggacaatatcatcacgcaacttatcgttaggcgcgtgcagggaaatcgccagcgcgacgtcgatcatatcgcccagtttatccagcgcaggcaccacacccgaggtagagagggtcacgcgacgcttcgacagaccaaaaccgaagtcatccagcatgatctccatcgccgggaccacgttattgaggttgagcagcggctcgcccatgcccatcatcaccacgttggtgataggacgctggccggtgattttggctgcgccgacaattttcgccgcgcgccacacctgaccaataatttctgacacccgcaggttacggttaaagccctgctgtgcggtcgaacagaatttacactccagcgcacaacccacctgtgaagagacacagagcgtggcgcggtccccttccgggatatagaccgtttccaccagctggtcgcccacgcgaatggcccatttgatggtgccgtcggtagagcgcatctcttctgccacttctggcgcacggatctccgtcagctccatcagccggttacgcagctttttgttgatgtcggtcatctgctcgaagtcatcgcagcagtagtgataaatccacttcatgacctgatcggcgcggaaaggcttttcgcccagcgacaggaagaattcgcgcatctgctgacggttgagatccagcaggtttattttctggcttttgggggagacgacaataggggatgcggacgcggacgtcacaatctgttcggacataatattctctggcctcgttgttacacgttatggcgctgttcagggataggtgaaaaaaattgcgccttcattaagctgagtcaatgaaggcgcaatattgtacaacatctgcagcctgataacaggcgggagtgacctcccctacgcagatttttgtaaagcctacgtaacgtttatcgccaggcgattaacgggtacgtgggcagatttcgttttcgccaaagaaataagcgatttcgcgggcagcggattcagcagaatctgaaccgtgcgtggcgttttcggtgaagctgtcagcgtagtcagcacgcagtgtgccagccagtgcgtttgccgggttagtggcacccatcaggtcacggtgacgctgaacggcattttcaccttccagcacggaaacaacaaccgggccagaggtcatgaattcaaccagaccatcgaagaatggcttgccctggtgctcagcgtaaaaaccttcagcctgctctttgctcagctgcagcatttttgcgccaacgattttgaagccagcgctttcaaaacggttgtagatagcaccaatcacatttttagcgacggcgtttggcttgatgatagaaaaagtacgttcgattgccatgatgacctctgtcttaacgttctgaagaaaccggtggcgtccgccccggttaagaaacggcgccgattataggggctgagtccggcattgcctatcagagatccctaatttgatgaaaaatcttgatctgagtcgaagcagacgcgccatagttatgatttagcgcaaaaaagcgtcagccccggctgaaggtgaccgagacaagttgcccctcttcatccatcaccaccagctgatactcgcccggatgatcgagctgcagcgacaggctgtctgcggcgtttctgcgtcatcagaggctcaccattcaggaaccaccagcgctgtgtgccctgccctccctgcaccgcgaccggcattgtcagcgcgctcctgcccggcagcggtctgacaatttgcccctcaatcacgccggtaacgatcagcggtgcgctgctgccctgctgtaacggcggacaccgggcatcgacagggggcagacgttgcgcccgccgctcctgaggcggcagccaggcctccagcggcagcggccagaccagccgttcatggcgggtggcgtcggggcagtctgctgcgacgcgcagtccctgcgcattctgccagtagcccaggcgtaatccgctgaggctctcctgaccgggagccagcaatgtaggcggcagcgtgtcggcggcaacccagctttgccgccgctggcgacagttttcgtctccggcgggcaacggctgaccgccaggccagcaaatggtcgccaccgtcaccgaggccggccgcggatcgcccggaacgtcacgtctgccgaggcgactcatcagcaggctgttgatctgattcatgacgggcacggcagaggcaaaaccaaactgcccggcaaccggcgtcgcatccggtcttccgacccagacgccaatcagataacggggattgatccccaccgaccaggcgtcgcggtagccataactggtgccggttttccaggccagtggcaccacatcgggtacgctgccattgcccgcgggctgcgcttccccggccaggatacgccggatgatccacgccgactcaggcgaaagcagcggccgctgctgtaagggttgatcgggcatccagcgcagctggccggcgttgccgtggcgggcaaaggcgctgtaggcagccacgatctcatccatgcgcgctccggtgccgccgagaatcagggaaagattaggttcagcgccggggggaaaacgcaagttcagaccgacattgcgcaggcgcgctgcaacgtttttcggccccagcgcctccagaagctgcaccgcaggcagattcagcgaccgcaccagtgcgtcactggcgctgaccggcccgtgaaatccggtatcgaagttgcctggccggtaatcaccaaagcgacgcggcacatcctgcagcagtgattcagcatgaatcagcccctcatccagcgccatgccgtaaataaagggttttaacaccgagcctggtgaacgcacgctggcgatcatatccacatggccaaaacggctgtcatcggtaaagtcagccgagccgacatagccgcgaaccgccatggtggtgtgatccaccaccagcatcgccagcgaggtgcgtggaggaagctgatttttaacattcagcgccaggctttccagttcgcgctgcagtgaggggtcaagcgtagagacaatcttatcgctgtggctgatcgacagcagtcgccgggccagcagcggcgccatctgtggcatctggcgcggcggcagccacaccggctcctgacggatttccgccacctgttcagcggaccagatgcggtattccgccagccgatccagcactttgttgcgtgcggcttctgcccgctccggccagcgatcgggccgcagacggctgggtgcctgcggcaaaacggccagcagcgccgcctcgcccggcgtcagctgtgacggggcttttcccagccagctccagctggccgcgcccaccccttccagcgtgccgccaaagggcgcacggttaaggtagagcgtcaggatgtcacgtttggaaagatgccactccagctgcagcgcccgccacgcctgaatcagcttgccgcgcagcgttcggggttgcgggtcgataaggcgtgccacctgcatggtcagcgtgctgcctccggaaatcacgctctgatggcgcagatcctgccaggcggcgcgcagcagagccaggggattgatgccgggatgataccagaaccagcgatcttcataggtcagcagcgcctgcagataggccggagccacctcctctggcgtgaccggatagcgccagatccccttgctgtcagcaaagcgccacaatggtgtaccgtcgctggcaacaaccacccgcgcaggctgcacctgtttaagcggcaacgggaaaagccgatccagcccccatatcgccagccacagcgccagaaaaaaaagcggcagcgcgagccaccactttttgatgctgctgacgtttaccacgcgtcgcgtcacttactgaatatgcagctgtgacggcgtgctgccggtggcgcgccactccggcacatacatcgactcgacctgcggtggtggcatcagatagcgacccggtgtgaccgcccgcgccaggtagaccagcgtcgcgggacgataagtatccaccgccagtgccgccacaaagcgatcgtcacggaactcaatgtgtctgatgtcagcctgctgcatgtcacccatgctctccttcagcgcatccgcactgtcgccgaggctggcgctgctgtcagccaggttctggttttccagctccagaccggcaggcagcagatccaccaccagcgcatcggtgatgctgcgcttcgacgaaacggtcagacgtaccaccagcaactcgccgctgcgcagattactgagatcggcggctttgccatccagcgtaaagtattcacgctttatcccgagcacattgctctccggctgtggcgcggccagcggataaccggtgacatccagacgaccatacagcggcgcactgcccggattactgatggctaagccctgcaacagtcgttcagcccccagccctttattcagtggcgcatcaccctgcagaggctgtgcattgcccgacagttgcgcctgccagcttccgccctgcgcacgctgcagcgtatgcgccgctaaatagagcgcgttattctcctgagtcgagaaccagcgcttgccgttgacctcttttgacaacgacagcagcagactattctgcaaatcaggctgcagcttattctctgctaacagggctatcatcatcccctcatcgcgcaccgtgctgccatagtcgccataccactctttatctgagcgcgtcagactggcaccctgcatgatcgcaagcgatgcgcgctgcccgtcacccatcagcttcagcgccacgccaagctgcatcagcgccaggccggagcgggccttctcacgcttttcatacaaggcgcgcagcgcacccagcggcgcacgctgctgacgcgccagcaccagtccggcgtaagcctgcacgctgaactgcagcgcggcgttgttatcactgccgccgccgctgatctgcgcgggatcctgcagatagcgcagcagccgtgcgttagcgcggtcaactacattatccggcagcgcatagcccgcctcgctggcgcgaagcaggaaatcggtcacgtaaggcgtcagccagaactcctcctcactctgcttgtcccacagcccgaagctgccgttggcccgctgcatgcccgccagacgggcaatgccggtgtcgacggcggcccggcgcgcctcgtcactgctggtttttatccccatcgcggtcagctcggcatggctggtgtagagcgacggccagaggccgctggtggtctgttccagacagccgtagggataggcgtaaagcgcactgatataactggcgatattgagcggcggacgattgctcagcgtcagctgtccactcagggtctgagcatccagcccggtaaacgcggttgccgcgacctgccagggctgatcggaattgatgacggcatcgaaattcagtgtccgggccggataaggtggtctgacgccgattttccactgctgtttgctgggcttcacctgctcgcccggcaggttcagaccggaaatctgcacggcgacctcaccatcaccaaagtcggttttcgccgtgaccggaatctgaagtgtggtacgtgcgcctttggccagcgtcacactctggctggcagccccggccagatccactaagccactgctgctcagatccaccttcagagtttgcggcagatcggtcaggttagtgagatccagcgccagtgaggctgtatcgccgctggcaaggaagcgcggggtggccagttcgctgatcagcggcgccgcgaccaccagtttacgttcggccgcgccgaagctgtcgtcgctccatgcctgggtcatcagccgcagttcaccgttaaaggccgggatcggcagcgtaatcgatccgttgccctctttatccagcgtcaccgcctgtaactgctgcgccacgatattgacatgcgtcaccggctttttgccgccgcgcgtcatcgattcatcttcgccatcaccaccaaaacgcagcgccgcgagccggccaccgccttcgatcagctggccaaagacgtcgtactgatcgacgttgtagcgtttacggccaaagaaagcctgccacggatcgggcgttttaaaatccgtcacgctcagaacgccgctgtccaccgctgacagcagtacattcactttttcaggcagcgggccgccatcacgactggcgtggacttttaccgtcaggcgttgctcaggacggattttatcgggcgcatccagcgtcagatttaagcggcgcgcctccgtcgccatcggcagatgcaacagccccaccgcgcgttttggcgttgcgccactgaccttatcgccgtcacgcaccacgatggcgctgaagtagagatcgtgacgctgccagctctcagcaacagggacatccaccgttgtgccgccctttggtacggtcagtggctgccaccagagcgtgccgctgctcgactccaccatcaggtaacctttaccggccgccggtgactcaacctgcagatgcacggtatcgcccggctggtaagccgctttatccagcttcagtctgacctgatccgggcgcaatgcacccgtgccgttggtgttatcctgccagtcataacccgcctggaaaccggacgctgctgacgatcttctcgcccgcctgcacttccagccggtagtggccccactcgaccgggaagctgactttggtgctgccatcagccgggacagagatggcgcgttcatcttcctgcagatccttgtcgctatactgcgactgccagccttcgctgtcagagaagctccagtagtaatcatggcgttcacggatcaggcgaacatccagcttctctgccgccagttttttgccctgactgttggcatagacaatgtcgaattcggccaggctctgttccggcacggtcggctcatcgtgatagctgtcactgcggtagtcataaaccgccttgttaccaaacagcggccggatacctggcagcgcttcagcgggccagatggcctgggtggcacgacgggtgaccggacgtccgccggtctccagcaggctggcctgcaggatcagattgagcggagagtggagctgatcccactgattttctaccgtgagttgtgctttaccgctggcgtcgagcttgagatccacctcatccagcgtgcgctttaacccctcttcggtgatgtcaccaaactggtagcctggcagtgcagtcaccgcctcgcgtgccggtcgcagatagagttgaccctgtagcgtgttacctgctgctggggcgccatagagatagcgcccctcaataccgaactcaacactggcatcagcggcctgtggctgagggtcatttttcagggttaacgccatacgctccggcagaaaatcttcgacgtgaaacttccactctcgcttgaggttatcgccggtattcagtcgcaacatccagtcgccggtcatggccgacgcgggcagcgccagtcgctgctggtagaatcccgcttcaggctgccagacaaaagtccgcatcacctggccatcgggctgcaccagctccgctttgatcggctgcgcgggcaaggggtgtccgtcggcatcgcgaagcagcgcattcacgatgaccgtttcgccaggacgatagatatcgcgcggaccaaaaacaaacagctgtttgtcatagccctgcggccccgcgaccgggaattcagcgagatccagcgccggacgcgccaggtcgatcattgaggtctgttctccctgaattgccagcaggagcttgcctttttcatccgccttgaggctcagatgaccggtgctgtcactggtaccgctttgcagcacctgccccttctcatccagcaacctgacgctgaccccggaaagcggctgaccgtctgccagactctgggcgaacagttcgaaccgggtcgggaagcgatgcagtgacaggccaatatcgctgagggtgaaaagcgtggcgggctggctgtagcgataagtaccggcctgcttcatcaccgccagatagacgcccggctgctgaagtgcggtaatgtcacgcatcggcagctgcaatttttcacgcgtgttacgcgccgggttgagctcaaagcgtccgctataaaccagctggctgcttttcagcagttcctgcgactgccagcttgagaggttgttgccgtaattccactgcgagagaaattccgccaggccggcattctttatccggaagaaatcgacatcgacctggtcaacattcagcgccagcaccggcagtccctgggtgatacgcagcggcagcagtgaaccgcgactggcaaagcccaccatcggctggatatcacgggtggcgattttctgactgtaatcggcggcaagcgtctctccgctggccgcgcgcagtcccgcatccaccgtgacggtgaagtgacgcgacggctcgggatggcggaagcgcaacgttttgcggttagcagaaagctcccagccgccatccacccggccctgtttatcgtcggtcagcctgactttttgcgcgatatcctgtttatcatcaagcggctgactgaaggttaagaccagcgcagcggcattatcgatctgcagtttccgagagatcgataatcgtcagcggtttgctgacctgggaggttgcgggtgcttctgccgcctggagaggcaaaacaggtaacaggttcgctgacagcagcgagccaccgatcagcatgctgagcagcagccgggtattgcgtttcttcatggtagttccttcaccgggacgcagggagtgtcgtttgattacgcagcgcaatttcatatcaatgctcgcatttaatcaacgcttctcttgagatggtgcgcacattccctgacactggtatgacagattgctgagatgaggttgttatgacgacgccactgtttgtgtccgccgactggttacaagagcactacaacgatgagcggcttcaggtgctggatgcacggttgttgccacccggtatggaagcggttcgcgatatccaggccgaatatctggcgggtcatttacccgacgccccttactacgatattgaagcgctttccgatcacaccagcccttacccccatatgctgccgcgcgccgaaagttttgccgtcgcgatgcgtgaactgggtgtcagcagtgataagcacctggtggtgtatgacgagggtaatctcttttctgcgccacgcgcctggtggatgctgaaaacctttggtgtggctcaggtgtcgattctggccgggggcttgcagggctggaaagaagctggttttgcgctggcaaccggcgaagtgaatctgccggaaggtgagtttgaggcccacgcagatgaaagccgggtgaagcgcctgacggacgtactgctgatcagccatgaaggcggcgcacagattattgatgcgcgtcctgccaatcgctttaacgccgaagtggatgaaccacgtcccggattgcatcgtggccatattcccaacagcctgaacgtgccgtggaacagcctggttgaacagggaaaactcaagccggaggcggaacttcagacgctgtttgccgatgcgggcgtcgatattacccaaccggtggtcgccagctgtggctcaggcgtgacggcggtggtggtgattctggcgctgacggcgctgggcgcacgggatgtcacgctgtatgacggatcctggggcgaatggggcagtcgcgacgacttacctatcgcgaaataaaaaacaggcggcccatgagccgcctgtttactttgttgtctcagataatccgctcactgcccttgaagtcccgcaggaaactgccccagcgacgctcatagaatggcgtgatgtgggcggtaaagaagtggctgatgccgcgatcgttcagcgtcacctcacagatatcaaccggcgcatcgtccggcagcgtatcggttgcaacgctgcccgccgcctgaatgatcgtctcaatattgctgtccgcttcaatgccaatcagcagattgggcgcttcgtcagcccgctcacggatactggcgataaacgcgcgacgcacctgcttatgcttgctgaagagctgagtcagtgagtcgatcatctgcgcagggggttcagccacctcagacagcaatagtgactgtccgccttccagcacggtttgctggcttagtgcactgccctcttcagccagcagatgggtgatctcggccgcagtaaactctttaccggaaggcagtttgggattgagaaacagcgtctcgccgcgcgtaatctcaaacagcgtccgtaccggcagacgtagccaggactgctcaccgctcaccgcttcactcatcgcctcttctgacgtgaaaaaaggaatgatgctgctgccatcctctttttcccagtgctgcagatcaacgggcgtgctggcatcaagctgttgcgtggtgctttcacctggcacccacgcatcagattccagcagcagctgaaaaaattcgggccgatgggcaggctcagtggccgccagcttcagcacctcttcaagacgattcatagtttccctctgaacagcggcggcatcagccaccgctgagatcggcttatttcagtaacagattggcgagggtaagcacgccaagacctgttgcacccgccgcccactggtcaactgcgcctttgcgataggtcgcggagcagtcgatgtgcagccagccctgctgatagttactgacgaagtgtgacaggaacgctgccgcgctactggcacccgccgcatgtgacgggctggcgatattattgagatcggcgaagttagacggcagatggctgcgatggaattcggccagcggcagacgccagaaaggttcgttctcactcaccgcgctgcccatcagcgactgtgccatcacatcatcaaaggtaaacagcgcatggtaatcgttgcccagcgccgtcttagccgcaccggtcagcgtcgcagcatcgatgatcatcgtcgggtttctgctcgctggcgtcgattaaaccgtcggccaggaccagacgcccttccgcatcggtgttcatcacttccaccgatttaccgttgcgatagcgaatgatgtcgcccagtttaaaggcgttgctgctgaccatgttatcggcacagcagaggtagagtttgacgcgcttgttaagaccgcgcgaaatcgccatggccagcgcgccggtgacggtcgccgcgccgcccatgtcagatttcattgagtccatgaagctgctctgcttcaggctgtagccaccggtatcaaaggtaatgcctttaccgaccagacaggcgtagaccggggcattgtcgtcgccggtcgggttgtaatcgagcgccagaaataccggcggacgatttgaaccgcgtccaacggtgtgcaggcccatatacccctgtacccgcagatcgtcgcctttggtgatgcgatagctgacggcgctgccgcccacttcactgatcagatcgactgcattgtgcgccagctgttccggccccagatcttccgcgggcaggttaataacgttgcgaacccagtcgataattttcagacggcgatcaaactccgcctgctcatgttcgcccagcgccggccactcaacctgacgctggcctttcggaccacggaagccctgccagaatgcccagcactgctcaaggtgccagccttcgccggtcagcgccacatggcggatcccctggctgtcgattttgtgagccgcacgctgaatgatattcagcgcatccgcgccggtcagatgcagtgtcatgccgctgtcgttgctgctgagaatcgctttttcgccccagcgcgcatcggcgggctggctgctaagcgtaatattcatgggttgtgtggtcatcgaaaagctccataatcgttatctgtttcatccagcctgattgttataacggctttaataagatgttaaatataattcgcagagagacctgataacagattccgtcaggtgttgccagcgaagtgcaaatataggcgcaatttccggactatgaccggatatcaggatttcattaaggcccgcagacgggtcactgatttctgcaccagggcaatggcgtagtcgatctcttcctcggtagtgaagcgtcccagcgagaagcgcagcgaactgtgcgccagctcttcactcaggcccagcgcccgcaatacataggaaggctccaggctggcggaggtgcaggccgagccggaagagagcgccagatctttcagcgccatgatcagtgattcaccctcaacgtcagcaaaactgaggttaagaatgttcggtgcgctctgctgcagatcgccattgagggtgacgtcgggcagtgtgctgatgccctgccacaggcgatcgcgcagagtctgcagtcgcgccatctcggtttcgcgctcttctgctgcgatacgatacgcctcgcccatgccgacaatctgatgcaccggcaatgtcccggatcgcataccgcgttcatgtccgccgccgtggatctgcgcagcaatctgcacacgcggtttacgccggacatagagtgcgccgatgcctttcgggccatagagtttatgggcagaaaaggacatcaaatcaaccggtaactggctgagatcgacaggcagcttgccgacgctctgggtcgcatccacatgaaacagaatctcacgtttcgcggcagagttcgccaaaggcggcgatatcctgaatcactccggtttcattattaacgtgcatcagggtgactaaaatcgtgtcgtcgcgcagcgccgcacgcagctggtcaggcgagataatgccgttagccgccggggtgagataagtgacagcaaagccttcacgctcaagctgctggcagctatcaagcaccgctttatgttctgtctggctggtgatgatatgtttgccgcgcgcctgatgggcgtgagctgcacctttaatcgcgaggttatcggattcagtggcgccagaggtaaagatgatttcacgcggatcggcattgaccagttcggcgatctgattacgcgcaacatcaaccgcttcttcagactgccagccaaaacggtgcgatcgcgaggccggattaccgaacgtgccatccagcgtcagaaactgcatcattttgctggccacacgcggatcggccggcgtggtggcggcgtaatccaggtaaatcggtaatttcattgcgctacagctccgtataaaaaatcatacgtctttatagcagattcggccctgaccgcgttagcagtaagggccgcaacagcggggattacgaggcgcgttggttgacgttaatttcctgcgtgcgcgggctctggaagcgacgattatcaatcgcattctgacgatcggctacatccaggatctcctgattattcaccagctcagccagtgtaatattgttcaggaagtcactgatacgcacgctcagatcgcgccacagcacgtgagtcaggcaacgctcgccgccctggcagccttctttaccttgacatttggtggcatcaacagactcatcaacggcggtgatcacttcaccgacagagatggtattagacgctttgcccaacagataaccgccgcccggaccacgtacgctggacaccagctcatttttacgcaatcgggagaataactgctccagataggagagcgaaatgccctgacgctctgaaatatcagccagcgggaccgggccttcatgggagtgaagggcaacgtccagcattgcagtaacggcataacgtcctttggatgtcagtctcatagcgtacgacctcaatagcgtccggttatcggaggattagcaacagatgctctgaagtctgccattcccgagtaaattggtcaactatttaacctggtaaattagtcaggtatttaacctggtaattcactcaactattatctgcttcttttttatcgttttttcgcttttcaaacgacgaaagcatgccgcgcaggatgttcagttcatcgcgttccgggcgggcacgggtgtaaagacgacgcagtttgctcatcacctggccaggattggcttcacggataaagccgctgttcagcatcatctgttccatatgctgatagaagcgctccaggtcatccaccagcggataaggtgactcttcatactgcggcggcgggctgccatgctcctgcgcctgtaaccatgccatgcgcacttcataggcaataatctgtacggccatcgccaggttcagcgagctgtattccgggtttgcctgaatcgcgacgtgatagtggcacttctgcaactcgtcattggtcaggccgacacgttcacgaccaaataccagcgcaaccggtgcctgctggccctcttccacgcttttcacgccacattcgcgcgcatccagcatcggccagggcagcgagcgggaacgtgcgctggtgccgaccaccagactgcatccggcaatggcctcatccagcgagtcgacaattttggcgtcgccgataacgtcgctggcaccggccgcgagtgagatagcctgtgagtcaggcttgaccagcggattaaccagatagaggttggttaagcccatcgttttcatggcgcgcgcaacggagcccatgttaccggtgtgagaagtctcgaccagcacgatacgaatattttgcaacatgattagggatactcagaaacgggtcagtaaaatcagtagagagaatattaacataaagcaggacatttaccgaacacgctgctatactccgcgccgttttccccgttctttaacatccagcgagagataccgatgcatccaatgctcaacattgccgtgcgcgcagcgcgcaaggccggaaatttaattgccaaatattatgaaaccccggacgccgtcgaagccagccagaaaggcagcaacgacttcgtaacgaatgttgaccgcgaagcagaacgcctgattatcgaaattattcgtaaatcttacccgaaacataccatcatcaccgaagaaagcggtgaactggcgggcgaagatcaggatgttcaatgggttatcgatccgctggatggcacatcaaacttcatcaaacgtttaccccactttgctgtttctatcgctgtgcgcattaaaggccgcaccgaagtcgctgtcgtttacgatccaatgcgcaatgaactcttcacctcttcacgcggtcagggcgctcagctgaatggctatcgtctgcgtggcagcacggcccgcgatctggatggcaccgttctggcgaccggcttcccgttcaaaatgaagcagcacgcgccggcttacatgaatatcatgaccaaactctttacccagtgtgctgacttccgccgcaccggttctgctgcgctggatctggcctatgtggctgccggtcgcgtagatggctattttgagattggcctgaagccgtgggattttgcggcgggtgaactgctggtccgtgaagcgggcggtctggtgaccgacttcaccggcaaccacggctatctgctgtcagggaacctggtcgcgggtaacccacgtgtggtgaaatcgatgctgtcgaacatgcgtgatgagctgagcgaagcgttaaaacgctaagtctcagtacagaaaaaggcggcttctcagccgccttttttattgcctgttactcagtgatgcttaacgacgttcgtgtgacagcacctgacgaggctgagtacgacgacctaccatacccatcacgcctgccagcaccgcttcgatgatcagcagaatcagggcataccagctcgctttcgcagtcgcggcagcggctttttcaccggcttcacgcgctttctgttcagcctgctgtttcagttcctgatacttctgaaccgcctgctgatagctctgttcagttttggccacgatctgatccacttcctgatcgcttttgccggtgcgcgctttgataatatttttcagcgcatcacgatcggctgcctgcagggtatctgaatgacgatccatcaccccttttaaccagttagccagatcagtatccgctgtctgtggatggtttgcggtgttgttagcctggttttcagcattctgcgcttctttatttgcatcctgctttaagttctctggctgtaattccggtttcccggtctggcgtaaagtcgtttccagttcgttctgcaggttatctaaattaatattactctcctgcagtttgtcttttgccatttgggtaacggatggcgcagcggcggaaataccactacccagcgcctggaagcctgagcccacaatattcatcgcgccgcctaatacactggtcgccagcgcaatagccaggtaaatagtgaaaattgtgctaaggccaaacatcagtaaaccgtgcagtgcgccttcgcgctgagccagtcggcctgcaacataactacctgcagccatcgcgaccagcatttcaatggcagtccagaccagcgcgcctgtgcccaggccgtcgagtggattctgttctttcatcggatcaatggttgttgcaccaatggcggttcccagcagcgtcagaataatgtgaacgatcaacgcacaaatgacaccggcaaagacggcgctccaggaaatacgttttaacggcaatccagcaggcccggtcgccagcgtttcggtgtagccattattaatacgggtatcagccatgaaatatactcctcgcaataaacagaaagcggtcttgatcttttatcatcccgacggcggaatgccgttttggtattatcagcgtagacagggaatagtcatttcaccactaaaccagccagagaaaaaaataaagagatgaattcagagataattaacgaagagaagagcgcagcggcaattttatttccgctgcgcttttattcagaaaggtcgaattccgccacccagcgtcatctgcgctgactgccatagcgcgatacccgctacgattaaaatcaggctgccggttaaggccagcgcggggatcagcagtcgcgtcatgcctgcggtaacgccaggctgtgccagccgttgcgccaccgtgcgcgcctgctgaaccagcaggccaatcgccgaaatggtcagtgccgtgcccagcgccatcactgcagcagagatcaccccccagccatagacaccaatcactttggcaaacagcagcatcataatcgcgccggaacagggacgtaatcccatcgacaccaccaccagcagctgggttttcacgctgagattgccgctcatctgctgcggtgtcggaagatgcgcgtgtccacatccgcactgatcgtcatgctgatggtgaggtttgaaggtgcgaaataccggggccggacgcggacgcaatgtccgccacagcgaacgcagcgcccgataaccgatcatcacgcccagcccgatcaccaacagataactgcccttctccagccagaaactgctgagatgcagctgtcgcgatgacgttttcagcagcaccagcatcaccgtcaccagggcaatcgccaccgaaaccctgcagcagtgaggcgagcagcgtcagcctgatactggttttcactctggtgggatgggtcgccagaaaggtcgcgatcaccactttgccatggcccggccccagcgcgtgcagtacgccatacagcaggctgaatatcaccagagaaatgcctgtttggtggggctgctccgcaacctgctgtagcagctgagtcatctgctgatgcagatctttttgccacagtacgctctgcatcagaatctgcggccagtagagccagaccagcaatgcgctgctcagcagcacgcccgccatcagccacagcggccagaggcgggaagcccgtaacggtgtggagattactgacatgtcagtatcaccgtctgggcaaactgccggcctaaatccatctcctctgcaggcgcgtcggctttatccagcgacagcgcatactgcttcagtgaatcattgggctttggcgtgttcagcgcgaacttgcagcgcgcctgcagcgccgtcggcagcgttaacgcaccgggattgtcatagaacatatcgacgaaataggtgggatcaaaagtcaggatctcaaagcgctgcccggtcagcttcgggggttccgccagcggcagaataaattccagcaccgctttatggccgttacgtgacaggttgtattcggttggcagattcaaaaactttacccgctgttggttgtgccagatttcagaaaagtagtgctggcccagcacgttcgccatcacgcctgccgccagcttcttccacaccacgctgcctggtttcgcctcgcgcgcgtcgtaaagcagatcggcggaggtaatctcatccatggtccaggtcatctttaatccggtaaaggtgtcatcctgcgccaccagttcggttttcatatcgatgaagctgtgaggatgtgccattacagccggacttaataccatcaagagggtaaagagtgtgcgtttcataatgttataaagtaacgttcccgatgaaaagaatctataagtaacaaaattttgtgacccgccttaaacctccggcaaataaaccgcgtaaaccgcgcaggcgctgacggggttgactattcttagctcaaaatagcctgctggaaacctgattgatgagttctgctacccctttggcaccactcttcacccgctcacagcgtcagtgccatcttttattgctgctgtttctgccgacacccgtgcttacgcttgaaaaagtctgccagctgaatggcgtcgatcctgctgttgcccgacaggatatcgcggatgtgggccttgagatacagcgatatcaccagctggaattgcatcagatggtggatggcagctttcgtcttcatggcacagagttggatcggcgcctctgtctgctgcacaacctgcgacgcagtttgcgtttatcgcaggatttcgtctgcgatcattttgcagcccccctgcgtcagcgcctgaaggtgatgaagattgagaaggcgctgtgggatgagaccaatttacaggcgctgatccagcactgtagcctgcgtctgaagcgcgatttcagcgaacgcgaccggctttttctgcagattttcatgaagtatggattgtgccagcgccagccggtgctgttcagtgaagcgcagtgtcactggctgcagcagaaggctgagcggcaggccgccgaggatgtgattcaccactggcgtaaacgctgccaccttgcaccgcccgtcagtgaaaccgacttctggacactgctgttcagccagatccatacgcctgtcgtggatgcgatcgcgcatcctgctgagcagcggttaatggctgcggcccagcagttgattaatgactttgaacggtgtgccgacatcacatttgctgatcgcgacgagctgcttaaccagctctatcctcatctggcgcaggcgctggatcgcacccacttcactatcggcatcgacaacagcgtggcgctggatgtcagccgcctctatccccgcctgttgcgcaccactcagcaggcgctgcaggcgtttgagcagcaatatgggattgcgttcagcccggaagaggtgagcttaatcaccgttatttttggtgcctggctgatgcaggagaatgcgttgcaggagaagcaggtgctgattctgacgggtgacgataccgatctggagcaggatgtggagcagcagatccgggagatcacgctgctgccgatcaatattacctatcaggacgtgaaacagtttcagcgggatggcgcaccgcgggatgtggacatcatcatttcgccctaccccacctcgctgccactcttctctccgccgctggtgcatgcggaactgccgctgacgttacaccatcagcagcggattcgttatttactggagtcgtagccgggacgcagaaacagcgcgggcagcgccaccagcgccatcacccagaacagatgcccctgcagatgagcgaacagcacgccgcagatcatggtcattatcgcaatgccaccccccatcgccagcgcggaatagagcgactgcagacggatcacttccgctccctgacgcgccgcaataaaacgcatcgccgccagatgacagacggtgaagctgccacagtgaaggatttgcgccacaatcagcagcggcagcgcggtagtagcacccatcagactccagcggatcagcgcacaaatgcccgaaagcagcagcagatcgcgcgcgctccagcggcggaacaaccggttgctcagggcaaacacgacgatttcagccaccacgcccagcgaccagagataacccaccgtggaggcggaatagccactctcctgccaccagatagcactgaagccgtaataggcggcgtgcgccccctgcagcagtgttacgcagagcataaatcgccataccgcattctcacgcagcaattcacgccacacctgccagccgccgcccgccgcgccctgccgttcattaccctgtggctgggtggcgggtgacagcatcatgcctgccagcatagagatgacgccgacggaaagcagcagcagaatggcgtttgaagagtaagcactgaccagcacgccggttaacgccgagctgattacaaaggccagcgaaaccccacagcctgaccggcccatacgccagccctatctgctgtgtccaggtggcggccagcgcatcgctgagcgggaccagcggcgagaaaaagaggttaaagccgatcatgaccgtcagcagccacatccactgctcacccacccagaaaccggcagcgaacaggcaggtcatcagcgccagcagacgcagcgccgtaatcaaccgtgaaggatttttcacctgagaagcgataagcagactgccaacaaagcgtgccaccatgccacagccgagcagcaggccaatcttttcagcatcgagaccggtgcctttcagccacacgccccagaatggaagatagatgccgtaacagaagaagtaagtgaagtagcccaatccgagccatctggcggagccgattgccatattccctccagcaagtgtgctgcctggcagcatgagtgggcgctactctggcagagcgccgcaggacaggcaataaaaaaggatggctgatgccatcctttgtatgctgtctcacaacaggttaacgattaagcgtagaccggcagacggctgcagatttccagcactttctttttggtgcgctcaatggtcgcttcgtcattgacgttatccagtacatccgcgatccagccagccagctcacgcacgtccgcttcgttgaagccacgacgggtaacagctggtgtaccgatacggataccggaagtcacaaacgggcttttcggatcgttaggcacgctgtttttgttaaccgtgatgttggcacggcccagcgccgcatccgcttctttaccagtcaggtttttgctcaccagatcgatcaggaacagatggttatacgtgccgccagaaacgatgtcatagccacgctcaatcagcacctcaaccatcgctttggcgttttttgccacctgctgctggtaggttttgaattccggctccatcgcctctttgaacgcaaccgctttaccagcgataacgtgcatcagaggaccgccctgaccgccagggaagacagcagagttcagtttcttatagaaatcttcgtcgccgtttttcgccagaatgataccaccgcgcggacccgccagcgttttgtgagtggtagaggtcacgatgtgcgcatgcgggatcggactcgggtaaacgtctgcagcaatcaggccggcaacgtgtgccatgtccacaaacagccatgcacctacgctatccgcgatttcgcgcattttcgcccagtcgcaaacgccggagtaagctgagaatccgccaacgatcatttttggcttgtgggttttcgccagttcagccagttcgtcgtagtcaattttaccggtctcatcgataccgtaagccacaacgttatagagtttgcccgacaggttaaccggtgagccgtgagtcaggtgcccaccgtgcgccaggttcatccccagaatagtatcgcccggctgcagcagcgcggtgtaaaccgcaaagttagcctgtgaacctgagtgtggctgcacgttagcgtaatcggcaccaaacagtttttttgcacgatcgatcgccagctgctcaacgatatcaacgtactcacagccgccgtagtagcgtttgcccggatagccttcagcgtatttattggtgagctgagaaccttgtgcctgcataacacgcgggctggtgtagttttcagaagcaatcagttcaatgtgctcttcctgacgcactgtctcctgctccatcgcctgccacaactcggcatcgtaatcggcaatgttcatatcacgctttaacatccggatctcctgactcagctaactttctgacggtatttaccccccttcaggggcgaaggcccacagtgtaaaccgttttaacaggtgaaggtagggtgaacctcctctttttacgcaaacgattggctggctactggcagggcttttttacaccttttcaccctgttcagacgccacgatttttcttcaggatgtgacggcggcttctcaggatgcaccaaaaagttgccactttgacaaccgggaaatttatcgggttatttacaccacaggcgagacggctataagatgcatttaaaatacatctttaaatgagaggccgtttttatgcttgatgcacacactatcgccacggttaaatcgaccctgcctgccatcgccgcctgtggtcctgcgcttaccgcacacttctatgaccgcatgctgtcgcaccatccggaactcaaaaatgttttcaatatgaacaaccagcgcaatggcgatcagcgtgaagcgctgttcaacgccatttgcgcctatggcgcgaatctggagaaacctggccgtgctgctgcccgcagtggaaaagattgcgcagaaacataccagcctgaatattcagcctgcgcaatacgccattgtcggtgaaaatctgctggcaaccattaaagagctgctgaatccgggtgaagaggcgctggcagcctggggccgggcctatggcgtactggcggatgtgttcattaatcgcgaagaggagatttatcaggcgacggagcagcaaaccggtggctggcgcggcactcgtgcgtttcgcatcagtgctattgagcagcagagcgaggtgattaaaagctttaccttcagtccggcagatggcggcccggtagcggcctttaaaccgggtcagtatctgacggtgcatctgcagcccgtcagtttcgaacatcaccagattcgtcagtactcgcttactcacctcagtaatggcaaagattatcggattgcggtgaaacgtgaagcgcagggcaccgtctccggctggctgcatcagaatggcaaagtgggtgatgagctgatgctggccgcaccgcatggcgacttcttccttgaggtcgatgctgcaaccccggtcgcgctgatttccgcgggcgtgggtcagacgccgatgctggccatgctgcatgccctggcggcccgtcagcaccgcgcgccggtcagctggctgcacgcagccgagaacggcaatcagcatgcatttggcccggaagtgatagccacgggcgcgcagctcaccgatttcgtcagtcaggtctggtatcgcgatcccgccgctgaagatgctggtcgctatgacgcacagggtctgatggatatcaccgcgatctccgcacgtctcgcctcacccgacacccacttctacctctgcggtccgctgccctttatgcagcatgtggtggcgcaactgcgcgatgccagcgtggcagacacacgcattcattacgaactctttggcccgcacaaagggatgtaattgagcaataaaaaaagcccgcagcgcgggcttttttatgctgataaagagacaatcagatcgcctcttcatcctcttcgccagtacggatgcgcaccacgcgcgccacgtcgaagacaaagattttaccgtcaccgattttgccggtctgcgcagtacgcataatggtctcgacgcaggtatcaacgatatcgtcgcccaccaccatctcgattttcactttaggcaaaaagtcgaccatatactctgcgccgcggtaaagctcggtgtgccctttctggcggccaaaacccttcacttcactcacggtcatcccggtgatgccgacttccgctaaggcttcacggacatcatcgagtttgaatggtttgataatcgcatcaatctttttcatgtcagaccctttttcactccctccatggtcagagggtttatcaagtataaatgttgctggcgctgtcgggcggtaatatccgggattcttcaggttgccgcaagcgctgccagattatgctgaccgcacccattctgattcgggcctgagcaggcaacctgccggtatcactccgcagcctccgctactctttgaaatcactggcatccagctcatgacgagacagcagcttatagaactccgtgcggttgcgtccagccagacgtgcggcattggtcacattgcctttggtcatctgcaacagcttacgcagatagttcagctcaaactgattgcgcgcctcagcaaaggtcggcaaagcgctgttctcaccgcttaacgcctgctccaccagcgcatcgctgatgaccggcgatgaactcagcgccacacactgctcaatcacgttaaccagctgacgcacattgcccggccagctggccgccatcaaccgcttcatcgcatcaacggaaaaactgcggatctgcggtttatgccgttccgccgcctgacgcaacagatgattagccagcagcggaatatcttcagtgcgctgatgcagcgccggaatcttcaggttcaccacattaagacgatagaagagatcctcgcgaaactcctttttctccatcgccttcggcagatcgcgatgcgtggctgaaataatgcgcacgtcaatctcaatatcatgatcgctgcccagcggcctgaccttacgctcctgcaacacccgcagcaacttaacctgtagcggttgcggcatatcgccaatctcatccaggaaacagcgtgccgccacctgcggttttaaacagaccgtcacgggcactgactgcgccggtaaaggcccctttggcatgcccgaacagctctgactccagtaactgctccggcagtgcgccgcagttaatggcgacaaagggcttgccgtttcgcgggctggcggcgtgaatcgcctgtgccagcatctctttaccagtaccgctctgcccgttaatcagcacgctgacgtccgactgcgccaccatgtgcgcctgctccagcagccgcaacatcagcgggctgcgggtgacgatcgcttcccgccagcggtcatcgctgaccggcgcctgctgagccagtgcttcatcgatcgctttgtaaagcgcatctttatccaccggtttagtcaggaagctgaagacgccctgctgcgtggcggaaactgcgtccgggatagaaccgtgcgccgtcaggataatcactggcagaccggtgtggcgtttctggatctcgccaaacagcgcaagaccatccatctcatccatccgcagatcgctgatcaccagctcgattttttctttctgcagcagacgcaacgcttcgggtccgctggccgcggtggtgacctgataaccttcgctgcgaagacgcatgcccagcagcttcagcaggctgggatcgtcatccaccagcagcagttttgccgcttgtctgaccattattgctcctcatcctgcggcagcgcagtgccatggccgctgtcagaaacatccggggctttccgcgatgaaagctggcgctcaatatcagtaagtcgctccagcttatgctgcgtgtcgctgagctgctgctgctgtttaaccatctgctggcgtatcgcctccagttgggtatcgctgctctgttgcagatgaacataacgggtgcgcgcttcactcaggtcgagctgcgcggcctgattactgcgccacaactggagcagcggacgcacagactgcgggaaatcgctgctgtagcgatcaagggtttcaacataacgacgacgctccactggcgtcacgttgccgttcgacatcagcacgccctgcttgaaagcgcgcgaccagctctcaaccggccagcggtgggcttcggctcgggcctcggcgggggaaaggcgttcagcgcaatcgatggctcgcatccagtagagaggattactcagtgccgcactattctctatcgtccacaggtcattgcagcgggtcgccaggtaatcagccacgctgacctcgggttccgctacctgatggcctgacggcagggatgaggtggccggggaggtcgtacatccgctgagcagcagcgtggtcagtgtgctcaacagcaaagcgggtaaatatttcatcagtcagactttcccggctgtggtgttcagttcaattcgaaaacagacgtcagcctgctcgcaggagaccagcgtcaggtcgccatgcatccggcgcaggcaatctttggcaatactcaatcccagcccgctgccttttaccggccctttgcgctgctggctaccctggaaaaaaggttcgaaaatcattgcctgctcttccagcgggatcggcgtgccgctgttcgcgacatcaatccagacccgctcgccctgctgctgactgcgcagccagatggtaccggattcgctgccgtagttcacggcgttcgaatagagattatcgatgacccgcatcagtaacatcggttcggcaaggcagtgactgacctccagatcgacaaccgtctgcatgagtttggcacgcgccgagagtgcatgtgcattcacgaccccctccacaatttccgccacgctgaccggttccagctggatcgggccatctgccagtttacggttgtaatcaagcagctgttcaatcagccgctgtagatgacggctgctgccgtcgaggatagtgaccacctctttttgatcggcgttcagcgacccggctacctcgtccgccagcagtttcggtgccttcacgcaggctggccagcggcgttttcagttcgtgagaaagatggcgcaggaattcatggcgctgcgattccagccactgaagccgttcgctgagccagacgatgcgctgtcccagcgagcgtaactcgcgcgggccgcgaaatgtcacgctgttacccagttcccggccttcgccaagccggttgatcatccgctcaatacgcttgaccggcccgataatcatgccggtaaacagcgtcatcaacgccagactgatgataaacagaatcagcgcctgccagccaaaaaactggccgcgatcggcaatttcgcgctgcagctgaaggccgcgtgaaaacaccacttcgcgcgtgtcctgcaccatttgcgcattggtggcagaaaaacgatccagctcctctgcggcaggtgtaaccggattgccgttttcgcactttaacggtgtcagcagcggcaacgtcgcctgtaaagtctggaatgcgggcagctcgggcaggctggcgctgtgcgaactcagcatctggctgtagcgggtgtgctgggtctgataaaggcgcgccagcgaggcatcatccagcacgcagtactggcgatagctgcgctccagctcaaccgccgtgcgcgccatcgcctcacttctgcgaacgtcggtgaaggtattgcggttggtatccgctgcctgttcgcttaacgcagagagactttcccacgcctgccaggccagcaccagcaacggcagcagcaccagtacaaacgccatcagcaccagctgacgcagagaacggggaaataaacgccattttttcacgcagccgcttccttaagatttgctgtctggatgctaacggactctgtcagcggaagaaaggtgtcgtcggaagaaaggggaacaaaagaaaacggcaggctcaatggcctgccgctggcacgacgcgtgatgcatcgcgtaaaaatgggtggagccttactcaacgttacgtccggtgtttgataacgcaagcgattatcggtcagttggacggcaggctccgtttggtgcgtcattcggactttatgagctcttctccgctaagcggggcaatcataaacaggtgaatgagcagctgcatgagtatagcaagttccatgccaggaaataaatcattatatttttcagcagattgaataagcttaccggacaactgttgcgcaaaatctgattacagtaagtgaaaactgtctccgctgagcgacatgaaatcgcgccggacaggcgcccattaaaaatcaacgagatagatgtcgccaaaaagagacagtacgacatgctcattgtcgccatttgccaacagagccacaaaaaagagcaggaggcacactggcctcctgctcttttcagcggattaaattaacccagctgtctgcgcgcattgcggaaaatacgcatccacgggctgtcttcgccccactctgccggatgccaggagttgctgacggtgcggaatacccgctccggatgcggcatcatgatagtgacgcgaccactttcattagtcacggcagtgatgccgtttggtgagccattcgggttagccggataggtttctgtcaccttgccgaagttatcgacaaagcgcagtgccaccagccctttcgactccagcgccgccagatgcgtagcatcacgcacttcaacaaagccttcaccgtgcgaaacggcgataggcatatgcgaaaccggccatgccgtccagcaacagcgagggactggcggccacttctaccagactgaaacgcgcttcaaagcgctcagactggttacgcacaaagcgcggccagagatcgctgcctgggatcagttcacgcagattagacatcatctggcagccgttgcagacgcccagcgccagggtttgcggacggtggaagaaggtttcgaactcgtcacgcacgcgcggattaaacagaatcgatttcgcccagccttcaccggcacccagcacatcgccgtaggagaagccgccacatgcgaccagcgcctggaactcttccagaccgcgacgtccggccagcagatcgctcatatgaacgtcaatggcggtgaagccagcccgatcaaaggcggcggccatctctacatgggagttcacgccctgctcacgcagcaccgccacccttggacgtgcgccagtggcgatcatcggggcagcaacatcttcctgcggattaaaggtcagattaacgttcaggccaggatcgctgtcgtttttcttcgcttcatgttcctgatcggcacacgccgggttgtcgcgcagacgctgcatctgccaggtggtttccgcccaccaggtacgcaacgtattgcggctttcactgtagaccgcgctgtcaccagaacggatcacaaagcgatcgcccggctgcgcgctgcccagcagatgcgtcgagtcggcaaggctgtgatccgccaggatctgctcaaccacggcgcgatcggcggcgttgatctgaatcaccgcgcccagctcctcggtaaacagggcggccagcgcatcgttacccagcgaggcgatgtcaacgtcgatgccgcagtgaccagcaaacgccatctcggccagcgtcaccagcagaccaccgtcggagcgatcgtggtaagccagcagtttctgctcagccaccagcgcctggatggcattgaagaagcctgccagctgagcggcatcgcgcacgtcggcaggtttgtcgccaagctgacgataaacctgtgacagcgccgttgcgcccagcgtattcgcgccgttgcccagatcgatcagcagcagcaggttatcctgatcggcctgcagctgtggcgtgacggtgcgacggacatcttcgacgcgggcaaaagcggtaatcaccagcgacagcggtgaggtcatttcgcgctgtttcgctgccttcctgccagcgtgttttcatcgacatcgaatctttaccgaccgggatggtgatccccagcgccgggcaaagctcctcgccgactgccttcaccgccgcatataaaccggcatcttcacccggatgaccggctgcggacatccagtttgcggaaagcttcacacgcttcagcgaaccaatatgggtagccgccaggttggtcagtgcttcaccgacggccagacgacccgacgccgcgaagtccagcagcgcaaccggtgaacgttcgcccagggcaaacgcttcgccgtgatagctgtcgaggctggcggtagtcactgcacagttggcaaccgggatctgccacggtcccaccatctggtcgcgcgcaaccatgccggtcacgctgcggtcaccgatggtgatcaggaaggttttttccgccacggcaggcagatgcagcacgcggtttaccgcatcgaccagcgtaatgccgtcacgctgcagggcagtgccctgcgtctgctgcgtcaccacatcccgcgtcatcttcggcgttttgcccagcaggacatcaagtggcatatcgatcggcttattaccgaaatgactatcttccaggctcaggtgcagctcttcggtggcttcaccaatgaccgcgaacggtgcgcgttcacgctggcaaattgcctcaaactgcgccagctgatcgggtgccactgccatcacataacgttcctgtgattcgttacaccagacctccagcggactcatgccaggctcatcactcaggatgtcacgcaggttaaaccggccgccacgaccaccatcgctgaccagctccggcatcgcattggagagaccgccagcgcccacgtcgtggataaacagaatcgggttctcatcgcccagttgccagcagcggtcgatcacttcctgacaacggcgctccatctccgggttatcacgctgtaccgaggcaaagtcgaggtcggcatcagactgacccgaggccatcgatgacgccgcgccgccgcccaggccgatgttcattgccggaccgcccagcaccaccagcttcgcgcctacggtgatttcacctttctgcacgtgatcggcacggatattcccgatgccgcccgccagcataatcggcttatggtagccacggagctcagtgccgttgtggctggtgacctgctcttcataagtacggaagtaaccattcagagccggacgaccaaattcattgttaaatgcagcaccgcccagcgggccatcggtcatgatttccagcgcgctgacgatgcgggccggtttgccgaagtcctcttcccacggctgttcaaagccagggatacgcaggttcgatacggagaaaccgacgaggcccgcttttggctttgaaccccttccggttgcgccttcatcacggatctcaccaccggaaccggtcgcagcaccaggccacggcgagatggccgttgggtggttatgggtttccaccttcatcaggatgtgtgcggcttcctgatgccagcggtattcgctctctccggcgtcagcaaagaagcggccaacctctgagccttccatcacagcggcgttatctttgtaagcagagagcacgtagtccggcgtctgctccatggtgtttttgatcatcttaaacagcgactttggctgtttctcgccgtcgataatccagtcggcgttgaagatcttgtgacgacagtgctcagagtttcgcctgcgcaaacatatagagttcaatgtcgttgggattgcggcccaatgcggtaaacgccgccaccagatagtcgatttcatcgtcagccagcgccagacccagtgagatattcgcctgaaccagcgcctgacggccctcccccagcagatcgacacttttcaccggctgtggcgtgtgatgcgcgaacagctgttcagcctgcgccagatcgccgaagaccgtttccatcatccgatcgtgcagcagtgtgcccagcgtttgccactgcgcttccgtcagttgtggggcctgtacataaaaggccaggccgcgctccaggcgacggacctgcggcagaccgcagttgtgggcaatgtcagtggctttggatgaccagggcgaaatggtgccgggacgaggcgtcaccagcagcagacgcccctgtggggcatgttcagcgagagagggaccatatttcagcaggcgctgcagacggctctgttcgtcagcgcttaagggcgtgctgacatcagcaaaatggatgtactcagcgtaaatatcactcaccggcagatgagcgtcctgaaagcgggtcagcagtttgtttacacgaaatgccgacagggcgggcgaaccacgcagaatttccattaataaatctctcgtcagggcgccgggcgacgcttcattgggcgcaacagggaaaacggggcgtattatagagaaagcgacctcgcgacgaaaccgtttgcgcacaatttttggcgacccggatttgcctgaattttgcgcaaaagctgctataaaagttgctcagcgtgattttgttgcgcaaaatgcccctcgctctgggagttcaaagaagacaaatactgcctttaaaagacagaggccttagagccagcgagagataactatttgaaacgcctaaaatttaattatctgtttatcggtctggttgccgtgctgttagcgttagcgctatggccatccattccctggtatgggggtgggcaggaccagatttcacagattaaatcacggggagtactgcgtgtcagtaccatcaattccccgttgacttactacacagtgaaccaatctccggccggtatggattatgagctggcaaaacgcttcgccgattatctgggcgtcaaactcaaggtgacagtacgtcccaacctgagcgatctgtttgacgatttagatgatggcaaagccgatttgctggccgcgggtctgaactacaacagcgaacgcctgacccgctatcagaccgggccaggctactacaacgtttcgcagcagctggtctatcgcgttgataagccgcgccctaaaaacctcggtgacttaaaggggcggctgactgttgcgtctggatcggcgtatctgtcaacgctgaagagcgcgcggtcaaatcagtaccccgatctggactgggcgatctccaccgatcaaagtcctaaagccctgctggaagcggtggcagacggcaagctcgactatacgattggcgactccgtgaccatcgctctgctgcagcgcatctatccgcagctggcggtggcgtttgacgtcactgatgaagagccggtcacctggtatgtgcggcacagcgatgacgacagcctgaatgccgcgatgctcgacttctttaacggtatgggtgaagaaggggcgatggcgcgactggaggagaaatatctcggccacgtcggcacctttgattatgtcgatacccgcactttcctgcgcgccatcgacaacacgctgcctgacatcaaaccgctgtttgagaagtacgccaccagcattgactggcgactgctggcggcaatctcctatcaggagtcgcactggaacccgcaggccacctcccctaccggcgtgcgcggcatgatgatgctgacccgtaacaccgctgagagcctggatgtgggcgaccggacggatcccgaacagagcattcgcggcggcagtcagtatctgcaggatatgatggcgaaggtgccgcagaccatcccggaagatgagcgcatctggtttgcgctggcggcctataacatgggctatgcccatatgctggatgtccgtaaactcactgcccgccaggggggtaatccggatagctgggcggatgtgaagctgcgtctgcccatgctgagccagaagcgttactacacccagacggcttatggctatgcccgtgggcatgaagcctataactatgtggagaacatccgcaaatatcagttaagcctggtgggttatctgcaggagcaggaaaagcgcctggcgcagcaggctgaagcacaagaagcacaggccgaactggccaaaggctatccggcggtcgaaccgaagatcgccatgaactaatcctggcgttgcgcctgccgcagcgcttttttctgctcgcgacgcatacggaagaagtcgctcagcatagcggcacactcttcagccagcacgccgctctgtaattcaacctgatgattcatgccggggtgtcccagcacatcgagcagcgatcctgccgccccacttttgatgtcgtgcgcaccgtagaccagccggctgatgcggctgtgaaccatagcgccggcgcacatcacgcacggctccagcgtcacgtagagcgtggtgtccagcagacgataattttccagtactttaccgccctgccgcaacgccataatctccgcatgcgccgtcggatcgtgctggccgatgggccggttccagccttcaccgatcacccggtcattctgaaccagcaccgcacccaccggcacttcgccctgctcccacgcccggcgcgccaggtcaagcgcatggcgcatccagtattcatcttgttgtttcatgctgaccactccgggcgacagaaaagcggcgcattatagcggtctcaccgatcctttagaaacttattccagctgttgcagctcacctgcgggtgttacgcgccagcgatgttgacagaaaaacagcagcgggttgtcctgtttgctgtcgctatagccgctgtagagctgtagcggcgtgccgattttctcttccagctgtgccactttctcatggccgaggcagcgcattgccagtacccggccgccccagccgcgctgcatctgactggcaatcaacttcacgcgtggcagaaacgcggagtcgtaatagacctgctccaccagagactgtggcgatccggtgatgagccagacgtcagcatcatcactgccgagataatcggtcaggcgctgctgaaccaccggaaaggctttaacgcgcaggcggaaccactgcgcaaattcggcttcgagttgcagcagcgtccgctcagaacgaccaaaagtaatagaccagagcagcaggctcatgggccagcgtgccgcccggcctttaaacaacaagccgatacccactaccggcaacaacggcaccaccagcagcagattaagcgggcggcgacgcagcagatagcgcataaaagtgccgaacatgtcctgctggtgcaaagtgccatccaggtcaaaaaatacgacgcgacgttgtgttcccctggtcaaacaactctccttcaggctgattctggaatgataaagagtagtgtagccatcatcaggcgctacggcgatgactgtcatttttaattccgatgactacaatgcctgatgaatagtttattcttcacagattatccctgaattacgaggattgggcatgagttcattgctgcgcattcgccagctttatccacgtctggcattgaacgagcgtcggctggctgattttttactgtcgcaacccgatcgggcgcgccacctgagttcgcaaaagctggcggaagagtctggcgtcagccagtcgagcgtggtgaagtttgctcagaaactgggatacaaaggttttccggcgcttaagctggccctgagtgagtcactggcggacaaagatgccattaccgtacataaccatatcctcagcgacgatccccttaaaatggtgggtgagaagctgctgacggagaaactctcggcgatccgcgccacgctggatatcaacagcgaagagaagctcaacgatgtgttacagctgctgaaaaatgcccggcgtattttactggtaggcattggcgcttcgggtctggtggcgaaggacttctcctggaagctgatgaagatcggcattaatgcggtggcagagcaggatatgcacgccctgctggccagcgtgcaggcgatggggccaggcgatgtgctgctcgccatctcttacaccggtgaacggcgggagatcaatctggccgcgcaggaggcggttcaggtaggcgcagatgtggtggcctttaccggctttacgccgaatacgctgcagcagagcgccagttactgtctctatacggtggcggaggagcagagtacccgcagcgcggccatctcctcgaccacggcgcagctggccctgaccgatctgctgtttatggcgctggtgcaaaacgatccggaacgcgcgtccagtcatattcgccacagcgaagcgctggtgaaaaagctggtctgatcagcggcagcgcgtataatacccgcgctttttctgttgttatcaggtgggtaaaatggcgctgttgattacgtccagatgcattaactgcgatatgtgtgaaccggagtgcccgaaccaggccatttcactgggcgatgcgatctatgagattgatgtcagccgctgcacggaatgcgtcgggcactatgagacgccaacctgtcagcaggtatgccccatcgacaacaccatcatcattgacccacagcacaccgaatcacgcgatgcgctgtgggagaagttcgtgctgctgcacggctagctttcaatgatcaccgtggcgcaggcgtagtgacgctcatcggccagcgtcacgtgaacgtgtttaacgcccagcctctccgccacttcagcggcatgctgaaagaagcgtaatcccggttttcccagcgcatcgttgtaaacttcaaactgattaaacgccagaccaccgcgaatcccggtgccaaaggcttttgccgccgcctcttttaccgcaaagcgtttagagagaaagcgcaccggctgcttgtgcgcctgatactgttgccattcggcttcgctcagcacccgccgcgccagccggtcgccggagcgctctatcaccccggcgatacgttcaatctcaacgatgtccgtacccagtcccagaatagccatcagcgacgggcttcacgcagcagctgcttcatctctttcaccgcatccggcaggccactcatcaccgcacgaccaataatcgcatggccgatattcagctcatgcatttccggcagcgccgcaatcggcagcacgttgtgataggtcagaccgtgaccggcattgaccttcagtcccaggctggcggcaaaggtcgcggcgtggcggatacgcgccagctcagcgtcacgcgccagtccctctggtgcttcggcgtaagcgccggtatggatttcgatgtaaggcgcgccgctggccacggccgcttcaatctgacggtgatcggcatcgataaacagcgaaaccagaatgcccgcgtcactcagcagtcgtacggccgcgttcatcttctcctgctgccccgccacatccagcccgccttcagtggtcacttcctgacgcttttccggcaccaggcagcagaagtggggctggatatcacaggcgatgccgatcatctcatcggtgaccgccatctccagattcatacgcgtctggatggtgtcacgcaggatacgcacgtcgcggtcagtgatgtgacggcgatcttcgcgcaggtgcacggtaatgccgtctgcgcccgcctgctcggcgataaacgctgcctgcaccggatcgggatagtttgtcccacgggcgttacgcaccgtagcaatgtgatcgatattgacgcctaacagcaactcagccatgaccatcctcacttctttttcatcgtgatgttgagtgtaccgcgcaaagtgaaacaggcggtacgacccgcgctattcttctgcctgttcaggctttttcttcgggataaactggcggaacagctcctgactcttcagcggcttgccaccaagatagggcttcagggcgatgcgggtaaaccgcttcgcggcgcgcagagtgtcggcatcgggaaactctcgctcgcacagggcgcgcaattcgcggccggtaaagctgcgctgattgaccaccaggctggcaataaagccgcgctcttcgcggtagctgtacgtcatgttgtcgctgaccggctcgccgctgccggcgcagtgaaggaaatcgacgccataacccaggtgaccgagcagcgccagttcaaaacgccgcagtgccggtttcgggcttgccgtgcgttgaggctaatgcctgaaggcagttgagatagtcgaagaagagttctgagaaggggaattcctgctgcaatacgcgagagaccagctcattaacgtagagaccgcagtagagcgtgatgccgctgagcggtaaggccagcgacaccgcttcggcattgcgcagagttttgacttccccgcgcccgctccagcgaaccagcagcggggtaaaaggctgtaacgcccccttcagctgcgagcgccgcgaacgtgcgcccttggccagaacccgcacccgcccttcactttcgctgaacaggtcgagcagcagactggtttcgctgaaggggcgactatgcagcacaaaggcgcgttgccagccttccattgaatcagagatcgtctgtataacccaggctgcgcagcgcacgttcgtcatctgcccagccggatttcactttcacccacagttcgagatgcactttcgcttcgaacatctcttccatgtctctgcgcgcttctgtgccgatgactttgattttggcgcctttgttgccaatcaccatcttcttctgcccttcgcgctcaaccagaatcagaccgtgaatgtcgtaaccgccacgttcgttagtcacgaagcgctcgatctcaaccgtaacggagtaaggcagttcagcacccaggaagcgcatcagtttttcacggatcatctctgacgccatgaaacgctgtgagcggtcggtgatgtaatcttccgggaagtgatgatcggcctgcggcagatgcttgcgggtaatcgccgcaatggtatcgacgtttttgccgctctcagcagaaataggtacgatatcgaggaagttcatctgctggctcaggaactgcagatgcggcagcagaatgcttttgtcctggatgttatcgaccttattgatcgccagcaccaccggcactttattgtcgcgcagtttgcccaacaccatctcatcatcgggcgtccagcgggtgccttcaaccacgaagatcaccagttctacgtcgccaatggaactgctggctgcgcggttcatcagacggttaatagcgcgcttctcttccatgtgcagacccggggtatcgacgtagatcgcctgatattcgccttcggtatgaatgcccatgatgcggtggcgcgtggtttgcggcttacgcgaggtgatcgacaccttctgccccagcaactggttcagtaaggtggatttaccgacgtttggtcggccaacaatcgcgacaaagccgcaataagtaacgttttcgctcattcgagtcctgaattgttcagcgcctgatgcggcgccgaaagagtgctatttgagtcatgtgtcattcagcgtcttctgacgccgggatagagtgtcaggttaatggtcagtgccggttccggcactgtcaccccgacagatctattcaagacctaattttatcagtgcctgttcagccgctgcctgctcagctttacgacggctggagccgacgccgacaaccggctcggccatgccactcacctgacagtgaatggtgaattcctgatcgtgggcttcgccacgtacctgtactaccagataacttggcagcggcagatgacgtccctgcagatactcctgcaggcgcgttttcggatctttttgtttgtcgccaggactgatttcgtcgaggcgggtctgataccagtcgaggatcagctgctctacccgctcaatactgctgtcgaggaagataccgccaatcagcgcttccaccgtatccgccaggatcgattcacgacggaaaccgccgcttttcagctcaccgggtcccaggcgcaggcactcgccaagatcaaattcgcgagccatttcagccagcgtgttgccccgcaccagcgtggcgcgcatgcggctcatgtcaccttcatcaacccgcgggaagcggtgataaagggcattagcaatcacatagctaagaatagaatcgccaagaaattccaggcgttcgttgtgcttactgctggcgctgcggtgagtcagggcctgctgtaacagttccgaatgagtaaaagtgtagcccagtttgcgctgaagcttgttaatcaggatggggttcatgcgattccagttctttgttgcgtctgtgactctgcataccaaacggggctggtaatccaacacgttccgtttggtgtgcagtggcctccctgaggaggccacccgatttgcctgttaatcagacaataatgttagtggataccaccgatgcgactgaatcgcacgccggttggccactggccttcttgtttctcaaagctcatccagattgcgaccgctttaccgaccagattacgctccgggacaaagccccagtagcggctgtcggcgctgttatcacggttatcgcccatcatgaagtattgccctttcggcacgacccagctcgcctgcggctgacccggctgctgataatacatgcctgcctgactctgcgcttcgtttaccagcagaatgtcatgcgtcacgttaccgattgtctctttgcgggttcccaggcgcaaaccaccgcgcagggtatcgccctgcggcacctgataaaaaccgttgccggtttcgttgccatcaaagccgctaaaggtctgaacaaagttgcttggctcaacgtcggtgtaagttaccgctaacgctgtgtcacaggctttatcatcggagcaggtcggtttcaccgtcagcgttttgctgtaaggatcataaatgactttgtcgcccggcaggccgatcacgcgcttaatgtaatccaggctcggatctttcgggtatttaaataccgcgatatcgccgcgcttcggctgaccggttgggatcagcgtcgtctgggtgatcggatccttgatgccgtaagcaaacttctccaccaggataaagtcaccaatcagcagtgtcggcatcatcgagccagagggaatctggaatggttcgtagataaacgaacgcacgatgaaaaccacggccagcaccgggaacacagatgcggtcgtttcaacccagcctggctttgcagcgaccttcgccagcgttttgctgtcgagcgcgttaccggtctgggcctgagcctcagcctgtttcgcgcgacgcgcgggtgcccatttaaaacgatcaattacccatacgatgccagtaatcagcgtcgctatcgccagaatcagggcgaacatattagccattggaaatccttatttgctgtccttaccgacatgcagaatggcgaggaacgcttcctgtggcagctcaacgttaccaacctgcttcattcgcttcttaccatctttctgcttctgcaacagtttcttcttacggctgacgtcaccgccataacacttggcgagaacgtttttacgcagctgtttcaccgttgaacgcgcgataatgtggttgccgatggcagcctgaatcgcaatatcaaactgctgacgcgggatgagctctttcattttctcaaccagatcgcgtccgcgataaggcgcgttgtcacggtgggtaatcagcgccagcgcatccacacgctcagagttaatcagtacgtcgacgcgtaccatgtctgaaggctggaaacgtttaaagttgtaatccagcgaggcataaccgcgcgaggttgatttcagacggtcaaagaagtcgagtaccacttcagccatcggaatttcgtaagtcagtgccacctgattgccgtggtaaaccatgttggtctgcacgccacgcttctcaatacagagcgtgatgacgttgcccagatactcttgcggcagcagcatgtgacattcggcaatcggttcacgcagctcttcgatattgttcagtgccggcagcttggatgggctgtcgacatgaacgatttcgccgctggtggtcacgacttcatacaccaccgtcggtgcggtagtgatcagatcgagatcgtattcgcgctccagacgctcctggatgatctccatgtgcagcagaccgaggaagccgcagcggaaaccaaagcccagcgccgttgagctttctggctcatagaacagcgaggcgtcgttcaggctcagcttaccgagcgcatcacggaacgcttcatagtcgtcagagctgatagggaacagaccggcgtaaacctgtggcttcacttttttaaagcctggcagcgctttgtcagccgggttacgtgcggtagtcagcgtatcgcccacgggtgcgccgaggatatctttaatggcgcagaccagccagcctacttcaccgcagttcagctcattacgatcaacccgtttcggggtgaagatacccaggcggtcagcgttataaacctggccggtgctcaggactttgatcttgtcgcctttgcgcatggtgccgtttttcacgcgcaccagggaaacaacacccagataattatcgaaccaggagtcgataatcagtgcctgcagcggcgcttccggatcgccttctggcggcggaatgtcgcgcactaagcgttccagcacttccggaacgccgacgccggttttggctgagcagcgcaccgcgtcagttgcatcaatgccgacgatatcttcaatttcctgcgcggcgcgatcgggatcggcagcgggcaggtcaattttgttcagaaccggcaccacttccagatccatctccatcgcggtgtagcagttcgccagtgtctgcgcttcaacaccctgaccggcatccaccaccagcagcgcgccttcgcaggcggccagtgagcgggaaacttcataagagaagtctacgtggcctggggtatcgatgaaattgagctggtaagtttggccgtctttcgcgtggtaatcgagtgtgacgctctgtgctttgatagtgatgccacgctcgcgctccagatccatagagtcaagaacctgcgcagccatttcacgagcggtgaggccgccgcaaatctgaatcaggcggtcagagagcgtagatttgccatggtcgatatgagcgatgatggagaaatttcttatgtgcttcatttattgggatatcttcgcttaaaattcagttgaaaacctgagcacagacacattcaggaagatcgctctttacccacaatcctgtcagcctcattaatgacgacgcatattacactgttaacgccgcgcataaaagaatggaacgtggtggaagcgaaacagatatctgcgcgaggcagaacagacaaaggccgcgggatgcgcggcctggacgtgcgttacgcttcgctttcaacacgcagcgcatcgggaggcaaggcgatgttcagaatgaccggctgaaaggcttctcgatcgccgaatttcattgaaacgcctttggcgacaataaaacccccgataccgcccagcagcgcaccgcaggcggcggccagatcgctgctgaacagcgcctgaaacagcccggaaaccaggaacaggccaaacagcggcgtcatgtagaccagcagcgctgaacccagcaggctgctctctttgataccgagttcgatccgctgccccggctgcagcggcttgctgctggcgatttgcatcacgtgggcattcttcggaccgagcttattcagcatatggctgccacagcctttacgcgcctggcagctgttgcaggaggtttttgcttcggtgtgcagcgtggcgatgccatcctgccatgccaccacggtggcccattctctcatcatttttgtgaccccaggtcgatgctgtccgcaatacgttttgcggtagagggcggtaattcgccgatcaccgctatttcgttattattgcgcacaacggtctggaccgtacgacgcccagtgcgcaatgtctgcgttgtgctggttttatcgcccggcgtcacgttgatcgcgaaactaaacaggccatcgctgtagagcttcgattccatatttttattcagcccgggtagcgtgcggcgattctgcgacaccagcgacataccggcaggtatccagccaggctgccaggtgagcgtgaccgcatcccctttcggcaccgaaagcgacggaggcagattggctttctccagcccctgcatcagattacgcaccccttcgtccaccgcaaagctgatgacgcggaactgctccagcgtttcgccatcacgatcgagcaggtcgatgcgcagcggcagcttggtgtccacatccagccagaccacatagctgtaacgggtgccatcgcgtgaaacgatgcgcaacacatcacacatctgatcggcaatgcgcgagcggcctacggtaataaaatcataggctgtggcgagcttggtgaagtcagcaaaaatcaccgacggcaaagcatcgataatgtgattgccggggagtgaaaagggatcgaggccgggttcgaagtaactgatatcgttgccgcgctggatcacttcccgacgtggcccgtccatctgcaacagctgcgcgaatatccggttatcgattacagcatgacgataacgcagcgattcgatgccgatgcgggagacgttgatataggcgaattcgtagttgaggttctgacttgcctgctccatctgctgcaatagcgccccggacgcagaaggttgcgccggggcggcagatgaccacaacaggctgcctgtcagcaggctaacagcataccaaagcggcttcattactgctgttgctgtcctaatgattgatttccgggaacatcaacctgcgcctgttttggcgcagtggtttcaaactgcagctggtcagcgtgcaggcgacgttgcagtttcgtaatcctgcagcatggcatttacgcgacgacgctggtcctgaacctgctggttagaactgttggtgtcaaatgcatcagacggcacgcccaggctcaccggagacgctttgcccatcatcggcatcgtattgaacaccggagagtcagaggtctgcgtggcgctgccctctggctggttatagtgctgaacacctacgatcacggccagtgaaacacaggcagcgacaccgacctgggtcagttgcgcagcccacgggcgcgcttttttccagaacggcattttttcccagcgggaaggttctggctgagcttcagggatcagcgttgtaaccgtacgcaacggttctttttcgatggcagcagcgacgcgcgcagaaatatcaaaatgcaggacatcgcccacatcaccgcgcatggtatcgcgaatgagatgatagcttgcccagcttttctgtaattctgcgtccttagacaaggcggaaaacagctcgttatctaaggtctcaccatccattaaagcggaaagtttttctttctgcatgcctatgtacccttccagtagccgttatcactgacgttggataagcggttgaactttgttatcaatggcctctcgcgcacgaaagatacgtgatcgaacagtgcctaccgggcaatccataatgacggcgatctcttcataactcagaccgtccagtttccctgagggtgattgccatacgcaaatcctcgggtagcgcctcgatggtacgaaagacaatttgtttcaattcttctgacaacattaagttctcagggttcgaaatttcttttaatgcacccgcactttcgaaattttctgcgtcaatagcatccacatcgctggatggcggacgacgcccctgagcaaccaggtaatttttcgctgtatttaccgcaatgcggtacagccaggtataaaacgcgctatcgccccggaatgaatccagcgcgcgatacgctttaataaacgattcctgtactacatcaggtacgtcgcccgagggaacatagcgtgaaaccaggctcgccactttatgctggtaacgaatcaccagtaagttgaaagctttttgatctcccttctgtacgcgctcgacaaggacctggtccgtcaactgctcgctcatccgaggtaatgtctccccaaatttttcatacgcataaagtaactgccagcacatctcatggttctgagcaagcatgcgcttagagttgtgatgtggtgcgaagttcacttctcgccctgatatttaccgctccgatggacattacacaggttcttcgttttcgttcagtgtaaggagcgtaaatcgcaggcagagtaacctatgacaacagctttttcatcattaaatcctttaggtttaataagtttgctataaaaaaccgcgccaaaagcagtccggttttaactcactgatattaagtaactttgggaaatcatcagacaaaaacctgcgccagatgtttaaaatacttcacagcaacccccattgcgcttatgctcagccctattcttgtttagtaaattaaacattatgatgaatgcgaacccggattatcagtgtgatgtactcattgtgggcagcggtgctgctggcctgtcgctggcgttgcggctggcaaaacagtatcaggtgacagttctcagtaaagcgcaggtcaatgaggggtcaaccctttacgcccagggcggtattgctgcggtatttgatgagactgacagcatcgagtcgcacatcgaagatacgctgattgccggagcaggattatgcgaccgtgaagccgtctcgtttatcgccagtaatgcccggcattgcgtgcagtggctgatcgacaacggtgtcgcctttgatctcgatccgcaggcggccggcgacatgcgttatcacctgacgcgggaaggcggccacagtcatcgccgtatcctgcacagcgctgacgctaccggccatgcggttgaaacgacgctggtaagccaggcgttgagccatcccaacatccggattctggaacgcaccaacgcggtcgatctgattctttcagataaaatcggcctgccaggcccacgccgtgtagtaggcgcgtggatctggaaccgtaatcgcgaaacaggtggaaacctgtcgggcacgggccgtggtggttgcaaccggtggtgccgccaaggtctatcaatatacgactaatcccgacatcgcctccggtgacggcatcgcgatggcctggcgtgccggctgccgggttgccaatctggaatttaatcagttccacccgacctgcctgtttcatccgcaggcgcagaatttcctgttaaccgaagcgttacgcggagaaggtgcctggctgttgcgtcccgatggcagccgtttaatgcccgattttgatgagcgcgccgaactcgccccgcgcgatatcgtcgcccgggccatcgatcatgagatgaagcgactgggcgttgactgtatgtatctggatatcagccaccagcctgaggaatttgttcgcgcgcacttcccgatgatctatgagaagttgctgacctttggctttgacctcaccaaagaacccatcccgattgtgcctgccgcgcactatacctgtggcggcgtagtcgttgatcagcatggccagaccgacgtaagtggcctctatgccatcggtgaggtgagttataccggcctgcatggcgctaaccgcatggcatccaattcgctgctggagtgtctggtttatggctggtccgccgcagaggagctgattcgcaccctgcccgccatcgaagccgttactgcgctacccgcatgggatgaaagtcaggtcgatgacgccgatgagcgcgtggtgatccagcataactggcacgagctgcgattattcatgtgggattacatgggaatcgtccgcacgacccggcggctggagcgggcgctgcgtcgcatcaacctgcttcagcaggagatcgatgaatattatcgtcatttccgcctctccaataatctgctggagctacggaatctggtgcaggtcgctgacctgatggtgcgctgtgcgctggagcgaaaagagagtcgcggcctgcactatatccgcgactacccggatttactgcccgaggcgcggccaaccatcctgacgccgccggactacataaaaaggtagaactcccgcgtcaggctacaccactcatcagaatagcgggtgtccggcgtgcggatggcaaggcgctccagcagggtttcaccggcctgcggcgacagccccagcaggacacggtgtggcggacgatgggcatattccgccacgtccagccggaaacgcagatgccagccatccgcctgcgccagggcgatgaattcctggccggtcgcggtgggcagcaccacgcagaacatcccctcttcttcaatcagtaatgcagcactgcgcaacagtgtctgatgatcgagcgaggccgtggcacgggcgctgtcccgtgccgcagtcgaacaggccacacctggcgcaaaataaggcggattgctgacgattagcgagtaacgtttatcgcactgttcggcccagtcggcgatatcacgctgatgaatctgaatacgttcaggccacggcgactgctgcacattctcctgcgcctgaagcgcggcttgcggttctaactcaaccgcatcgatgttgaccagcgacggcgtacgctgcgccagcatcagcgcgataagcccgctgccgctgccaatatccagaatacgttttacttcggcaaccggcgcccaggccccaagcagaatggcatcggtgcccactttcatcgcacagcgatcgtgcgcgacaaaaaattgtttaaaggtaaaaccgttcttgtttaactgtggccgttcacgcggcttatcctgcatcattcgtcactaccatcgtttttttcctgccgtacggcagcgcatgagtgtaacgtgacgacagagggaattcacgcggcagacaaccccaggcgcagccgaaacggattaacagatgaagattcagtctgatctgtctataatcagcgccccaaactgaggtagaccatgacagtaaccacattttccgaactcgaactcgacgaaagcctgctacaagcgttgcaggaaaaaggctttacgcgcccaacagtgatccaggctgctgcaattccgcccgcgctggagggccgtgacgttctgggttcggcacctacagggaccgggaaaaccgccgcgtatctgttaccggcgttgcagcacctccttgattttccgcgtaagaaatctggcccgccacgcatcctgattgtgaccccgacccgcgaaactggcgatgcaggtcgccgatcatgcgcgtgagctggcgaaacatactcatctggacatcgccaccatcactggcggcgtggcttatatgaaccatgccgaagtgttcagcgaaaaccaggacatcgtggtcgccaccaccggccgtctgctgcagtacatcaaagaagagaactttgactgccgcgcagttgaaaccctggtgctggatgaagcggaccgcatgctcgatatgggctttgcccaggatatcgaaaccatcgcggctgaaacgcgctggcgcaagcaaaccctgctgttctccgccacgctggaaggcgacaatatccgtgacttcgccgagcgtctgctgaacgatccggttgagctggaagcggacccaagccgccgtgagcgcaaaaagatccagcagtggtactaccgcgctgacgatctgcagcacaaaaccaaattactgatccatctgctgaaacagccggatgtgacgcgcagcatcgtgttcgtgcgtaagcgtgaacgtctgcatgagctggtgagctggctgcacgaagcggggattcgtagcagctatcttgaaggcgaaatggtgcaggcaaagcgtaacgaagcgattaaacgtctgagtgaaggccgcgttaacgtgctggttgcgacggatatcgccgcgcgcggcattgacgttgaagatgtcagtcacgtcttcaactatgacatgacgcgcaccgctgatacctatctgcaccgcatcgggcgtaccggtcgtgcgggccgtaaaggcatcgccatctcactggttgaagcgcacgatttcgtgctgctgggcaaaatcacccgctatgtgaacgagccgatcaaagcgcgcgtgattgatgagctgcgtcctgagacgcgggcgccaagtgccaaaacgaccggcaaaccgtcgaaaaaggttctggcgaagcgtgcagagcagaaagccagtgaaacagaaaaaccgcgagtgaaaaaacgccatcgtgatgccaaaaatgtcggcaaacgccgcaaggcaagcggcagtacgccagctaacgagaatgcggaataaatcatcgcagctataaaaaaatcgcctcacaggaggcgattttttttatctgataatcagtaacagccctttcacaatcttttgtctgccagagcgctttcttcacgacactgtcatcagcgtgccaggcagttaactgtttatcttattcataatattaataaaaattgctgtgtgcgctttgcgctaattttcagcagccgctaactcaggctgctcaaagactttcagtaaaggtacgggtaatcacatcgcgctgctgctcaggtgtcagtgagttaaaacgcacggcatagcctgaaacgcggatggtcagctgcggatagttttcaggatgtttaactgcatcttccagcgtttcgcgacgcagaacgttgacgttcagatgctgtccaccttcaacacgtacctgaggtttgatttcaaccggcacttcgcggtaagcgaattcgcccagtttcgctgatggcgacaacctgatcttcttcgtagcccgcttttgcacacaggcaacgcgcttcggctttctcttcgtccagcagccagaaggagttcagtaattgtgaattgtttgattgagtgatctggataccagtgatcatgattgcgtctcccgggtaatacgtggataaatcaaatttgaggccccggtatatcacctttgatttcggacagctttgacctgtatcaatattaatcaggcattccgaccgcttttaagctaacccgttgatctcaatacccctgccacctaaacttaatttttattattcaaattatttttgccttcaggtcagcggcaggaaccgctaagcttatggcactaacgttaagggagttaaacatggctgaaaagctgacctggcacgacgtgctggctgaagagaaagagaaaccctattttatcgagacgctgaagcaggtcgccgatcaacgcgccgcaggtgtcacggtctatccgccgcagaaagatgtcttcaacgcctttcgcctgacggagctgggcgacgtcaacgtcgtgatactcggtcaggatccctatcacgggcctcatcaggcgcacggcctggccttctcggtactgcctggcgtccaggtgccgccctctctgcagaatatctataaagagctgatgcaggatattccaggctttcagaagcccaatcacggctttcttgagagctgggcaaaacagggcgtgatgttgctgaacaccgtgttgacggttgaggcgggcaaagcgcattcccatgcgcgatttggctgggagacctttacggataatgtgattgcggcgattaaccagcactgtcagggggtgatttttctgctgtggggttcacatgcgcagaagaaaggcagcattatcgatcgccagcgccatcacgtgttgcaggcaccgcatccctcgccgctctccgcgcaccgtggctttttcggctgcaaacacttttcaacaaccaatgagctgctgagcgctgccggtaaaaagccggtggactggacgccggttttaccggactaacgccagaaagcacacggccgcgtcagtgcgcggccgtgtaacgggattcaggcgttgaatcagcttttagctttggaaaccgcaaccatcgccgggcgcagcaggcgaccattcagcgtatagccacgctgcatgaccagcatgacatggtttggctcaaactcttcagactccatcatcgacatcgcctgatgcacttccgggttaaacggcacgccggtttcgccgaccacttcaacaccgaatttacgcacggcgcccagcaggcctttcagggtcagttcaatcccttcaatcatcgaggccagctgtggatcctctttgttcgccacttccagcgcacgtttccagactgtcgattaccggcagcagttcgttggcaaacttctccagcgcaaatttgtgcgccttctcaacatccatctcggcacgacgacgaatgttctcaatctctgcctgcgcacgcagctgggcatcgcgcacaccggtctgcgactgcgctaattcagcttcgagctgagcaatacgctcatcacgcggatccacctctgccgctgtctccgcttcctgaggttgctgctgatcctgctgaatttcgtctgagacttgctcgtttggggtgttctgttctttactactcatgaatttctccgcgttttgcacattcatttcgctggttggcttattatggggattggtatgacggattcaagggaacctatcacattgccttaccgttttggcttataaggaacaccgaccagatgaacaaacactttaactgcattggtattgtgggtcatccgcgccatcccaccgcgttaaccacgcatgagatgctctggcgctggctgacagccaaaggttatcaagtgatcgttgagaagcaaattgcgcaggagctgtcgcttcacgacgtgcagacgggcacgctggcggagattggtcagcaagccgatttagcggtcgtggtgggcggtgatggcaatatgctgggcgcagcgcgggtgctggcgcgctacgacattaaagtgattgggattaaccgcggtaatctcggctttctcaccgatcttgatccagacaatgcgcagcagcagctggatgaggtgctacagggcaactatttcgtcgaaagccgctttctgcttgaagcgcaggtgtgcaaatctgactgctcgccgcgcattggctccgctatcaacgaagtggtgctgcatcccggcaaagtcgcgcacatgatcgaatttgaagtctacatcgatgaagtgttcgccttctcccagcgatcagatgggctgattatctcgacacccaccggctcgaccgcctattcactctctgcgggcggcccgattctgacgccgtcacttgaagcgattgtgctggtgccgatgttcccgcatacgctgtcagcgcggccactggtcatcaacagcagcagtaccatccgtttgcgcttttcctcacgccgcagcgacctggaaatcagctgtgacagccagattgcgctgccgattcaggaaggcgaggatgtactgatacgacgcagcgccaaccacctgaacctgattcatcctaaaaactacagctatttcaatacgctgagttcaaaactgggctggtcaaaaaaattgttctgaaatgcggcatcacctctttactggataaaaaaccagtttatactgtatgaaaaaccatatgtgtttattcatacaggtgaacctatgctggcccaactgaccatcagtaatttcgctatcgttcgtgagctcgacattgattttcaacgcggcatgacagcaatcactggtgagaccggtgccggtaagtctatcgcgattgatgcgctgggattatgtctgggcggtcgtgctgatgccgacatggtgcgtcagggtgccagccgggccgacctctgcgcccgcttccagcttaagtcctccccttctgctcagcgctggctgatagataatcatctggacgatggcaacgaatgtctgctgcgccgggttatcagcgctgacggacgttcccgcggctttatcaatggcacggcggtgccgctctctcagctgcgcgatctcggccagttactgattcagatccacggccagcatgcccatcagcttctgctcaaaccagaccatcagaaacatctgctggatgcctatgccggtcacgacgagctgctgcagcaaatgcgcgccagctatcagacctggcatcagagctgccgcactctggcgctgcatcagcagcaggcacaggagcgcgaatcccgtcgcgagctgttgcagtatcagctaaaagagctgaacgacttcgctccgcagcagggtgaatatgagcagatcgacgaagagtacaagcgtctggccaacagcggacagctgctgtcgaccagccagcaggcactgcaactgttagcagacagcgatgacaataatctcaacagcctgctctacagcgcacgtgagatgatttcagaattgacctcactggatgagaagctgaatggcgttcacaacctgctggaagaggcggcgattcagctgagcgaagccagcgatgagctgcgccactactgcgacagcctcgatctggaccctaaccgcctgtacgaactggaacagcgtatttcgcgccagatcgccttagcccgtaagcatcacgttactcctgaagggctgcctgaactgcatcagcaactgctggcagaagcggaactgctgtctcagcatgagagcgatcaggagagcctgcaatcactggtgggtgaacactatcaggcagcgttgcaaagcgcagagcagctgcaccagcagcgcagccactatgccgatgagttgcagctgctgattacccagagtatgcatctgctctcaatgccgcatggccagtttaaaatcgcgctgacctttaatccggatcagctgaccgcagacggtgcgagccgcgttgatttccaggtgacgactaacccaggtcagccactgcagccgctgggcaaagttgcttcgggcggtgaactgtcacgtatcgccctggcgattcaggtcatcaccgcgaagaaaatggaaacgccagcgatgattttcgatgaagtggatgtcggcatcagcggcccgaccgccgccgtggtaggtaagctgttgcgtcagctgggcgaatcaacccaggtaatgtgcgtaacccacctgccgcaggttgccggttgtggtcatcagcatttttatgtcagcaaagagactgatggtgcgatgaccgagacccatatgcagccgctggacaagcgtgcacgtctgcaggaaactggcgcgactgctgggtggcagcgaggtcacacgtaacaccctggccaacgcaaaagaacttttagccgcatagcagcgcacttttttaaccggctggggtcataagcttgctctgtagaggtttccaatagcgaaaaggtttattatcatcggcacttatgtcgccaaagtaataaagcctgccgcaggcagagttcagattttgatggcaagaaaaaccgcctgtaaaaggcgtttggccccggaaaaggaatgtatagatgcgctgtaaaacgctgactgccgcggcagtagtaatgttgatgatgaccgccggatgttccaccttagagcgcgtggtctatcgtcctgatatcaaccagggtaactatctggtagctaacgacgtagccaagatccataccggtatgacacagcaacaggtggcttacaccctcggtacgccgatgatgaaagacccgtttggcagcaacgtatggtattacgtgttccgccaggagccaggtcatgagcgcgtgaagcagcagacgctgacgctgaactttgatggtaacggtgttctgactaacatcgacaataagcagaatctggccaaaaacagcgactgattgaacgtaagaccgtttaaacgacagacagcaaaaaggcgcactgagcgcctttttttatgcccgctatccactgagcctgaagggatagcgacttattttttgctttctgccgctcgctctgcgcgctgacggcgcagctctttgggatcggcaatcagcggacgatagatctcaatacgatcgccctcattaacctcatcacccagcttcactggccgactgtagatgccgactttgttactggtgaggtcaatctcccgacgcagttccagtagccctgacttttcgatggcctgctctaccgtgctgccctgctccactttcacgtagagctgatactgtttttcaggtaaggcgtagaccacctcaacggagatctcaggcactgtagacctctttagcacgctgagtgaaagcctgcaccatgctgttggcaagctctttgaagatacgtccaaaggccatctctaccagcatgttggtgaattcaaactccaggcttaattcaaccttgcaggcgtcatcgcccagcgagacgaacttccagccgccggtcagcttgcggaacggtccatcaaccagttgcatatggatgctctggttatctgtcagggtattgcgggtggtaaatgtcttgctgatgcccgctttcgacacatccacggacgcagtcatctgattatctgacgcatccagcacgcggcttccggtgcaacccggcaggaattgcggataggcatccacatcatttacaagtttgtacatctgcccggcactaaacgggaccagcgccgaacgactaatctgagccataatggttcctgttcatcacgaaaccgctgaataatagcattttcagcgattaaacaaaaatgtccccgagtgagggtgtgctagaatatcccgtttcctgccgccccgctggactggggatgcgataaccgactaagtgatgtaaaatacgccgcactatgacaaagaaaaaagcacacaaacccggttctgccactgttgccatgaacaaacgcgcccgtcacgagtacttcattgaagaggagtacgaagcgggattgtcgttacaaggatgggaagttaagtcacttcgtgctggtaaagccaacatcagcgacagctatattctgctgcgcgatggcgaagcctttctgttcggttcaacctttcaacccttagccgttgcttccagtcacgtggtctgtgacccgacgcgcagccgtaagctgctgctaaagcaacgtgaactcgactccctgtatggccgcgtcaaccgcgaaggctacaccatcgtggcgctgtcgctgtactggaagaacgcctggtgcaaactgaagattggtgttgcacgcggtaaaaaagagcacgacaagcgcgatgatatcaaagaccgcgaatggcaattagacaaagcacgtatcatgaagaattcaaagcgttaagcactggattttgacttgttttgttgttagtatatgaggttctggggctgattctggactcgacgggattgtgaagccttaggagcatgccgaggggcggtttgcctcgtaaaaagccgcaaaaaaatagtcgcaaacgacgaaaactacgcactagcagcttaataacctgcttagagccttctctccctagcttccgctcttaagacggggatcaagagaagtcaaacccaaaagagatcgcgtggatgccttgcctggggttgaagcgttaaatccaatcaggctagtctgttagtggcgtgtctgttcgcagctaaccggcgaatgtaaaaactgactaagcatgtagtgccgacggtgtagtaatttcggacgcgggttcaactcccgccagctccaccaaattcttggttgatggttaccagaaccatcatcgaagtcctgagagcccgcaaggtcaaagccttgcgggcttttttgtgtcctcaatttgtcccgcgcagtccgaagagaactaattaaatccggaccttttaggcactttgttaggcacctcctgaagctttaatgtttttgaggtgcctaaactatggaaacccggcaatggaaagacaaacctctctccgttaaggaaatcgaatctgccaaacccaaggaagcggactatgtgctctatgatggcgatggcctcgagctactgatcaaatccagcgggagtaaaatctggtagtttcgctacaatcgccctgttaccaagaaacgggcgaagaagagcataggcccctacccgccagttaggcttgccgatgccagaaactacagggcagagtctcgctctctccttacgaaacaaatcgatccacaggaacatcagcaagaaaaacttcgcagtttcgctggaagccaaaaccaatactttccaactcgtggctgaacgttggtggaatgtgaagaaagccagtgtgacagaggactacgcagaggatatctggcgctctcttgaaagagatgtctttcctgcgattggcgacgttagcgttacagatattaaagctcacacactggttcaggccgtccacctggttcaggccagaggagcgctggaaaccgtccgtcgcctgtgccagcgcattaatgaggtcatgatctatgcccaaaatacaggtctgattgatgcggtgcctagtgtcaacattggcaaggcctttaagaagccgcagaagaagaacatgccaagcattcaaccggatcagctacctcaactgatgcagacaatgcgaacagccagcattagcctttccacacgctgcctgttcatgtggcaacttcttactattacccgccctgccgaagcggctgaatctcgctgggaagaggtagacatagaagcgcgagagtggaatattcctgcagcgcgcatgaaaatcaaccgcgaccatactgttccattgtcagatgaagcaattgcgatactggagatgatgaagccgttaagtggaaatcgagaatttatctttcccagccgcatcaagccaaaccagccaatgaacagtcagaccgtaaacgcatcgctaaaacgctgaggttttggtggggtgctggtttcacacggtctgagatctatcgccagtacagcccttaatgaacaaggctttccacctgatattattgaggcagtactggcccacgtggataagaatgaggttcgtcgtgcttataaccgcagcgattacctgaagcagcgacggtcaatgatgcagtagtgggctgattttgttaacgcggcagatagtggcagtatttttgaaggaggggtgaaaggaatgcgacttgttgggtagtatactggagctggagtctactctgtctttacttgggctagagtgaatactcttaaaattagatctaccacatgagtgaagttaaaccctgtttataagcagggttatatatttttgttctggtttttcagtttaagtcacttttggcagcctgaatatctgcccgttttgcggagtattcccactcatcagctattctaaaaagcattgcagaagtacgaacacaatgtggcatcgaacttgcccattcgcggtattgttcagccaattttctttcttgttgcccaccttcatatagcatccttgtaaataccccccttttattatacagaccaatttgaatacctttctctaattcatcagaagataatttttcaatgatgtgccgaattgcttcatgaggccaagcattatctattgagctcttaggagcatgtgccagaattttacctatgacataatccgtgatgtcttgacgatgatgtagtttggctaaatgacgcacacttacacaccaatcttcaagcatcttctgatcaatgttattcttttcctgccctggaattatccgtattttttcaagtaatctataaacagaagttgctcttttgacctcgagttccgaaagttctctttgtttatctttgtcgctacgataaacaatacatattgcttctataaaaattccaggctgcttcatcattagacgatgtaaaatgaatggttcatctctatcagaaaaacaaggtaaatagatcatttctttaaatgccaatgtattctcagaaacatcacttcgtttttgaagctcatcaaatacctttgtaatataaaatgaaatcattgaatcaaatttaatttcttgattatttatttctttaacaacaatatctaaaagtgctaaaagtgtaactgatggcacatcagaaagacgttgactggcggatatgatagcagaaagccctctctcccaagaaatatatttatctatgataagcaataaatctgaaacctcacctttcacagcgaaaggttgtttttgtaaccaatagcttttgttaatttcgtatccaaactcttcaatagcgcgccataccaactgagaatctcttaatgaagccagtattttcccagccctatcaggagcgatcccaacctgttcaaaatagacatttattttataaagccacttaattccaaaacgttccacaccatcattaattaataacccacaggcatcatcaatgtttttatcgctattaatgagcaatacaaacaaatcaatagtctcatcttcatttagcgaaagtgcggggatatgttttgccgcaatataaatattattaacttgttgaaaaaggtttaacactccttctaattttaaagaagaatatatctcccttagcttgccaatttgcatatcttcgacagtagaaaatcccccaccaacatttagaattgactcttcgatatcgctgacccaatcattgaaaacccataaccctgccttaactagatcattaggttgataaacctcaagtattatttttattttctccataaactcatatttaaatgaccaattggcatctgaatattttttgtggcgagaatactcatggcgcaacgcctcccatacactaaatcgctcattttcagtttgtttatcgagacaattttttaggtgaacaaatgtttcatccattacattttcaggaaatgagctcatatgagaaattagagttttccatctttctggtaatgtacctgcaagtagaattgcttcttggatgacaaaagtctggccctcccaaacaacaccccatgttagtttttctatatccttagtcgactctctgaatttcatttttgagttttgatcagaggtatcatgggaacgaggaagaagattctgtaacaaactccaacctataccaggaactatagtgataatttttttaataactgcatttctaactttcactggcgcccatgtattaggagaccatgccagaaaaatggttcttaaactattaatagggcgatccgagtaagtccctccgggatcgattacggcgagttttgcaagacacgttgcggcacgtaacaagtatgtttgttcccaagctaaggcttctaatgcccattttaatccatgataatgactttgtggagctaacagccctttatcctcattaaatatcgggacaataatctctccattgcccttaagcaattgctcaagggcattaaagaaagggtctggagcagcttctgccagcagcggaagttgatctcgcaaactaacaaacagtcgatggtcattagcaagcccaggaatactttggactattttgttaacgaaatcctggggtgacatacccgtaacccggaattcggcctgttcatgtaatattgccatatgcagcaaaattgttgccattccattgcgtaaccacgagctataagacgttttaatatcattatcaggtacaaagagatcttcggacttagggggtgtagggatataggaaaaaacgtctcttacagccgtctcaaaacgccctaaatgttcttcacccaataaataacctaaatgtataaaagcatctaccgacgatcgcaatgaccaaatatcatccactcgatcaattggcgaatctcggcgtcttattaacggtcttaatgggttttcaacttgagaatagtctgcataacccgctaattgcttgagaattgatttatctttttctgaacatgtactccatgcgccagcgagtaaagcaggaagcaactcagggttatctttccattctggtaattcagccgtgctacttgatatctggcgagctaagacagacaaacttcgaccacactgccgcgccatttgataacttttatctgaatcaaaccccatggattcaagagccttacctaaagatatgctatcaggacggctcagaatttcgtgattagtttcgtgtttcatcagccccagcactcactacggtgatagatgattgctgtaacaagccggccaaaaatcttgctcgatcacgaggcaagaagatcattcctttttttccagaaagctgccttgcggcatcgtccgtatcaataattagtgctcgactttgaaaggaatgtcgaagttctaattcggtggttctgatagctgcaatcgcaaaagcaataacctcatctggggaatctgcagctaaagatatttttcgaccattctctcgtagatgatttaaaaaacgctctttttgcttttctctccccgccagtaagactgcttcagttaaaggaggattaaatttagtggaatattcatcccaaaactctttaatacttctaacaccaacttgtggcatgagctcaagatggtagcgagcgtagtaagcagctacagcagggcaagcactgagccaatcttcaagcatagaaccatcaattaatttgatatctttccacttaccactgctacgtttctcttgtagccagtcttcaagctttaccttaggattatcccatgttcttaatgaagcgaaaacgaaagtagtcttcagacgtatctccggaacaacttcgcgtgttctcttttcgtaatcagagttaactttatcgagcaatttttcgttaacaccaaattcccaaaatgaatcgccatcaggaacatacgctccctccccttcggctttaagtacaccgtcataacctctaacctgtcccttatcaccattaggaaatctaatttcagtaatattgttagccgttgcacgtataaggtcagcaactagtgctggaaaaatgacttttgctggaatagaatcagcccattgctgaagatttaatgcttttatccatttcatatttgtattctgcccaataaaattttaaacaaccaaaaaggtacaaaaaatcagcatgtacaagacattttccgtgcacacaaaattctaacaaaacactaaagagtaaaaaaaccgagcttatttcttgagtttaaacattaacctattttttaactcccgctaaatctactgttctatagttaatcatcaagttagtgaaatttcttgaactggaatgctccttaccctgacgttcacatcaagtatgagcctgtgctttgcgcataccatatccttgattcagtcatactgatagttctatgccaaagtggatatgatcaacatcacaattctgagtcaggaaaacttaactaattgatgacactgagttttcaacggacattagtttcgtcattggttatactaagggtaactttttatatggccgcagtatctataatagggttaggatgtggcaatctttgacattgaaaaggacgaattacttcggctcaccgatactcagctagaagagctgattgctcggctagcggaagctgaagtagcaatgcatgaccatagccctgcgtgtgtaaattggtctggttcaatcactgcccctgacggaggaattgatatccatgttcaggttccagttgatcaactggatgcaggctttctggtaaggcctgatacggtctttcaggcaaagaaacataggatgccaaaggttgcaatcgagaaagagatgggcaccagtaaaacactttcatcgaccatttctgaacaagccagaaagcaaggcagctacatcattgtcagcttgggcgacgattgctcgccgtcaggaaagacggatcgtctcaaagcaatgcgagatgcggtaaaagacgatcctaacgaaagcaatcttcatcttgatttctacgaccgttccaaactcattcaatggctgcgccaacacccttcagtcatgctgtgggtaaaagagaaacttggacaagggtattctggttggcaaccatacggtacgtggagtaatccaccacaaggtgttacggacactttaatctcagccccaggtgtaactattactttaccgtcgggaaaggggcaaaaactcaaaattgaggaagctattaatccaatgcgggcacttattcggtcgacgaataaggtggttcgtattacaggattatctggtgttgggaagacccggattgttcaggcactcttcgatccaactgttggaacagatgcgttagaccggacggtggcgatttatgtcgatactggttctgagccagtaccgtcggctacagcaatgcttgataagctggttgctgagagccgacgagcaatcatgatcattgataattgcccatcagatctccatgcttcgcttgctagcaaagtatcaactgcaggaaaagaagtaagactcatcacgatcgagtacgacatcagggatgacaaaccacagacaactgaggtcatccacattgagacagacggtccggaggtggcaaagcaacttcttatccgtcgcttcccttctattggtcagaataatgcccgtcggattgctgagtttgcagatggtaatgcaagagttgctttggctatagcagagagagtggaggaaggtgagagtttagccctactttcagatgctcagttgtttaatcgcttgtttgaacaacgtaatcatcccgacggccatttacgggagcaagctgaaatattgtcactggtgtattcgttctcggtatctaattctgatgttgctaccgatgaactagaaatattgggtgcgctctctgggtatcccaaaatccagttattcaaagctgctacgaagttaatggaacgtcacatcgttcagaaaagatcccactggagagccatccttccccatgccattgctaacaagttggcagcatctgcacttaatagtattccggttgatcaacttagggcggcctttgaagctccggagcggcaacgattattgatgtcgttcgcgcacaggttgggattattgcacagccatgctgtggctaaagagattgttgaagcttggttacagcccgaagggctgcttgggaaaataataaacctagatgatgcatcgacacgtattctgaattatgtcgctccagttgcccctggagctttgcttgagcggattgaagaaacgcttgttacgtctcattttgagcatgttaaatcaccctacaacccaaaaagaacagcaattatcaacttgttgcagttacttgcatatgaatcgaaatactttgaacgatgcattaagctcttaatctgtatcgcagaccaggaaagcgcgagcaataattttgattcagctcgaaataagataactaggtttttccaaccgtatctatccggtacccatgcctctttagatcaacgtgttgcgatcatgaatgaatgcattggttcaggtatggccggacgtagaaggctggggctcgaaatgcttgaaacggccctcgacggaccaccgtggacaggattcgggattaatgagtttggtgctcggccaagagattatggatttcggcccggttacgatgaatttgttgcgtggctaatcaccttcatcgatattttggtgagattaggaaacctcagaagttcccgagcttgaagacgatgccaggaggatcttggctggtaaatttcgcaggatttggcgtcatggaggaataaggtcaaaattaattgatgcggttcgtaagttacatacccatcgcccttggggtgaaggctggaaagctgtacgctcaacaatttattttttccatacaaaaagaaaagataacgaagacgtagaaccattgccggaaatacttgtgacattggaacgagaattagagcctaatgacttggttcaggcagttatggcttatgtactcagtaaggggcgcgatttttgggcgctagatgctgattatgagcaccaaggacctaacaaatttagtgaaatcaggaaactacttggtgccaaagctttcaagttgggacacgaatttgcagtatctgcccatggacttgatgagttgtgccctaatctttttttgcgggatggaatgccctatcgcgtcgaatttggtaaaggcttagctaacggggctcctgacatacgaatttattggcggcaactagtcattcaattggatctacaacacaaatctcaaagtgatttttcggtgattcgaggtttcattgaagagactaattctatcgattcagcattagcgcaggaacagctcgatcagtgcgcacaacattctgaacttcgattggaattagtcaacctgcatccttggcaggagtttactgaaatcgatctggatcgctgcatgtcgcttctagatgactctgacatacggccccatatgtatggggcgattctgtggggtgagcaattctctaatttgccagaaagcagtgttctcgagcttgctcataaactgctgagtaaaccgaatggtgatgaagtagtattggaagcactgagtatgaaactagctgataaaggagatgctgcggatacactaggtcttgcgctacgaacgatcggactatctgctgcaatccagaggttccgaagagatcacaacgattccggcgggtatatagattacgcaatgaaacgtgttatcgatgccacattgcacttcgatggcaacgagactgaaaagttagaatggctaaatacaatcttcgctgttgttgatgagcattatggctacatttattctttcgaagacgctatcggtatcaccgctgcatggatgccaaaagaatttctcagtcgcatttttgatggtacggaagatcaacaacagaggcgtctgcatttcatcaatcattatgattcacatcaatctcctattgcgaaaatcgatgtagatattttgattgaatggtgcggtgccactaaagatcctcaggtttgggcttcagtcgcttcaggtattaatctatggtcaaaagacggtgagaatagtcctatttgcttgcaagatgatgcactgagatttctagaagcctcacccgagccaagagccgtccttgagatctttgccgaaaacgtagcaccttcatcatggtccggtagtcgtgcgaaacgtgatgcaacctagggttgaagcgataggccagttggtcacgcacgagcgtgcagacatttctaagtcggctagagctgtgtatgaaaaactgactaactgggttgaaaaggaaaaagaacgtgagcgattggaagatgagacattggaacaacggtttgaatgaaggctagttggcctgcccccagaattagatacaacgctcagttaataatgtcggatccttcactctcagaattactctttctccagcccgctgcaaattcagacggcgtctgataattcagcatggagtgcgggtgacattcgttataatcctgatgccattcgcttatggttttcctggcatgactgacgtcgctgaaccagtgttcattcaggcattcatcgcgaaagcgtccgttaaaactctcaataaatccgttctgtgtcggtttaccgggctgaataagccgcagctccacgcaatgctcaaaggcccattggtcaagtgctctacaggtaaactccggccccttgtcagttcttatcgtagccggatatccgcgaaacagcgcaatactgtccagaatatgcgtgacctgcacgcctgaaatccccaaggcaacagtgacagtcaggcattcctttgtgaagtcatcgacgcagttaaggcacttgatcctgcgaccggtggccagttcatccatgacgaaatccattgaccaggtcagattgggcgcatccgggcgaagcagcggcagacgttctgttgcaagccctttacgacgacgtctgcgtttaacgcccagcccgttcagatgataaaggcggtacacgcgcttgtgattaaccagaagcccttcacggcgcagtaactgcaatatgcggcggtagccaaaacgcctgcgatccagtgccagtttagtaatgcgccctgataaatgggcatcagccgccggacgctgagcgtcatagcgccaggtcgacagtgacaaacctgtgagtctgcaggcacgacgttgcgacagaccggtcgcaacacacatcaacaccacgacttcgcgcttctggtctgtcgtcagtactttcgcccaggagccacctgaagcgcctccttatccagcatggcctcggcgagcagtttcctgagtctggcgttctcttcctcaagtgacttcaggcgcttaacctcaggcacctccatgccgccatacttcttacgccaggtataaaacgtggcgtcggaaatggcgtgcttacggcggagttcccgggcagaaactccggcttcagcctcgcggagaatactgatgatctgttcgtcggaaaaacgcttcttcatggggatgtcctcatgtggcttatcaagacattactaccatcgcggtgtattaatcaacgggggagcaggtcaattgtaccaagtgactaaattttgttataaaaagccaacaatcaaacaaaagacactaattaattatgaataaatttgatatagaaaaaatgctattagaagaggggtttaccccaaaggaagtttctgtgacacgtcatcatgctgagaaagaaggttatccttatccctggctcctttcacagttaaagaaaagattcatagttgcaatgatattaatagcaatccttctggcaggactcatttataccattagcagtggtacacaagaaaaaattgtatcttattcgataacgctgttagcaggcttcacaattctgtatacttttattcctttgaaacctgcatacaaagcatttaattttttgagaaaacactctcatgttttataaagtcgctaatgaatattttcatttatttaatcgaagaatcgcattacctcttccccctacagcaatacattcaccactaaagacatctatataatatttaattggatttggcatgttttccatcatccatggaagatcttcagaaaatttcaaatctgaggttgaaataacccaaacagatttaccatcaaaagacgatctaacagcctcatgaaaacgttcgtcccaaccatgccctgttacccttgcatattctttggcaatttcaacagctttattttccgatatcattgctgaactccataccaaacattatacatcaaccctccaaccactactggccccaaaagaatacctgcggtttcatgccgcaataatgtatatgtaatttcgtaagtatttccaagagggaatttgaagccttcaatgatatatcctctactcatccctctggctcttaataagccaatagtttcagcaagcgactcttccagatatcgtaatatatatgatttattatatgcgctttgtctcatgaaaaccctaagttctcttaataaatagaacttaggcgcaattgccatgtgtacctgttcatgataaagagttgaaagcatctgcaaatatgcgtcatctttcgacattgcaccaggatagtagttgcgtcctacttctacgtccccccagggttttgtgcgtccctgaacgacgtcactatgctttgtgatttttatcttaggagtataacgccaacctccattgcgaggcaggttcattttccttccaatatcgctgctgtatctaggcatttttactcccctgaaaggagttttaaatgtatcaccaggcttcttctttaaaagaagtgcgaggacagtattaacgcctaacagagtgatcgcgtctgctaaatccttagcagcaacgtcaagatctccttcgctacgagctgcgttagtcttcgttgcaaaatcaaacaacttcttagccgcttcaagcgctacgccccctactgctacccaacctacaatgagaagcactaaatcagcgatttcaccaatcccaaaaaagtgcgcaccagcccaaaccacgattacccccgccatagttgctaatgctgagggggtgaccatagcaagaagctgttgacctacgtcagatggtaagagcactgccgctttcgagatgactagttgtagccttgactgtatatcgctagggataacttccattctctatcctcagttatatgttaagctgcctgcagaataactcttgaatactgcattatccagtagttttgcttatcatgtttgtttgctctgaacgaagaagatatatccacttatcatttagcttttttaaaaatttattataaactgacagcattaaaattatgatttaaatcaaaagcccaacctaaccctgtataataaaaatataaaaatcgagagtggtaagaaaaagagcagcttcccgctttcaatcccgttatcagaaatctatgtaaatgaaatcttaaagctgacagaacacgatgcaacaacatgggctcagaaggaaagatttgtacgttatcttgagcgttatagaactggtcttcttaacaatcagcaattgcaggataagtaattaatccaatacctcaacgacctgaaaagataagtagcttgatgaagatgatgtctctgacaggcgctggttgaacagaaaagaagtctgtggtatcgcagaacttgcaagacaaaggctggtggcaggtcagagccgctccatagtacatgaatggtctacagtgggactggcagggatcccaggttattcaggttatgtaggcaatgcagcgaaagcggcaaaattcttgaaatcaggtggttacataggaatggggtttgcctttgctggaaccacgaatgatgtagtcaatgcctgcgttaaaggacgtgagagcgaatgtaaaagaaccgcattcaaagaatatggtaagtttggggcttcgaccttaacgggtgttggagctggtgcagccggtttctttagcaggcgtaggtatatgcgcagcaatagggatcgccacggcaggaaccggcgcggtagtctgcgcagctgttggctcaatagctgcgggctatgtaggtgctaaagcgagtgactctgtaatggatactatctatgaatacatgggaatttgaagaatgaagtcggccataatggttttaatcatgcttccgttggtttgcttagtggtaagcgtttttttgtatctaatgaacaggtctcgctacaaggaattgatctcagacttccaacaacagcatacactgcccgccccttacttgttgcactgcaatataggatatataggttcacctctaatgacctatttttttatgcgattaaaaaaaaataaaaaaattttctttttaaacaggaacgacaatgcttataactttgcacatgaaggtcaaaatctaaaaaaataaacaatttaaaaccattatattatacatttttattagggtttttctgttgcttttcactttccattattgcaatactgatcaaagctcaaataatttgatcatgttaataaaacattcagatagataattttccataccatattttatggttcaccttaaaattagattgtatagtgaattatgtctctggattagaaccaggcgggcatacgcttttaaagcatattggaaaatcaccccaggaacttcatgaaagaattatccaatccaatggggtattggatctatctggttcgttctcgtcgctggagattgccgaagcgatcgtgaagatctaaaaaaagaagtgatgaaccttctgacatatgatgatgaaatgataaaatcagagttcagagacaggtatattaatacctttgcaccggaagatggtaaagggttgcttctgcgaatactcgaaagtatcaacaagtatagtgaccatggcaatcccttattaacgagcattggtgttcgatggagggttaccagaacttcgtcgaactcctcaaagcccgcgagataaacgtactgcgggctttttgtgtctgtgcagccctgcggccttccgtgcgaatgcgcttcaggcatgtctatcaacattttctgcaacgtcattactatacctccttccgcctccccactcccccctttacagccccaacctaaacacgaaataatacccctttacgccgggccacaacgccctgccaacgcttaaacccaaactcaactctgcggacaccctatgaataacgaaatctctctcaaatactatgatgtcgcagatgagtatgcgacggagtccgctaagccggtgagcgaagctgaacgtaccccactggcacattacttccagctgctgatcacccgtctgatgaacaacgaagagatcagtgaagagtcgcagcaggatatggcgcgtgaagcgggtatcgatgagcagcgtattgatgaaattgccgagtttctgaaccgctggggcaacgagtaacagacactcaccggcagacgagctttgcgcagtttcgccggttaatcagcctgacttagtaccgcagcgctacagcgccggtattcccataaaaacgcacaatgctgacagccacgtgtcccacgtggctgatgtccgttcccggccctaccgacccatcttcgtctttatctgccgctacacacactccatcacacacgccttcatccgccacaaagtcccccttccgccgctcaccctctggcgcacctgaaaattatcatccagacttatatagtctgcgcaggcattgtgttttacactgcgcgctgtaaaaaactgagtagattaagcaggcaaaaatggcgatgaacggaacgatcacaacctggtttgaagataaaggttttggctttatcaaagatgaaaacggtgataaccgctattttcatgtgattaaggtcgccaatcctgatctgatcaagaaagatgcggcggtgacgtttgaacccaccaccaacaacaagggcttatccgcctatgcggtgaaggtcgcgccgacaagcaaatacatctatatcgcaggcgagcggctcaagatcacctcgattaagtcttatctggtctacaacgaagaagtcccggtcgatgccggtgtcgataaagagaacgcggtgttgtcagtgggtctgttgctgaataatatccggccgaaaactgacccgaacgctaatgagatgcgctcgctgaaaaagctggcggtcaccaccttccagggtacgacactgatcttctccgaagatgagatcgacattgaaagcacggttaaagtgcttaaaggtctgaagtaatcccgcaggcgggccgaaattgtgttggcaggatttcggccttcaggcgactgccagcctgctattcaggcacatttctctgacacgaaatccccgcccacagggctgatacataacaaagcgttgctctggcggataaaaccgtcctgctctcccctctaatccattgtttatgataaaacaaaggtcaaaagcgcagctcatcaaggttcatccccacaaagcgactttccagggtagaattagaaactttgttcagtcattgccaatgttttccatcatcgcaaagtgatacgaaaagcgggtgaaataaggtataaagccgcatgaaaatcccaaacagaatccagcccctggtcgatgacggcctgattgacgatgtcctgcagcggctgaaaagcggcaaagaagcggacgtctataccgtgctatgcggcggcaaggtgcagtgcgccaaagtctataaagaagcgacccagcgtagcttcaagcaggccgtgcagtatcaggaaggtcgtaaaacccgtaacagccgtaacgcccgcgccatgcagaaaggcacaaagttcggccgtaagcagcaggaagagtcctggcagaccgccgaagtagatgccctgttccgcctggcgaaacgccggtgttcgcgtgccacaaccttatctctgcatcgacggtgtgttactgatggagctggtgaccgatgccaatggctcggtcgcgccacgtctcagcgatgtctctctgtctgaagagcaggcggtcacggatttccacaccatgatccgcaacatcgttcgtatgctctgtgctggtatcgttcacggtgacttatccgagttcaacgtgctgctggatgaccagggcccggtgattatcgacctgccacaggcagttgatgcggcggccaataaccatgccgagtcgatgtttgaacgtgacgtagacaacatcacctcttactacggtcagttcgctccgcagctgctgaagacgcgctacgccaaagaaatctggctgctctatgaagatggcaagctcaccccggaaacgccgcttaccgggaagtttgtggaagaggagcgcgtagtcgatatggattctctgatggatgagatcatcacggcagaagatgaatattacgagcgccagcgcgccagccgtgagcgcgacgaagagtaactgcctcaataaaaaaggcagcgagtcgcctcgctgcctctcacttaccgcactatcacaacgccatcaccgcacgatgaccgtcagcgcaatcagagttaagccgatgatcatcacgccgacaaagaccttatcgagcctgctttttttcatcttctcctccctagaaccactgaccaaagcgacggatatagaaacgcttcatgccctgcgccaccaggcagtagctgaacagcgtcagcaccagccacgggaaatactgccatggcagtggcaccagaccgaccatcgcacccagcggggagaacgggatcaggatgcccagagccatcactgccagcgtagtcagcatcaccggtaaggtggcgcggctctgaataaacggaatcttccgggtacgcagcatatgcactaccagcgtctgtgacagtagcccctcaataaaccagccggactggaacagcgactgcacgcctgcatggttagcgccgaaaacaaaccacatcagcgcaaaggtggtgacgtcaaaaattgacgaggtcgggcccatccacagcatgaagcgtttgatgttgccggcatcccatttacgcggtttattcagaaactcacggtcaaccttgtcccacggcagcgccagctgggaaacgtcatacatcaggttctgaatcagcagatggatcgacagcatcggcagaaacggaataaaggcactggccaccagcagcgagaaaacgttgccgaagttggagctggcggtcatgttgagatacttgatgatgttgccaaaggtctcgcgtcctttgagtacaccctcattcagcacctgtaaatccttctccagcaggatgatgtccgatgaggctttcgccacatccgccgcgctgtccacggaaatcccggtgtcagccgcccgcagcgcaggcgcgtcattaatgccatcgcccaggaaacccgacggtgtgaccgttctgctgcatcagccgcaccagacgggatttctgcagcggtgtcagctgagcaaacagggtgcagcgctcggcttcctgcgccagctcatcatcgttcatcgcctcaatctgatcgccggtcagcatggccggatcggtcagcccgacatcggcacagacccgcagcgtcaccagcggattgtcaccggtcagcactttcaccgtcacaccgctgtcacgcagggctttaatcgctttgcccgcgctggctttaggcggatcgcggaaggtcagcattccctgaataatcagatcgcgctcatcactgtcgctgagcggcgcgtgcagctcgccatcacgggttgccaccagcagcacgcgatagccctgctgatgatagtgttcggtctgcgccagcagcgccgcgcgctgtgctgcatccagcgcgaccaccgtgtcgccctggcgcacggcaatgctcactgccagcatctcttccactgcgcctttacagatcagttgtgaacgatgctgagtcagatcttccaccagcaccgacacccgacggcgggtaaaatcaaacggcagctcatcgatcagctggaactggctgcgctgagactgtgaaatgaccttgtcgcccgcgcagagtaaggcgcgatccatcaggtttttcgcgccactctggctgccgctattgagccatgccagcagcagcacctgtgcatcttcgttgccccgcgcatccagatgatgcgccagcaggatggtgtcctgggtcagcgtgccggttttatcggtgcacagcacatccatcgcgccgaggttctgaatggcgttgagctttttaacgatcactttgcggcgtgacatcgcaatcgcgcccttagccaggttggcgctgacaatcatcggcagcatttccggggtcagtccgaccgcgacggccagtgcaaacagcgtggcatccatccagtcgcctttggtgaagccgttaatcagcagcaccaccggaaccatcaccagcataaagcggatcagcagcttgctgacgctgttcaccccgcggtcaaaggcggtctgcggacggcttccggtcagcgatgaggccagggagccgaaccaggtttcgccacccgtcgctaccacgactgcgctggctgtgccgctggccacgctggtgcccatcaggcagatattcggtgatgccagccgctcctgggcggtctgaccttcggcatcgatacccgcatcgctgctctgtttctcaaccggcagcgactcgccggtcagtactgcttcactgataaacagattacgtgaactcagcagacggacatcggcaggcacctgatcgccggtgctgagcagaatgatatcgcccggcaccagttcactcatatccacatcctgacgctgcgcggtttcgctgcctggctcacggcgcaacacggtgacctggctgcgcaccagtgacttcagagcctgcgccgcacggttagtgcgaaactcctgccagaagcgcagcagcccgctcagcatcaccatggtgaagatgatgatcacgccggagagatcggtctcctgaccggcgcgcagcggcagaatatagtcggtaaacaggctcaccagcgccaggaccagtaatacgtagataaacgggttattaaacgccatcagcagctgaatcagcgcgggtggcgctttctcatgcgccacttcattacggccatacaaagccagtcgtttcgccgcctcagcctgagtcagaccctgacgctgactacgcaggtttcgccagcgtcctatcaatgtgctggtctgcctgctgcgccacggcaaacatttttttactttttttatcattacggttgccggatgaagtgatcgcaacctgttccagtttcatgtcgctcatttcgacatctccctgatttaaagcaatagttgtcctgcacgggaaataacgtgcatggataaaacctggcgtagccgggttatttaatggggtgactttcagaaacagtcaggttattccgcctgcgcgataaataatgacgcgcgcagggttacctgacgccggttatacgcggcgttttaaaagtctgatatcagcgattgggcgcagcctgggctacgccagacggggcggaggaaaaagagcgaatataaacagcagcataacgcgcactcctggtgatgacaggattaaaattaaggagcgcgatcgttaattaaagcggggatcgctgctcgccggttggcaagcagcagaggaaactcagcttgccagaataaaggttaatctcgggtgactgtccaactgaattctcctgaagttatctgccgccattataaagagaggccggcttcggtaaagcaataacgtattgaataacagtttcgttgaggatttgtttctgctcaggttgccgcttcggtaacagcgtggcgatcttcttataacctccaggtaatccttataaccttttggcatatgattagcccatattcgactattcttcgcatcggccctttcgtaaactcgcgtaactttttagaggcaaggaaatttcatgaaaactataattccatcactgctggcgctgacgctggctgccgccttcacagcccaggccgcaacaccaaaagatacgctggtgattgcacaatcaactgacgacgcagacagcttcgacccggccaaagggtttgaactgaccagcgttcaggcttttacgaacatctatcagcgtctggtgcagtctgacccgcagaatccggtggatctgaaacctacgctggccacctcgtggcagcccggcagcgacaaccgcagcctgacctttgaactgcgtaaagatgcgaaattctctaccggcaacccgctgcgtccggaagatgtgatcttctcgctgggccgcgtggtgaagctgaacctcgatccctctttcatcctgacgcagctcggctggaccaaagataacgtcgatggcttcctgaagaaagtcgacgacaatcatgtgcagatcagctggaccgccaacgtcagcccaacctacgtcctgagcctgctctctgccccggtttcgtccatcattgatgaaaaaaccgcgatggcgaaccagaagaaacggcgatttcggtaacgcctggctggccacccactcggcgggcagcggcccgtatcagatccgcaaagtggtgatgcatcaggtggtgctgctcagcgctaacccgacctcaccagcgggcgcgccaaaaatgaagaacatcctgatcaaaaacgtaccggaaccggctgcgcgtcgtctgctgctggaacagggtgatgccgatatcgcccgtaacctgggtgccgatcagattgctgcgctgaacggcaaaccgggcgtgaagacggaagcgattcccatggcgtcgctctactacatccagttcaacatcggcgctaacgagacgatgaagaacccggccttctgggaagcggcgcgctacctgtgggattacaaaggcatcgccagtgagctgctgaaaggccagttcgacgtgcatcagagcttcctgcctaagggcttcctgggcgcgatcaacgacacgccatacagctacgatccggaaaaagccaaagcgattctgaagaaagcgggcctgaacaacgtcaccttcaagctctccaccagcaaccagccgccttatctggatatcgcacaggcgctgcagggcagcttcgccaaagcgggcgtgaaagtggaagtggtgccgggtctgagctccgaagtgtcgaccaacgtgaaagcgcataaatatgaagcgacgctgaacgcctggggctccgactatttcgatcccaacaccaatgccgcctcgtttgcttacaatccggaagatggcagcaaaaccatcgccttccgttcagactggcacattcctgagctgaacaagcaggtgattgcggcgaccgccgaaagcgatccgaagaaacgcgtggcgctgtatgaagcgatgcagcgtgaagtgatgaagaactcaccgtatgtgattgggatgcaggctaagaacctcatcgccctgcgcgacaacctgaaaggctatgtgcagggcattaaccctgacatggtgtattactcgcaggtcactaagtaatggcacagtctgttccttcagccgggttcgcccggcttttttggcagcgtggcgggcgcctgatcggtagcgtactgtcgctgctggtcacgctgcttggcctgctcgccttcacctttatgctgtcgcatctctcgccgatcgacccggtgcagcagatcgcgggcgatcacgccagtgaagcgacctatgagcaggtgcgtcatgacctgggtctcgaccagccggtgctgatgcagttctggcgctacgtcgaacatctggcgcagggcgatctgggtgtctcccgcctcaccaatcagtcggtgagcggcgacctgatgaccaccttccccgccaccatcgagctggcgacctgcgcgatgatcttcgcggtggtgttcggcgtgacgctggcgctgctggccgcctggaaaccgggcagctggatcgataatctcgcccgctttgtctcgctgctgggctactcggtgccggtgttctggctcggcctgctgggcctgctgctcttttatgcggtgctgcactggtccgccggaccgggacggctggatgatatctgggtctacaccctggagccgaaaaccggctttgtgctgatcgacagctggctgtcgggtgaaccggagatgttccgcaatgcaattgcgcacctctggctgccggtggtgatcctcggcctgctggcgatggcgggcattacccgcctgctgcgtgctgcgctgctggaagagagcagcaaagagtatgtggtgctggcgcgtgctaaaggcgcgggtcgggtgcgcatcctgctgcgccatatcttccccaacgtgctgggcacgctggtcacggtgatcgctctctcctacgctacgctgctggaaggctcggtgctgactgaaaccgtcttcgcctggccaggtgtgggtcgctatatgaccaatgcgctgttctccggcgatgtgccggcgattctgggctcaaccctgttaatcggcagctgctttatcctgattaacaccctggcggatgttttaacctggttaaccgatccgagaacccgatgacgcaacaactctctgaactcgaaacgctgcgaccacgccgtcgccgtcaacgcgttacctcgttaaccgttgggctgacgctggtggcgattcttatcctgatggcactgctggcgccgctgattgcgccgttcgatccgaacgtgcagaccatgtcgagccgtctgctggccccgtcggcacagcactggttcggcaccgacggctttggccgcgatctgctgtcgcgcgtgatttacggcgcgcgtccgaccctgctgctggtgtcgctgattctggtgctgaccattccggccgggctgctgatcggcatcaccgccggttacgtgggcggctggaccgaacgcctgctgatgcgcattaccgatatcttcctgtcgctgcccaacctggtgatcgcgctggcgctggtggcgattctcggccctggcctgatgaacggcgcactggcgctggcactgaccagctggccgccgtttgcccgtcaggcacgcgctgaaaccctggcactgcgccgcagcgactaccttgccgccgcgcggatgcaggggattacgggctttcgcctgatgttcggtcatatcctgccgctctgcatgccgacggcggtagtccgcgccgccctgagcctgggcgggattatcctggccgcggccggactcggtttcctcggtatgggcgttcagccgccgacggcggaatggggttcgatggtggccgaaggcagtaaagtcatttttgatcagtggtgggttgctgctgcaccgggcgcggcgattctgtttgccagcctggcctttaacctgacaggcgatggcctgcgcgaccgactggatacccgtcatgcaaaataatctgctccatgccgaggggctgaccattcgcagcgacgatgcgctgctggtcgacaacatcagtttttccgtgggtcgcgagcgcgtggcgctggtcggtgagtccggttccggcaagtcactgaccgcccgcagcctgatgggcttactctcgcccgcgctgcatctgcaggccagccagctccaggtggccggtgaaaatgcgctgacgctaagcgagcgtcactggaaccagctgcgtggtaaccgcgtggcgatggtgatgcaggacccgaagtatgcccttaacccgacgcgcaccattggctggcaggttgaagagccgctgatcctgcatcgccgcctgagccgtgccgagcgcaaagagaaagtgtgtgaaatgctggatgcggtcggcctgcccgatccgcgtcgtctgatgcagcagtatccgcatcagctctctggcggcatgggccagcgcgtgatgctggcgatcgccctgattaccgatccggacttcctgatcgccgatgaaccgacctccgcgctggatcatgccatgcgcgatcaggtgctggcgctgatccgcggtctggtggaggcgcgcaacatgggcctgctgctgatcagccatgatttgcagcaggtttcagaacattgcgagcgggtgatggtgatgtataaaggccggttgctggatacactacccgctgccgatctgccgcacgctacccacccctacacccgcacgctgtgggcctgccgtccgggcaaagcgacccatggacagacattaccggtgctggaccgcgctgcgctggaggcgaatgatgattaagctgcagaatctaagcgtcgcccacaaacagggttatgagctgcgcaccgtggtgcatgaggttaacctggaggttaacgctggcgagtgttttggtctggtgggtccgtcaggctgcggcaagtcgtcgctgctgtgggtgctggcaggtctgaacccgcactggcagggtcagatgcagcttgccggtcacgaagttcagccgggtaaagctttcaccggcgcgctgcgtcaggaagtgcagatggtgtttcaggatccctatgcctcgctgcatccgcgtcaccggctgcgtcgcacgctggcggagccgctgaagctgctgaaacgcgacaatatcaacgatcgtatcgatcagggcttccgtcacgtcggactcgatcccgccctggcggatcgctatccgcatcagctctccggcggccagcgtcagcgcgtcgccatcgtgcgcgccctgctgctgcagccgaagatcctgctgctggatgagccaacgtcggcgctggatatgtcagtgcaggcggagatcctcaatctgctcaacgatctgaaacagcaggatggcctgaccatggtgctggtgagccacgatcccgacgtgatcgatcacatgtgcgatcgcgccgtgcacatgtcgcagggtcgcatcatcgaacagatttctgcctgaaatcaggccggacggcgttcacctgccgtccggcgctgctgcatccgcctcgcctttctgtaaaatcctcttcttccgcctttatcctcatcctctctattgccagaatggcgcactgttctcttcctctgagacatttgattaccacgcgacgctgtaaacctttacagactgaagcaggcacgcgaatgcgacagcgcaaaacgcagcggctggctgatgcggtatactcgcgaccattatttcatgagaggaaaaggcaatgacggtaaaactgcgtccgctggagcgggaagatctgcactttgtccatcagctggataacaacgccagcgtgatgcgttactggtttgaggagccgtatgaggcgtttgtggagctgtctgatctctacaacaagcacattcacgatcagacagaaacgtcgctttgtggtggagcacagcgggcagaaagcgggattagtggaactggtggaaatcaaccatgtgcaccgacgcgccgagtttcagatcatcatcgatccggcccatcagggcaaaggactggcaacccaggcggcaaaactggcgatggattacggcttttcggtgctgaatctctacaagctctacctgattgtcgatcaggagaacgaaaaagcgatccacatctacaccaagctcggcttcgagatcgaaggcgtgcttaaacatgagtttttcatcaacggggagtaccgtaacaccatccgcatgtgcattttccagcatcagtatctggaacgccataaaacgccaggcggaatggtgaagccgaccgcgcagtaatcagccgcgcgcgccaaccgggttcataaagggacgcgggtgttcaggcttgaggtcgtacatgccgccatagaaaggatcgaccagcagccagccggggaatccacccagcgggatgttacccagcagataccacaggttagcgcgtgcctcgataggcaccgtgaccggcacgtagcccgggctttccagcatcagcagatagtgctttttgccaaagtagcggccggtagatttttccagttcaacggtctgcggcgtgaaaccctgcgcaaccgcatagccacgctcatcctgcacggtaaagcgcgcgccctgcggcaaggagtcgatgcgcaccagttgggtttcattgccgacaatggtggcacagccgctaagcagcagcgcggcggccagggccagaattcgctgtttcatgaaggggtccacagagtgatcagtgatcagagtgtagaccgccctctccacctcaatcgggctatcatcgcccgattcagccagcttattgcggttgacaagcacgggcgatagccgcgatgtcgttgggtgaggtgcgacagcagccgccaatcagcttcgcgcccgcctgctgccactctgccagtttgtcatgcaacgtgcagcctgatggcgctgagtgccaggttttgctgctggcatcatactgctcgccagagttgggatagaccaccagcggcttgtcggtcagcttctgcaactgctgcagcgcaggcgtcacgctctcaagtgccacgcagttgattcccaccgctaccacctgtggctgctgattcagccagctcacgacgtctgacagcggcgtgccgtcgctgatgtgtccggcgtcacgcagggtaaacgagaaccaggcgcggccttcaggaaattcagccagcagcttcaccagcgcctgcgcttcggcaaacgaaggcagggtttcgcaggccagcagatcggcacccgccgccagcagcgcctgcacgcgtgggcggtgaaacgccatcatctccgcttccggcaacgcatagtcgccgcgatattccgaaccatccgccaggaaggcgccatagggaccgaccgatcccgctaccagcagcgtttttgcgtcgggccggaccgccagataatcgtgacgggcgcgtcgcgccagctcgacactctgcgcgatcaactccagtgactccgcctcatcaaggccacgtgtggcaaagccctgcggcgtcgcctggtagctggcggtaatggcacagcgcgcgccggcgacaaaatagtcgtagtgcacctgatagatcagctcaggattttccatcagcaccttagctgaccataacgcatcggccagatgacagccgcgggcttccagctcggtggccagggcaccatccagaatcagcagtggtgactccgttaaagcctgcgcgacagggttatacgacatcattggcctcctcaggcttcggggatgatttgtgggtcagatggtaagcggcatagcagaaacagcacaaacgggatgccacaccacagcgcgatacgctgggtcggatcaaacgccagaccgacacaggccagcaggcagagcaggaaacccagcaccggcgtcagcggatagagcggcgcacggtaggccagatcggccagcgatttgccctgctgaagatgacgacgacggaaaacaaaatgcgaagcgcagatgctgagccagacggctaccaccgcaaagccggagatggccgacagcgccacaaacaccgtgtcgggcgcgaccacgctggagaccagcgccagcaaaccacccaccatgctgacggtgatcgccagcatcggcacgccgcgcttgttcacccgggcaaaggcgcgcggcagcgtattttcattggccagcgaccagagcatccgcccggaggcatagagtccggagttggccgcagacaggatagcggtcaggatcacaaagttaataatgtcagccgcccacgggatgccgatcttttcgaagaccagcacgaacgggcttttcacgatacccgcctgatccataggaatcagcgccgccagcacaaataccgtgccgatgaagaagataatcagccgggccacggtagtacggatcgccagcggcagcactttctccggctgctgggtttcaccggccgcaataccgatcagctcggtgccggaaaaggcgaagttgactgccaccatagtcatcagaatcggcagtacgccgttaggcagccagccgtgcgccgtcaggttgctcaggcccggtgcgggcgtgccatccttcatcgggataaacccaaacatcgccgcaccgccgagcacgataaaggcgacaatcgtcaccaccttaatcagcgagaaccagaactccccttcggcgaagaagcgggttgagatgacgttcagcagatagatggcgcagcagaagaccagacaccagatccataccgggatctgcgggaaccagtactgcatacagaagcccgccgccgtcaggctggagccgagggcgacggtccaggtgagccagtagagccaggccacggtgtagccggttgccgggctgagatagcgtgcggcatagacgtggaacgcgccggtttccggcatcgccaccgagagctcgcccagacagaccatcaccagccagaccaccagcgcgccaatcagataggcgagcagcgtccccgccgccccggtggtggaaatgatgtagccggtgttaaaaaacaggccggtgccgattacgccgcccagcgataacatcaccagatggcgcactttcatggtgcgtttaaattgttcctgcgagggagttggctgttcgctcatcacttttatccgtatggacgtctaaacatctataagggacagttttatacgcgtcacagccggtaattgcaacggcagggaaacagggaggaggtaaaggcggttcagtgccccgtcgcggcggggcctgatgcgttagccgaaaacgctttgaatataacgttccagcgccatgcgggaactaaatccgtgcgggatgccgtagtgttcctgtgaatcacccgccaggtagagagggaattgggtgtagtgatcgcaggtcttcatttctgaagcaggttcagcgaacggctggctcttctctttcagtgtcgggtgaatgacgagtgccatgcgccccatgcgcgcttcgcgattcacataaacatagttctctccacggcgataaccataggcccgtggggtaatttcatcgacttcgaaacccgctttttccagtacgcgcgctacctcatctggtcgtaaatacatgctcgatcctctcctctttcaaaagcttcgcaaccttacaacagcatgacagagtgggcattcggaattttccctaaagaacactcccgcgtctcgtttatctcaaggtcgtctacactagtattacgtttttaaatcaaagggagctaaaaaatgtttaatcgcactgtaaaaaacgatgacattgatattaatcaggatgttaacgaactggccgattcactggaagcgctgctgaaatcttacggcagtgacgccaaagacgaagtggattctgcacgcagtcaggcagaaaagctgctgaaacagacccgctccagactgaacggcggcagcaaccgtgtctcacaggttgcgcgtgatgccagtgcgcaggttgacacctacgtccatgacaagccatggcacggtgttggtatcggtgccgctttcggtatcgtagtgggtgtgctgctggcttcacgccgctaagctcaactccagaaaatctcctgagccctgccctgtgcggggcttttttatgccctttttctggccgatgacatttacaaaagatttttccaggctgcagggcgcatccctgctggctttgccgctgttgcgcaaatgcaaatcataaaaccctatatctggtgggcttgacccacaaaaccactacatctagtatttatctcatcagcacgacaccagatgtccggcagaatgaggcccgcaaactgctcctcctgctctgtttcctgacatcagaaccgcatatagagggaaatacgaatcatgcgcattattatttacactaaagataactgtgtccagtgcacggcaaccaaaaatgcgatggaccgtcagggtctcgcctatcagcttatcaatctcgacagccagcccgaggcgatcgacaacctgaaatcactgggttaccgccaggtaccggtcgtgatggcggataacgatcactggagcggtttccgcccggacaaaatcgccacgctgcgcacgctttctgctgtcgggggataaacacatgttcccgctggtctatttttccagccagtcggaaaacacccaccggtttgtgacgcgcctcggcctgcctgccaggcgcatcccgcttgatgcccggcaacaactgcatatcgaccagccctatattctggtcgtgcccagctatggcggtggcagcagtcgcggtgcggtgcccggtcaggtgattcagtttcttaatgatgaggcgaaccgacgcggtattcgtggcgtgatcgcagcgggcaaccgtaacttcggtgccggttactgcctggcgggcagcatcattgcaaataaatgtcaggttccctgcctctaccgcttcgagctgatgggaacgcctgacgatatcgcgaaagttaaagcgggagtaacccaattttggcaacaacagacaccctcaacggcgtgacgctcgattatcacgcccttaatgccatgctcaatctctacgacgccgagggccgcatccagttcgacaaggatcgcgaagcgacacgtcagttttatctgcagcatgtgcaacccaataccgtccccttcaatagctgcgctgagcgtttacgctatctggtggcagagagctattacgaagcggaagtgctgaaccagtacgattttgcgttcctgcttgcgctgcatgaggtcgcggaaaattggggatttgagttcaaaacctttctcggtgcctggaagtactacaccagctacaccctgaagaccttcgacggcaaacgctatctggaaaccttcgaacagcgcgcctgcatggtggcgctgacgctggctcagggcgatgaaaagcttgcgcgggccctgctggaggagatcctcagcggccgtttccagcccgctacaccaaccttcctgaactgcggcaaacagcaacgcggtgagctggtctcctgcttcctgctgcgcatcgaagacaatatggagtcgattggtcgcgccgtgaattcggcactgcagctttcaaagcgcggcggtggcgtcgcctttttgctgtcgaacctgcgtgagtccggtgcgccaatcaaacgtattgaaaatcagtcgtcgggcgttatcccggtgatgaaaatgctggaggatgccttctcttatgcgaatcagctcggcgcgcgtcagggcgctggcgcggtgtggctcaatgcgcaccatcccgatattttccgcttccttgataccaagcgcgaaaacgccgatgagaagatccgcatcaaaaccctgtcgctgggcgtagtgatccccgatatcaccttccagctggcaaaagagaacaaaccgatggcgctgttctcgccttacgacgttgaacggatctacggtcaggcctttggcgatatcagcatcagcgagaaatatgacgagatgctggccgacgaccgcatccgtaaaacctatattcagccacgcgacttcttccagacgctggccgagattcagtttgagtcgggctatccctacatcatgtatgaggacagcgtgaaccgcagtaatccgattgccggtcgcattaacatgagcaacctctgctctgagatcctgcaggtgaacagcgccagcgagtacaatgacgatctcagctatcgccgcatcggcaaagatatctcctgtaatctcggctcactgaacattgcgcacgcgatggattcacgcgatctggcgcgtaccgtggatgtggcgatccgcgctctgacctcggtgtcgatgatgagcgaaattggctcggtgccctcggtcgccgaaggcaatcgccgttcgcacgccattggcctgggtcagatgaacctgcatggctatctggcgcgggaaggcatcgcctatggttcaccggaagcgctggatttcactaatctctacttctactgcatcacctattatgcgctgcgcacctctaatcagctggcacaggagcgtcagcagaacttcgatggctttgcggaatcgcagtacgccagcggcgcctacttcgataagtatctgcagcgcgaatggctgccgcgcacgcaacgggtagcgacgctgtttgccgacgccggactgacgctgccgacacaggcggactggcaggcgctgcgcgacgcggtgatgcagcacgggctgtttaatcagaacctgcaggcgatcccgccaaccggttcaatctcctacattaaccatgccacctccagcatccatccgattgtctcccctatcgagatccgcaaagagggcaaaaccggccgcgtctactatcccgcgccctttatgaccaatgagaatctccatctctatcaggatgcgtatcagattgggccggaagcgattattgatacctacgcagaagcgactcagcatgtcgatcagggcctgtcgctgacgctgttcttccgcgatgacgtctcgacccgtgacatcaacaaagcgcagatttacgcgtggaaaaaaggcatcaaaacgctctattacattcgactgcgccagatggcgcttcagggcacggaggttcagggttgcgtctcatgctccctgtgatgaaaacgatgaaactaaaacagattcaggcaattaactggaaccgcattcaggatgacaaagatcttgaagtgtggaatcgtctcaccagcaacttctggctgccggagaaagtgccgctctccaacgatctgcccggctggcagacgctggataaacagcagcagcagctgaccatccgggttttcaccggcctgacgctgctcgacactatccagaaacgtggtcggcgcgccggggctgatggaagatgccattaccccgcacgaagaggcggtgctgtcgaatatcagctttatggaagcggtgcatgcccgctcctacagttcgatcttctcaaccctgtgtaacacccaggatgtggatgccgcttatcagtggagcgaagagaatgcgccgctgcagaacaaggcgcgcatcatcctggaacactaccaggccgatgatccgctgaagaagaagatcgccagcgtcttcctggagtcgtttttgttctattccggcttctggctgccgatgtactggtcgagccgtggcaagctgactaacaccgctgacctgattcgcctgattattcgcgatgaagcggtgcacggttactacatcggttacaaatatcagcaggcgctggctgccgctgacgatctgcgccgcgaagagctgcagcagttcgcctatgatctgctgctggcgctgtatgagaacgaagtggcttataccgaggcgctctatgccgatgtcggctgggtagaggaggtgaaaaccttcctgcactacaacgccaacaaagcgttgatgaatctgggctatgaggcgctgttcccggcggagctgacagcggtgaatccggccattctgtcggctctgtcgcccaacgccgacgaaaaccacgacttcttctccggttcaggctcctcctatgtgatgggaaaagcggtcgaaaccgaagacgaggactggaatttctgagggttaccgggtgctgttttgtcagcatccggttttctctggcagtgccgtgtcagccgcgccatttcgtctaatcataagaaaaaaatattactgcaaaacagcctgactatttcaccgtttgttgattctgcccctccccgcatttccttttttttcgaccaattattccactgaacccgatcgtttcaggcgtgattatttccctgcatcggaatccattatttccgtaatatttcacgtcggtgacacttgtttttctccctttcacgcggtaaatcggctgaaatgccaaaaacccgccaatgatttcacaaaaaattaatccacgcttatcccttgtgagcactgaagataatcggcatctgaatgtcccgcggccggtcaatattccacttcagggttgtcagataacgtcagtgtgctacggtatggcctgcttaaatttcagcgggaacgacaggataatattagatatttcaaccaggatttaatgactgcatggctattaagctcgaagtaaaaaatctctataaaatatttggcgacaatccggatcgcgcgtttaaatatattgaaaagggtgcgaccaaagatgtcattcttgagaagaccgggctctcccttggcgtaaagaacgccagtctggccattgaagaaggcgagatattcgtcatcatggggttatccggttcaggaaaatcgaccatggttcgccttctcaatcgtctgatagagccgacgcgcggccaggtgattattgacggtgtcgatattgccaaaatatcagccagcgaactgcgcgacgtgcgcagaaataaaatcagcatggtattccagtcatttgctttgatgccgcacatgaatgtattaaataatacggcatttggtatggaattagcgggagtcgcactggctgaacgccaggaaaaagcactggaagcgttacgtcaggtcgggctggagaattatgcgcacgcttatccggatgaactttccggagggatgcgacagcgcgtcggattagcccgcgccctggccatcaatcccgacatcttattaatggatgaggccttctccgctctggatccgttgattcgtactgaaatgcaggatgagctggttaatttacaagccaggcatcagcgcaccatcgtctttatttcccacgatcttgatgaagcgatgcgtattggcgaccgtattgccattatgcagggcggcgaagtgatacaggttggtacgccggatgagatcctgaataacccggccaatgactatgtccgcacctttttccgtggcgtcgatatcagtcacgtattcagcgccaaagatatcgcccgtcgtagcgcgggagcgttgatccgcaaagcgccaggtttcggcccgcgctccgccattaagctgctgcaggatgaagaccgcgactacggctacgtgctggagaaacagaagtttcttggcgtggtctccaccgactcgctgaaagccgcgctggcagcaggtctgggactcgatagcgccctcctcgactcgccagccgcggtgcccgccgatacctcactgagcgatctgctctcgcacgtcgctcaggcgccctgtgcggtgccagtggtcggtgaggagaatcagtatgtcggtatcatttccaaaagcacgctattgcgcgcgttagatcgtgaaggagcccagccatgagtcaggaaaccaccaatccgtgggatagcggcaccgccgccagcagtcaggctgcgcccaccagcagcggcggtgccgatgcctggggcacgcccgatggcagcgcgacacccgatgcagccagcagcagtgactggctcaacagcgcccccgcgcccgcgccggaacatttcaatatcatggatccattccacaaaacctggatcccgcttgatcactgggtgactaccggcatcgactgggtggtcaaccatttccgcccgctgtttcagggtatccgggtaccggttgactatattctcagcgcctttcagcagctgttgctggggatgcccgcgccggtagcgattctggtgtttgcgctgatcgcctggcagatcgcgacgcccgccatgggcatcgccacgctggtatcgctgatcttgattggcgcaattggcgcctggtcgcaggcgatggtcacgctggcgctggtgcttaccgcgctaatgttctgcattctcatcggcctgccgctggggatctggctggcccgcagtgaacgggcagcgcgtatcgtacgccccttgctggatgcgatgcagacaacacccgcctttgtctatctggtgccgattgtgatgctgtttggtatcggcaacgtgccaggcgtggtggtcacgattatcttcgccctgccaccgattgtacgcctgactattctcggcattaagcaggtgcccgccgatctgatcgaagcgagcgaatcctttggtgccagtccgcgtcagctgctattcaaagtgcagttgccgctggcgatgcccaccattatggcgggcgttaatcagaccctgatgctggcgctgtcgatggtggtgatcgcctcgatgatcgccgtgggcggactcggtcagatggtgctgcgcggtattggccgtctcgacatggggctggctacggtgggtggtgtggggattgtgatccttgccattatccttgaccgtctgacccaatcgtttggtcgcgatagccgcagccgcggtaatcgtcactggtatcacaccggcccgctgggcctgatcttctctccttcgcgtaaaaaataatctgtcgggcggtgcctgcgcgccgcccatcctgacgcgacatctgaaataaggaatgactatgcgcaacagagcctctctgctcgccgccgtggtaaccacgctggccgtttcacacgtctccgctgccgatctgccgggcaaaggtattacggtacaacccatacagagcactatcgctgaagagacttttcagaccctgattgtcagccgcgcgctggaaaaactcggctatcaggtcagcaagccgagtgaagtggattacaacgttggctacacctctatcgccgctggcgacgccacctttaccgcggtgaactggcagccgctgcatgacgacatgtacaaagccgccggtggcgatcagaagctctatcgtcagggaacctatgttaccggtgccgcccagggttatctgattgataagaagaccgccgagaaatatcacattaccaatatcgaacagctgaaagatcctaagatcgccagcctgtttgacgccaacggcgatggcaaagcggatatgaccggctgtacgccaggctggggctgtgaagcggtgattaatcatcagaacagcgcctttggtctcagtgataccgtgaccgccaatatgggtaactattcggcgatggtggcggatacgctggcacgctacaaacagggtaaaccgatcctttattacacctggacgccctactggctgagcgatgtgctgaagccgggccgcgatgtggtctggctgcaggtgccgttctcttcgctgcctggcgaacagaaggatgtggatactaagctgccaaacggtgcgaactacggtttcccggttaacaccatgcacatcgtcgccaacaaagcctgggcggcgaaaaacccggcggctgcccgtctgtttgcggtcatgaagctgcccattaccgatatcaatgctgaaaactcagcaatgcatgccggacaaaactcagaagaggcgattaaccgtcatgtggatggctggattaaggcgcatcaggctgagttcgataaatggatcagcgaggcgcaggccgccgcgcaataacatgaaaacatatccgccccagggtggttgataaaagtgctggctcagtgagcatacgctttaagtcgggcagttatctgagggcagaaatttttctgccctttttttatgcctgctttcccgactggtatggcctgttaataaacatgcgtgtgaaatagttttttgagttactattaacctcaaatgattattagcgaccgatgctgtttatgaatgcgactcgccagggtctgacgcctgctttagtaatgctgatgtcagtagcaaccggcctctgcgtagccagtaattactacgttcagccactactgaataccatcgcccaacagtttgatctctctgtcagcctcgccggatttattgtcaccacggcgcagctgggctacgcctgcggtctgttgctgctggtgccgcttggcgatcggtttgaacgacgcagcctgattgttacgatgatcctgctggctgctgcgggcatggtgattatcgccctttcgcactcctttctctttttactgctgggcacggtgatgaccggcctgtttctcggtcgccgcacaaatcctggtgccgctggccgccacgctggcagagccggagcggcgcggcaaaatcgtgggaacggtaatgagcggtttgctgctggggattctgctggcgcgcaccgtggcaggcggcctggcgcagcttggcggctggcgtaccgtctactggactgccagcctgctgatggtggtgatggccctggcgctgtggcgatcgctgccgcgcgtgaaacagtccgtgcccatgagctatccgcaactgctggcctctatttttcgcctgtatgccggtaatcgggtgctccgcacccgcgcctggaccggctgcctctcctttgccaatttcagcctgctgtggacctcaatggcctttctgctcgccggggcgccctatcacttctcagagggcgagattggcttgctggggctggtcggtgccgcgggtgcgctggccgcacgtcaggcgggcgcgctggctgacaagggtaaagcgaagctgaccacccaactgggcctgctgcttatgctgctgtcgtgggctgccattgcgtggggcgcggagcagcttgcgccgctgatcgtcggcatcctgctgctggatctggcggtacaggccgtccatatcaccaatcaaagcgtgatctacgcgcagatgccggaggcgcggaaccgtcttaatgccggttacatgaccagctactttatgggtggcgcggccggctcactgctctccgcgaccgcttaccatctttggggctggtatggcgtctgtggcgctggcgcgctgctgactgtggttaatctgctgatttgggcagccggatcgcgctttgagccggaaaaaatcaactgaagcctggccggacagcgcattgcgtctggtcacaaatggttaggtttgttatggttagtagcaaacctattcacttcagttatttttccccgcgatattattaaatttgccccctttttgatcacgttccggcacagcggctgccgccggacgtacgggtttttgacccagggccagggaatggcctggaatacctttgatggtgaatagtgattctgtcagcgatcacctgccaaaaagtgactacgcttatcctgtcaccatagttattatacaagttgcaattagtgaggttttttttaatggaaagttcgtttactcccattgagcagatgctaaacatccgtgccaatcgccacaaggattttccgttacaggaaattattctgacgcgtctctgtatgcatatgcagggtaaactgctggacaaccgcaataagatgctgaaagcacagggtattaatgaaaccctgttcatggcgttgattacgctggatgcacaggaaaaccatagtattcagccctctgagctcagctctgcccttggctcttcacgcaccaatgccacgcgcattgctgatgagctggaaaagcgcggctggattgagcgtcgcgaaagcgatcacgaccgtcgctgcctgcacctgcatctgaccgataaagggatggagtttcctgcgtcagctgctgccacctcagcatcagagcctgcagtacctctggtcgtcgctctccgtcgatgagaagtcgcagctggaaggcatcacccgtaagctacttaatcgtcttgataaaatggatgaagatcagctgatcgcctcgctttcccgctaatagcaataagtgcgacacaatcacctgtcggaatcgttattttaatttccttttttatctggccagcgctcagtcgctggctttttcgactcgggcgctggcgaaaaggaatttctgccgcccgactaaatggaaaacgtggagaaagacatgagtgcaacggcagaagcacaaagcccgcaaccgtcagccaacaaaaagaagaagcgcaaaagtgtgctcatcgtgctggcgctgatctttgtgctgattggtattgcctggggagtttactggttcctggtcctgcgccattttcaggaaacggatgacgcctacgttgcgggtaaccaggtgcaggtgatggcacaggtctccggtagcgtgaataaagtctggtttgaagataccgatttcgtcaaaaaaggcgatgtgctggtttcactggataagacggatgcggagcaggcgtttgaaaaagcgcagacggcactcgccaccagcgtgcgtcagacgcatcagctgatgattaatggcaaacagtatcaggccagcattacattgcaacagaccgctctggcgcaggcacaggccgacctgaaacgccgtgagccgttaggtgcggctaatctgattggccgtgaagagttgcagcacgcccgcgatgccgtcgcgacggccaaagcacaactggacgtggcgattcagcaatacaatgcgaatcaggcgatgatcctcaacacctcactggaaaatcagcctgccgtgcaacagagcgcggctgagctgcgtgacgcctggctggcgctgcagcgcaccgaaatccgtagcccgatggatggttttgtctcccgtcgcagcgtacaggtcggttcgcaaatctccaccagcaccccgctgctcgccgtcgtgcctgcaacgaatctgtgggtcgatgccaactttaaagagacccagctggctggcgttcgtattggtcagcctgtcaccgtggttgccgacatctacggtgacgaagtggtttatcagggcaaagttgcaggactggatatgggcaccggcagcgccttctcactgttgccggcacagaatgccaccggtaactggatcaaagtggttcagcgcctgccggttcgtatcgaactgaatcaggaagatatcgccagacatccgctgcgtattggcctctcaacgctggttaaaatcgataccaccagcaaagagggcagcgcgctggccaccagcgcccgtcagcaagccgcttacagcagcaacgcactggcgattgaccttgcgccggtcaatcagctgatcaccgatatcgtccgcgccaacgccggatgatgacgcggaggctgtaatggcacaaaaaccgcttgaaggaatgccgctggtcctgatgaccattgcgctatcgctggcgacgttcatgcaggttctggactcgaccatcgccaacgtggctattcccacgattgccggtaatctgggggcgtcgaactcccagggaacctgggtgatcacctcgtttggtgtggctaatgcgatctcgatcccgctgaccggctggctggcaaaacgcatcggtgaagtgaagctctttacctggtcgaccattctgtttgctatcgcctcctgggcgtgcggcatgtcagacagcctggagatgctgatcttcttccgcgtcattcaggggatcgtcgcgggtcccttgatcccgctgtcgcaaagtctgctgctcaacaactatccgcccgccaagcgcagtgttgcgctgtcgctgtgggcgatgacggtgatcgtcgccccaatctgtggcccgatactgggcggctggatcagcgataactatcactggggctggatcttctttatcaacgtgcccattggtgtggcggtggtgatactgacgctgcaaaccctgcgcggccgggaaaccaaaaccgaaatccggcggatcgatatggtcgggctggtgctgctggtggtggggatcggctgtttgcaggtgatgctggaccgcggaaaggagctcgactggtttaactcgtccgagattatcgtgctcggggtagtggccgtgattgcgctgtcagtcctgctggtgtgggagctgactgacgatcacccgatcattgatctgtcgctgtttaagtcgcgcaacttcaccattggctgcctgtcgatcagtctggcttatatgctctacttcggctcgattgttctgttgccgcagctgctgcaggaggtctacggctacaccgcaacctgggccggtctggcgtctgcgccagtgggcattttgccggtgatcctgtcgccgatcatcggacgctttgcccataagctcgacatgcgacggctggtcacgttcagcttcattatgtatgccgtctgcttctactggcgcgcgtatacgtttgaaccgggaatggactttggtgcctcagcctggccgcagtttattcagggctttgccgtggcctgcttctttatgccgctgaccaccattacgctgtcgggactgccgccggagcgcatggccgctgcctccagcctgtcgaactttatgcgtacctttgcaggctcggtgggaacgtcgattaccaccactatgtggagtaaccgcgaatcgatgcatcatagctacctgacggagtcgatcaccccttacaacgtcaattcgcagcagatgtatagccagctggagagcatggggatgacgcagcagcaggcgtcggcctggatcgcgcagcagattactaaccagggactgattatttcagcgaatgaaattttctgggcgtcggcgggggtctttttgattctgctggtgctgatctggtttgcccgtccgccgtttagcgcaggcggcggtggcggtggcgcgcactgatgtgacacagcaaaacgggcctttcggcccgtttttttatgcgttctgacgccaccattcggcgagcagtacgccggttgcgaccgagacgttaaggctttctacgttgccggtgccgccaatcgacaggctcatgtcaccctgtttgaacgcggtatcagagagaccttcacgctcctgccctaacaccagcaccattttctccggcagctgagcctgcgccagcggcgtgccctgatggctggaggtggtgacgatggtgtaacccgctttacggaacgcttccagaccttcactgaaggttgcgccgctgatagcctgcacatgctcagcaccgccttctgcggtacgtaccgctgcgcctgactccagcagcgaggcgtcgttcaccagcaaaccttttacgccaaagtgcgcgcagctgcgcataatcgcgccgaggttatgcgggttgctgacatcttccagtgccagcacgcaatctttggtattcgcctggctcagccattcagaaaccgccatacccatgcgctttttgatcaggaagcagacgccaccatgatgctcagtgcctgacgctttggtaatctctgcatcttccacgacgtgataggctttgcggttagccgccagccagcgcagcgcttcgcggaaacgcggagtcacttcctgcacgaaccaggcgcgaacaatagcttcaggacggctctggaacagcgcctgacaggcgttctcaccatagacgcgcgtctcttcgttgcgctgacgacggatctgctcgggatcgacgaagctcttgccgctgatgccgccgtgatccggcttatcgctttcggttgccggacgatctgctgatggcgcgcgtgacacggtgcgccatggggaatcgctgctgccataggcgccgcgattatcatcgccacgatcgttgcggcggcctgcgccatcgtctgaacggcgtggagcgccacgtccgccttcatcacgacgcggtgaactgctgcgaccggtgtcgtcgctgcgacggccagcggagcgaccaccttcctgactgcgttcagtacgggggccagacgaacgacgattatcatccgaacgggcagcagcgtgaccacctttgcctgtacgaggattaggcgcgcgcgcgcttttatcgtcctcgccacgcacgtacatcaccttaaccttaccgctcttgcctttaaattcgtcgttcatgtcttcctcctgcattgagagcgcgcagattacctgatgtgctggcgcttagctatcaactattgaacctatcgagcaatccagattgagagggaatccgtcccctttcataatgaacaatatttatcagactgacacttttcaacatcagaggttcctatgaatacggtatgcgcttcctgtcaggcaaccaatcgcgttcctgaagaacgccttgccgacgtggcgaaatgtggtcgctgtggaaatgcgttatttgatggcgaagtggtgaatgccaccagcgctaactttgacaaatatctgcaggatgatctgccggtggtgatcgatttctgggcgccctggtgtggtccctgtgtcaattttgcgccggtgtttaaagatgtcgccagtgaacgcagcggtaaagtccgctttattaaagtgaacaccgaagcggaaccggccctgagcgcccgtttcaacattcgcagtatcccgaccatcatgctgtttaagaacggcgagcgggtcgacatgctgaatggcgcgatgcccaaagcgcctttcaatgaatggctggatgagtcactttaatcttcagaggccagcctggctggccttttccttttcgcgtgtgcttcgattacactgacgtttttcctgccctgaatactcatgtctgataatgctgttttgcgcttgcgcacccaacgcctggcccgatccacccgtcctttcctcgcgcgcggcaatcgggtcatccgctgtcagggctgcctgctgccagaggtcaactgtctctgcagtcagatcgtgccgcagtccgcccgtagccgcttctgcctggtgatgttcgataccgagccgatgaagccgagcaacaccggccggctgattgccgatattctgccggaaactcaggcttttggctggtcacgcaccgagccggatccgctgctgctggcggcggtgcgcaatcccgattatcagccgctggtggttttcccggccgcttatgccgaccccggtcgtgaagtgctgacaatgccgcccgtcagtggcaagccgccgctgtttattatgctggacggcacctggaccgaagcccgcaaaatgttccgtaaaagcccctggctcgacgccctgccggtgatgtcgctggatgtcagcaccccgtcgcgctatacgctgcgtgaagcccacggcgcaggtcagcactgcactgctgaagtggccgcggcgctgctggcgcaggcgggcgatcggctggcggctgaggcattatctcaccattttgatcagttccgcgcagcctacctggcagggaaaccgcaccacgccggacaggcttaatcgcccagtcacgctcctggcgggagcgtccctgcggtgacagagattaaaatcggaatgcgcagcctgcgatctgcccggaagcactgccagcaaaaagcgtttacaatcacgcaaatcccgaactctggagagcgagatgagccaacgcggactggaagcgctgttacgacctaaatcaattgcggtgattggtgcctcggtcacgccagggcgcgccggatactttatgatgcgtaacctgctggcgggcggttttagcggcccggtgttgccggtgacgccaaaatataaagcggtcagcggcgtactggcctggcccaccatcgacagcttacctttcgcgccagacctggcagtaatctgcacccactcaaaacgtaacctcgaactgctacaacagctcggggagaaaggctgcaaagcctgcattattctctctgcgcccgccagccagtctgccgaaactcaaagcctgcgccagccagtggcagatacgtctgctgggaccgaacagtcttggcctgctggccccctggcagggattgaatgccagcttctcgccagtgccgatagagaaaggccgtattgcatttatctctcagtccgccgccgtatccaataccattctcgactgggcgcagcagcgtaatctcggattctcctggtttatcgcgctgggtgacagtctggataccgatgtcgatgatctgctcgacttcctggctcgcgacggtaaaaccagcgctatcctgctctatcttgagcacctcagcgatgcgcgtcgttttgtttctgcctcacgcagcgcctcccgtaataaaccgattctggtgatcaagagtggtcgcagccgggaagcacaggcgctgctgggcacccacagcggtctggacgccgcctgggatgcagccattcagcgtgccgggttactgcgggtgcaggatacccatgagctcttctccgccgttgagtcgctgagtcatatgcggccgctgcgtggcgacaggctgatgatcatcagtaatggtgccgcccccgccgcgctggcgctggatgagctctatgcccgcaacgggaaactggcgcagctcagcgagcagacgattcagcagctcgaggcgctgttgcccgctggcgcaggccgcggtaacccgctggatttaaaagatgacgccacagcggaacgttatgccgcctgcacagagatcctgctcgacagccatgaacttgatgcattgatgattattcatgcgccaagcgcggtcgcgcccgcgactgaaacggccggacatctgatcgacaccatcgcccgtcacccgcgcggtaagctggtgacgctgctgaccaactggagcggcgagttctcttcacaagccgcgcgccgagcctttacgcaggcggggataccgacctggcgcacgccagagggaacggtgaccgcctttatgcatcaggttgagtaccgccgtaaccagaagcagctgcgcgaaacccctgccctgcccgccaccctgaacctggacagcgcccatgcacaccagctgctgtcacaggcgctggagcgcggtgttaccgcgctggatacccacgaagtgcagccggtgttgcaggcttacggcctggccacgctgccgacctggatcgccagcgacagtaaggcggcagtggcgattgccgatcagattggctatccggtggcgctgaaactgcgttcacccgatatcgcgcataaatcggaggtgcagggcgtgatgctctacctgcgtaatgccagcgaagtggagcatgccgctgaggccatttttgatcgggtaaaacagacgttaccgcaggcacgtatcgaagggctgctggttcagagcatggcgagtcgtgcaggcgcacaggagctgcgggtcgtggtcgaacaggatgccctgtttggcccgatcattatgctgggggaaggcggcgttgaatggcaggccgataaacaggctgccgttgcccttcccccgctgaatatgacgctggcacgctatctggtgattcaggcgatcaagagcggaaagatccgcagccgcagcgcgctgaatccgctggatatccccggtttaagccagctgctggtgcaggtctctaacctggtggtggattgcccggagatccagcgactggatattcatccgctgctggctgcgggcaatgattttaccctgctggatgtcaccctgacgctggctccgttccacggcgataacgaagcacggctggcaatacgtccttatcctcagcatctggaagagcaggtagagttaaaggatgggcaattctgcctgttccggcccattctgccagaggatgagcccctgctgcgcgatttcatcagtcaggtcaccaaagaagatctctactaccgctacttcagtgaaatcagtgagtttactcatgatgatctcgccaacatgacccagatcgattatgaccgcgagatggcgattgtggcggtacgtcagcatcatggacgatccgagatcatcggcgtcacccgcgctatctctgatgcagataacattgatgcggagttttcggtgctggtccgttccgacctgaaaggcttaggcatgggccgtcgtctgctggaaaaaatgatccgctatacccggcatcacggcttgcaacaattgaacggtatcaccatgccccataaccgcggcatgattacgctggcacgaaagctcaactttcatgttgatattcaactggatgacggtattgtcagcctgaaattgtctttacagaatgagatcaactaaccttgtagagaaaggtaaaaaacgttcgaatcggcgaagttgatgttattatttgtggttataaccctgatttgatggcaaaaggccatgcaatgaacagagaagaagtgcactgtgatgttgtctaaatttaaacgtaacaaacaccaacaacacctcgcacagctgccgaaactgtcacaatccgttgcggatgtgtcgacactttactcgcctgccgaatttcgccagacgttgctggagaagattgcggcagcgcagactcgcatctgtattgttgcgctctatctggaaaatgatgacgccggacgtgccgtcatggatgcgctttatagtgcgaagcaggcgcggccggagctggatatttcgattctggttgactggcaccgtgcgcagcgtgggcgaattggcgcagcgcgaggcgtaaccaatgccgactggtattgcgaaatggcgacacgttatccggatattgccatcccggtttatggtatcccggtcaatacccgtgaagcgctgggcgtgctccaccttaaagggttcattattgatgatatgctgctctacagcggcgccagcatcaatgatgtctacctgcatcagcatgataagtatcgctatgaccgttatcaggttatccgtaattcccagctgacagatacgatgtatgactggatcacgctcaatctgaagtcagcagaggcggtaaaccgactcgattttgctgagcgcccctcaagtcctgaaattaaaaatgagacacgccagttccgtcaggacctgcgcggtttcaattatcagtttgaagggaatgccggcaacgatgaactgacggtcacgccgctggtcggtctgggtaagcatagcctgctcaataaaaccattttccacctgatgccctgtgcggaacagaagctgatcatctgtaccccctacttcaacatgcccgccttgctggtacgtaatatcattcatcttctgcgtcagggaaaacaggttgagatcatcgtcggcgataaaacagccaatgacttctatattgcgcccgatcagccgttcaaaatcatcggcgcactgccttacctgtatgaaatcaatctgcgtcgctttatgagccgtttgcactactacgttacgaccgatcagctggtcgtgagactgtggaaggatggcgagaacagttatcaccttaaaggaatgtgggttgatgatgaatggcagctgattaccggtaataacctcaatccacgtgcctggcggctcgatctggaaaatgcggtgctgatccacgatcctcatcaggagttagcggctcagcgtgagaaggaactgacgttaatccggcagaaacacaacggtagtgacgcatttccgtgagcttgagagtattgctgattacccggccaaggtgcgcaaactgattcgccgtctgcgccggatacgtatcgatcgcctgatcagccggattctttaatcactgcggccaataaggcatctgctatgcgaagtgtgctgcttgctgtgttgttgtgtagcggatgcgcccatatggcggaagatcagtggaccggacgggataaagcggagcattttgtcgcctctgcagtcctggccgctgccggtagtgaatatgggaaggcagcgtcagcaccattctgaccggcaaagccagactgttttcattaacgcctggggcgggaaaagagtggtatgacagccgcccgaatggcagcggctggagctggaaagatttcgcctgggatgccgccggtgctgccagcggcattgccctgtggaatcagagtcagtagctttctctgttaaagcttaatccccttaccgcgcttgtgcagcaacagcgacaccagaaatgccaccgcgcccatcgctgaaacataccagaagaaagtcgtctcaatcccctgctgcttcatcagcaacgcaacatactctgccgacccaccgaagatcgcattcgctactgcgtaagatagtcctacacccagtgcgcgcacctgtggcggaaacatttctgctttaagaatgccactgatggcggtgtagaagctggtaatcagcagcgccagcatgattaacaggaaagccacaccgggactttgcacgttttgcaacagggtcagaatggggaccgtacagatggccgcgcccgcgccaaaaatcatcattgaggtgcgacgaccgattttatctgacagggcaccgataatcggctgaatcagcataaagaccagcagcgcaccggtcatcaggccgctggcggttttaggatccatacctgacgtattaaccagatacttctgcatgtaggtagtgaaggtgtaaaaactcagggagccgcctgcggtgaaacccagcaccatcaggaagggacgagtatgattacgcagtaacccgattacgctacccgcatcgcgatgttcgcggctcgtcttatctgaggtctcttccagtgagcgtcgtaaccataatgcgacaacggcgaggagtgcgccgaggaagaacggaatacgccagccccagcttcgcagtttctgcatccgtcagcaaaaattgcaggaccacgacggtgagtaccgccgctaactgaccacctatcagcgtgacatactggaatgaggcgtagaatcctttgcgtccttccagagccacttcactcatgtaggttgcgctggtcccatattctccgcccaccgataatccctgaaacatacgcgccagcagcagaatgacgggcgcagccacgccgatcgttgcgtaaccgggtaagcaggcgatcaccagcgaaccaaaacacatcatgcagactgaaaccagcatcgaattttttcggccatgtttgtcgccgatatagccaaacagccagccgccaatcggacgcattaaaaatcctgccgcaaaaacgcccgctgtctgtaacaactgagtggtggtatcgccctgcggaaagaaaatgtgggcaaaatagagtgagaagaaggagtaaacgtagaagtcgaaccactcaaccaggttacctgatgacgcgccgacgatagcccagatacgtttctttgtatcatccgtctgagttttattatttgtaggtgccatgccttacctctgttccttgctgatcagcagcgtttaaaggagtgagtaaagcatttaagtctactgaaggtaaaggcggcgtaatccgagattattattgtgagccatgtcgctaattatcgaaaaatcagcgggttgctggtcattcagaagtggagaatggggagttaagggtgacataccgcgtgcctgcaggtcatattttcagcttaaagtggcaaagcgcagacgtaaaaaagccccgcacttccgtgcggggcttcttcacttatttaatgcctggcagttccctactctcgcatggggagaccccacactaccatcggcgctacggcgtttcacttctgagtttcggcatggggtcaggtgggaccaccgcgctaaagccgccaggcaaattctgtctccgcgccgcccgtaaggccgcgcagatatatccggtacaggctgaaaatctgtctctcaaaaacgcctctggcgttgtaaggttaagcctcacgggtcattagtaccggttagctcaacgcatcgctgcgcttacacacccggcctatcaacgtcgtagtcttcaacgtcccttcaggactctcaaggagtcagggagaactcatctcggggcaagtttcgtgcttagatgctttcagcacttatcttttccgcacttagctaccgggcaatgccattggcatgacaacccgaacaccagtggtgcgttcactccggtcctctcgtactaggagcaacccccctcaattctccagcgcccacggcagatagggaccgaactgtctcacgacgttctaaacccagctcgcgtaccactttaaacggcgaacagccgtacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctgctttcgcacctgctcgagccgtcactctcgcagtcaagccagcttatgccattgcactaacctcacgatgtccgaccgtgattagctgaccttcgtgctcctccgttactctttaggaggagaccgccccagtcaaactacccaccagacactgtccgcagcccggattacgggcctacgttagaacatcaaacattaaagggtggtatttcaaggttggctccacgcagactggcgtccgcgcttcaaagcctcccacctatcctacacatcaaggctcaatgttcagtgtcaagctgtagtaaaggttcacggggtctttccgtcttgccgcgggtacactgcatcttcacagcgagttcaatttcactgagtctcgggtggagacagcctggccatcattacgccattcgtgcaggtcggaacttacccgacaaggaatttcgctaccttaggaccgttatagttacggccgccgtttaccggggcttcgatcaagagcttctccttgcggataaccccatcaattaaccttccggcaccgggcaggcgtcacaccgtatacgtccactttcgtgtttgcacagtgctgtgtttttaataaacagttgcagccagctggtatcttcgactggcttcggctcggggagcaggtccctccacctacgcgccagcgtgccttctcccgaagttacggcaccattttgcctagttccttcacccgagttctctcaagcgccttggtattctctacctgaccacctgtgtcggtttggggtacgattctgtgttacctgatgcttagaggcttttcctggaagctgggcatttatcacttcagcaccgtagtgcctcgtcgtcacgcctcagcgttaacaagcgtccggatttacctggacactccgcctacacgcttaaaccgggacaaccgtcgcccggctgatatagccttctccgtccccccttcgcagtaacaccgagtacaggaatattaacctgtttcccatcgactacgcctttcggcctcgccttaggggtcgactcaccctgctccgattaacgttgaacaggaacccttggtcttccggcgagcgggcttttcacccgctttatcgttacttatgtcagcattcgcacttctgatacctccagcatgcctcacagcacaccttcgacggcttacagaacgctcccctacccaacaacgcataagcgtcgctgccgcagcttcggtgcatggtttagccccgttacatcttccgcgcaggccgactcgaccagtgagctattacgctttctttaaatgatggctgcttctaagccaacatcctggctgtctgtgccttcccacatcgtttcccacttaaccatgactttgggaccttagctggcggtctgggttgtttccctcttcacgacggacgttagcacccgccgtgtgtctcccgtgataacattcttcggtattcgcagtttgcatcgggttggtaagccgggatggccccctagccgaaacagtgctctacccccgaagatgagttcacgaggcgctacctaaatagctttcggggagaaccagctatctcccggtttgattggcctttcacccccagccacaggtcatccgctaatttttcaacattagtcggttcggtcctccagttagtgttacccaaccttcaacctgcccatggctagatcaccgggtttcgggtctataccctgcaacttaacgcccagttaagactcggtttccctgcggctcccctatacggttaaccttgctacagaatataagtcgctgacccattatacaaaaggtacgcagtcacccccataaagaaggctcccactgcttgtacgtacacggtttcaggttctgtttcactcccctcgccggggttcttttcgcctttccctcacggtactggttcactatcggtcagtcaggagtatttagccttggaggatggtccccccatattcagacaggataccacgtgtcccgccttactcatcgagctcacagcatgtgtgcttttgtgtacgggagtatcaccctgtaccctgcgactttccagacgcttccactaacacacaagctgattcaggctctgggctgctccccgttcgctcgccgctactgggggaatctcggttgatttcttttcctcggggtacttagatgtttcagttcccccggttcgccttgcagcactatgtattcatgctgcaatgatgcacagagtgcaccgggtttccccattcggacatcgacggctgtagcggttcatatcaccttaccgtcgctttacgcagattagcacgtccttcatcgcctctgactgcctgggcatccaccgtgtacgcttagtcgcttaacctcacaacccacaggcgtttttcaacgctgcgtgttgcaagcatttgagagactcgaacgcatcgctttgtcattccttattacggaggaataacgcgctgcgtcgtttcaattttcagcttgttccggattgttaaagagcataatacgtcgcagcacaccgtcgccggtatgctctgaggtatttcagaaaaaacagataaacggtatggtggagctaagcgggatcgaaccgctgacctcctgcgtgcaaggcaggcgctctcccagctgagctatagccccatacagttactgcagagaccactactaccactcaaccgagtacacttcgtgagaaatgtaattcgtgctcaggcaaggcatgtttccgcgaagcatagtgaactatgcgagccggagacataacgcagcgtgagtgcgaatttggtaggcctgagtggacttgaaccaccgacctcacccttatcaggggtgcgctctaaccacctgagctacaagcctgtagaggttttttctgctcgttactttttatcagacaatctgtgtggacactgcgcgggaaggtatcttcaggtaaggaggtgatccaaccgcaggttcccctacggttaccttgttacgacttcaccccagtcatgaatcacaaagtggtaagcgccctcccgaaggttaagctacctacttcttttgcaacccactcccatggtgtgacgggcggtgtgtacaaggcccgggaacgtattcaccgtggcattctgatccacgattactagcgattccgacttcacggagtcgagttgcagactccgatccggactacgacgcactttgtgaggtccgcttgctctcgcgaggtcgcttctctttgtatgcgccattgtagcacgtgtgtagccctactcgtaagggccatgatgacttgacgtcatccccaccttcctccggtttatcaccggcagtctcctttgagttcccgaccgaatcgctggcaacaaaggataagggttgcgctcgttgcgggacttaacccaacatttcacaacacgagctgacgacagccatgcagcacctgtctcagcgttcccgaaggcaccaaagcatctctgctaagttcgctggatgtcaagagtaggtaaggttcttcgcgttgcatcgaattaaaccacatgctccaccgcttgtgcgggcccccgtcaattcatttgagttttaaccttgcggccgtactccccaggcggtcgacttaacgcgttagctccggaagccactcctcaagggaacaacctccaagtcgacatcgtttacggcgtggactaccagggtatctaatcctgtttgctccccacgctttcgcacctgagcgtcagtctttgtccagggggccgccttcgccaccggtattcctccagatctctacgcatttcaccgctacacctggaattctacccccctctacaagactcaagcctgccagtttcaaatgcagttcccaggttaagcccggggatttcacatctgacttaacagaccgcctgcgtgcgctttacgcccagtaattccgattaacgcttgcaccctccgtattaccgcggctgctggcacggagttagccggtgcttcttctgcgggtaacgtcaatcgacagggttattaaccctatcgccttcctccccgctgaaagtactttacaacccgaaggccttcttcatacacgcggcatggctgcatcaggcttgcgcccattgtgcaatattccccactgctgcctcccgtaggagtctggaccgtgtctcagttccagtgtggctggtcatcctctcagaccagctagggatcgtcgcctaggtgggccattaccccgcctactagctaatcccatctgggttcatccgatagtgagaggcccgaaggtccccctctttggtcttgcgacgttatgcggtattagccaccgtttccagtggttatccccctctatcgggcagatccccagacattactcacccgtccgccactcgtcacccaagagcaagctctctgtgctaccgtccgacttgcatgtgttaggcctgccgccagcgttcaatctgagccatgatcaaactcttcaatttaagtttgatttgcttaaacaagttaagcgttgctcatctgtaaaacgtcataatgaatttcattatgtgttcactcgtgaggcttgatatttttttacgtccggagacgctgatatcaatcctgcgagtgcccacacagattgtctgataaattgttaaagagcagtgcgaacagtgcgttagcgtcctgtcgcgaggtggcgtatattacgctttcctcctgcagagtcaacctctatttcagaagtttttctccggcggcgcagtctcctgtgcctcctgacccgttttccgttgccggtttgccgtgtcagtggaggcgcattatagggaacggctcagatagcgcaagtgcaaattgagacttttttactgaccgttcattttgcactcaaaaggagtattaaataagcaaaaacccctcaaaagggcaaaaaaaacgggccagaggcccgtttttcattccacacccttactgatgtgcagtaatgatgttgttctccacatccatttcgatggttttgcctggcaccagcgaaccggcaaggatctgctgagccagcgggttctcgatctgctgctgtatcgcacgtttcagcggacgtgcaccgtagaccggatcatacccgttctccgccagcagtttgatcgcatcatcagagatgtgcagctgataaccccgttcatccagacgtttgtacagccgctgcagctgaatctgcgcaatggacgcaatatgtttctcagccagcggatggaacaccaccacctcatcaatacggttgacgaactcaggacggaaatgctgtccgaccacacccatcacgatatctttcatttccgggtaactgagattgccgaaccgctcctggattaaatctgatcccaggttagaggtcataatcaccacgctgttacggaaatcgaccgtccggccctgcccatccgtcagacgcccatcatccagcacctgcagcagaatgttaaagacatcagggtgcgctttctctacttcatccagcaggatgaccgaataaggccgacggcgcacagcttcggtcagataaccgccctcttcatagccgacataacccggaggtgcacccaccagccgtgatactgagtgtttttccataaattcggacatgtcgatacgaaccatcgcatcgtcactgtcgaacaggaaattagccagcgctttacacaactccgtcttaccgaccccggttggccccaggaaacaggaaggaaccgataggccggtttggatcagaaaggcctgcgcgactacggcgaatagcatttgataccgcctcaaccgcttcatcctgtccgatgacccggccatgtaagtcctgctccatgcgcagtaacttatcgcgctcaccttccatcattcgtgcgaccgggataccggtccagcgtgccagcacatcggcaatctcaacatcggttacccggttacgcagtaacttcatggtcttgccttccgcctgagtcgctgcggctaactgtttttccagtgccggaattttaccgtactgcagctctgacatctgagcgaggtcaccctggcgacgtgcctgctctaaattcagacgcgcctgctcaagttccgctttaatgttctgcgtgccggacagcgaggctttctctgtcttccactcatcttccagctcggcgtattcgcgctctttctggttgagctcggtttccagcatctcaagacgcttgatgctggcatcgtccgcctctttcttcagcgcctgctgctccagcttcagctgaatgatacggcgctcaaggcgatccagtgactccggcttcgagtccatctgcatacgaatgctggaagctgcctcatcgatcaggtcaatcgctttatccggcagctgccggtcagcaatataacgatgagacagggtcgccgccgcgacaatcgccgggtcagtgatttgcacatggtgatgcagttcataacgctctttcagaccacgcagaatggcgatggtatcttccacacttggctcagccacaaagactttctggaaacgacgctccagcgcggcatctttttcaatgtactggcgatattcgtcaagcgtagtggcacccacacagtgcagttcaccacgcgccagcgcaggtttaagcatattgccggcgtccatcgcaccgtccgctttaccggctcccaccatggtgtgcagctcgtcgataaacagaatgacgttgccttcctgtttcgacaggtcactcagtacgcctttcagacgctcttcgaattcaccgcgatatttcgccccggccaccagcgcacccatatccagtgccagtacccgacgtcctttcagaccctcaggcacttcaccattgatgatgcgctgcgccagcccttcgacaatcgcggttttacccacgccaggttcaccaatcagtaccgggttgtttttggtacggcgctgcagaacctggatggtgcggcgaatctcttcgtcacgaccgatgaccgggtcgagtttgcccttctctgcccgctcggtcaggtcgatagtgtatttttttaaagcctggcgctgatcttcagccccctgatcgttcacgttgtctcctccccgcatctgttcaatcgcactggtgattttttcgcgcgttgcgcccgctgctttgagcagatcggccagtgagccccgcgattccagcgcggccagaacaaataattcggatgaaataaagttatcgttgcgcttctgcgccagcttgtcgcacaggtttaatacccggacgaggtcagatgagggttgtacatcgccttcgctgccttcaacttgtggcaggcgatcaatagcctgctcaacctgagcgcgaaatggcgtaacgtcgacaccggccgaagtcagtaaaggtgaaaccgatccgccttcctgtttgagcaatgcgctcatcagatgcagaggttcaatgaattgattgtcgtgtcccagagcgagggactgcgcgtcggcgagagccagctgaaatttattagtaagacgatccagacgcataattcctcccattacaggtcaaaatgctactggagattaaatgaggtcatccctcaaaatttcaaggttaatgacctgagatttgagtaaaaaatacgctaactggaccgtcttatggcgtaaggttataacagccagatcaaagttgccatacgcccggtgatcccatcgcggcggaaagagaagaaatcgtcgcgctgcgtaaaggtacaaaggctgctggcgctgactgaattcacgcccgctgcctgtagtcgcatctgcgccagcaggccgatgtcggcgtaaaagcggtcacctgatggacggaaagcctgcacagcccggggatcctgagccataaaggcctgacggacttcttcgccgacctcaaacgcatcaggtccgattgccggtccaagccaggcatgaatctgatcaggcggcgaacgaaactgcgccagcgtattttccagtacacccgcacaaagtccgcgccagcctgcatgtgccgccgccacttccgtgccatcctgcgaacagaaaacaggaccggcagacagtcagcggtcatgatggcgcagacaacaccgggctgatcggtaatacaggcatcagcacgtaatggcgtacttccccctgcagtcagacgcacaacctcagtgccatgaacctgatccagccactgcggcatggcaggtaaacccgcctcttccaacagcaactgccggttacgcgccaccgcatccggattatcccccacgtgcccgccgagattcagtgcatcccagggcgatgtgctgatgccgccctgtcgctgcgtcgagcaggcccgaacgcgtgacggagcgggccattgaggagtaatcagattcatcaccaattcaactggtctttaaattcttcagtgtctgcttttaacgccgcgatgagatcaaccatgtcctgcggaagcgcagcatggaattccatttcaataccgctaatggggtgatagaggcgcaacatcgtggcgtgcagtgcctgacgatcgaaaccgcgcagcgtagtaataaatgcttcagacgcgccttttggcggacgcggacggccaccgtaaagcggatcgcccaccagcggatggctgatgtgagacatatgcacacggatctggtgagtacgaccggtttccagacgcaggcgcagacgggtatgggcccggaagtgctccatgatgcggtaatgcgtgaccgccggtttacccattgggtgtaccgccatgtgggtgcgtttggttgagtgacggctgataggctgctcaacggtgccgcccgcagtcatattgccaatcgcaaccgcttcatattcacgggtgatttcgcgacgctgcagcgagtccaccagatgcgtctgagccggaacggttttcgcgaccaccattaagccggtggtgtctttatccagccggtgtacgatgcccgcgcgcggcacatccataatcgccggatagtgatgaagtaaggcgtttaacaccgtgccatccggattaccggcgccagggtgaaccacgaagtcgcgtggtttgttgatgacaataatgtcttcatcttcataaacgatgtcgagtggcagattctgcggttcccagcgctgcgcctcctcgatctcagcgtcaatcgcgaccagctcgccgcccagcactttttctttaggtgtatcgaccatgacgccgtttacagtaacgcgacgatcgaggatccactcttttatgcgagaacgtgaataatcagggaacaattccgccaaagtctgatctaagcgttgtccgagttgtgattcggataccgttgcggtgagttgaacttgttgtgccatatacagcttcttcgttaacgttgggttttcacggcgatgccgtttaatataatgtgctatcgtacctggtcattaccgggagctatacggacagcttccgccataacatttgaggataatcacttcgtcatgacgcgtatgaaacatctggtggctgctgccacactgagcctggcacttgttggttgttccggctcaaatgacgcggtaccggacagcccgccttctgaaatctatgctacagcgcagcaaaagctgcaggacggtaactttaaagctgcgattaagcaactggaagcgctggataatcgttatccgttcggtccttattcgcagcaggtgcagctggatttaatctacgcgtactataaaaatgccgatctgcccctggcgcaggctgccattgctcgctttatgcgtctgaaccccacgcatccgaacattgactatgtcatctatatgaaaggtctgacggacatggcgctggatgactccgcgctgcagggcttctttggtattgatcgttctgaccgcgatccgacgcacgctcgtgatgctttccgcgacttctctcagctgctgcggagttacccgaatagccagtatgcggctgatgctcagaaacgcctggtctatctgaaagaccgtctggctaaatatgagctgtcagtggcgcaattctatactaagcgtgaggcttatgtcgcggttgttaaccgtgtcgaaggtatgatgcgcgattatccggatacgcaggcaacacacgatgccctgccgctgatggagaatgcttaccgcaatctgcagctgaacgctgaagccgataaagtggcgaaaatcattgcagctaacaaaagctgatcgttcgaaggattttcagccataaaaaaagcagcctctcagggctgcttttttttgctcacagaacagtcagatttggatctgttctcagcgagctaactcatcaagcatgccgtgttaatcgtttcgcttcaagccatttcggccagtttctctgcatttctcacagaatgttgtgactgacaaaaagtgacattttttcgtgatcgaaatcccacattgaacgctttttcgcgctatgctgagaagaccaagacggaaatgacagagaggtaagaacgatgattctgaacattaccagtaaacaaatggacatcactccggcaatccgaagccatgttgaagaccgtctcgccaagctcgaaaaatggcaaaccgacctgattaatccacatattgtcctttccaaagagcccaaagaattcgtggctgacgccactattaacacacctaacgggactctggtggccagcgccaagcacgatgatatgtataccgctatcaacgatttgattgccaagctcgagcgtcagctgaataaagttcagcacaagtctgaagcacgccgcgccagtgccagcgtgaaagacatcattcccgccgacgaagagtcctgattttcttaacgctgtttcttaacgcgcctccgggcgcgttttttattgacagcttttaagcagtacggttactctcaggtcactctcttttcggacattaccatgaaacttgatctgtttttcttcgctttcttttttaccttcccctgaacgggaggccattcgtcgtgtgaaaatgaaagcgaagacgaacaccgaagcctcccaaccgggaggctttttttttggatagcatacaggtgagccctatgaatcccgataatccattgctggcgctacgcgataaaatcagcgccgtggataaaaaacttctgacgctgctggccgagcgtcgtttgctggcagtggaagttgcacaagcgaaactggcgacgcatcgcccgattcgggatgtggagcgcgaacgcgcgctactggagaatctcatcgtactgggtaaggcacacaacctggatgcgcactacatcacccgtctgttccagctggtaattgaagattccgtgctgactcagcaagcgctgctgcaaaaaaacctcaaccatccccatgcgcatgccgcccgtatcgcctttctgggcccgaaaggctcttattcgcatcttgcagcacgcaactacgcgtcgcgccatttcgatagcatggtggagtgtggctgcctgaagtttcacgacatcatcaaacaggtcgaaaatggcgtagctgattacgccgtgatgccgattgagaataccagttcaggctcgatcaacgatgtctacgatctgctgcaacagaccagcctctcaatcgtgggcgagctgacattgcctatcgaccactgcgtgctggtgaatggccccaccgatcttcagcagattgagacggtttacagccatcctcaaccgttccagcagtgcagccagtttattaatcgtttcccgcactggaaaatcgaatacaccgagagtaccgcggcagcgatggagaaagtggctgcgctcaactcacctaaggtggcggcgctgggcagtgaggccggcggcgaactctatcagctgcaggtgctggaacgtaatctggcgaatcagcagcagaaccacacccgctttatcgtgctggcccgcaaagcaatcgaggtttccgaccaggtgccagcgaaaaccacgctgattatggcaaccggccagcaggcgggtgcgctggtcgacgcgctgctggtgctgcgtcagcacaacctgattatgagcaagctggagtcccgcccgattaatggtaacccatgggaagagatgttttacatagatgtgcagggcaacctgcaatcagagcggatgcagcaggcgctgcaggaattacagaccatgacccgctctctgaaggtactgggctgttaccccagcgaaaatgtggttcccgctgaacctggcgaataaaaagaagaaaaaaggcatccaactggatgcctttttcattgatggatggctgtcatttatgggcggctgtcattggccgatcgcaacaggcttcggctttcgaccaggaagcgttttgcgtgatcgccaaaccactgttcaacccggttaaagctggcgataaacgcctgcttgtcgccctgctccagcagcgcaatggcttcaccaaaccgctggtaatagcgttttatcagcgccagattactctctgaagacatgatgatatccgcatagagttgcggatcctgagcgaacagccgccccaccatcgccagttcaagccggtaaatgggcgacgagagcgccagcagctgatccagattgacgttctcttcggctaaatgcagaccataagcgaaggtagcaaagtgacgcagcgcctgaatgaatgccatgttctggtcatgctcaacagcgctgatacgatgcagacgcgcaccccagacctgaatctgctccaggaaccactgatacgcttccggttgtcttccatcacaccagaccaccacctgttttgccaggctgccgctgtccgggccaaacatcggatgcagacccagcacaggcccgttatgggcagccagcattgcctgcagaggccggtttttgaccgacgccagatcgaccagaatacaatcttccggcagtggtggcagttgggcaatcacctgctcggtcaggtgaatcggcacgctaatgatcaccattccggcatcgctgagcagagtctcagcctgaggccagtcctctttatccagcgttttaaccgtgtagcctgatagcccgagcattttttcaaacagccggcccatctggcccttaccaccgacaatcaccaccggacgcagttcaggacagagggttttaaagcctttgtcattctcgctggtataggattcccgcatcacgcgacgcagcacatcctcaatcagatccggtgggacgccgagcgcttcggcctctttacgacgggaagccagcatcgtcgcttcacgctcaggcacatagataggcaggccgtaacggctcttcacctcacctacctcggccaccagttccagtcgcttagccagcagatccagcagcgctttatcaacactgtcaatttgatcgcgtaacgcggtcagttcagccaccattgctcttacacctcttgtgacagacgcgccgacaggactccctgcagatcctgatgcatttcacgcagcaacgtttcggtgacttcccagttgatgcatgcatcggttacggaaacgccatacttcatttcgctgcgtggctgctcagaagactggttaccttcattgatatggctttccagcatcaaaccaatgattgaacggttcccatctttgatctgcgcaatagcggattccgctacgccaggctgacggctgtagtctttgttcgaattaccatggctgcaatctatcattaaggctggacgcagtcccgccttgagcatctctttttcacactgcgcgacatcttcaggaccgtagttcggcgctttgccgccacgcaggatcacgtgaccatccggattgccctgagtctgcagcaggcagacctgaccggcctgattaatcccgacaaaacggtgtggcattgcggctgcacgcatggcgttgattgccgtttcccaggctgccatcggtgccatttttaaagcctaccggcatcgacaggcccgaggccatttcacggtgcgtctgagattcagtggtacgtgcgccaatggcagaccaactgaacaggtcgcccagatattgcggactattgggatccagcgcttcagtggccagaggcaaacccatttcaaccaggttcaccagcagctggcgcgcaatgtgcagacccgcttccatatcaaacgagttatccatgaaaggatcgttgatcagccctttccagccgacggtggtacgaggtttttcaaaatagacgcgcatcacgataaagagctgatctttcagctgttcagaaagggtttgcagacgacgagcatagtccagtgccacttcggtatcgtgaattgagcagggtccgcacactaccagcagacgcggatcgcggccagcaataatgtcagagatggtctggcgcgacgccgcgacctgatcctgctgttcagtggtcagtggaaactttgctttcagctcttcaggcgtgattaatacctgttcaccggcgatatgcacattgttcagcgcgtctttttgcatgatggcgatcctttggctcgtattggcagtcatggactcctcactgaggaatgcaaatactgtatcacaggcaatacatagcgcaatattatatgtacacttttattaccacggatgaagaagggtgcgaaatatacttaaaataaacaataaaatcatggatataataaaaacctcaatcacaaaaaaccaaagacaattgtacaaataagtttacagttaaggttattgcctttcttctacccacaggcagaataaaagaatcattctgttcgcgctgagagagttatgtacccatcaccacaaaatatttatctgcgaccttttgagctcagcgacgtatctgcgtttaccactgcggttaatgcctcgctggatagccttatcccatggatggtctgggcgcatcacgattatcagcctcatgaagcagaaagctggatccgctttacccactggcaacggatgaaagaggaagcggaagagtttgccatcgttgatcagcatgaccagctgctggggggcgcaggaatacgctttgcccgtcatccgggtgacaccagcgcaattggctactgggtttcgccgtgatgcccagcgtcagggaatcgccagccgcgcggtggccgcgttgctgccgctggggttttcacgcccagagacccgggtgattgagattctggcagcagaggataacctggccagtcggggcgtggctgagaagtgcggtggtcagttcattggctgtcgctatggcctgattgtattagaggaagggccggttaataccgcgatttatcattttcagcggccggacgacggttaactgtaggcagcaaggttgacagtgacataaaaaaaaggggctggcatcacgccaaccccttgtttgctattaacttttagatgtcgcgttagcgataccttagttaagacgctctttaatacgagcagacttaccagtacgctcacgcaggtagtacagtttggctttacgcacagcgccacgacgtttaacagcgatgctgtcaattacaggtgaatgagtctggaatacacgctcaacgccttcgccgttagaaattttgcgaacagtgaatgcagagtgcagaccgcggttacggatagcgataaccacgccctcgaatgcctgcagacgttttttagaaccttcaacgacccatactttcacttccacggaatcacccgggcggaaggaaggtacgtcctgtttcatctgctcttgttcaatttgcttgataatgttgctcataattaaatctcatatcctgggtaaactgatagtcggggaagagcttactcttccacatcatcgttttgttgctgctgagattcccgctggaactcattcagcaaccttgcttgctcttcagtcagagccaggttttccagaagttcaggtcttctcagccaggtacggcctagcgactgcttcagacgccagcggcgaatatcagcatggttgcctgacagtaatactgccgggacctccacgccgtctaacacttcaggtcgggtatagtgcggacaatccagcaaaccttccgagaaagaatcctcatcggctgacgcctgcttgccgagcacgccaggaataaaccgggcgactgcgtcaatcatcgtcatcgctggcagttccccgccgctgagaacgtaatcaccgattgaccattcttcatcaatttcggtctggattacgcgctcatcaatcccttcataacggccacagaccagaattaacttgtcccgtgccgccagtttcgcaaacgccctgttggtccagtttgcgaccctgaggtgaaagatatatcaccctggccccatcacctgccgctgctttcgctgcggagatggcatcccgtaagggttgtaccatcatcagcattcccggtccgccgccgtaaggacgatcatccacggtacggtgccggtcgtgcgtgaagtcacgaggactccagctctgaatgctgagcagaccgttttttacagcccggccagttaccccgtaatcggtaatagcgcgaaacatttctggaaacaggctaataacaccaatccacattgtattcgccgttacgttaccgttcgattcggagatcaaaaaccaggatcccaatctacctcaatgatgccagtagagagatcgactttcctgataacctgttcatcaagaaacggaattaaccgctcctgagcaccgaatgcatccttcaggtttgccttaacgacgagaacgtcgttcgagccggtttccatcatatcgatgactttacccatctcgtagccttcaaggttaactacctggcagcccataaggtctttccagtagtagtcgccctcttccagcgatggcaactgcgtcgagtcaacctgaatttcgcaattggttaactgagccgccgcatcccgatcttcaatgcctttgactttgatgatcaggtcctgattgtggtgcttccaaccgtccagttcgacctgctgccatttaccggcgcgctggatgaaccagggttggtagttgaagatgctttcagcgtcttcagtggaggaaaacactttgagccagccgcgaataccgtaggcggctcccatcttacccaatacaatcgggttaacaggaggctgtgcggcaatttgtctgctcatgctcaccaccgtgacagattaagctgctttcttagcttctttgaccagcgcgttaacgcgatcagaaagcgttgcgccctggccaacccagtgctcgatacgatccagatcaagacgcagaccttcagcctgaccagatgcgatcgggttgaagaaaccaacgcgctcgataaaacgaccgttgcgtgcattgcggctgtcagtgacgactacctgatagaaacggacgctttttagcgccgtgacgtgccaaacgaattgttaccataacatcctcttcagttaataaaacacccggcccccatcgaggaacggggtccgggtgctgtataaaaagcccgaaaattttactcattttggcgaaaaaagcaacctaaaccgtgccatttcgggcttttttgtggaacgctttagcggccaggaaaacctggcggcatcatacccttcatgccgcgcatcattttcgccataccgcccttcttcattttcttcatcatacgctgcatatcgtcaaactgcttcaataagcggttaacgtcctgcacctgcataccggagccggtcgcaatgcggcgcttgcgtgagcctttgatgatctctggtttttcacgctctttgcgtgtcatcgagttgatgatcgcttccatgcgcaccagcactttgtcatccatctgtgacttcacattgtcaggcaactgtcccataccgggcagtttgcccatcaggctggccattccgcccatgttgcgcatctgcttcagctgctcaaggaagtcgttgagatcaaaaccgtcgccggttttcagcttcttagccagtttctcagcctgatcgcggtcaaccttgctttcgatatcttcgatcagtgacagcacgtcacccatgccgaggatacgcgaagcaatacgctccggatagaacggctcaagtgcatcggttttttcaccgacacccataaatttaatcggcttaccggtgatatgacgaatcgacagcgccgcaccgcctcgtgcatcaccatcgactttggtcaggataacaccggtcagcggtagcgcttcattaaaagctttagccgtgtttgccgcatcctgaccggtcatggcatcgaccacaaacagcgtttctaccggattgatcgcggcatgaacctgtttgatttcgtccatcatcgcttcgtcaacgtgcagacgaccggcggtatccaccagcagtacatcgtagaacttcaggcgagcttcacgcagcgcattgttaacgatatcgaccggcttctggctgagatcggatgggcagaaatccacgcccacctgctgtgccagcgtttccagctgtttgattgccgccggacgatagacgtcggcagaaaccactaagactttctttttgtgcttctcacgcaggaacttacccagcttagcgacgctggtcgttttaccggcaccctgcagacccgccatcagcaccacggctggcggctgagcagccaggtcgagtgcattgtttctctgcacccatcgccgtaaccagctcgttacgaacgattttgataaactcctgacctggagtcagacttttattcacatcatggccgaccgcgctctctttcacacggttgatgaagtcacgcaccaccggcagcgcaacgtcagcctcaagcagtgccatgcgcacttcacgcagggtctctttgatgttctcttcagtcagccttccgcggccgctgatgtttcgcagggtttgcgacaaacgatcggttaaattatcaaacatggtctctcactaaaaaaaagatcgcgaggcgcctgatcggcagaatgcggcggattataacacgaagcctcagcgatctctgcaattgcccctcagatcgtttggagcctgcttcggctggcgctatactgcctttttccttatctgactgaacctgaaaggatctatgttcgttttcgcgatagtggcgctattcgcctactccttaagtcttgccctgatcattcccagcctgttgaaacgtaacggcggctggcggcgaatggcgatgctctctgcctgtgtggcgctggtgacacacgcggtggccttgcagcaacgcatatttgctgttgatagcggacagaatttaagcctgctcaacataggctcgctggtcagcctgttgatttgcgccatcatgaccattgtggcgtcacgcaaccgtggctggctgctgctgccgattgtttacagcttcgcgctgatcaatctggccttcgccacttttgtgcccaatgcgtttatcacccatctggaaaccacgccaggcatgatgatccatatcggcctgtcgctgttcgcctacgcgacgctgattattgccgcgctctatgcactgcagctggcgtggatcgattaccagttaaaaaacaagcgcctggcgttcacacaggatatgccgccgctgctgaccattgaacgtaagatgtttcacatcacccaggtgggcgtcgtgctgttgacgctggtgctctgcaccggtctgttttatatgcaggatctcttcagcgcagaaaacgtcgataaagccgtgctctccatcatcgcgtggtttgtttatatcgttttgctctgggggcactatcatgaaggctggcgtggtcgccgcgtcgtctggtttaactgcagcggtgcggtgctgttaaccatggcttacttcggcagtcgcatcctgcagcatctgcttgtccccacctctcgttaaaaaggaagttctgcgttggagaatgtttcaaccaccacgctgattattattctctgcgtcatggtactggtttccgcctggtttgccgggtcggaaaccggaatgatgacgcttaaccgctataagctgcgccatcaggccaaaaacggcagtcgccccgctcgccgggtggagaagttactgcgtcgcccagaccggttgctcagcctggtattaatcggcaataacctggtaaatattctggcttccgcacttgccaccattgtgggcatgcgtattcacggtgacgaaggggttgcgatcgcaaccggtatcctgacctttgtggtgctggtatttgctgaagtgctgccgaaaacagtggcggccctctatcccgaaacgcgtcgcctttcccagcagcctgctgctggtcccgctgcaatacatcatgctgccgctggtctggctactcaacaccattacccgtctgctgatgaggatggcgggtatccgcgctgacggtgccattaactccgcgctgagcaaagaggagttgcgtaccatcgtctatgagtcacgtagcctgatgtcacgccgtaatcaggacatgctgctctccgtgctcgacctggagaaagtcagcgttgatgacatcatggttccgcgtaacgagatcgtcggcattaatatcaacgatgactggaagtcggtggtgcgccagttgagccactcgccacacggccgcattgtgctgttccgggactcactggatgactgcgtcggcatgctgcgggtgcgcgaagcctggcgcatgatgacggagaaaaaagagttcaccaaagagacgctgctgcgcgccgccgatgagatctactacatcccggaagggacaccgctgaacacccaactggtgaagttccagcgcaacaaagagaaagccggcgtggtggtggatgagtatggcgacatcaaggggctggtgacgatagaggacattctggaggagatcgtgggtgacttcaccacctccatgtcaccgtcactggcagaagaagtgatgccgcagaatgatgggtccgtgctgattgaaggcagcgccagtgtgcgtgaaattaacaaggcgtttaactggcagctgccagagcaggaagcgcgcaccatcaacggcatgctgctggaagcgctggaagagatccctgccatcgccacccgtgttcagatcggtcactacaacatcgatattctggacgtgcaggacaacatgattaaacaagtgcgcattacgccgaagacgccactgaaaaaatcggtagggtcctgaagcgataaaaaaacgccgcaatcgacatgatgcggcgttttttttagcagcaaagccctgactagatgtgcagttctttcagcttttcagcaggcagtttcagatcttcgttgcggttaacgccgatctcatgcgccagcacattgcgggcgatctgctgcgcttcatccagtgagtgcagcttgtagctaccgcactggtattcattcagctcagggatctggttctgatctttcactttcagaacatcttccatcgcccctttccacgctttggcaacgcgctgctcgtctggtgtaccaatcaggctcatgtagaagccggtgcggcaacccattggcgagatatcgacgatttccacaccatcaccattcaggtgatcacgcatgaagccggcaaagagatgctccagcgtatgaatgccacgctcagtgagaatatcaatgttcgggcggcaaaaacgcaggtcaaaaacggtaatcgtatcgccatgcggagtcttcatggttttcgcaacgcgaactgccggtgcgcccatgatggtgtgatcaacggtaaaactgtccagtagtggcatacgtcacctcctgttctgagaattttttttaaaacgatgaaacttttctgttcgcccaacgtctgaatatatgaaagacgcgcatttgttatcatcatccctgacaacagagatgttaatttggccacattgatgtggcctttttcttttctacccttcccggctcgccagatacgcttcaaaatccagcttatcattcgcttccagctgctgctgtgcagcaacagacgcctgcgcctgacgcgtgaaatcttcttctgtcagcacttccagcggctcttcgcagagcagatggcgatactgttcagccagcgccacgccggtttccggttacaccgttgtccttcattgcctgaaggatgcgcgccgagtaggttagctcaggatcgtcgaacgatgctaccagttgatcgcaaacctgctgatattccgtgctgtcctgattatgactgtctaacacttcagcaacccgacgcagatcggcaaacagggttttgcccacttcaaccagcgaatgttcctcttctccgcagcctacggcaattttctggtccggtttacgcccttccagcacaacccggttccagtttatacgggtgcattgcaactcatctgcactcatttccggcgcatcggccagggtacaccagatcaggaacaggtcgaggaagcgaacctgattctcatctacgccgatcgcagagaacgggttgatatccagcgaacgcacttcaatgtactcaataccaccacgcagcagcgcatcagagggcgcttcacccgagcgtgtcacacgcttaggccggattggcgcatagagctcgttttcaatctgcagcacgttggtgttgagctgcagccagttaccgtcggcatctttagtgcccatcgctgcatactcttctgacggcgtcttgatcgctttcttcagcgcagtgacatagccttccagtgagttaaacgtgatgcccagagagctctgcgatttattggtgtagcctaaatcgctcagacgcagcgaggtggcatacggcagccacatcgtgtctttgtcgttggtttcaaacggcagcgcgctctcacggccctgcaggaagctggagctgatagcaggcgatgcgccaaacagataggggatcacccagccgaagcgataatagttgcggatcagccgcagatagcccgccgagatcgtctcttttccgctttccttatctttcacgtcagcccactcctgccagaatgagagtggcagtgagaagttatagtgaatgccggagatggtctgcatcaacgcgccgtagcggtttttcagcccttcgcggtagagcgtcttcatctgaccaatattggacgtgccatattgcgccagttcaatattgtccgcatcgtcaatcacgcacggcatactaaacggccacatgcgttcatcacccagttcacgggcaacgtgacgatgaatatcgcgcaggaatgccagcatatgatcaatgctgtgatccactggcgtaataaactccagcaacgtttcggcaaagtcagtggtgatccagtcatgtttcagcgccgaccccagagattccgggtggccgctttttgccagctcgccatttgcctgtacacgcagcgtttcacgctcgatgccacggccaatacctttaagggcattgggatgcgcttccagccaggagagcgctttagatacgtccgggatcacattacccccccgctgtgataataatttatttttgttcagcataatgttaaccgtagcctcgaatctgtgcgaatcaatgccaccattgcataccctgtaatgtggcagtcgcgataacgatataacgcagtgttttgccgacagcgagaaacagcatcgcgggtagccaggcgaaacgtaaccagcctgccagaacgcagagcagatcacctatcactggcagccagctgaataacagtgctgcaggtcccagtcggtgcaaccacgtcattgctgtgtcatgccatcgcccctgacgttttaacggcagcaagcgaccaataagaatgttggttaagccgcccaaggtgtttcccagtgatgcggccaaaagcaacccgtaaactgatgtcttttttgctatcaatagtgctatcagcagtgcttcagaacttcccggcaggagcgttgcacttaaaaagctgctgccgaacatcgaggcataggtaagaacgtcactcacagtaagcggacatccaccacagccatacctgccgccttcgctgcctgaataccaaagtccgcatcctcaaacaccacacaacgtgtcggcgtcacacccatcagctcagcgcagcgtaagaaggtttcaggctcaggtttatgacgctgtacgtcgtcagcaccgacgacggccgaaaagagctcacgtacgcccagctgcgtcagtaacgcctctgccatgctgtgttcgcttccggtaccgaccgccatcggacgacgcccgtgatacgctttcaccacctccattaaaggcagtggcttcacgttttccagcagcatcgctttcacagcagcggttttttctgcggcaagaagatgagggtcgagtgacgactgattggattcaatgatgaactgcgacagccgccaggttggtgcgccattgaagtcgataatacgtgcttcatccagcgttaatccataacgcgtcagtacctgacgccacgcttttcgatgtgtcggctcagtatcaagaatcgtgccgtccatatcgaaaatcagggcgtcatattgatcgtacattgtcactccggacattcatcaaatgagacattactttagcctaatgtggacaggttgtcgccaggggggatgaacagcaaatgctttgaaagcattaacaatttttgttttcagataaaggtgatcgtgcacggccagcgataaacgtacgaaattccagcgtttttttaacattcttctggcagacaagcggcggcggacgggcatgggcagctaaacagaaggcgttgatgcgggaaacaggcgtttcggatcgcttaagtcaggatgatgaatcaatggagcagattaaacaggaaaagagtgcgtgtgaagccagagggaaactgcagaggtttttcaggatactcactcagcgtttgctgtacggacggttacggaagtaacgctatcgtgtttagtgaggtcttagcgatcatcgcgccatgatactttgagggattttgaggctaaagaagaagatggtgcatccaggaggatgactcagcttgcgcttcgccctgcgggccgttgcagatgcaacgttatccctcttcgtgcggccggaacgcttattgcgtcatgtcacactgaggaactgccaacattcgagaagatggtgcatccaggaggattcgaacctccgaccgctcggtttcgtagccgagtactctatccagctgagctatggatgcattgggatctatcttttggggtctatcttttgaggtacaactttttatggacttacagaaaccaacctgaggatgttacaaagaatggtgcatccaggaggattcgaacctccgaccgctcggttcgtagccgagtactctatccagctgagctatggatgcataaaacaaattcttgtacaacgcagggtgctaactactcaccatgaaaggaattgctaattcgctttgtttcgatggtgcatccaggaggattactcagcttgcgcttcgccctgcgggccgttgctgatgcaacgttatcctccttagtgcggcctgtacgctaatgcgtcatgtcacaccgaggcacttctccatattcgaaaatatggtgcatccaggaggattcgaacctccgaccgctcggttcgtagccgagtactctatccagctgagctatggatgcatcgaaaatggcggtgagggagggattcgaaccctcgatacagcttttgaccgtatactcccttagcaggggagcgccttcagcctctcggccacctcaccttacgctttctttcgaactgtgcgtctgaacgttgtttctgctcatcggcactgcgtggcgcacatattactttcccggacttttaagtcaaacaatttttccgaaactttgtttgattgagcaaatcacacacaattgggacaaaatggcgacaaaaagagtgaattatcaacaatgaaagatgatggcgttaacaaaacagaggaggaacaggtagaaagaaaaggcaggatttttacagaaagcggtagcgcctcgcacaggtgcgagacgctgaatccgttaaacgctggtttgttgcgttttttcagcctggatgcgttgatagatctcttcgcgatgcacagacacttctttcggcgcgttaacaccgatacgaacctggttacccttaacacccagcaccgttacagttacctcatcaccgatcatgagggtttcaccaactcgacgagttagaataagcattctttgctccttgaaagattaaaagagtcgggcttgtacaggctcccggcattatccatcatttaacgctgcacaatgtgtatgagaaatacaccaatgcacatcgatgcgccaatacattctgctgatagttagtttagccgaaatacactacatcaacctgactttgtcatttgctgctttagcatcgtattaaaaagcgccggaacaaccgttctgacgctttttacgatgccttgttttaattcacttacagacggctgctgacccagtcctcaacccctgctaatacgcctttcagagcacccgcatcgttaccaccagcttgtgccatatcaggacggccaccgcccttcccgccaacctgctgagccagaccggcaatcaactcacccgctttaacacggtcagtcagatctttggtcacacccgcaatcagcgacaccttaccttcagtaaccgttgccagcacaataatcgccgaccccagctgattcttaagatcatcaaccatggtacgcaacattttaggttcaacattgttgagctcactgactaacagtttcactcccttaatgtcgatagcattgctgctcagtgaagcgctctcctgcgcggcttgctgatcgcgcagttgctgcaactctttctccagagcccgtacatgatcgaccagaccacgcactttctcattcaggttgctgctgttcgcttttaccagctgcgcaagatcctgcagctggctgctctgcgcattgacctgcgccagcgcgccttcacccgtaatcgcttcgatacgacgaataccggctgcagtacctgactccgcctgaatacggaacagcccgatgtcacccgtgcgcgcagcatgggtaccaccacacagctcaacagagaaatcacccatggtcagaaacgcgcacgcgctgatcatatttctcgccaaacagtgccattgcccctttagacttcgccgcatccagatccatcacttcggtttcaaccggcaggttgcgacgaatttgcgcattgacgatatcttcgacctgacgaatctcctgaggtttcatcgcttcgaaatgcgagaaatcgaaacgcaggtacttgtcgttaacaagcgagcctttctgcgccacatgctcacctaaaacctgacgcaaggcggcatgcagtaagtgagtagcagagtggttaagacggatgcgcgcacggcgtgccgcatcaacctgtgcctcaaggcggtcaccgatacgcaactgccctgcggtcagcttaccgacatgaccgattgcctgaccatatttttgtgtatcctggacgctaaattcagcattcttccctttcagcagaccggtatcgcctacctggccacccgattcgccatagaatggcgtttcatccagcacgaccacggcatcctgacccgcggtcacttcatcaaccgcctcgcctgcaacatagagcgctttcaccgtggcagctaaatcgagctggtcgtagcctttaaaggatgaggcggcatcaatacgaataacgttgctgtagtcagcgccgaagccactcgcttcacgtgcgcgctgacgctgctgctccatcgcccgctcaaagccggcttcgtcgatcttcagattgcgttcgcgacagacgtcagccgttaaatcagccgggaaaccaaaggtatcgtagagacggaagacgatttcgccatccagcgtgtcgccctgcagtttttccagctcttcgtccagcagcgccagtccgcgctccagggttctggcaaactgatcttcttcgcttttcagcacctgctcaacctgagcctgctggcgctgtaactcttcgcctgcggcacccatgacctcaaccagtggcgcaaccagcttatagaagaaggcctctttggcgcccagcatgttgccatgacgcacggcacgacgaatgatacgacgcagcacgtagccacggttctcattagacgggatgacgccatcggcaatcaggaatgcacaggagcgaatgtggtcggcaatgacacgcagcgatttgttactgaggtcagtggcaccggtaacctgcgccacggcctgaatcagtttctggaacaggtcgatttcatagttggagttgacgtgttgcagaacggcagaaatacgctcaaggcccattccggtatcaaccgacggttttggcagcggcagcatggtgccatcagcctgacggttgaactgcataaagacgatgttccagatctcaatgtaacggtcaccatcttcttccgggctgcccggcgggccaccccagatgtgatcgccatgatcgtagaaaatctcgctgcacggaccacaaggaccggtatcgcccatctgccagaagttatctgacgcatacgcgctgcccttgttgtcgccgatgcgaataatgcgttcacgtggcacaccgatttcattcgcccagatatcaaaggcctcatcgtcggtttcatagatcgtcacccacagacgctcttttggcaggctgaaccactgctcgctcgtcagcagttcccaggcaaaaccaatcgcctctctcttgaaatagtcaccaaagctgaagttacccagcatttcaaagaaggtgtggtgacgagcggtgtaaccgacgttttcaagatcgttgtgtttgccgcctgcgcgtacgcagcgctgtgacgtggtcgcacgtgtgtagtcacgtttgtcctgaccgaggaacacatctttaaactggttcatcccggcgttagtaaacaacaacgttggatcgttattcggtacgagggagctgctggttacaacctcatgtcccttgctatgaaaaaagtcgagaaacgcttgacggatctcagcagtgctcttgctcatatatatcctggaatcacgctaacgaacgttccctctgatcggcgcgaccacattctggtggtgcctgattagcggaacaaaaagtgggaataagataaattttcttcagtgggaagtaaaattacatcggcttttagtcatcaaaatttctgaaaatggactggatatcttcgctcataaaaccctttgactgcagatagcgtagtactttcgctttctctttccactctgtgggcagcgggtgtccgaattttcgttcagccagctgagccgcacacgccgcccagtctacctctgtctcttccattgcaagatcaatggcttcacggtcgatgcctttctgggccagttcaaggcgtacgcgctgcgatccaaagcccttacggctccggctctgaataaatcgttcggtgaaacgctcgtcgtttaaccagccgctttcctgacaccagttaagaacctgttccagcaacgcttcggtaacaatttcgggctcttttttctgcgcccacgcagcacgctgcgctgattgttgcagcttacgcgctaactctgcacggctgtggtcgcgctgacccagaatacgcatcgcacggtcaagcaaacgagagtaagagacgacattaggttggggctgagagggttcagtcatactgcgcaccttgtacaaacagagggagattatggcgacagaacaggacagagggaaggcaagaaaggtaatagagggggataaaaactacgggagaggctttcgcccctcccgcatcagagattagaagtcttcgttcgcttcagccgcgtcttctttctcagcagccttgtcggctgctgcgagtttttcatccgcgccgttgagcaacatctcacgtaacttcagatcaatctcgtttgccacagcagcattctctttcaggaagttgccggcattcgatttaccctgaccaatcttgtcgccattgtagctgtaccatgcacccgctttttcaatcagcttgtgcttcacgcccaggtcgaccagctcaccaaaggtattgataccttcgccgtacatgatctggaactcagcctgtttgaatggcgcggcgattttgtttttcaccactttaacgcgggtctcactgccgaccacgttatcgccctctttgattgcaccgatacggcggatatcaagacggacagaggcgtagaacttcagcgcgttaccaccagtggtggtttccgggttaccaaacatcacaccaattttcatacggatctggttgatgaaaatcagcagggtattggactgcttcaggttaccggccagtttacgcatcgcctggctcatcatacgtgccgcgaggcccatgtgtgagtcaccgatttcaccttcgatttccgctttaggcgtcagcgccgcgacggagtcgacgatgatcacgtcaacggcaccagagcgcgccagcgcatcacagatttccagcgcctgctcaccagtgtctggctgagagcagagcaggttatcaatgtctacgccgagtttcttggcgtaaaccggatcaagcgcatgttctgcatcgataaaggcacaggttttacctttacgctgtgcagatgcgataacctgcaaagtcagcgtggttttacctgaagactcaggtccgtagatctcaacgatacggcccattggcagaccgcctgcgcctaatgcgatatccagcgacagcgagccggtagagatagtttccacatccattgagcggtcttcacccaagcgcatgatggagcctttaccaaattgcttctcaatctggccaagcgcggcagctaaagccttctgtttgttttcatcaatcgccatttcaactcctaatcaagccgggtaaacacgcactcagggtgcctgtactctttctgttgccgacaattatactgtatagtcatacagtatcaagtttaatttgtcagaaattcgccatacagtttctgcagggcccatgccaccgactggcggcgtacggcatcacgatcgccgctaaaatgctgctgaaaagtcaatacgttatcctgcggcccggcaaagccaaaccacaccgtgcccaccggtttttcttcactgccgccatccggaccggcaataccgctgacggagatcgcgtagtcagcatgggccgccctgcgagcacccagcgccatctcccgcaccaccacatcacttaccgcaccatactgcaacagcgaagcagcctgaacactgaccatctgctgtttggcctggttactgtaggtcacaaaaccccgctcgaaccaggcggagctgccgctgatatcggtaaagactttggcaatccatccccccgtgcaggattccgcacaggttacggtggcattgcgctgcttcagcttctcacctatctgcgcactaagcgcctgcaattgctgatcatccattgcgactctccctttggctatgggttgaaggtggtgcagaaaaactgctttttcaaggccactcaccattattacgctgtttttgcggccagctttccactgcgcttaccggtttttcaccgcaaccataaaaagacgcgggaaggcgagcaacacctgaccatcggcctgagccggataagccgcgagcagacgctgatgataatcggtcagaaacgccgactgttcggtctcatccagcgttgccaggaaaggccgtaaaccggtcgcctgcagccagctgataattgcctgcgcatcggccatcacgtgataataggtggtacgccagatatccacctcacagccggcctgcgtcagcagatcgtaatactcgcccgtggaaagcagctgtgtacgttcagcggcatcggcattgatgcgtgaacgccagcgatctgttgccgccacctcgcgcatcagccggtgcgacggctcattgaggttatcaggcatctggatcgctaacacgccaccgggcgccagctggctgaccagatggggaaacagcgttgcgtgattatccagccattgcagagacgcattggcgtagaccacctgctgcggcacatcggcctgccagttgcggatgtccgcctggataaaacgacagtgcggcaggcgttcagcggcctgagttaacatcgtggcggaactgtccagcccggtaatctgcgccagtggccaggcatcggcgagcagctcggtgctgttaccgggcccgcatcccagatcggtcacctgctcaacctgttccaggctgaggcgcgccagaagttcgcgggctggacgggttcgttctgcttcaaacttacggtacagcacaggatcccactctttcatcatgacctctcgctcagttatcagatgcatccgcttactgagacggatgaaagaggaaaaagtgcgacccgttgctcacttttgaatcatgcgctggcagagaccggccggagtcattaagttaaaacactgtttcatttttttaacatccgattcaggagtcatttatgagtgaaaaatcgccctttgccggtgtctggtgcccttcagtcaccccgtttaatgcgcagggtgcggtcgatattgatgcgctcgggcgacatttctcccgcctcaatgactccggtatcgataccttactggtgatgggcagcattggcgagttcgcctcactgacgcagcaggaacgcttacaactgattcaggaagccagacccttgtcatcgctgaagatggtcgcgaacgtctcggcaacctgcattcctgacatgctggagctggctgaagccgcctggaaaaatgattttgacgcggtgatggtgctgccaccctactattatggccagacgcaaaaccagctgatgcactacttcgaagcactggacgcgcagctgggtggtaaatggtttgcctacaactttccagcccgcactggctgcgatctgacgcccgcgctgattgccgccctggcggcaaagctgcccaacttcgccggcattaaagatacggtggattgcctgtcgcacaaccggatgatgattgaagagacccgcaaggtgcgtagcgatttcgccgtactgtccgggtatgacgagtacctgctcccgaacctgctggcgggcggtgccggtgtaatttcaggactgaataatattgtgccggagtactttgcgcagatgatgacggcatggcgaagtggcaatctgccggagctgacgcgcctgcagcagcagatcggccgtctgatggcgatttacagtattggagatgatttcgtgacgacgattaaaacggccgtggcacggcgctatgactcgatgagcagcggctcacgaaactacggtggcacgctgaatgcggaacagtgtgccgcaattgataagctgttcagctaagcaggaaagcgggcgcatccctgcgcccctgatctcagttctttttcacaaactcagattttaatttcatcgggccaaaaccgtcgattttacaatcgatgttgtggtccccttcaaccagacgaatgcttttcactttggtgccgatcttcagcgatgaagaactgcccttcaccttgagatctttgatcaccgtgacgctgtcgccatctgccagcagattgccgttggcatcacgcacttccagtgttgcgttgctgctgtcaccttctccctcggtccagatgtgaccgcaggaggggcagttaaggttatcgccatcttgccaggtgtaatcggcgtgacaagccgggcaggcaggtaaagacatagtgactccagaaatatcagtggctgtgtggcctgaaaaagggcgtcatcatataaccttacagttaacaaggatagcctttataacaggccgccctggcgcgccttgctcaccgcctcacccagctgccacaccgccatcgcataatgggtactgtggttgtagcgggtaatgacatagaaattgggtaagccgtaccagtactggtagctggtgcccaaatccaggcgtagcagactgacctgatcgttaccgttcagcgagccctgtggtgacaatcctgacgccgccagcatgctcacgctgtaacgggttttgaagccatcttccagcatcggtgcctgaccgctggccggtaccgccacattttcgccgctgtgccagccatgcttctgaaaatagtgcgccacgctgccgatagcatccaccggatcccacaggtttgcatgaccgtctccgttgaaatcaaccgcataatcattgtaagaggagggcataaactgaccatagcccatcgccccggcaaaggagcctttcagcgccagcgggtcatcctgctctttgcgcgacatcaacagaaaggtttccagctcgctgctgaagtactctgcgcggcgcggatagttaaaggataaggtcgcaagcgcatccagaatccgcgttttccccatcacacgaccccagcgggtttccacgccaatgatgcccacgataatttccggtggcacgccataaacctgctgtgcgcgttgcagggcatcctgatactgattccagaaacgccaccccattttgcacgttatcgggcgtaatgaacttgttgcgatagcggatccaggcgccattaggtcctggcgctggcgtatagcttggtgcctgacggtccattagtcgcagcacataatccagtcgtttggcctgaccgatgatgttgtgcagttgctgacggtcaaagtcatgcttctccaccatcttatcgataaattgctctgctgccgggttaccggcaaagtcgccaaacatcgcctgtccgctgtgcgacggctgcagtaaaaaaccgccctgtggcgcagccagcatcttctgctgggacgggacttcaggtttgctgctgcaggaggccagaagcgggatgaacgcaaggaaggctaacttgaggcgcatcggttatccataaacgaggggtaatttcagatgcggtaatagtagacgttcagcgcaatgacatacagggcaaaatcttaaaaaaacgtcaaggcagccgtgggctaaaatggctgcgggtctctctctgtcccgcagccatcatgcgcttagcggcggtttctcaccagctgatagcgacgggtcagatactcaaccggcgcgctccagatatgcaccagccggcagaacgggaacagcaggaacagcgtcattcccagcaccatgtgcacgcggtagataaacgccacgccgtcgagatgctgcgaagcgccaccgtggaaggtcaccaccgcctgcgcccagcccaccagcttcatcatttcactgccgtccatatgctgggcggagaagggaatggtcagcaggcccagcgtcgcctgagccaccagcagggtcatgatcagaatatcaccgacgctactggtcgcccgcacccgtggattggtcagacggcgcttcagcagcagtccaccgcccaccagtgtcatcgccccgaacaggccaccggcaatcatcgccagtttctgcttcacgtcgatcggcaggaaggattcatacatccagtgcggcgtcagcatcccgacgatgtgaccgaagaaaataccgatgatgccgatgtgaaacaggttggaggcgagacgcatcccttttttgtccagcatctgactggaaccggcacgccagctgtactgcccgtagtcatagcgcagccagcttcccaccaggaagaccgttccggcgagataggggtaaatatcgaagaagaaagtgttaataaaattcatgctgattctcctgtggtacgcgccgtcgccgcggcgatgtccagatactgcggcgcgaccgcatcggcgaagcgacgctgatgcatcgcctgctgcgccgaggcgcagccctgttcgccgagaaatttaatctgctcctcttcccagacagcatccagtgctgccggcgtatcgtcgcgcgcttcctgcgccacctgtggcttgagggccgcaggatcaaccgcgctaccggatagcgtcagtaacactgtgaagagatcggcgtaggggctctgacgctcttcaagccgcgccgccagcaaggccaggataggcacgatgtcgtccagtccctgacgcgcggcctcatcgcttttacaggcgagatactccaggtagagcggcaggaaatcgggcagctctttgctgtccagctccagaccatcggcacgatactgttccagcagatcaaccatcgcctgaccgcgatcgcgtgactcaccgtgcacgtgttcaaacagcagcagcgaggtggcgcggccacgatcaaacagttcgcagtagtcagcctgcacgtcgagcagtggccgggcacagagctgattgataaaccgcaccagccgtgcactctgctgcaggttgagttcagtggcgtcatccagcgccgcgatcaggtcggaagagtgggtaaacagcgcctcgtccgggtagtccagcagccgcgaaagaatacgtaacgtcatcatgaggcatcctccggacgaatggttttcttactgatgtcgatggcatcaatacggcggctgttgaacaggttgaatttgctgtcgctgccgtgacagccatcgccaaagctaaagccgcagcctttgctttccgggaaggcttcacgcgccagtttcgcgatggctggaaggcaccacaaagcgatcttcatagttcgcgatcgccatatagcggtacatctcctgcgcctgcgcttcggtcaggccgacctgctccagcgcccggatatcatgctcaccgtccacgctttctgcgcgtttgtaatgacgcatcgccagcatccgcttcagtgccagcagcaccggtgcggtgtcgcctgcggtcagcaggttcgccagatactcaaccggaatgcgcaggctttccacatccggcagcacgccggtgtgcgccagcgccccgccatccaccgccgactgaatcggtgacagtggtggcacataccagaccatcggcagcgtgcggtattcagggtgaagtggcagcgccagcttccactccatcgccattttatagaccggtgaacgctgtgctgcgtcgatcacgctcagcgcaacgccatctttcagcgcctgcgcaatcaccgccggatcgttgggatcaaggaagatatccagctggctctgatagagatctttctcgttttccgctgcggccgcctgttcaatgcggtcagcgtcatagagcaacacgccgagatagcggatacggccgacacaggtttctgaacagacggtgggctggcccgcttcaatgcgcggataacagaaaatgcatttttctgatttgccgcttttccagttgaagtagatcttcttgtacggacagccggtgaggcacatccgccagccgcgacatttatcctggtcgatcagcacgatgccatcttcgccgcgtttgtagatcgcgccgcttgggcaggtcgccacacacgccgggttgaggcagtgctcacacaggcgcggcaggtacatcatgaaggtgtgctcaaactgaccgtaaatctccttctggatgttatcgaagttcttatcctgcgaacgtttggcaaactcgccgccgaggatctcttcccagttcgggccgttttcgatctttttcatccgctgaccggtgatcagcgagcgcggacgcgcaatcggctgatgcttaccggcgggcgcattgtgcagatgctgataatcaaaatcgaacggttcgtagtaatcatccagcgcgggcacatccgggttggcgaagatcttcgacagcaggccgatgcgactgcccatgcgcggctccagcttaccgttgatcttacggatccagccgcccttccacttctgctgatcttcccaggcgtgcggatagccgacaccaggtttgctttcaacgttgttaaaccaggcgtactccatgccctcgcggctggtccagacatttttacaggttaccgagcaggtgtggcagccgatacatttgtcgaggttcagcaccatgccgacctgtgaacgaattttcatggttttacctcctgctggctgccctggcaggcatcgttgccttccccatctaaccagttaacgttgttcatttttctcactaccacgaactcatcgcggttcgagccgacggtgccgtagtagttaaagccccaggagagctgcgcataaccgccgatcatatgggtcggtttcgggcaggtccgcgtcaccgagttatggatcccgccgcgctggctggtgatctccgagccagggatattcacgatacgttcctgcgcgtggtacatcatggtcatacccgccgggatacgctggctcactactgcacgtgcggtcagcgcaccgttggcgttgaacgcctcgatccagtcgttatccacaatacccagctcacgggcgtcatcttcactcatccagacaatcggtccgccgcgtgacagtgtcagcatcagcaggttgtcgctgtaggtggagtgaatgccccacttctggtgtggcgtcaggaagttcagcgccttctccgggttaccgttgggtttgctgttcagcaacggcttcgccgcacgggtatcgattggcggacgatagaccatcaggctctcgccaaaggcgcgcatccactcatgatcctgatagagctgctgacggccgctcagggtttcgccacgggatcagctcatgaacgttggtgtagcaggcgttgtaagagacatgttcatcttccagccctgaccaggtcggactggagataattttgcgcggctgcgcctggatatcgcggaagcgaatcttctcatcttctttattgagcgccaggtgggtgtggtcacgaccggtaattacgcccagcgcctgccaggctttcaccgccacctgaccattggtttccggtgccagcgccaggatcacttctgccgcatcgatcgccgtgtcgatatttggccgccccgctgccgggccatccgttttgacgtagttcagctgcttgaggaaatcgacctctttgctggtgttccagctgatacctttgccgccgttacccagggtctccagcaacggtcccagcgaggtaaagcgctcccaggtcgccggatagtcgcgctccaccaccataatgtgtggcgcggttttacccggaatcagatcgcattcgccttttttccagtctttcgcctcaaaaggctgcgccagttccgcgggcgagtcatgtaacaccggcagagtaacgacgtccgtttcaacgcctaaatgacccgggcagagatcggagaaggctttggcgatgcctttgtagatctcccagtcactttttgagtcccaggcaggatcgacggccgccgaaagcggatgaataaacggatgcatatccgaggtattcatatcgtctttttcataccaggtcgccgttggcagcacgacatcggagtagagacaggtgctcgacatgcggaagtcgagtgtgaccaccagatccagtttgccttcggcaccctgatccagccactccacctcttccggcttcacgcggccctgctggcctaaatctttgccctgaatgccgttttccgtgcccagcagatacttcagcatgtactcatgcccttttccggatgagccgagcaggttggagcgccagacaaacaggttacgcgggaagttctgcggatcgtccggctgttcagcggcaaaccgcatggtgccctgcttcaggctttccacggtgtaatccagcggcgactgaccggcggctttcgcctgcgccgcgatgtgcagcgggttgacgttaagctgcggcgctgaaggcagccagcccatacgttcggaacggacgttaaggtcgatcaggctgccgctgtagcgacttttatccgccagcggggagagcagttcgctggtggccagggtttcatagcgccactgactggagtggttgtagaagaaggaggtgctgttcatctggcgtggcggacgctgccagtccaggccaaaggccagcggggtccagccggtctgcggacggagtttctcctggccgacatagtgcgcccagccaccgccgctctgaccgacgcagccgcagaaaatcagcatgttcatcaggccacgatagttcatgtccatgtgataccagtggttcataccggcaccgacgatgatcatcgaacgaccgcgggtcttctcggcgttttcggcaaattcacgggcaatgcgaatgatgttctgacgggagactcccgtaatctgctccgcccaggccgggctgtacgctttgatgtcgtcgtaggtttgcgcgcagttgacatcatccagaccgcgatccagaccataattcgccagcgtcagatcgtagacgctggtgaccagcgcttcactgccatccgccagttgcaggcgtttcaccggcagcttatgcagcaggatttcgtccagcgcaacgctgttgaaatgctcgctggtaatgccaccgaagtaagggaaaccgacctccaccacctcatcatggctgccgagcaggctgagctgcagttcaacttcctgatgtgacgccccatcacgctgctcgaggttccatttgcctttttcgccccagcggaagccgatagatccctgcggcgcggtcagctccccggtcgcctcgttgatcgcgacggttttccactccgggttattctcctgaccgagcccatccaccagatcgctggcgcgcagctgacggccggcggcgtaaaaaccgccctcacggggttccagcagcaccagcatcggcatatcggtgtaacggcgcacgtagtcgcggaaatagccaacttcgcgatcaagatgaaactctttcagcatcacgtggcccatcgccagcgccatcgcgctgtcggtgccctgcttcggactcagccactggtcacacagcttcgcgacctcagcatagtccggcgtgatcgccacggttttcgtccctttatagcggacttccgtaaagaagtgcgcatccggggtacgggtctgcggcacgttagagccccaggcaataatgtaggaggagttgtaccagtcagccgattccggcacgtcggtctgctcgccccaggtcatcggtgaggccggcggcagatcgcagtaccagtcgtagaagctcagacaggttccgccaatcagtgacaggtaacgtgcgcccgcagcgtaagagaccatcgacatcgccggaatcggtgagaatcccataatgcggtcagggccgtaagtcttcgcggtacagatgttcgcggcggcgatcatctcgttgacttcctgccagctggagcggacaaagccgccgcgtccacgcgcctgtttgtagcttctggccttttcaggattactgatgatggatgcccaggcgtccaccgggtcgctgtgctgcgctttcgcgtcgcgccagagctgaatcagcttcttgcgcattaacggatatttcaggcggttagcgctgtagagataccacgagtagctggcaccgcgtgggcagccacgcggctcatggtttggcagatcgggacgggtacgcggatagtcggtctgctgggtctcccaggtgaccagtccatttttaacgtagattttccagctgcatgagccggtacagttaacaccgtgcgtggagcgcacgattttatcgtgctgccagcgactgcgatagccatcttcccagtcgcggttgctgtttaacgtctggccatgctggccggaaaagggttcggccagctgtttgaaatagcgaaaccgatcaagaaacttgctcatccggaatactcctgaaggcttaatgtgacattgctgactctgcatctgtcccgacacagaaagtgaaattgtgccggtgcgccacaccggctttgtcgttatcaggcgcgtgattttcggccgtaaaccagccaggtcaccgcgatgcagcagagataaaagaccaggaagattttcatcgcgccggcgggtgaaccggtcatcgcgagcgacaggccaaaagtctgcggaataaagaaaccgcccagcgcgccaatggcggagataaagccgagcgcagcagaggtttctgttgccgcttcacgctgtgccagcgcatcgtcgccgccctcagctttgatacgttccagcgtcagcttacggaagatcaccgcaatcatctggtaggtggagccgctgcccagcccggacgtcaggaacaggcccataaacacggcgaagaaggcaacgaacgagccatcatgtccggcacccggcagggtaaggaacagcagcgcagcaaacagcgccatcagcacgtagttgacaagcgtgacgcgggtaccgccgaagcggtcagaaatgatgccgcctgctgaacgggccagcgcgccaataaaggggccgaaaaaggcgtaatgcatgatcacgacatcaggaaattgcgtcttcgtcagcatggcaaaaccggcagagaaaccaataaacgagccaaaggtggccagatagagcagcgccataacccacaggtggggacgtttcagcaccggtaactgctcacgcagcgaggatttcgccgccgccaggtcgttcatgccgaaccaggccgccagcgtgccgatcgccaggaacggcacccagatccaggcggcattctccagccagatgctgtcgccggtgacggtggtctgacccacatcggcaaaaccaaaaatggcacaggagatcgccagcggggcgacaaactgcattacgctgacgccaagattaccgaggccaccgttgatgcccagcgcgccgccctgacgggctttgggaaagaagaagctgatattgcccatgctcgacgcgaagttagcgccaccaaaaccgcacagcagggaaatcaccataaaagtggtgaatgaggtctggctgtcctgtacggcaaagccgagccacaggcagggaatgatcaggatgccggtgctgaaggcggtccagcgacgtcccccaaagatgggaataacaaaagagtaaggcacacgcagcaacgcgccagaaaccgacggcagtgcggtcagtaaaaagagctgctcagtgctgaaggtaaagccaactttattcaggttaaccgcaacggtgctgaacagcatccagacgcagaagcccagcagcagacagaagacagaaatccacaggttacggctggcgatacgtttaccacgcgcctgccagaacgcatcgttttccggttgccagtcctgaattaacgcgccgcgcgtcggggtttgcaaagaggtggattgggtcataaatctctcatcagcagaataataattgtgcgtatcctgcgcatccgccgtggtgtcgggcttgatacaaatcaacggcaatgcaggttacagaggtgcagcgccctctcttcaccccggttaagtagttgactgaattcagataacccttataaatcatagggtttaaacacggccgcccatgccttctgtaaaagggtgtccgactggaaataaaggagtagtccattgggggtatatagcgaccccgtttcaccggtaagataggctctccgcccgctcagggctggcgtatgtgacaggagcaggagccattgtgacggcagagaaattgacgcttttattgatcgacgaccatcccatgctgcgcaacggcctgaagcagctgattgcgctggatgaaaggctgcaggtggttgccgaagcgggtaatggcattgatggcctggcgctggcacagcagcatgatcccgacctgatcctgcttgatcttaatatgccaggtctgaacggactggataccctgacccagctgcgtgagatagccctttctggccgggtagtggtgttcagcgtttcagataatgaagaggatgtggtcagcgcgttgaagcgcggcgctgatggttatctgctgaaagatatggaaccggaagccttactgaaagcgctgcatcaggctgctgccggtcagatcgtgctgagcgaggcgttaaccccgattctggtcgcccggttgcgtgaagcgcagcctgctcagacgcgcgacatcaatcagctgacccggcgcgagcgcgatattctgcaactgatcagcgacgggatgactaataaagcgattgcccgcaagctggccatcagtgaaagcacggttaaggttcacgttaaatatctgctgaagaagatgaaccttaaatcccgacttgaagccgccgtctgggcgctgcagaacgggctgcactgacttttcccccttcccgatgcggcgcagtgccgtcctgctggccataaactgccgcagaaatcgcgagccgcctcgcagcctcgcatcagcgtcatgagaacaggcacttttttgtcgccagccgccgccacatttgccaggatgcctgtcaggttacacccggtcaggatcgcggctgtgcatcacgctggcatatgccctgccctattcgttatcatctgattatcctgcgcgcctggaatccctttcggtttcatgggcgttgaccgccagaaatttaccgcattaaaaatgagctaaaaccttatgcaagagccaaccgaaaaggactttccttcccacacgccgatgatgcagcagtacctgcgtctcaaggcggagcatcctgacattctgctgttttaccgtatgggtgacttctacgagctgttttatgacgacgcaaaacgtgcctcgcagctgctggagatttcactcaccaagcgcggtgcgtcagcgggcgaaccgatcccgatggcgggtgtgccctatcatgcggttgaaggttacctggctaaactggtgcagctgggcgaatccgtagccatctgcgagcagataggcgatccggcgctgagcaaaggcccggtcgaacgcaaagtggtgcgcatcgttaccccaggtaccatcagtgatgaggcgctgttgcaggagcggcacgacaatctgctggcggcgattgtgcaaagcccgcgcggttttggctacgccacgctggatatcagctcaggccgttttcgccttagcgaacctgccgatgctgaaaccatggcggcagaaaactgcagcgcaccaatccggcggagctgctctaccccgaagatttccaggcgatgtcgctaatcgatcagcgacgcggcctgcgacgccgtccgctgtgggagtttgagatcgataccgcgcgccagcagctgaacctgcagttcggcacccgcgatctcaatggcttcggcgtggagaatgcgcacctcggactgagcgcggcgggctgcctgctgcagtatgttaaagatacccagcgcaccacgctgccccacatccgctcgctgagcatggagcggcagcaggacagcatcatcatggatgcggccacccgccgtaatctggagatcacccagaacctggcaggcggcaccgacaacaccttagcggcggtgctggataaaacggtcaccccgatgggtagccggatgctgaaacgctggctgcatatgccgctgcgcgatgcgcgcatcattaaccagcgtcaggagtcgattgctgagctacaaaatctcagcgacgtgctgcaaccggtgctgcgtcaggttggcgatctggagcgaatcctggctcgcctggccctgcgcaccgcacgtccgcgcgatctggctcgcatgcgtcatgcgtttcagcaactgccggaacttaaccagctgctggccgatgttgaggcgccccagttgcagaagctgcgcacgcagatgggcgagttcactgcgttacgtgagctgctggaacaggcggtgattgagtcaccgcctgtgctgatccgcgatggcggagtgattgcgcccggctacaacgcggagctggatgagtggcgtgcactggcagatggcgcaaccgactatcttgaccggctggagatccgcgaacgcgagaagctgggactggataccctgaaggtcggctttaacggcgtgcatggttattacatccaggtaagccgcggacagagccatcaggtaccgatgcactatgtccgtcgtcagaccctgaaaaatgctgaacgctatatcattccggagctgaaagagtacgaagacaaagtactcacctccaagggtaaagcgctgtcgctggaaaaaagcctgtatgaggcgctgttcgatcagttgctgccgcatcttgaagcgctgcagttgagtgccgccgcgctggcagagctggatgtgttaagcaacctggcagaaacgtgcctggtccctgaactattgccgcccggtattgcaggataaagccgggattaaaatcagcggcggacgccatccggtggtggaacaggttctgaaagagccgtttattgccaacccactgtcactggcaccccagcgcagaatgctgattattaccggccccaacatgggcggtaaaagtacctatatgcgccaggcggcgctgattgcgctgatggcatggattggcagttttgttcctgccgatgagacgctgattggcccgctggatcgcatctttacccgtgtcggtgccgctgacgatctcgcctccgggcgctcgacctttatggttgagatgaccgaaaccgctaacatcctgcacaacgccaccgaaaacagcctggtgctgatggatgagattggacgcggaacatccacctacgacggtttatcgctcgcctgggcctgcgccgaaaacctggcgaaccgtatcaaggcgatgacgctgtttgccacccattatttcgagctgacaacactgccggaaaaaatggaaggcgtggtcaacgtccatctggatgccgttgagcatggcgacacgatcgcctttatgcacagcgtccaggagggtgcggcaagtaagagctatggtctggcggtggcggcgctggccggcgtacccaaagaggtgattaagcgggcacgcaataagctgaaggaacttgagaccgtttcaaaccactccgcgtcatcgacggtcgatggctctcagctgccgctgctggttgaagagacctcgcccgctatggaggcgcttgaggcgctggatccggatacgctgacaccgcgtcaggcactcgactggatttatcgtcttaaatcgctggtctgatattacatcccgtacatcgcaccgcgttaatgcgcggtgcgatgcttgctcgcccgcaaatcacttttctgcagacataaaaaaagcgatggttttcaccatcgcttttcgcattcaaactcagatttactgttaacgattattcacgaaacagtgcttcaatgctgaggccctgcgcctgcaggatttcacgcagacggcgtaaaccttcaacctgaatctggcgtacacgctcgcgggttaagccgatttcacgacccacatcctcaagtgttgccgcttcatagcctaacaggccgaaacgacgtgccagcacttcacgctgcttggcgttcagttcgaacagccatttaacgatgctttgtttcatatcatcgtcctgcgtggtgtcttccgggccgttgtctttttcatcggccagaatatccagcagcgctttttcagaatcaccgcctaatggcgtatcaaccgaggtaatgcgttcgttgagacgtaacatgcggcttacgtcatcaaccggtttatcaagctgctctgcgatctcttccgcactcggctcatggtcgagcttgtgggaaagttcacgcgcagtacgcagataaacattcagttctttcacaatgtgaatcggcagacggatggtacgggtttgattcatgatcgcccgttcaatggtctgacgaatccaccaggtggcgtacgttgagaaacggaacccgcgctccgggtcaaatttctctacggcgcgaatcaggccgaggttaccttcttcaatcaggtccagcagagctaaaccacgattgctgtaacgacgagcgattttcaccaccaggcgtaagttactttcgatcatacggcgacgggaagggatatcaccccgcaatgcacggcgagcgaagaagacttcttcctctgccgttaacaacggagaatagccaatctccccgagatagagctgcgtcgcatctaacacacgttgcgtcgcaccctgtgatagcaactcttcttccgctacgtcgctatcactggcttcattttcaacgagtgccttctcgtcaaaaatttcagctccgttctcatcgaattccgcgttctcatgtaactcgtttactttcagcgtattctggctcataagcggctcctacccgtgattccagggcagaacataaacctgttttgttctgccggattatcgctgcggtaaataacgcaacgggtttacggatttccccttgtaacgaatttcaaagtgtaatctgactgaactggttccggtgctacccatggtcgcgatcttttgccccgccttaacttcctgttgttcccggaccagcattgtatcgttgtgggcgtaggcgctcaggtaatcatcgttgtgtttaatgatgattaaattaccgtaaccccggagtgcgttacctgcgtaaaccactcgtcctgaagcagtggcgaccacagattgtccgcgcgtcccggcgatatcgatacctttattgccaccttcggcggcagagaagttatcgatgatcttcccgtcagtcggccagcgccagcttccgaccggcgttgaactgttggttgtactgctaaccgttgggggtgcggtaacgactggagctgttgtcgttgcaacatttgctccattcgaaggcaacattttgctgccacccgaattacctgaatcatcagaatacgtaataacaggttgctgtgcaacagcaggcgatttaatttgtggcgccgccggaacgccgccctgcgttgcatcagcaacggtaatgggattgccgccggtaatcggctgacccgacccattgccaatctgcagagtctggccgacattcaggccatatggcgcaggaacattgttgcgctgggctaaatcacggaaatcgttgccggtaatccaggcgatgtaaaacaatgtgtcgccacgcttaacggtataagtttcaccggagtagctacccttaggaatgttctgataactgcgattgtaaacaatccggccattctgcgtctcaacattgctgttggtactaatcattccaccacttgcgggggcagatgctgaatttttgcttaacatttgtccctgggctggcgtggcaggaacgccgcctgaactcatgtctgctccagactggttagtgttcatgccgccattatcgccaacgcgactgatgggtgcctgtgagttgtcgctggagctacagcctgccagccaaaaacctaccagtgaaagcgccgccagacggcgtaactgaaaaagtgtgcttcccgtgctcattaatcccccgtgatggcaactctgatctatctgtttcactgtatctgccagcaggatactctgcgcggcgcgataaaatctgcgttttcgatgaataaactggatagtaacaacatcaggtacgtggtgctatgaaacagttgtgaagaaatacgaagagggtcaggccagatcgccctgcaccagcgggacaaaacgcactggttcgatggtctcttccatcacctcttcgccctgacgacgcaggcgcttcagtacctgctgatcttcgccaaccggcagcaccatgatgccgccttctgccagttgtgctatcagcgcaatcggaatttcaggcggtgcagccgtgacgatgatggcatcgaaggggccacgtgaaggccagccctgccagccatcaccatgacgggttgagacattatgcagatccagctgtttcagacggcgcttggcctgccactgcagccctttgatgcgttccactgaataaacatggtccaccagatgggcaagaatcgccgtctgataacctgaacccgtaccaatctccagcacacgcgaatgcggattaagcccgagcagcgcggtcatccgcgcgaccatgtagggctgtgatatcgtctgaccggagccgatgggcaaggcaacattgtcccaggctttatgctcaaacgcttcgtcgataaaacgttcgcgcggcacctcgctgatggctttcagcaggttttcatcatcgatgccctgctgacgcagttgtgacagcaacgtctcaatacgccgattcaccatgccaggttcacctcagctttagccagccagtcactgagcacgtttctgcgcgctgtgcgccgttaaatcgacatggagtgccgtgacagagacgtagccctgatccacggcggcgaagtccgtatccgggcccgcatccagtttttcccctggcggaccaatccagtagagtgtattgccacgcggatcctgctgcgcgatcacctgatccgccggatggcgactgccacagcgcgtcacgcggatgcctttgagttcagataacggcagatcgggaacgttgatgttgagaatgcggccggtgcgcagcggttcatgcgtcagcgccctgaggagcgcgcaggtcacggccgccgcggtggcgtagtgctgatggccgttgagcgaaaccgcgatagccggcaagccaagatgtcgcccttccatcgctgccgccaccgtgccggagtagatcacatcatcgcccagattggggccggcattgatgcccgacaccacaatgtcgggacgcggctgcatcagcgcattcacccccagatagacgcagtcggtcggcgtccccatctggacggcgatatcgccgttttcatgggtgaaggtgcgcagaggcgtttccagcgttaatgagttcgaggcaccgcttcggttacgatcgggggcaacaacctgcacgtcagcaatctgccgcagggctttcgccagagtctgaatgcctggcgcatgaatgccgtcatcgttactgagcaatatccgcatttcgttctgacctttttttattcgactggtcgccgtgacggaacctgttttaacggcatggcaacaggtgaggaatagacggcgatttttgcattctagcgaggcgcgcaaggaagtggtaggcgtaaatcacacgacggtgggggtttgccgcaacattacccacactgcgggtcaggttgcggcgaagattactcatcaatctgatcgggcgagtccgcgtgggtcagcagctcccggaccacgctggtagcgaagctgcccgctggcagccagaatgccagttccagcgtaacatcatcccaccagctccactgcatatcgcgcggcaccaccagcatggcacggcgtgcagcatcgaccttttcacgttcaatcagtcccagcagcagcgtctcatcagccagcgcctgctgttcaaaggccagcgcgtcagcctgcgggccaggctcgccccgtcccggcagcggcgcggtgatgcgcagctcatgctgctcaacccggcgctgtgactctgccagttcatcaggctgggcgacaaaccagctgcctcgtccggtcagctgcaacgcatcgccgttgagcacctgagtcagcccaccctgctgttgcagacgcgcactggtcacctgattaaacagcgcactgcgcgcggcagagagcatcaggctgcgcttgttgcggtcgcgaataatgatctcattgcgcgcccacttttctgccatcacgaggttattgccgccgcgaccaaaacgctgttcaccaaaatagttcggcacgcccgcatcgcgaatctgcgccagacgcatttcaaccgcatcacggtcactgatctggcggatgatcagccggaaacgcgttccccgccagtgcgccgatgcgcagcttacgtttgtggcgcaccgcctgcagaatctcgaccccttccagctcaaaaccgcgcagatcgggcatcgcattacccggcaggcgaaaacagagagtctgttccgtcaccgcatggcgatctttcattccggcataactcatgtcgcgctgatgaataccgagatacttcgccagtgcctcagccacaaagcgggtattggcccccactttacggatgcgcaccagcaggtgctcaccttcaccatccgcgccataaccgagatcctcaaccaccacgaaatcttccggattggctttgatcacgccggaggccacgggtgtaccgtgcaggtaattcagcatcattggctgtcagctttcaggactaacgccaccgcttcacaggcgatgccttcgccgcgcccggtaaagcccagcttctcggtggtggtcgctttgacgttgaccgcatccatatggcagcccagatcttctgcaatattgatccgcatctgtggcacgtgcggcagcattttcggtgcctgagcaataatcgtgacgtcgacattaccgatgcgatagcctttggcttcgatacggcgccaggcctcacgcagcaggccacggctgtccgcccctttaaaggccggatcggtgtcaggaaacagcttgccgatatcgcccatcgccactgcgcccagcagcgcgtcagtcagcgcatgcagcgccacatcgccatccgaatgggcgataaaaccctgctcaaacgggatccgcacaccgccaatcactaacggaccctctccgccaaaggcgtgaacgtcaaaaccgtgaccgatacgcatcatgcgctctcctttaattgaatctgactcagataaaaagccgccagcgccagatcttctggccgggtgactttgatgttatcactgcgtccgctgactaacagcgggtggtagccgcaatactccagcgccgaggcttcatcggtgatggttgcgccttctgccagcgcccgcgtcaggcaggcggtgagcagcgcatgagggaaaaattgcggcgttaaggcgtgccagagatcgtcgcgctctacggtatgggccaccgcggctttgcccggctcgccccgtttcatggtgtcacgcactggcgcggccagaatcccgccaacgtggctctgttcacgcacgttgagcagttgctggagatcgtcgggatgcagacagggacgcgcggcgtcatggaccagcacccaggcggaaccctgtgcggcctgcaatccggccagcaccgattcggcgcgggtctctccgcctgtcaccctgagcacgcgcggatcgcgtgccagcggcagtgaagcgaagtgctggtcatcaggactgagggcgacaatcacctgtttgatagcgggatgggaaaacagacgcgcaatgctgtgttccagaagggtgtgctgaccaatcgtcagatactgcttcggacaggttgcctgcatgcggctgccgatcccggcagcgggcaccacggcaatcacatccgcaagggaggccagagtgttcatgttttatcgttgttggttaagcgctgcttgttgcgcgttgcgtttgttctggtcaggcaccagacgatagaaagtctcaccgggcttaatcatgcccagttcattgcgtgcacgctcctcgatcgcttccgagccgccattgagatcgtcaatttcggcaaacagctgatcgtttcgcgatttcagtttggcattgtttgcctgttgcaccgcgacatcatcattgacgcgcgtatagtcatggatgccatttttccccagccacaacgaatattgcagccagccaagcagcaccaataacagtaacgtcagttttcccatcccgccccctaaaaacggcccaatcatcccataactttgcacaggactccacaccagcggagaaaatggcgcgctttgctgcgcgtctgcgcaaaatatgaatcagtaccgattcagacgggaaaagatttgtaacctgccgatgcgtttgcacatcagcgcgggcgcactgagggcttaccagccagagagaaaagagaacattaaccagaagagcgtgaccaccatgatcaccgtggcgagcgcggcccacagccactgtccactcagcagcgtattcagcgcgatacccgtgaccaccgcaaccggcagcagcgccagaaagaatggccaggtataaagaaagaagaacagcgtgttagagccgaacagcaggaaaggaatcgccagcgcgcaccagtaagcgagaaagccgataacgccgcccggcagcaatgagcgcggctcatccggggaggagtcatcttttcgagcgagcattggggtaatgttctgcataggcatcctgttggcgcgagggcggcaaatcagaaacgatttgccgctgtctcttcaggatttgatgatatcgcggtcacgcagcaggtctaacaattgggcggccagttttgtaaccaattgttcgccatccagctggatttccgggctatcgggcgcctcatagacgctgtcgatgccggtgaaattacgcagttcaccggcgcgcgctttgcgatacaagcctttcggatcacgcgcttcacacacggctaacggcgtatcgacaaatacctcgataaactgtcccggctccagcagatcgcgcaccatctgacgctcggcacgatgcggcgaaataaaggcagtgagcaccacgagtccggcatccaccatcagtttcgccacctcaccgacgcgacggatattctctttacgatcatcatcgctgaaaccgaggtcacgacagaggccgtgacgcacattgtcaccatccagcagataggtgctgacgccgatgcggtgcagcgcctgctccagcgcaccggcaacggtggatttccccgagcccgaaagccctgtgaaccacagcaccacgccctgatggccatgctgctgttcgcgagaggcgcgtgtcaccggatgatcatgccacaccacgttatcgtcgtgctgagccattactgaccgcccagcaggtcgcgcgcattccagtgtgggaagtggcggcgcaccagcgcattcagttccagctcaaacgcgctgaactcgccggtattaaccggggcatcatggtttggctgatggatcatgccggcacccacggtgacgttgctcaggcgatcgataaagatcatgccgccggttaccgggttctgctgatagctgtcgagcaccatcggttcgtcaaaggtgatctcaatgcgaccgataccgttcagcggcagcgtatcgacctgacgcgtctccagcgagttgatctcgacctgatgcagcaccttctctacccggccacgagttttcttaccggcgattttcaggtcatagctctgaccggcctgcagcggctgttctgccatccagaccacgtcaacgctggcagactgaaccgctgccagctcttcactggcatccaccagcagatcgccacggctgatatcaatctcatcctgcagcaccagggtaatcgcttcgcctgcacccgcttcctgcagatcgccatcgaaggtcacaatgcgggcaatggtcgactccacgccagaaggcagcactttaacgcgctggcctacctgcacgctgcccgacgccagagtgccggcatagccacgaaaatcgaggttcggacggttgacatactgcaccgggaaacgcatcggctgatgatcgacgacgcgcttcagctccacggtctccagcacatccagcagcgtcgggccgctataccacggcatggtctgactggcagaggcgacgttatccccttccagcgccgacatcggcacaaagcggatatcgaggtcttccggcagctgcgcagcaaagtcgaggtaatcctgtttgatctgttcgaagcgctcctggttgtactccaccagatccatcttattgatcgccaccaccaggtgtttgatccccagcagcgtcgagataaagctgtggcggcgggtctgatccagtacgcctttacgcgcatcgatcagcaggatcgccagatcgcaggttgacgcgccggtcgccatgttacgggtgtactgctcatgtcccggcgtgtcggcgataataaatttacgcttttcggtcgagaagtagcggtaggccacatcgatggtaatgccctgctcacgctcagcctgcagaccatccaccagcagcgccagatcgagcttctcgccctgggtgccgtgacgtttgctgtcgttgtgcagcgatgagagctgatcttcatagatctgacgggtgtcgtgtagcagacgtccaatcagggtactttttccgtcgtcaacgctgccgcaggtcagaaaacgcagcaggctcttgtgttgttgcgtggtcagccaggcttcaacgccgccctggtcggcaatctgttgtgcaattacggtattcatctggcgtctccttagaaataaccctgacgttttttcagttccatcgaaccggactgatcgcgatcgatcatgcggccctgacgctcgctggtggtggaaaccagcatctcttcgatgatctccggcagcgtctgcgcctcggactctaccgcgccggtcagcggccagcagccgagcgtacggaaacggaccatccgttcggtgatctcttcacccggctgcaggttgatgcgatcgtcatcgatcatcatcagcatgccatcacgctccagcaccggacgcggtgcggcgagatagagcggcacgatctcgatgttttccaggaagatgtactgccagatatccagttcggtccagttcgacagcgggaagacgcggatgctttcgcctttgttgatctgaccgttgtagttgtgccacagctcagggcgctggtttttcggatcccagcgatggaagcggtcacggaatgagtagatacgctctttggcgcgtgacttctcttcatcacgacgtgcgccgccaaaggctgcatcaaaaccatatttgttcagcgcctgcttcagcccttcggttttcatgatgtcagtgtgtttggcactgccgtgaacaaaggggttgatgcccatcgccacgccttccgggttgcggtgaaccagcaactctgcgcccatcgctttcacggtgcgatcgcgaaattcgtacatttcacggaatttccagccggtatccacatgcagcaacgggaagggcagcgtgcctgggtagaaggctttacgcgccagatgtagcatgaccgaggagtctttgccgatggagtacatcatcaccggattgctgaactccgccgccacttcgcgaatgatgtggatactctccgcctccagctgacgcagatgagtgagtcgtttttggtccatgattttccctcaagccagattgacaacggcggactcgcgagccccctgctgtgctgaatgtttaaaccaggcgagttgcccgtgcagattaaccacctctccgatcaccagcagcgccggagtgggtgccgaggcggccagcgcctcaagttgttctaaggtgccggtcagcacctgttgatcctggcgggtgccgcgactgatcaccgccaccggcgttgatggcgcgcgaccatgctgaatcagcgcctcgctgatggcagcggctttaacggttcccatgtagatcgccagcgtctgacgcgcacgcgccagcgatggccagtcaatgtcatccccatcgggacggcagtgaccggtaataaacatcacgctctgcgcgtagtcgcggtgggtcagcggaataccggcataggccgtcgcaccggcagccgcggtgacgcccggcaccacctggaacggcacacccgcctgctgagccgcctgcagctcttcgccgccgcggccaaagataaagggatcgccgcccttgaggcgcacgacgcgcttgcctttcagcgccagtgaaaccagcatctgattgatctcttcctgcggcaacgtgtgcgcgctggcccgtttgccgacgcagatgcgatcagcatcgcggcgcaccagatccagcacctcttcgctgaccagatggtcgtagagcaccacatcggctaactgcatcacctgcaggccacgcagcgtcagcagaccgctgtcgcccggcccggcgcccaccagaaagatctcaccctgacgggtcggctcttcctgcagctcacggtccagcgtgcgtttcgcctcttcgacgttaccggcagacatctcactggcgaaccggccgtcgaaagcgcgtttcccagaagcgccgacggtcagacatgcggctgaagcgctgtttgactttatcgcgccagagtccggccacttcagccatctgacccagactggcaggcagcagcgtttcgattttttcgcgcagcatgcgtgccagcaccggtgcggtgccgctggaggagatcgccaccaccagcggtgagcggtcaacaatcgaggggaagataaaggtgcattttggctggtcatccaccacgttaaccagcttatgccgcgcattggcggcttcaaacacctgggtgttgagatggttgtcgtcggtggcggcaatcaccaggaaaacgccatccagctgggccgggtcaaattcggtcgccagccactccagctcctgcttatccagcagtgcctgcagttcagggcagagttcacgagatgcgatcagaacgcgcgcgcgtgcacggcgcagcagttcaatttttcgcgccgcaatatctcccccgccgacaaccagaaccgggcggccagaaagatcggcaaaaagaggcaaatagtccacgttaaccctgatgttttaactttgtattaacgcgactatacgtcgctgagtttatccagatgaaattacgaattggaatgagtagttaccgaatggaataacgacgccgcaaagcacagaacaatttggtcttaacagatgaaatttaatggctttttcgtgaacaggctcacatattgaaagccacacctgcggcagcaaaagcagataagtgccagcgataatggtccgttacgcctttcggtagtgacagcgcccgattccactaacaaagtcacgggacaaaaaggatataatgcgcgcggcatggctggccctggcccccatgcggaacggctcccgaataatgaaaaaggatgcactatgttttattccctccgcttgagggtagcgacaattttatttggcgcactcatttctccgctggctctggccactccgcctggccagtttgccgaacagcaggtccggcacatcgccaccttgtttcctggccggatgagcggcagcccggctgagctgatggcagccgactacctgcaacagcaatttaccgcgctggggtataagaccaatacccgccagttcaggaccggctataagtggcaggaagaggacggcacgcagcgctggcataagctcacggcaacctcggtgattgccgcgcgtgcaggcagcgtgccgcaggagattctgatcgtggcacatctggatacctggacgccgcaaaatagcagccaggcccagtacaatctgggcggcttacgcctgcagggcgtcgatgataatgcatcgggtcttggcgtgatgctggagctggcgcagcagctgagccgcaaaccgctgcactacggcatacgctttgtggcgctgagcgccggagaggcagatctgcacggcatggatgattatgttgagcggatgagcacgcgtgagaagaagaataccctgctggtcatcgatctgaatagcctgatcaccggcgatcatctttattttaacagcggcatgaatacgccccgggcggtgcgcaagcagaccagcgaacgagccctgttactggcacgccagcagggcattcccgccgccagtcatcagctgaaccgtaaagactttgacgctcttaatgccttcgacaaggcgggctttccgctgctggatgtgaccgccagcaactggacgctgggtaataaagatggtgcgctgcagcgtcatcgtagtccccactttcctgatggcgttacccgccatcagactgacctggataatctgagctatctcgaccgctggctgccggggcagataaccttgcgaacccgcgacagcgtttcgcgtgctgctgccgctgctcagtgaactgaccaatcccaaagtgtaaggatctgacatgtacgtggtctttctgaattacgttcgtccggtagaagaagttgaagcgctgctggcagcccatatcgaatggctggatcgctattttgacgcgggcttttttattgcagcgggacgtaaagatccgcgcacgggcggcatgttactggtcagggagatggaacgagaagagctggatgcaattttagcggaagatccgtttgtcacggtggcagagtatgaggtgacgaaagtgaatgtgacccgtgcagcagaggcgtttgccggattaaaaggcgcttagctttccgcctgactgcagccaaaaacttctctccctgtgtgcggggagagaagtcctgcgtcagccttcgtgcagaccacactcgcgcttgaggccgaagaagcgcgtctcttcttctgccatacccggctcccacttgcgggtggtatgggtatcgcccaccgatagatagccttcatcccacagcggatggtacttcagcttatgctgctccaggtactgatgaatctggcggttatcccagtcgataatcggcagcagcttaaagacgccacgctggacgcccagcaccggcagattcgcccggctgcccgactggtcgcggcgcaatccggcaaaccaggtctgcgcgcccagggtttcaatggcgcgattcatcggctcaactttgttgatctcgttatatttctcaatcccctcgacgccctgctcccacagtttgccgtagcgcgcttcctgccaggccggagaggtttcggcgcggaacactttaaggttgagattgagctggtccgccagctcatcaataaaacgataggtctccgggaacagatagccggtgtcggtcaggatcaccggaatatcgggctgcagacgcgtcaccagatgcagcgacaccgcggcctgaataccgaaactggaggagagcacataggcacccggcagattctccagcgcccagctgacccgctcttccgctgatgacttctccagctgcgcattggtcgcggccagcgccatagcacgctggactttggacatctcattcagtgctgcgaggtcggggtgactcattttgcttcctcccaaaaatcgcgtgccgggtccagcaccggcgcaacaatgcccgcgcggatggtgaagtcaccaaagccttcagcggcctggcgctcagtggcccagcgtcccaccagctcatcaatggtggcgagaatttcgctttcgttaatgttttcacggtacatgcggggaatacgcgttccgctgcggtttccacccagatgcaggttgtagcgacctggcgctttacccaccagacccagctcagccagcatggcacggccacagccgttgggacaaccggtaacgcgtaacactatgtgctcatcaccaacgccatgcgcatgcatgatcccttccactttggtcacaaaggcaggcaggaagcgctcggcttctgccatcgccagcggacaggtcgggaacgccacgcaggccatcgagttttcgcgctgtgccgtaacgtgatccatcagaccatgttcgcgcgcgattgcttcgatctgcgctttttcgctttccggcacgccggccacaatcaggtttctggttagcggtcaggcggaaatcgccctgatggattttcgcaatttcagcgatgccgcttttcagcggtcggcccggatagtcgagcaggcgaccattttcgataaacagcgtcaggtgccatttgttgtcgatgcctttaatccagccaatgcgatcgccacgggtggtgaactcataaggacggatcggctcaaacgtcaggcctgcccgtttttcaacttcggctttaaaggtctcaacgccaacgcgttccagggtgtacttggttttggcgtttttacggtcggtgcggttgccccagtcgcgctgagtcgtgaccaccgcctcggcaacgtcgaggatcttctccaccggaaaatagccaaactcgctggcggtgcgcgcataggtcgctttgttaccgtgctcaatcgacagcccgccacccaccagcaggttaaagcccaccagcttgccgtgctcggcgacagcgacaaagttcagatcattggcgtgcagatccacgtcgttatgcggcgggatcaccacggtggttttgaatttacgcggcagatacgtttcaccgaggatcggctcttcgtcggtggtggcgactttttctttatcccaccagatctccgcataggcacgggtgcgtggcagcagatgctcagagagtttcttcgcccactcatacgcttcctgatgcagttccgactcaaccgggttcgacgtacagagcacgttacggttaacgtcgttggcggtcgccagcgcatccagccccacttcatgcagcatctgatgcgtcggcttaacgttcttcttcagaatgccgtgaaactggaaggtctgacggttagtcagacggatgctgccatagatggttttatcggtggcaaatttgtcgatggccagccactgagtcggcgtaatgatgccgcccggcaaccggcaacgcaacatcatggcgtggcgcggctccagcttctgctccgcacgttcggcacgaatatcgcgatcgtcctgctggtacatgccgtgaaaacggatcagcaggaagttgtcgccggtaaaaccgccggtcagaccctcttccagatcttctttaatggtgccgcgcagatagttgctctgcttcttcagacgctcagcgtctgctaatttgccttctacaaccagcggtccagggtgtttatcgctcattagtaaacgtctcgctgataacggcgctcaatgcgcagctcacttaaaaattcgtcggccgtttcacgatccattccgccgtgttcgaccaccacatccagcaatgcctgctcgacgtcttttgccatacgattcgcgtcgccacagacataaagatgcgcgccctcttcaatccagcgccacacttcggcccctttcgcgcggatcttatcctgtacgtaaatcttctctgcctgatcgcgtgaccaggcgaggtcaatatgggtcagcagaccatccttaacatatttctgccactctacctgatagaggaaatcgtcggtgaagtgcggattaccaaagaatagccagtttttgccgctggcaccgtcgttgtcgcgctgctgcataaaggcgcggaacggcgcgatgccggtgcccgggccaatcatgatcactggcgcatccggattagacggcaggcggaaattgtcattgtgctcgatgaagacccggacttcgccctcttcttcgatgcgatcggccagccaggtcgatgcaccgccgccacgctggcgaccttcaatatcaaagcgaacggcaccgacggtgatatgcacttcggtatcggtttcagcctgcgaagaggcgatagagtagagtcgtggcgtcagcggtcgcagcagtccggtcagctgttcagcgctgagttcagacggtgccaggcgcaccatatccacaatcggatagtgctgcgcatagtgctgcagcctggctttatcatccaccagtgagagcaactccgcgttgcgtgacagctgggcatactgcgccacgatctgcgcggtgttaaccgtcagctcgaaatgcttctgcagcgcctccgccagcggcagggttttcccctgaacctctaccggctcatcgcctttcagccagaccagctccagcagttcgctgaccagcgccgcgtcgttctcataccagacgcccagcgcatcgccaggctggtagcgcagaccggaatcgcccagatcgatttcgatatggcgcacatctttatctgagtcccgtccggtaattttctgattcaccgccagactcgcgctgagcggcgactctttagtataggggctggtggtgacttcgttgacgctgccggctgctgtcgccgcagcctgcgccggggattcagtgggaacgcgtttcttgagaatttccgtcagtgcattgcgccaggcggcggcctgctccgcatactcaacatccgcatcaacgcgatccagcagacgctcgccgcccagctccgccagtcggctgtcaaaatctttacccgcctgactgaagaattcataagaggtgtcgcccaggccaaacactgcgaaggcggcaccctccattttcggtgcctttttcgacatcaggaatttatgcagcgccaccgcctcttctggcggtttcgccttcgccctgggtggaggttacaaccaccagcattttttcctggccaatctgtttgaacttgtaatcaccggcattcaccaggtttacgttcagctttgcggccagcaggtcatcacgcaactgctcagccagacgacgtgcgttgccggtctgggaagcggaaagcagcgtaatggcgggcgcttcggccggagccggagcagatgcagtgctggcgacggcgctacccggggtctgttccaccctgccccagaaatagcctgacagccacgccagttgagtcggggaataatctgtcgtcgccgcctgtaagcgagcgagttgttccggagagagcggaagcattgaaccaggtgcctgagtcgtcatcgcgttaaaaattccagtatcagaagtccggaccgtaaaatggcggaagagtgcgtaggttaccggtccgtatattaacgattaaatacaccttcgacatatcaaataaccaaaatgactaaatggttttccaggtagaaataatcgttaaaagtggtaagtaaagcggtgatatatcagttaattagctggacgccactgtataaacgcgcaggaaaagtatcggtttgtgcggttcgggtgcgaaaaaagcggtaatcaggtagaattcagcggttttttaatgtctgagaaccattatgtctaccaccttgtttaaagagttccagttcgaagccgcgcatcatctaccgaatgtgccggccggacacaaatgtggccgtctgcacggtcattcgttcctggttcgtctggagattaccggcgaagtggatgcgcataccggctgggttatggattttgctgagctgaaggcggcgtttaagccggtctacaatcggctggaccactactatctgaatgatatttccggcctggaaaatcccaccagcgaagtgctggcgaaatggatctgggatcagatgaagccggaactgccgctgcttagcgcggtgatgatcaaagaaacctgcaccgcaggctgcgtttaccgcggctaaccctgtcggatcgaacccttcgatccgacgcggcttttctctccgtcctgcctctgacgctcaacgctttcctgtagttaacggctcactgcgtgccgctttatcaggatcaggcgatattgagatatttatgggtctgcatcgacagacgccagttacgggcaatgcaggtctcaatgcagagccgggttgcatcatctttgcggctgattggctgcagggcgatgatacgcgctttggtgtcatcaatgcctgccagcagccgatccagcgcttccacatcacgctcgcgcgctaccggatgcttgatttcatcggcccggctcagcgcctggggcagaacatcgtagccgccgcgcatgttgaccttcggcgagacagtcacccaggtccgttcggaacagtgaatctcgtgggttccgctggtctcaatctggcactggaaaccgtgctgctccagcgcagtggttaacggacgcagatcgtatatcgccggttcaccaccggtgatgaccacatgacgcgccgtccagccctgctgcgcaatggcactcaccagggtcgccgcgtccgcatcaccccaggcgtcgctttccaccgtcttgatcaaaatatcgcccagcgacgtttcccgatctgtccgcttttcccaggtgtgtttggtatcgcaccagctacagcccaccgggcatccctgcaaacgaatgaaaatggcaggcacgccggtgtaataaccttcgccctgcagtgtctggaacatttcgttaatcgggtattgcattacggactcgcttgaaaaaaacagggcgctgattatggcagatttgccgcgcagctcaaccacgcgttgtgccttttctccgcgccggacaaaacacaaaagagaggcttcagacggctgacaggctcagaaacgtggatggccaggaccgaagagcaaagcgtcccgcgctcaggacaaaaacgccggaagcgtttttgaacaacgcaaaacgttgtcccggtaaggggcgcacctcagggatgaggtacgtaatcgcgcggacccggccggcagagatgccgctttggcgatcgggcctttccatctgcgtttgcacaccgccatcaacaaaaagccccgcacaaggcggggcttcagaggccgatgatgtcacttagcgcgacatcaatgcacagtcattactgacctttaacttctttcagaccgttgaatggcgctttagaacccagcgcttcttcgatacggatcagctggttgtacttagcaacacggtcagaacggctcattgaaccggttttgatctggcccgctgcagtacctaccgccaggtcagcgatggtagcatcttcggtttcgcctgaacggtgagagatcacggcagtgtagcccgcgtctttcgccattttgatcgcagccagagtttcggtcagagaaccgatctggttgaatttgatcagaatggagttagcgatacctttatcgataccttctttcaggattttggtgttggtaacgaacaggtcatcacccaccagctggattttgtcgcccagtactttggtctggtaagcgaagccgtcccagtcagattcgtccaggccatcttcgatagaaacgatcggatactgtttagtcagatcttccaggaagtgggtgaactcttcagaggtaaacgatttaccgccttcaccggccagaacgtatttgccatctttgtagaactcagatgccgcacagtccatcgccagggtgatgtctttgcccagctcgtagcctgccgcttttaccgcttcagcgataacagccagcgcttcggcgttggaacccaggttaggcgcgtagccgccttcgtcacccactgcagtgctcatgcctttgcttttcagtacttttgccaggctgtggaacacttcagaacccatacggatggcttctttcaggttcggagcgccaaccggctggatcatgaattcctggatgtcgacgttgttgtcggcatgttcgccgccgttgatgatgttcatcattggcagtggcatagagtatttgcctggggtgccgttcagttcagcgatgtgctcatacagcggctgacctttagaggctgcagcggctttagcagctgccagtgaaacagccagaatggcgttagcaccgaagttagatttgttctcagtaccgtccaggtcgatcatgatcttatcgatgttcgcctgatctttcgcgtctttgccttttaccgcttcagcaatcggaccgtttactgcagcaacggctttggttacgcctttgcccagataacgtgatttgtcaccgtcacgcagttccagcgcttcgcgtgaaccggtagaggcacctgatggtgcagctgccaggcctacgaaaccgccttccagatgcacttcagcttcaacagtcgggttaccacgtgagtcgataatttcgcgaccgatgacttttacgattttggacattacgattttcctcagtacaagttagtcaatcctaagacaagcaacgcgcgaaaagttcgcgcgctgcctgtgaaacttacttcgctaaacgcttctgatgctcatgtgcggctttaacaaagccggcaaacaacggatggccgtcgcgtggggtcgaggtaaactcaggatggaactggcaggccacaaaccacggatggttcgggatctcgataatctcaaccagttgatcatcaccagagcgacctgctacgcgcagaccggctgcttcaatctgctttaacagcatattgttcacttcatagcggtggcgatggcgctcaacgatagtgtcagagccgtagagctggcgaacctggctgcccggcgttaactgacactgctggctgcccagacgcatcgtgccgcccagatcgctctgctcgctgcggacttcgacgttgccatcttcgtcacgccattcggtgattaatgccaccaccggatatttacagtctggcacaaattccgtggagttggcgcccggcatcccggcgacattgcgggcgaaactccatcagcgcaacctgcatgcccaggcagatgcccaggtacggcacgttgttttcacgtgcatactgcgcggtcatcagcttgccttccacgccacggtaaccgaagccacccgggatcagaatcgcatccagatctttcagtaattcgacaccgcgtgattcaacatcctgcgaatcgatcagtttgatgttcacggtgacgcgatttttcaggccgccatgtttcagcgcttcgatgaccgacttgtaggcatccggcaattccacatacttgcccaccataccgatggtgacttcaccacccggattggcttcttcgtagatcacctgctcccattcggccaggttggcttccggtgcattcaggttgaagcgcttgcagatatagtcatccaggccctgcgatttcagcatgccaggaatcttgtagatggaatcaacgtctttcagcgagataaccgctttttcagggacgttacagaacagggcgattttagcgcgttcgttggccggtacggcacggtcagaacggcaaatcagcacgtctggctgaataccaatcgacagcagctctttcaccgagtgctgggtcggtttggttttcacttcaccggcagccgccatatacggcaccagcgtcaggtgcatatacatggtgtgttcgcggcccacatcaacggccatctggcgaatcgcttccaggaacggcagtgattcgatatccccgaccgtgccgccgatttcgaccagtaccacatcatgaccttcaccgccttcaataatgcgttctttgatggcgttggtgatgtgcggaataacctgaatggttgcgcccagatagtcgccacggcgctctttgcgcaggacttctgagtagatacggccagtggtgaagttgttacgacgcgacattttggtacggatgaagcgctcgtagtgacccaaatccagatcggtttcagcgccgtcatcagtgacgaaaacttcaccgtgctgcgtcgggctcatggtgcctggatccacgttgatatacgggtccagcttcatgatggtcacgttcagaccacgggcttcgagaatggctgcgagggaggctgcggcaatgcctttacccagagaggaaacgaccccgccggtcacaaaaatataattcgttgtcatgctgaacctgagagtttaggtttaaagacggtggaataaccaggacgggaaaacagtatactggaaaccgctatcagccacaattgatgaatcaccgccatcctccaacgcattgctgcggctaacatagccgatagccgccaatgaaatgttgacgtgcgtcacaaagttgccgtcaggctgaatcgagtaagcgaaagcggtgactttatgcacagcgctggaataatcagcgcttctcgccccgtttcacctgctgccaggcggcttccatctgctccagtgtggcacccggcatacttaacccctgtgcagcgatgatcgcttcgacttcgcggaagcggcgctcaaacttgtcgttggccttttgcagcgcagtttccgctttgctgcccagatggcgcgacaggttaaccgtggcgaaacagcaggtcgccaatctcctcttccagcttctcaccatccaccacgctctgctgcgcctcgtgcatcacttcatcaatctcttcatgcaccttagccaccaccggccccagcgtggtccagtcgaatccgacattgtgacaacgcttctgaatcttgtgggcgcgcatcagtgcgggcagtgccttagggatatcatccagcgccgaatgctgggctttgtcagcccgctcagcggtttttatcgcttcccagtttttcagcacttcgctgctggtttctgctgtggcatcgccaaaaatgtgtggatgacggcgctccagcttgtcgctgattgcgtggcagacatcctcaaaattaaagcgatcctgttcgctggccatctgcgcatagaacaccacctgaaacagcagatcgcccagctcaccgcgcagatcgtcaaaatcttcgcgctggatggcgtccagcacttcgtaggtctcttccagcgtatagggcgcgatggtggcgaaggtctgttcacgatcccacggacagccatgttgtggatcgcgcagggttttcattatgccaagcaggcgctcaatagcattcattcaggaggatccttgattagtgagatgacaggcaacgggcgaagaggcaaagcgtacaacacggcaggacgctattcaccgcgtccggccgtgtctggtggtgcagaaaacgcctgcgcaacctcctgctgccggttgcctcagtgcctgcctgaatatcagtgcaggcgacgggcgtcaatgatatcagagacctggttcagacgcgccaggacacgtcccagtacctgatggttgtagatctcgatatccatgtcgatggtcgccagctgttttttggtgtcgctgcggcttgagacgcccaggacattcactttctcgttggcgagaatggtggtgatgtcacgcagtaagccgctgcgatcgttggcggtcacgcgcaccaccagcgaatagccgctggagtagctttcgccccacaccgcatcgacgatacgttccggcgcatgcgaaatgagttcagccagctggtcgcagtcggcacggtgaatagagatgccgcgcccctgggtgatgaagccgacaatatcatcccccggaatcggctggcagcagcgggcaatgtggtgcatcaggttgcccacgccttccacgacgacgcgtccgctctctttgcgtgaagagggagtgtacgatttctgggtcagctggcgcagtgcttcgcgatcttcctcttcggcgctcggcttgttcagcttcgcctgcaggaagttaaccatctggttaagacgaatatcgccgccgccaatcgccgccagcagctcttcaagcgaggtgacgttatagcgcggcagcagcagtttttcggcttcgcgcaggctgatatccagctgattcagttcgttatccagaatctgccgtccggcgattatattcttgtcgcgatcctgcttgcggaaccagttgtggatcttcgagcgtccacggttggtggtgatgtagcccagattcggattgagccagtcgcggctcgggttcggctgcttctgggtgatcacctcaacctgatcgcccatctgcagctggtaggtgaacggcacgatacggccaccgattttcgcgccgatgcagcggtgaccgatgtcgctgtgaatatgataggcaaagtcgagcggcgtcgatccagcgggcagatccaccacgtcgcctttcggggtaaagacgtagacccggtcatcgaacacctggctgcggacctcttccagcagtttcgccggagtccgccatctcttcctgccagctgatgagcttacgcagccaggcgatccgctcttcatgaccggccgcgccacgcgcgctgctggaagttggcccctctttatatttccagtgcgccgccacgcccagctcggcatcttcatgcatctggcgggtacggatctggatctccaccgttttgccctgcggccctaacaccaccgtatgaatcgactggtagccgttgggtttggggttagcgacgtagtcatcgaattcgctgggcagatggcgatagagcgtatgcaccgtacccagcgcaccgtagcaatcctgcaggcgatcggcgacgatgcgcaccgcccgcacgtcaaacagctcatcaaaggccagcgattttttctgcatcttgcgccagatgctgtagatatgtttcggacggccatagacttcggcgcgcacgccctctttgaccatctctttgcgcagattgctgacgaagttctcgatgtactgctcacggtcaatacgccgctcatgcagtaatttggcgatgcgcttatattcgtcaggatgcaggtagcggaagcagtaatcttccagctcccatttgagctgaccaataccgagacggttggccagtggcgcatagatattggtgctctctttggcggccagtacccgctcatcttccggcgcatctttcatttcgcgcaggttcatgatgcgttcagccagcttcagcactacgcagcggaaatcttctaccatcgccagcagcatgcggcgaacgttatccacctgttcagaggccatggagtcgttgtggatcgctttcagctggcggatagcatccatatcgcgcacgccgtgtaccagcgaaacaatgcctttgccgacggcggtttccagctcctcttcactcaccacttcatcgttagccagcgggaaaatcagcgccgcacacaggctttcgatatccatgctgagcattgagaggatttcaaccatctcaataccgcgccacagcagcagcgactgatcaggatggccctgcgtctgcgcttcacagtagcgccaggtctcggccacacgttgacatgattgcgggttggcaataccgagactggcgatccactggtcgagggcgaaatccccctcagtatttaaatgcgcacttctgaccgcaaccataacctctcctgcacaacgacatacatcgcttatgtttttctgaacagcaccatggattcgagatgacgggtatgtgggaacatatccagcatcgcgaccctttccaattggtagcctgccgacagcaatgtctggctgtcgcgggcgagtgtggtgggattacacgaaacatagaccacgcgatctggtgcaagtttaaccacatgcgccattacgcccgcagccccggcgcgtgccggatcgagtaataccttgttaaatccctgtgccgcccacggctggcgcgacacttcttcttccagattatgctgaaagaaactgacatttttaagattattcaaatcagcattatacgctgcctgccgcactaatgctgcaatcccctccacaccaaccacattatgtacgaagattcctataggaagtgtgaagtttcccatgccgcaaaacagatccagcacccggtcttccggctgcagatcgagccaggcaattgccttcgcgaccatctgctgattaacaccatcgttaacctgaataaaatcctgtgggctgaaggttagcttaagctggtgagattgataaaacggcgtcgactcatttaacgcactcaactcttcctcgcccgcatccaggaacagcatcagctgatgcttatgcgaaaactgttccagtttttcacggtcatccgcatgcagcgcatcaagatggcgcagaatcatcagcggcccgttgtctgccagcaccagctccacatgcccgagacgcctgacggcgcgtaagtcactgagacactgatgcaatggaaccagtaaagcctcaagttcgggcactaaaatggggcattgctgaatatcaaccagatcgttgctggcttcctgacggaagcccatctgcaaccgctgcgccttattttgccattgcagccccagacgggcgcggcgacgataaccccagggctgaccggcgattacctcatccaccgccacgtcttgtgcggcggcctggcgcagcatccggctcagcgcctgggctttgctctgctgttgcagcgccacatcggcatgctgctgctggcagccgccgcagcgttcataatgcgggcagcgtggcgtgatgcgcgccggactgcggctaatcagtcgtgtcactttcgcccgggcaaattgacgtttatcctctgtcagcatgacctccgcctgttccccaggcagggcaccggcgacaaaaagggttttgcccttgtgacgcgccaccccttgtccgaacggatcgagcgcctcaatggtgacggtgatccgttgttgcgtcgtcacgcgctgttttgcaacgtaaaattgcgccatagtgttattaattctctttatcgaaaacgacctgcattgtttttgtcgacagcatgcacagggacgttaatgccggagtagccaggcgactattatgaccaaatacagcctgcgggcgcgaatgatgattttaattctggcacccacgctgatggttggcctgctgctcagctcattttttgtggtgcaccgctacaatgaactgcagcgccaggttatcgatgccggagccaatatcattgaaccgctggcgatctccagcgaatacagcatgacctggcacaatcgtgacgccatgcgtgaactggtcagcctgctgcaccgccgccattcgggcatcgtccgggcgatctcggtgtttgataatcacaaccagctctacgtcacctccaatcacaagcagaacctcagcctgctgcaacaggatgatatccgcgccctgcccgacgatgtctccatggaacgtcacggcaacgtattgattctgcgcacaccgatcaccaccgagcgttacgatgtggatgaattgccggacgaagatgccaagccgtcgggcaatccgctgggctacgtggcgatagagctggatctgcagtcggtgcgcctgcagcagtacaaagaggtgtttgtcgccacgctgatgctgctcttctgtctctgcctggccatgctatttgcctatcgtctgatgcgcgatgtcaccgggccgatccgcaatatggtcaccaccgttgaccgcatccgtcgcggccagctcgacagccgcgttgagggatacatgctgggtgaactcagcattctgaaaaacgggattaatgcgatggcgatgtcgctgaccgcctatcacgaagagatgcagcacaatatcgatcaggcgacctacgatctgcgagagacgctggaacagctggagattcagaacgttgagctggatctggcgaagaaacgcgcccaggaagcggcacgcatcaaatctgagtttctggccaatatgtcgcatgagctgcggacgccgcttaatggcgtgctgggctttacccggcagatgctgaaaacccagctgcgcaccacccagcgcgactatatgcagaccattgaacgttcagccaataacctgctcagtattatcaatgacgtgctcgatttctcgaagctggaagcgggcaaactgatgctggaggcgatccccttcccgctgcgtgccacactggatgaaacgctggtgctgctggccccgtcggcgcatgacaaagggctggagctgacggtggtgtgtgacagcagcgtgccggacaatgtgattggcgatgcactgcgcctgcaacagattctgattaacctgatcggtaacgccatcaagtttaccgagaaagggtatatcggcctgcgtgtcggacagcgggtgattacgcagtcgcgcgtcgagctggagattcaggttgaagatagcggcataggcatctctgagcagcaacagacacagctgttccaggcgttccgtcaggctgacgccagcatttcgcgccgtcatggcggcaccgggctggggctggtgatcacccagaaactggtgcgggagatgggcggcgaaatcaccttcagcagtcagccggacaagggctccacctttgtgattcgcgtgcagctggatctcaatcccaatgcgcccggcatgccacgcgtgctggatgcgctgtcacatgcgcgcattgcctatgttgaagcggatgctaacgttgccagcgcagcactggagatgttaagcgccacaccattgcagatcgattacagcgaaacgctggagggtttaaaagcgtctcactatccgctgctgctgatggcgatgccggtcgacatcagtcagcccgagctgctcaatgaacgcatgattaatgcgctgctggatcgggccgacaacgtgctgatggcgctccccagcccgatgatgttgctggcggatgaactgaaggtacgcggcattgacggttgcatcgctaaaccgatctccctgacgcgactcctgccgatgttactggatctgcatacccgtcagatcagtgaactgccgctttcaccccggctgccgctgacggtgatggcggtggatgataaccccgccaacctcaagctgattggcgcgctgctggaggagcaggtgcagaacatcctgctgtgcagcagcgccgaacacgccatccgtgaggcacgtcagcagtcgctggatgtgattctgatggatattcagatgccggacatcgatggcattcgcgccagcgaaattatccgcagcatgccgcatcatgccagtacaccgattgtggcggtcaccgcccatgcgattgatggcgagcgtgagcaattgatcaaggcgggcatgaatgactatcttgccaaaccgattgatgagagcaagttaagacagttgctggcgcgctatacgccaccaccagtggtcaccgtgccggaactgctgccaatattacccacgctggactggcaactggcgctgcgacaggcggcgaacaaagccgatctggcgcgcgatctgctgcggatgctgctggaatttttaccggaagtgcatgcgaagatggcgcagtttatgtcgaccaatgaggtcaacgccctgcgtgagattattcacaagctgcacggcagtgccagctacagcggcgtgccgcgcatgaagcaactctgccatcagctggaaagagagctgctggaggccagcgatatcgctgcgctggagccggagctgctggagctgcaggatgagatggagaaacgtcgcccgagaagcccgccagctgttagggattggataaggctattggttagttaaacccggccgatgtggagtggccgggtaatgctggtggttagttaaacccggccagctttaacgtggctgccacattacgtgccgtcatctcaacattctttccggcgctggcgagtgcctcatccagcgtacagatgctgtagagcacgctgaataccgcatcgatcccgtgctgatgcaccacgccgacatcggccgtcaggcttccggcgatgccaatcaccggcttattaaagcgctttgccacgctggcgaccccgatcggcaccttgccattaatactctggctgtcgatacgcccttcaccggtaatcaccaggtcagcatcttttacctcctccgccagccccagcgcctcagtaacaatctcaatgccgcgccgcagctccgcctgacaaaaggcatgcagcgccgcccccataccgcccgctgccccgccgcccgggatatgcagcacatcaatatcgagatcgcggtgaataatcgcggcgtaatgggccagcgcctgatcgagctgctgcaccagcgccggtgtcgcccctttctgtgggccgaaaatggccgatgcaccctctttgcccgtcagcggattcgtgacgtcacaggccacttcaatgcggcactgatgaatgcgggcgtccagcgcgtcaatatcgatgctggcaagatcggcgagtgcaccgccaccgtgaccgatctcgcagccctggtcgtccagcagccgggcgcccagcgcctgcatcatgccggctccgccatcattggtggcgctgccgccgataccaatgatgatgtggccgacccccttatccagcgcatgtctgatcaactcgccggtgccaaatgaggtcgttatcagcgggtcacgctgcgatgcaggcacccgctccagtccactggccgctgccatttcgatataggcggtggactcatcgccggacaggccatagaaggcgtcaacctctgttcccagcggccccgtcaccttcagcctgacgatttttcccttcgtcgccgccaccatcgcttctaccgttccttcaccgccgtcggcgaccggtattttcacgtaatgcgcatcgggaaagatgtcacggaaacccgcttcaatcgccgatgccacatccagggcggataaactctctttatatgaatccggtgcgattacgattttcataggcaatccgagcgcagttgagtaattgaaacggctctgaaccagtccggtttccgcagagaccgacaccgggttttagcgggcgatttcaaccttcgctaacttctcataatagcaggccagcgcgctgtggtcggcgctaccctgcccgtcgttacgcagcgcctgcatcatctccatcaccgccgccgtcagcggcagatgcgcgccgatgctgtgcgaggtatccagcgcgttcgccagatctttgatatgcaggtcaatgcggaagccaggtttgaagttgcgatccatcaccatgggcgctttggcatccagtaccgtactgccggccaggccgccacgaatcgcctgatagaccagatccggattcacacccgctttggtcgccagtgataacgcctcggacatcgccgcaatattcagcgccacaatcacctggttggccagcttagtcacgttacccgcaccgatgtcgccggtatgcaccaccgatcccgccatcgatttcatgatgtcgtagcaggtatcgaataccgctttatcaccgccgaccatcacagagagcgtgccttcgatcgctttaggttcaccgccactgaccggcgcatccagcattttgatccctttttctgccagcgcatcgtggacttcacggctcgccagcggcgcaatggagctcatgtcgatgaccaccaggcctggcttcgccccttcgataatgccatttttacccagacagacttcaatgacctgcggcgagttgggcaccatggtaatcaccacatcgcactgctcagccacctcttttggcgatttcgccacggtcgcgcccagttcagtcagttccgcttcgttgtcagcgttatgatcgcgcaccaccagcgaataaccggctttcaccagatttttactcattggtttgcccataatacccaggccgataaatccaattttcattgcgtttccccttgattgattagcgcttaaatttgtcgcataacgcctgagaggcgttgcggaacataccgacatcgctgccgacggcgacaaaagtggcaccccactccagataacgacgcgcgtccgcttccaccggtgccagaatgccgctcggcttaccggcagctttggcgcgttcaaaaatgtgtttaatcactttcagcacttcaggatgggcgggctgaccgagatagcccagcgcagcagagagatcgcccggcccgacaaaaataccgtcgacaccgtccaccgccgcgatggcgtcaatgttgtcgaccgcctgctgggtttcgatctgcaccagcaccgtgatgttgtcattgatggtgctgttgtaatccggcagggtgccgtacatgttgctgcggtgcgaaaccgagacaccgcgaatgccggctggcggatagcgggttgatgcgacggcacgcagtgcttcctcttgggtctcgacaaatggcaccaggaagttgttaaacccgatatccagcagacgcttaataatcaccggctcgttgcagggcggacgcaccacgggcgcactgtggctgcctttaagcgccatcagctgcggcacaaacgtggtgatatcgttgggcgcgtgttcgccatccaggaccagccagtcaaaaccggccagccctaaaatctcggtagagatcgggctggcaagcgcacaccagctgccgatcagggtttcacccgctaacaaacgacgacgaaatccatttggccaggctgcattactcatggttaaactcctgtgacgatggctccccgtggggagccgaaaaggttaacgtaccaggcagggacgtttgttgtcgtaggtccatcccggcactaaaaattgcatcgcttcggcatcgtcacgcgcgcccagcccctgcttctgatagagcgcgttggcctgcatcacctgatccatatccagctcgacgccgagaccgggcttctgcggtacctgcaccatgccgcctttgatctggaatggctctttggtcaggcgctgattgccctcctgccagatccagtgggtatcaatagcggtgatcgcgcccggcgcggcagcggcgacgtgggtgaacatcgccagcgaaatgtcgaagtggttattggagtgcgagccccatgtcaggccgaagtcgtgacacatctgtgctacccgcaccgaaccctgcatggtccagaagtgcggatccgccagcggaatgtccaccgactgcagcgacagggtatggcccatctgacgccagtcggtggcgatcatattggtggcggttggcatgccggtggcgcggcggaactccgccatcacttcacggccggagtacccctgctccgcgccacagggatcttctgcgtaggcgagcacatctttgagctgtttgccgagcatgatcgcctcgttgagcgaccaggccccgttgggatcaagggtgatacgggcttcaggaaaacgcttagccagcgctgtgaccgcttcggcctcttcgccgccgcgcagtacgccacctttgagtttgaaatcgttgaagccatatttctcatacgccgcttccgccagccgcaccaccgtctccggggttagcgcctcttcgtggcgcaggcgataccagtcgcagggatcgctctcctggctctggtaagagagggacgttttgcggcggtcgccgatgtagaagagataaccgagcatctcaacgcggtcgcgctgctgtccgtcgcccagcagcgaggccacattaacctccagatgctgacccagcaggtcgagcagcgccgcttcaatgccggtcaccacatgaatagtggtgcgcagatcgaaggtctgggtgccgcgcccgctggcatcgcggtcggcgaaggtgctgcgcaccaggctgagaatgtttttgtattcgcccacggttttgccaatcaccagcgacgctgcatcttccagcgtctggcggattttttcgccgcccgggatttcgccgacgccggtgtgtccggcgttatctttgataatcacaatgttgcgggtaaagaatggcgagtgagcgccgctgaggttcagcagcatgctgtcgtagcctgcgaccggaataacctgcatggcggtgactttcggtgttgaactcatctcctgctccttatgctgttgcacggccaaatgccgggcgtttgcgatcaaatgtccagccggggaccagatattgcatcgccgtggcgtcgttacgcgcaccggcgggcagtgactgataaagctgattggctttgtttacctgctcccagtcgagctcaatgcccagacccggcgcatccggtaccgcaattttcccgttgcggatttgcagcggatttttcgtcaggcgctgatcgccctcctgccagatccagtgggtatcaatcgcggtaggattgcctggcgccgctgcacccacatgggtgaacatcgccagcgaaatatcgaagtggttattggagtggcagccccaggtgaggccccactcatcgcagagctgcgcgacccgcacggcaccgctcagcgtccagaagtgaggatccgccagcggaatatcgaccgcattgagcatcaccgcgtgattcatctcgcgccagttggtggcgatcatattggtggccaccggtaagccggttgcgcgccggaactcggccatcacttcacgtcccgaatagccctgctccgcgccgcacggatcttcagcgtagctcagcacatcctgcatccctttacacagcgctatcgcctcgtccagcagccaggcgccgttcgggtcgaccgtaatgcgggcgtcgggaaagcgctgcttcagcgccgccgcggtggcaatctcctgctcgccaggcaacacgccgcctttgagcttaaaatctttgaagccatatttatccgcagccgcctcagccagccgcaccacggcatcgctggtcagcgcttcctgatgacgcaggtgataccagtcgtggctggcctgctcaccactcagatagggcagatcggtcttgcggcggtcaccgagatagaacagatagcccagcaccgtcacttcatcacgctgtttacctggccccagcagttcagccaccggtacgcccagacactgtcccagcagatcaagcagcgccgcttccagcgcagctaccgcgttgacccgcaactcaaaagtccaggcaccgttgccgaaggtggtgaagtcagccgactgattgcctttgtgcacctgttgtaccagacggttcattcgcgcaatctgctggcctttcacctgcggaatcgcctctaccagcgtctgatagatggtgtcgccgccgggggcttcaccgacgccggtgtgaccggcgctgtcagtgagaaccacaatattgcgggtaaaacaggcgttgtgcgcaccgccaatattgagcagcatgctgtcataaccggcgaccgggataacctgcatctcagtaatcaccggcgaactttgcgtattcataatgcatccttaccgggccaggttttcagttcgacacgtttgatatcgcccgcgatcaccaggaagctgaatgcggcgacaaaggcgtgaataccgacatagatcagcgcgccttcaaaggagccgctggtggcgatgatgtaaccgatggcgataggcgtcacgatgccagagaagttaccgaacatgttgaacagaccgccgctcaggccactgatctctttcggcgcagtatctgccatcaccgcccagccaagcgcaccgatgcctttaccaaagaacgccagtgccatgaagaacaccaccacccattcggtatcggtgtagttacacatcaccatcgaaatagagagcagcatgccgagtacgatcggtgttttacgcgcgatattcagcgagccggttttacgcatcagccagtcggagatcaccccgcccagtacgccgccaaggaagccgcacaccgccggaatcgaggcaataaagcccgctttgagaatcgacatgccgcgcgcctgtaccagatagaccgggaaccaggtgataaaaaagtaggttaaggcgttaacgcagtactgaccgaggtagatacccagcatcatacgtgacgtcagcagctgtttgatctggaaccacttctcgctccagctcactttgcggctatcctttttgacatccatgttgatcagcgcaccgccctgctccatgtactccagttcggctttattcacgccagggtgatcggtgggatcgtggatcactttcagccagatgaagctgaggatgatgcccaggccgcccataaaccagaacacgtgcgcccagcccacggaagagaccagccagcccatgatgggcgcgaagataacggtggcgaagtattgggccgagttgaagatcgccacggccgtgccgcgctcctgcgccggaaaccaggccgcgacgatgcggctgttgccagggaaggagggcgcttcggccagtccgaccaggaaacgcagaataaacagcgacatgattatgccgaagccgctgaacagatcgacgaacccttgcaaaaaggtaaagagcgaccaggtaaagatgctccagaaatagacgcgttttgagccgaagcggtcaagcagccagccgcccggaatctgaccaataacatacgcccatgagaaggcagagaagatatagccgagtccgaccgaatcgaggccaatatcttttgacatcgccgaaccggcaatcgaaatcgttgcgcggtcaccgtagttgaatgaggtgacgataaataacatcaccacaatccagtaacgggcattggtgcgtttctgcaccgtttccgcggtctggctgaaactattcatgatgcactcctgaaatatagcgtgagctacattcgctctgactgcatacacatcgcgttgggtatcagagagaagttgggttaaacacggcgatctttttgttttggcaaactttatttatccatccggcgtctggcagccgcggccggtaataactccaggcaacctctttcggatgaataatacgtcgtgacagataacctgactttggctaacggaactcagtataagaacagcctgtggcgatcacattggcgcatagccctggaataatcgccttattgaagtgattgtctggcgaatgcacaaaagcctgcggtatagctcacgaaagtggcaaatacccgtgcaaaatccgccccggataacgctttcccacgctgtttgtgagggtcttcacttgcttttggataatcgacccaaaacagcgagacgaattgacttaatggtggtcatttgcacaatgcgcgacccgccccgcctccctatactgaagctggcaaacaagggcgtgacaggtcagatcattacagcgtgccgcacaagtacggtacgacagacgggaaggtgagcgatgaacccaaaaacagatgaacaaccgctctatatcaaagtccatgagcacgacaatgtggcgattgtggttaacagcctcggtctgccagccggtacgcagtttgcggatggtctgaccctcacagagcatgtgccgcagggccacaaagtggcgctgagcgcgattaatcagggtgcagagatcgtgcgttatggcgaagtcattggctatgcattgcgggatattgcccagggcagctggattgacgagtcactggttgcgctgccggaagcccctccgctggagagtctgccgttagccactcaggttccgcctgatttgccgccgctggagggctatacctttgaaggttaccgcaatgcggatggcagcgtaggcacgcgtaacctgctcggcatcaccaccagcgtccactgcgtggccggtgtggtggatcatgtcgtacagatcattgaacgggatttactgccgcgctatccgaaacgtggatggtgtggttgccctgaaccacctttatggctgtggtgtggcgatcaacgcaccggcggcggtcgtgccgattcgcaccattcataacctggcgctgaatgcgaatttcggcggcgaagtgatgatcgtcagcctcggctgtgaaaagttacagccagagcgtctgctgactggcacccccgacgtgcaggcgatttcgctggacgatcatgacatcgtgcgtctgcaggatgaaaagctggtgggctttggcgcgatggtcaatgagattctgcaggtggcggagcgtcatctccagcggctgaatcagcgccagcgcgaaacctgctccgcagcagaactgattgtcggcatgcagtgtggtggcagcgatgcgttttcgggcgtgacggcaaatccggcagtgggcttcgcctctgatctgctggtgcgttgcggtgccaccgtgatgttctcggaagtcacggaagtgcgtgatgcgatccacctgctgacgccgcgggtgattaatcaggaagtcggtaagcgcttactggaggagatggcctggtatgataattacctcgaccagggccagaccgatcgcagcgctaacccgtcgccgggcaataagaaaggcggtctggcgaacgtggtggaaaaagcgcttggctcgatcgcaaaatcgggacgcagcgccattgttgaagtgctctcgcccggccagcggcccacgcgacgcggattgatctacgcggccacgcccgccagcgattttgtctgcggtacacagcagctggcatccggtatcaccctgcaggtgtttactactggtcgcggtacgccttacggtctggccgcgattccggtgatcaagatggcgacgcgtaatgcgctggcagagcgctggcacgatctgatggacatcaatgccgggacgattgctaccggtgaagagagtattgagcaggtgggctggcgactgtttgaattgattctggatatcgccagtggcagaaagcagacctggtccgatcgctggggcattcgtaatcagctggcggtgtttaacccggcgcctgtcacctgacagtgcactcaacggatatcgccgtgcgcacactacaggcttatctctgttaaggcagagataagcctggccttgcaatcagagctgcgcgccccaggcttcaacccacggcgaggttaccgcctccggttccggattttcagtggcatcaaccagtaacacctcaccaacccgctgagcgccctgctcctgcagcagcgcgtcaaaggttttacccgcgccacagaaatggtcatagctgctgtcacccagcgcaatcacgccatagcgcagcgcgggctgatgaccgagctgatctttaatcgcatggaacagacctgaaatcgtgtcgggaaaatcgccatgcccggtagtagaagtgacaattaacgccacgtcgctggcatagttttgccagtcagccagcgtcggatcgtcaaacaccgttacgctgtgcccctgctgctgcagaatgggctctgcttcttccgcgaccagtagcgcattgccatataccgtacctacaaaaatgccaatctttgccatctgctttctcccttattctgaaacgttatcctgtcctggcgctgcgtcaaactcaacccgcggcacctcaggaatgcgatcctgccagccaaactggttcatcagattctgccagacgccatccagtccggcgcgaagcagcaacggttcaccggttaccggatgagttaatgccaggctgctggcgtgcagcatcaggcggttagcgccaaaatgttcggcagcaccccggtttctgacgcagatcgccgtgcgccgaatcgccaataatcggatgacgcaggtgtgacatatgacgacgcagctgatgcttgcgaccggttttaggagccagttcaaccaggctataacgcgaagtgggataacggccaatgccgaccggcatctcgaccgttgccagtgactgataatcggtgaccgcgggctgtgcggtgcgcgcttccgtggcgtgtttatcggcaattttatccagctcttccaccagcggataatcgagcgtcccgctgctctccagccagccgcgaaccacagcgtggtaggttttctgcatctggtgctgttcaaactgcagggaaagcagacgtccgacttcactggagagccccatcagcagtacccctgacgtgggcttgtcgagacgatgcgccgtaaacacatgctgcccaatctgatcacgaacggtctgcatcacaaacaccgtttcatggcgatccagccagctgcgatgaaccagccagccgctgggcttgttgacggcaaccagccactcatcctgatagagtatctccagcatcagtgggcagcatccgtgattaacgcatcaagttgacgcagggtcagcaacagcggcgcaatacccggctggtcaggcaccagagccacctcataatagggggccacggcaaaattttgtggtaacggatgtcgggccgcaatcagggcatgcatccgcgggactaacacccactggagccactgcagcggctccagcgtatccaggcaaaagggttcgcggctctcgagcgccccctcggccggcggggtactctgccagagatgatgctcacgcatcaccgcttccagttgttccagccgttgcgtaatcaattgttcaggcgtcatgcgccacctccgcgagcagtcaaaaatgggcggcaagcatatcacttgttggcacaggcacaaaaaaagggagcactgtataaacagtgctcccggttcgtttgcagccatcccgccacgttaatgctccctgctcttccatgacaacttgtccagtgcgaactcctgtcgcgcatcgtcctgatgtatccttagcatcctggcccaccacctcttccgagggggttctcattctccatcctggaggtgtcccttgctcaatcctgagcgatcctgtttcatcctgaaaccttccgtgtgccgtaagctccgttacgttcctgcctcatggcttatcatcatcctgacgatatctttttcctgagcttcctgcagtgcgaaacattttgacagaactcgttacgcgcacaaggtactcacagcagaactttacgaaatgtgcggcgtaaattcagataaacgccattaagttgatgattcacaatatttttacatctcagccttccggaagtctcacctgttatatagcgatctctcacagcacatgtaagagatgtctcacaaggtcaggggcaaatcactgcaactcagatgataaccggttgtaatgacttaagaaatatctcaagcgtttccgctaatttcacacgctgtttaccgccgggctgctccagaatcacttccccgctgagattagaaagcgagatgatctcctgttctgactcggtggtggcgataaacagcgtaggcgactgtttaaggcggcgctgcatcaccagatgcccgatcagattctcctgtaaacgcaggaaatcatcctcactccagacctgtaaaagtgtcagctgattctcaccaaaactggcctgcatatcgccggcaaactgcgtggtatagaaagccgtgatctgcggctggagctggatgtcgatcgcccgctcaaccgcatccagcgtctgtggcagagtaaaaggctgcggctgccagacgacccgctgatcgcgatcctccagggcacagggcgaaggtacaccaaagagatcgctgctggccggcgcatgcccggcctgctgaagccagtgctggcagtatcgggtggtaaagtcgcgcaacgcggcggcagtttgctgcatcattcatattctcacttctgatgggttacacttagccactttgattaattttggtggtaaccgcaatgactactcacgaacaggatcaggcactcagcaacctgacgctgggcaaacccacagcctatcacgatcattatgacaacagcttactgcaggcggtaccgcgcagcctgaatcgtgaaccccttggcctgtttcccgatagtctgccctttaccggcagtgatatctggaccctgtatgaactctcgtggctcaacagcaaaggtctgccacaggtcgccgttggcgaagtggtgctcgatgcgcagagccgcaaccttatcgagtcaaaaagcttcaagctctaccttaacagtttcaaccagacccgctttgccgactggggcgaggtttcgtcagacgctggagcgtgacctgagtgcctgtgctgaaggtgaagcgcgggtcgcgctgttccgtctcaatgaagtggaaggtcagcccatcggccattttgagggggtttgtattgatgagcaggatatcgccatagaggattatcgcttcaatgctgactatctggccgatgctgcgggcagcgaaatcgttgaagagacgctggtcagccacctgctcaagtcaaactgtctgattaccaatcagcccgactggggctccgtgatgattcgttataaaggcccgcgtatcgaccgtgaagcactgctgcgctatctggtctcattccgccagcacaacgaatttcacgagcagtgtgtcgaacgcatttttaatgatgtgatgcgtttctgccatccggaagcgctgacggtgtatgcacgctacacccgtcgtggcgggctggatatcaatccatggcgcactaatgtgcccttctcgcccggtttttcgcggctggtccgtcagtagtttgcgagacttctcgcaggctgcatgcactaagcgcagttccgcttgagctgtgcgggccgacaaggctactctggtgatggcggctacctgcgggtggccgaccagggattttcgtcactgccgttgcagtgccaacacgcacccaggcgggtgtaaaggagttcatttgattacccatatcagccctcttggctcaatggatctgctttcacagctggaagtcgatatgctcaagcgcacagccagcagcgacctctaccagctgtttcgcaactgctctcttgccgtgcttaactccggcagccagactgacagcagccaggagctgctctcccgctttgaaaatttcgacatcaatgtgttgcgccgtgagcgcggcgtcaaactggagctgatcaatccaccggaagaggcgtttgtggatggccgcatcatccgttcactgcaggctaacctgtttgcggtgctgcgtgacatcctgtttgtcagcggtcagctcaacatgccgggtcggttaactgcggctgaagaaaatgactccgccactattaccaacaccgtgttttccattctacgtaacgcgcgggcgctgcacatcggcgagtatcccaacaccgtggtctgctggggcggtcactcgatcaacgccgttgagtaccagtattgccgcaatgtcggaactcagcttggactgcgtgaactgaacatctgtaccggctgcgggccgggcgtgatggaagcgccaatgaaaggggccgccgttggccatgctcagcagcgctatcgtgacagccgctttatcggcctgaccgaaccctccatcattgcggctgaaccgccgaatccgctggtgaatgagttgatcatcatgccggacatcgaaaaacgtctggaagcttttgtgcgcattgcccatggcatcatcattttcccgggcggcgtagggaccgcagaagagttgctctatctgctgggcatcctgatgaatccgcagaacagcgatcaggtattaccgctgatcctgaccgggccggaagagagcgccgactacttccgcgtgctggatgatttcatcgttaacaccctgggcgaacaggcgcgtaagcattatcagatcatcatcaacgatgcagccgaagtggcgcgtctgatgaagaaagcgatgccgcaggtaaaagagaatcgtcgcgaaaccggcgatgcttacagctttaactggtcgattcgcattgaacccgatctgcaggtgcctttcctgccaacccatgaaaatatggcgaatctcaatctctacaccaatcagccacccgaaaagctggctgctgacctgcgccgcgccttctcaggcatcgtagccggtaacgtcaaagagatgggcatccgcgaaatccgtgagaagggacgctacaaactgcatggcgaccccgacatcatgcaccgcatggatgagctgcttcagggattcgttgcacagcaacgcatgaaactgccaggcaccgcctacattccctgctacgaaattatcaaataaaccaggaggcagcccccgggctgcccatactctcatggctcttcatcttgttattgttgacgcgttgaatctgattcgccgtctgcatgcggtacagggctcaccctgtgtcgaaggctgcatggccgcgctgcgacagatactgggtcacgcccatccgactcatgcggtggcggtatttgatggcgaagcgcgtcatcagggctggcgtcaccagctgctacccgattacaaaagcggtcggccgccgatgccagacgatttacaggcagagatgccggcattacaggaggcctttcgcgccgcaggcgtaagctgctggatagcgggcgaggatgaggcggacgatttagcggcgacgctggcggtgaaaatggctcaggccggacatcaggccaccattgtttcaaccgacaaaggctactgtcagctgctggcacccgagatccgcatccgcgactacttccagaaacgctggcttgatctgccttttatcgaggctgaatttggtgtggcgccccagcggttacccgactactgggggttgtgcggcatcagcagcagtaaaattccgggcatcaccggcatcggtccgaaaagcgcgaaacagctgctgacagagtttcacacgcttgagggaatctatcagcaactggatcaggtgccagccagatggcgggagaagctcgctgagggtcggcagatggcagagaccagccgtcaggtcgcaaccctgaagcgggatctggtgctgcagggcaatctgaatacgctgcgttataccggctgagtgcccctgcactcagcccggcgattaacgttcgtcgcgacgaccaccggcagccgcccagattcggcgcacatgtaccgtcacctcttcgcggtcatgataaagctggcgggcgcgaatctgcacgttaatgccattatcatcaaatcgttcctgcatcatggccagattctgcgtcacctcttcatagcgctttttcatgggcaacttaaggttgaagatcgcttcacggcaccagccgttaaccagccagtcggtcatcaggttagccacgcgcaccggcttctccaccatgtcacacaccagccagctgatgttggtgcgtggcggacggaatttaaagccatctgctttctcgtgcatcacctggcccgtatccatcaggctcggtgccatcggtccgttgtccaccgcatataccatcatgctgcgctgcaccagctgataagtccagccgcccggacaggcaccgagatccacggcgtacatgccgctggctaaacgctcatcccactcatccgcagggataaagacgtgaaacgcctcctccagcttaagggtggaacggcttggcgcatcggaggggaacttaaggcgtggaatacccatgtaaaacggtgagctgttttcccggatggagtagccgacgtaacaggtgcccggtgcgatgaaaaacacatgcacgaccgggcgtttcgggctctcataattcaacaggattttgctttcacgcagtgccgagcgcagcggcacggtaaacttgcggcagaacttagtcagctctttggcttcgttggtgtctggcacttcaacacgtagtttctccgcccttttccactacgccggtcagcatgccgacaatcggggtaatgcgatcttcctgcggcaggtcacgcagcatttcgccgacgaccagcatctgacggacaaaaatcagctcgtcaaacggcaactcacgtgccagccgctcggcatcttcaaactgatagcactcgaacagcacgtagccagagtcatctttaacccgtggaaagccgtagatttcacgttcagccgctttggcgctgatttccgccgcacactctttttcaaaaccggggcgacaatagagtaaaactttattcatggcgttctgcctttcgtttaagacgcagcgcgccaatcaacatcaatacccaaccggcgaggaaacagaccccgcccacgggtgtgataaaaacccaaaacttcagatgtgacagcgccagacaatagaggctgccactaaacagcacggtgccgagcgccatcagcgcactgctccagtaaaaccagatattggcgcggcgtaacatcgcagcacccagccccatcaccgctaaggtgtgataagcctgatattccagcccggtatgaatccaggccatttcagccgcaccaagcgactgacttaaaacgtgggcaccaaatgcgccaaaagccaccagcagaaatccgctgatagccgaaaaaacaaacatggcacgactggacattaaccgatcctcagagtccttttgcatctgaatgcaaataaatcaatacgttattgttgatagcgaaagcggaatttttcttgttcggttgcagctttttccaggatccactgtcggaaggcggctattttacccagtttctgcctgactgtcatgacaaaccagataaaaagcgtttttactgactaatacatcattaaacgggcagattaatcgcccggcttctatttcgctctgcgccatgacgttattcgccagcgccacgccctgaccatgaatcgccgcctgcaataccatggcgctgtggctgaagattggcccctgctgcacattgatatgctgcaggcccagttgccggatataagattgccagtcccggcgggaggcatcatgcagcagagtaaaacgcgacagatccatcggtgtttttagcggattatccccggtcatcagcgacggtgaacagaccggcagcagatattcggcgtagagtttttcaacccgcaggccgggccagttaccccggccgtaaaaaatcgccacgtcgacatcgtcggccagtttctcttcgtcgcggtcaaccgcctggatacgcacgtcgattcccggataagccatattaaagctggagaggcggggaaccagccactgaatggcaaagctcggcagtaaactaacggtcagcgcacccttggcactgcgtgcctgcagtttgcgggtcgcttcgttgattgccgagaaaatctctttgatatcgagatagtagctttgtccttcttcggtcagtaatagcgaacgattcctccggcgaaatagctttaaccccagaaaatcttccagagatttaatctgatggcttacagcagcctgggtgacaaacagctcttctgcggctttggtaaagcttaaatggcgtgcagctgcatcaaaaacacgcagtgcgttgagaggaggaaggcgtttcgacatggttttccgtatccggatcggcaaaaaatacgctggcttatacaaagcgtttacgtattagaatttttaatccgaggcattataatttgtccgttgaggaacctccagcaaatacctatagttgccgcacttcctgagccggaacgaaaagtttttagatttgtgagtgagttcgcagattttctgaaagcttttggcttgtggtcgtgatgttgtgtttgcaatttttgatccgacgattgcggatcgaactcttaattcctgtagatttaccctgtctgtccatagtgatttttaaatagcaccgcaaattgcggtgctttttttttgctgcttagttgccagactctaccatctctttgacatcagagcggttgatttgctgctcgttgccattcgcatctttatagctgatcatgccggtatcgttatcgactttaggcttgccggcagccacaatggtgcgaccatcattggtatgcatcacgtaattgcttgaacaggcactcagggtaaaagccagggtacacacggccagtactgcggttaattttttcatctgctatctccttgtagattgattgcatcaaaccacccgcgttacgctaaccagaggcagccgataagtgagatcgactagtaaacgtccgatcgttatgcgggtttggttcaaaccttgcaatattcagcataacgcgcttttccagctttgccagacgcagaccattctttcagtgtggtcctaatttttcttatcatggaccaggcatgaccgcatttaatcccaccgcatttcgccagcagtttcccgcactcgccgacgcaggcgtttatctcgacagcgcagcgaccacgctgaagccgcaggccgtcattgacagcacgcagcagttttacagcctcagcgcgggtacagtccatcgcagccagtttgccgccgcccaggccttaacccatcgctatgagcaggcgcgcaaccaggttgcccgctggcttaatgccgctgacgatcgtgagattgtctggacgcgcggcaccaccgaagcgataaacctggtggcaaacagctggctgcgcccgcgcttacagcctggtgatgagattgtggtcagcgaggcagaacaccacgccaacctggtgccctggctgatgaccgcgcaggcgtgcggtgcccgcgtcgtaaaatggccgttaggcgcggatcgcctgccggatatcagccagctgcccgccctgctcaacagccgtacccgcctgctggcggtcggacagatgtcgaaacgtcaccggcggatgtcccgcactcgctcaggcgatcccgctggctcacgccgtgggcgcgaaagtgatggtcgatggcgcacagggcgtggtgcattgtccgcctgacgtacaggcgctggatatcgacttttacgccttttccggacataagatttacggcccgatgggcattggcgcgttatatggcaaagcggaactgctggaggcgatggagccctggcagggcggcggtaagatgataacggatgtcgatttcagcggattcacgccgcagccggtgccgtggcgttttgaggctggcaccccgaatgtggcgggcgtggtgggcctgagtgcagcactgagctggctggtgcagtacgatctgcccgaagcggagcgctggagtcagcaacttgcgacgctggcggaagagcagctggcggaattacccggtttccgcagcttccgctgttcaaatgccagcctgctggcatttgaattcgctggcctgcatcacagcgatctggtgacgctgctggctgagcagggaatcgccctgcgcgctggccagcactgcgcgcagccgttgctggcggcgctgggcgtcagcggcacgctgcgggcctcttttgcaccctataataatctgcaggatgttgatgcgctggtgcgcgctatgaagagcgccatctcgctgttatcggagttttgattatgcattcatcgccgttagcgccacacccgtttggcgaacagattaccgttgccagcctgaaagagagctttggccgctttcatcagtgggaagatcgttatcgtcagctgatccagctgagccgccagttgcctgccttacccggggaactgaaaacagcagaaattgaactgagcggttgtgaaaatcgggtctggctgggcagccagttacgcgaagatggcacgctgcatttctatggtgacagtgaaggacgtattgtgcgcggcctgctggccgtgctgctgaccgccgctgagggccagacgccgcaacagctgctggcgatggatcccttaaaactgtttgatgaactgggcctgcgcgcccagctcagtgcctcccgcagcagcggcctgcaggcgctggccgccgcagtggagcacgccgcgcgtcaggcgctgacggcgtcctgacgggcagcacgcgccagaaacttcttcagcgcatgcgagacggcaacaaagccgaaggtggcggttaccatggtggccgcgccaaagccggaggtgcaatccattctcttcggcccctccgctgtgctgcgtgaagcacatacgctgccatcagcctgcggatagaccagcgcttcggtagaaaagacgcagtcgatgccaagtttgcccttgctgtttttcaccacgcccaggcttttcagtcgttcgcgcagctttgccgccagcggatcctggatggttttcgccagatcggcgacctggatctgagtgggatcgatctgcccacccgcgccaccggtggtgatcagcgggatcttattccggcggcaccaggcgatcagcgccgctttcggtcgcacgctgtcgatagcatcgatcacatagtcgaaaccggctgccatcagtttcggcggtgttctctggcgtaataaagtcatcaatgcagatcacttcacagtcaggattaatcgcacgcagccgttctgccatcacttccgttttggctttgccgacgttgccctgcagcgcatgaagctgtcggttggtgttggtgatacagacatcatccatatcaatcagggtgattttaccaattccggtgcgcaccagcgcttccgccgcccaggatccgacaccgccaatcccgatgacgcagaagtgtgcgtcagcaaaacgttgcagcgcatcctggccatagagacgcgccgtgccgccaaagcgctgatgccaggcgtcatttaacactttcatagttgaacctgttacgtcgtgcgggcccgaaggcccgcagagaagaagttagttagcgccgagaagcagtgaaccattattaccgttttgcgggctggagaacagcggttgtccggcacccggcgcggctttaattacccagacgcgtccgtagtgattatagaagcccgccagatgcgcagcgtcggggccgataccctgatagatatcaaagtgctggcctttaatcgcgccacccacgtcgagtgccaccatcaggcgcatctcatatttgccgttgaatttgcccttctcatttaactgcggcacttcagccagcagtacggtgcccgccggaataattgagcggtcagacgcaacggaggctttcgccaccagtggaactgcgctggcaccgcgcaccggcgtaaatggctcagccttaaagaagacaaatgatgggttggtttccagcagcgcacggacctcctgcggtgagtgctcctgcgcccactgacgaatcgcctgcatcgacatatcttcgcgcttcacttcaccgcgatcgatcagctctttgccaatgctgtgataaccccagccatttttaccggcgtaaccaaagaaggtcatcgggcggccatccccaaagtcgacataaccactgccctgcacatccatcatgaagttatcaatcagggaattgctgtaggcgatgatgtagcggtcatcgagtccgccactatagatagaggcgcggctcggtaatttttctccgcgtttgcgcggtggcatgcggtagatgggatactggaattcaccctgacgggtgtaacgcgcttctactaccggcgtgtagtaaccggtgaactgcacgttaccgtagttatccgtaccctccatctgccaggcgttaagcccatactgacgaagctgtcgggtatcggcacccgccatcagccagctctcaattgcactataagtgccgtttctgacggctatacagggcggatgaggcggactgaatctgacggacctgctcgccaaagtctctgccattaaccggtgcgcctttggcattgggctgattcaccagcgccagcggttgttccagtttgccatctttatattgctgaccgcgatcggtcggtttggagctacaggccgccagcagcgtaattaacgcgccagtgagtgcatacttcacccaatgtgatttcattatcttctctttttataactgttcgccccgcgacgatagcaaagcccccgacagaatgaaatgcatccgctcagacgtcacgcatatcagtttaataattaaccagatggttgaatccttcagcaactggctgttaatttggcttttatctgcaaaaaggggttgcatgaattagcgcggagagtatagtgcgcttccacggacgcggggtggagcagcctggtagctcgtcgggctcataacccgaaggtcgtcggttcaaatccggcccccgcaaccaatacttctgcagcagttttacagaagtcacaatgtgagaagtaaaagtaatagaagcaatacggacgcggggtggagcagcctggtagctcgtcgggctcataacccgaaggtcgtcggttcaaatccggcccccgcaaccaatacttctgcagttgttttacagaagtcacaatgtgaaaaaagtgtgatacggacgcggggtggagcagcctggtagctcgtcgggctcataacccgaaggtcgtcggttcaaatccggcccccgcaaccaatcatttaaacacctgaaagggtgtttttttgtttctgacgttcccaaaagccgcttcagcctctctctgccctgaaaagcgcgcggatagcccggctacccgcactcccttaccgatgggccagtgcagccccactctccacatacgctttgatgccgttcagaatcgcctctgccacctgatgctggtaacgggtggtttcgcaacttgcgctcctcctccacattactgataaacgctgtctctaccagaattgacgggatatcaggggctttcagcaccgcaaatccggcctgatccacggtgcgtttgtgcagatggttgatgcgccccatgcgatgcagcacctctttgccgaatttaaggctgtcatgaatcgtctgacgctgcaccatatcgaacatggtgtgatcgagatagcggtcaccgcttttgctgacgccgccaatcaggtctgattcattctgagtctgagccaggaaacgagccgccgccgaagtggcaccactggttgataaggcaaacactgaagagccgcgtgccgcgcgactggtaaaggcatccgcatggatcgacacaaagaggtcggcacgctgtttacgggctttggcaaccctgacgcgcagcggaataaagacatcttcattgcgcgtcatataggctttcatattggactctttatcgatcagcgctttgagtcgccgtccaatcttcagcacaatatctttctcgcgggtcttatatttgccgtgcgcgcccggatcttccccaccgtgaccgggatcgatcatgataatgatcggacgatcgcgccccgctttgccgggtaagggcgcctgcaccccttcatctttctccagatcgccctggttgtaatctttcagcagggccagcagaggatcgtcctcaacctggttctggctcggatagagatcgaccaccagccggtgattgatcccggcgaccggcgagagattaaagatcttcggcgcgacgttgcgctttaattccagtaccacgcgcaccgtgttgctgtcgaactgaccgacacgggcatttttaataaagggatcgtcgacccgaacctgcttatctacccctttcagaaccggattgagatgcagcccctgaatatcaatcaccaggcgttcgggattgctcagcgcaaactgcttgtacttcagcgcgacattggactccagcgtcatccgcgagtaggtcgatgagggccagatacgcaccgccacaatgtggttcttcgccgccaaccctgtccggctgacgcttaacagcagtaaggcgcccgtcccctgtaaaaatcgtctgcgtgaaaaatgggaattaacgtctgacatgccgctccagctgctgtgtaatgtctaaaaaagcgccagttactaaaatggcggcgaaaactttatccaatccgcagcatgatgtcaccccggaaaccctaaataatgcaggctgttagcggctttgacacccagaaaaacgtaaattttcgtcaggattaagacttgcaaaaccgggcgtaaaagcataaaaatacaaaaaatacgaataaacattcactgagggttggccgtgaaggaacgtagtaccgaactggttcagggttttcgccataccgttccctatatcaatgcccaccggggtaaaacctttgtcatcatgctgggtggcgaagcgattgagcatgagaacttctctggcatcgttaatgatatcggcctgctgcacagcctgggcattcgcctcgtcgtggtgtatggcgcacgaccgcagattgatgccagcctggctcagcagcagctggagccggtttaccataagtttacccgggtcaccgacgcgcaatcgctggagttagtgaagcaggccgccggccggctgcagttagatatcacggcccgcctctcaatgagtctcaacaacacgccgctgcagggcgcgcatatcaacgtggtcagcggcaacttcattatttcacagccgctgggcgtggatgatggcgtggattactgtcacagcggccgtatccgtcgtattgatgaagaggccattcatcgtcagctggataacgatgcgattgtgctgatgggcccggttgcagtttctgttaccggcgaaagctttaacctgacttcggaagaagtggctacccagctggcgattaaactcaaagcggagaaaatgatcggcttctgctctgagcagggcgtgctgaacagcgagggtgaaatcatctccgagctcttcccgaatgatgcgcaggcccgtatcgatgagattgaaaaggaaggcgattatctttccgggaccgttcgcttcctgcgtggggcggtgaaagcctgccgcagtggtgttcgccgcagccatttaatcagttatcaggaagatggcgcgctgttgcaggagctcttctcacgcgacggtatcggtacccagatcgttatggagtcggcagagcagatccgtcgcgccaatatcaatgatatcggcggcatcctcgaactgatccgtccgctggagcagcagggtattctggtgcgtcgctcgcgcgagcagctggaaatggaaattgataagttcaccatcattcagcgcgataatctgaccatcgcctgtgcagcactctatccgtttatggatgagaagattggcgaaatggcctgtgtggcggttcatcctgactatcgcagctcttcacgcggtgagatgttgctgcagcgcgtggcacttcaggcacgccagatggggctggaaaaactgtttgttttaaccacccgcagcatccactggttccaggaaacgcggctttacgccggtagatattgagtccctgcccgagagtaaaaaagagatgtataactatcagcgccgttcaaaagtgttgatggccgatctcacctgattcaatccgtaagggacaggcccccccgcgtggtctgtcccctctcttctcagccagattcccctagtcgctccaccagaccgctgcgtcgctgcgtttgcagctgcacggcacgctgaaatacgccgggttcgctgtagatggtcagttgccgccgtgcacgtgtaatcgcggtatagaccagttcacgggtcagcaccggcagaaactgcgtgggcatcaccagcgcggtatgatcaaactccgagccctgtgatttgtgcaccgtcatcgcccaggccgtttcatgtgagggtaaccggctcggctgaatcgccttgatcgatccatccggcagcgggaaaaagaccttcaggttgccctcttcatcccgcatcgtcatgccaatatcgccattaaacaggccgagcgcgctgtcatttcgggtgatcatcaccggacgcccttcataccagcggctgcccatgccaggacgacggatgcgctgcagctgcatcagtcgctgctcaatacgctggttcagaccctgcacgccaaatggcccgtcacgtaatgcacacagcagctgataacggccaaaagcggcaatcacttctgcgggcgacgactgctgtctgatcaactgcaggaagggctgataaccctgggctacctcatccagcatcgcctgatacgcgtcagcgctgttcagcggctggtaactgatatcctcataagccgcagcaaacaccgccctgacctgctctgcatcgccacgattgatcgcttttgccagctggccgatgcctgatgagtcatcaaaacgataactcttctgcagcagacagatactgtcgcggactgcgggtgcctgcacatcgtcactgccctgcagtgtgcagccggtcagcaggccgagctgttctgcccgcgccaggctgtagccgctttcggtgcagcggcagatgtcgcccagcaccgcaccggcttcgaccgaggccagctgatcgcgatcgcccagaaacacgacgcgggcatgggcaggcagcgcggcgatcagttttgccatcattgagagatcgaccatcgacgcttcatcaaccaccagcacatcaaggtgcagtgggttaccggcatggtagcgcagccgctgagtgtcgggctgagcgcccagcaggcgatgcagcgtggtggcttcggcaggaaaacgccggcgtttcttcgtcgctgaccgccagttcctgcagtgcactgcccagtgactcggtcagtcgcgcggcggctttgccggtcggtgccgccagctgaatccgcagtgcaccgggattcaggcgaatcagggcagcgaggagtttcgccacagtggtggttttaccggtacccggcccgccggaaataaccgcagtcttgcgggtcagcgccacggccgccgcaattttctgccagttctccggctggtcgtcaaacaggctgttcagcacgtcgcctgcagcatgcatatcaaacgcagttttcacttcctgcgcagcgaagaagtcggcaacccggccttcgctttgccacagccgatgcagatataaacgctgattgctcagtaccagcggcgtaaccaggctgccatcactgactgccgaccagtcagcaaagcgtgctgtccagtcttccggcgcaccagcagcgtgccagatcgcctgagccagcgcaggctggcgaccagcgaacagattcgcttcgcagaggttgctcagcggtaaacagacgtgcccctcacccgcgtcagcgctgacgcaggccgcagcgagcagcagcccaggctgtgattccggggccaccagccgggcaaactgtatatccagcggccgcaggagacgcttctctaccgcctgcaacagcagactcagcatgtcactcataacatctccccggtttcaccaaacagtgcatcaatttcttccacaaaggcttcagcaggtcgggtggcgaaaatgccgttgtccggcgagcagccatccatcccgcgcaaaaacagataaaacaccccaccaaaatgccgctgatagtcgtagtccggcaaacgatgctgcagatagcgatgcagcgccagcgtatagagctgatattgcagatcgtagcggtggccaatcatcgcctgcgccatcgcctctggcgtgtaagcggcgtggctatcccccagccagttcgatttgtagtcgagcagataatattttccctgccagcggaagaccagatcgataaagcccttcagcatgccccgcacctgacgaaaatccaggggggcggcctgctgagagagactgtcgtgccggcgcagcagagcgtcaagatccgccgcagtcagcagattgttgatcggcagatagaactccatctcaatcaggcgtttgctgctttttatcgccgacagcgtcagcccctcagcattgagcggcgtatgtaagacccggtcaatccactgttccagaaccggcaaccagctcagcggatagccattatgctgcagctgatcttccagccagaccctgtccggcggttcggtaaagtcgatcgactcaaacagaccgtgcaaaaacgtaccaggtgccgctccgcgcggaaagtggtggggtgttaatgcagcctcttcacccttctcttcttcgcccgctgcatcaatatcaaaattgggcatcgcatccagcagcggcgagctgtgatgctgttgcaggcctgaataactggttacccgccagacgtcagccagcgcgcgcgtaatgtcgcgactgcttaaaacctcatcgccctgctgcgcatcctgccacatttctcccggcagcagagcctcttcaaccagcgcaatcccttcaccggttaacgcattcaatcgctgactgagctgctgcgcatccgccgcctcaccctgctgcaccaggtagcccagcgcgctcttgtgcagatcgctttcgccctcttttttgcgggtgcctttgatcagtggcgcaatgccgacgctgcagtgatagaccgaacgggtcagcgccacgtagagcagacgcagatcctccgccaggcgctcctcttcggccagcgccagactttgtgcatcaccctgcacatccagcagtgccgtgaacgtgtcgcgatcgtgataaagcgcgctgaccgcctcgcggaacccggcagcaaatggcagccagaccagcggatattgcagtcctttcgatttatggatggtgatgatctgcaccagatggcggtcgctttccagacgcaactgctggctggaggcctggctgtttggccgggcaatctgctgcgccaggaagcgcaccagggcgtgcggactctccagctgcaccgaagcctcctgcagcagttcacccagatgcatcagatcggtcaggcgacgttcaccgttctccgaggccagcatattctctgccagctgccgcctgatcatcacgtcacgcagcatcggtaacacgccgcgctgatgccacagctgctgccagacggcaaactgctccaccagcgcatcccactcacgttcattctgtgtcagcgcgtcgagcgttgctgcatcgatggcaaaaatagaggtcgccagcgcgctgcgcagcagacgttcctgctcgggtgcctgtatcgcctgcagtaaccagagcagttcgcgcgcttccggcgtggtgtagacgctgtcccggctggagagatagaccgaagggatcgacagcgcattcagcgcgtcgcggattaaaccggcctcattgcgactgcgcaccagcacggtgatatcggaagcccgcaccggctgcagcgcctcgcctttgcccaagcgggcgcgcccctgctgtccggccaccagccagcggctgatatcggccgcacactgctgtgccataaactgctggtaatcgctgttacccacgccctcgccaggctgcagccagaaccgtaaagccggttgctgctgctcgtcaaaaatcagtttcagcgactgattgggcgcagcaggcttaactggctgaaaggggatcgccgagaacagaaaaggcgaatcgagctgagaaaagaggcggttgacgctcccgaccatctcaggtgatgaacgccagttggtatccagcgtgtagtgagcgctgacttcgtttctggcccgcagataggtaaaaatatccgcaccgcgaaacgcatagatcgcctgcttgggatcgccgatcagaaacagtgcctgttcaggctgattaatatagagcgtgcggaagatgcggtattgctgcggatcggtatcctggaattcatcaatcagggccaccgggtaacgcgcccggatggtttctgccagcaaaacgccacctggctgctgcaacgcttcatccagtttactgagcagatcgtcgaagcctaacagcgcacgtaaccgtttctcgcgctgcaccgtggcgcgcacatcggtcagcgcctgcgcaatgatgacatcccgcagcgacagcggttctgccagaaactgatcgatcgcctcaaacagcgaatgacgcggcgcttcaccctttttagttttctcctccagcacctgctgtccaaagcgctccagctctttgggcagctgataatccagcgtgtcgctgctggcccactgcgtgacgcgggcgacccagttgggcagatgtttactgctgtagctgcgcttatcaacgccagatgcagtgataatgccctcaacatcggcgctgagcgcctgccactgctgcttgatggcctcgatgcgcgccagattgcgggcgtgccgtgatgccagcgtctcatcggcggcaggcggacgtttcagccccggggactccccctgtagccaggggcgcagcgtggccagcagactgtccggcccgctccactctgcggcgatgacccgcgccacatccagactcagtggatagcactgacgacgccagaaatcggcggccgactgcttcagcagcgcctgctcatcttcaatcaactcctgctcgaacagcatacccgactcaaaggcattgagattcagcatccgctgacagaagccgtgaatggtaaaaatggcggcttcatccatctgccgctcggcagccagcagctgcgcggcggcctgactcagatccggcatctgctccagcagtaactggtgcatcggattgctgcttttgccgcggatacaggccagacgtagctgatgaatattctcgcggatgcgcccgcgcaattcggcggtcgcggcctcggtaaaggtcacgactaaaatttcttcgacagagagcggccggctgtaggcgttttcaccgcccagccccagcagcaggcgcagatagagcagaccaatggtaaaggtttttccggtgcccgctgacgcctcaattagccgctcgcctctgagcggcagcgttaaaggattcagcgatacgggaggtaactgcgtcattgggtctcactctttaccggcagcgactgctgcagttgtgccacttcgctccaggttttccagccaggctgacgggcaaactcaactttgccattgccggtgcctgcaatctgcgaggtcatcaccatgcccttatgttcgatcacggcctgccggaaaaagtctgccaggctggccggggttaaccgctgaacctgctctgtcattttttgccgggtatcaaattgatcattctgccgatcaaagtcgcggctaaagcgatccgcttcctcaaagagcgtctgaggacgctgctgcaaatcattgatcatcgcctgctgatactgggcaaagtctgcctggctcatactacgcagacgtttttccgcctgcgggtagaaggcctgatagcgctgcaacagccagcccggttgtttgctgttactttgcagcaggaagccgattccccactggcgacccactggcatctggaaggcaaacaccgcgtagccgagctgctctttggtccgcagctgattgtagaaccacggctgcacaatctggctcagcatggagctgtgcgccatgctctgatattcactgtatcccagtggaatatagagcgcggcaagggcggagtcggtgctgctgcctttttgttgcaggttggctttcagcggttttttaatcgagacatactgactatgccagtcgcgggtcgcatgactctgcatctgctgtttgagctcatgccccagctgcgtcacgctgtcagcactgaggttgcccactaccagcatctccggcgtcgcgtcgcggaacagcgtatcgcgatagtcagtgacatccttaagtgagagtgtgcttaccagcttgcggcgagcctcgcgctgggtatatggcagctgtgacagcagttgcatcggctgaatcgcctgttcaaacgctttgcccttttccgccgcgtccagccgctccagataccaggatttcgcctgctccagctgctgttctgtcggctggaaagtggcgtaaccttccaccagtttcttcagcagggtcggcagacgctgagtgaagccgttggcgctgaataccagcccttcatcttcacccgttgagaagctgatgccgcccactgaagcctgtgaattaagctcgtccagcgccaggctggaaaggtagtcattcaggccaaacagcacctgctgacgggcatcactgatggtgtgcttattgcgtaacgccagggtgatcgccgcttttggctcgctggcgtaataacgactgggcatccagtaaatacgcatatcatcctggttatccagtctcaccggatgctgatacgttttgccgtctgacggtaacagggtgaagtcgtccgggatataggggtttagcacgggcatcgccagcgtaatctggctggcgcgctgctgccagtctgcaaaggtttgtggagtgatcttctcaacctgataaggcgcatccacaaaataggcttttttgttgtgcggctcctgcggactgatgtaccagatacgcgcatgctgcggggtcatctctttcagccgggcattaatcgcggcggcatcgtactgatccgccagataaggtgcatccagcgtatgttcaaccggtacgcgcagcatggtgtcggccagccattcaatgtaatccatatcgcgggtaattgagggatagcggaagtcgagcgccagcacatgcgaaacttcatcgaaatagcgcttatcatccccctgctgacgcagcagattgatgtagctgaatatcgccgccacgacctggtcgcgctgcgccagacctttatcagtcagtgacgcggtaatcgcaaacacgccgctgttgcgctcggtcatcgggtcagcacccgcattcaccccgtcggccagcccctgtttttgcaaccagtcagtcagcgtgtttttgctgcggttactgattaaatagctgatcagcgtgtcggttttactgcggaaccgatcgctgttgttggcaatgcggaattcaattttgagctgcttgcgcggctgagccggaacgtaatggatgatgatgccctgctgcgcatcggtcaccaccggcatcgtaatctccggcacgctggcgtcatgattttgcacccggccaaaggttttagccgcaatcgacgccatctccggcagcggtttgttgctgtagatcaccgctttcatcagattggcggagtaatgcgtatgataaaagtcctgcagcgcctgatgcagtttgctgcctggcttatctttcagggtctcaagattgccgcccgagaaacgtgacgccggatgcgccgggttcagggtttccgcgccgacctgtgccatacgcaggccatcgcgcgagcgcgccatggtcagctcggcattcacggcgtggcgctcgcggtcagcgttaaccggatccagcagcggctcagccaccgcatccgccaggcgatcaaccgccggtttccagcgcgtcattttccacttccagataaaaggcggtgcggtaggaggctgtgctggcgttgtggctgccgccatgctttttcaggaattcggccaggttatcgggctgcgggtagtgctttgaacccatcagcaccatatgctcaaggtagtgcgccagtcccgcctgctgatcgggatcgtccagcgatcctatcggcagcgtcagcgccgccagcgatttcggtgccacaggatcggaaaccagtaacaccgtcatcccattatcaagccggatagcctgatagtggcggggatcctgttcacttttgcgaatagtgtcgttaaccggctgccagcctgatgatgcctgctcctgcgcctgcgctgtgcaagccatcaggcttaacattagcgccgctatccagcgtgcgtgtacccgcatgtaaacccctctcgtttcccgataaaccgccaatgtcggacgcggcggctcaaagcagagcaaaatttctgtgtaatgagtcagtcagcaaaaacgccttctgatcggctattcatcatcctgatgtgcagccagtaccggtaaataccagcgctgtgccgcctcagttatgtgctgtagttgtggctcatccagcacccggcaaagacgttgcagatagggatcgctgccttcaccctcaagctgatagttgcctgaccaggccgtcagcaggcgattacgcgccttaagctgggttgcctcatcagtcagtaactgctgactttttttgtcgtagctggcggtcagccatgcgccgccacttttgttaagcagcatcagcggctgacgcatacccgcgagataccccgtgacatactcattcagcgcagcaatcgcctctgcctgcggcacagcaaggaagcaccagcggctctgctgccggccaaacatccggctgctgccggtgccgcccagcgcgcagtagaccagatgttccagccagagtagcagtccgtcgttcatgttgagtatgccaggccgccagcgcagcaatccatcactctgaacctgcgtcagccacccggttaagctgacctgctccagttgcagattcacttcccagctctcgccgtcgctgcgctgggtgaccacttctgccgccacttcctgcatctcattgcgctgcgcctgccagaacagctcaccgaacgcgccataaggcagattaccggccgcacgatggtgcgcataaagccgctgagtatcctcgccttcgaccagggcattcagcatctgcgcgttaatctgataacgctcaaggttgtcgagcgcaaacggctcgctgtcgggcagttcgttctcctccagccagaaactcacgccaagccgctgatggaaccaggcccggaccggatgtcgccagaagcgcaggaacgcctccagcgtgagcgcatcaattaacggcgcctccagcggctgcacaaaatcgggctggggctgccccgcaccccgcgcggcaggcaaccactcacgggcgaaactttgcagtctggcagcaggctggaagttttcggcggcaaacggcatccggctgtgcaggtgctgcaggtgcatccgcacccgttcggcactctcatccagctcaagatggccatcaccgtccagataaaaactctgtccaatgtaatccagcagttctgtgaccagcaccgaggggtagcgttccgtattatcctgaatcgcccggccgatataactgatatagagctgctgctgcgccgaaatcatcgcctccaggaagagatagcggtcatcatcgcggcgactgcggtcgcctttgcgggactgctgctgcatcagatcaaaacctaacggcgctaaggtccgtggatagacgccgtcgttcatgcccagcaaacagaccagctgaaaaggaatggagcgcatcggcatcagggtacagaagttaatctgccccgccaggaaacgctgactgatgcgctgttgatcaagccggctgcgcagatcatcgcgcaacagcgccaccggaatcgcctcttcaaaccgcgcatccatgccatattcaatcaattgctgccactgctcttccaccagcagtaaggcggcctcggtttctgcatcggggctgaaaaaggcattgagcagttcccggcacatgggcagccaggccgccagtggccggggttcggcaagcagctgccgccagtgattaagccgggagagcaattcagccagatgtcccgccagctcccccaccagaccacccgactcgtcataaggcagaatcccttcccagtcaccgttatggctctccatcgcataacccaacagcatacgctgcaggccaaagcgccaggtgtgctggccggtaaccggtagtgacagggcttctacgctggcatcatccagcccccagcgtacacccgattcgctgacccagcgccgcagtaaacgcaggccgctttcatcaatggcgaagtgggaagcgagcgccgggacatcgagcagcgccagcacatcctccgagacaaaacggctgtccggcagtgccagcagatgcaaaaacgccacaatggccggatgagcctgactggcacggcgatctgaaatcgcaaacggcagatagcgatcggcaggtgcattggcgaacaccgcctgaataaaaggggcgtaggcgtcgatatccgccaccatgacgatgatgtcacgcgctttcagcgtcggatcggcctccatcattgccagcagatgatcctgcaacacttcaacttcgcgctgggcactgtggcagacctgcaccgcaattgatcgatcctccggatcaaggcagcgcttctgatcgctgtgtgccagttccgccgcattcagtccgatgatggcgttatcctgcagattgagaagatcgtgctgcatacagtgcagcaggttgtccggctccacatcgacaaaagcatcgatgtcgtcgtttgactccatctgactgagcagaaacaggttgtcacgccccagcttgccccaggaggcgagcaaagggttggtcagttgctgttcaccagcgtcgttaaacagcgccggtgcctgctctgcatcccggaagagtccgcgtgattcatcagcaccatggcggcggcgctgacgactttgcagtttcgccagaaacgcataatcctgaatatcgccccagtaatcgcggcagggattggtgaacagcagatggatgtcgatgtgacgtcccagcgcctgcaacgcctgcagatagaccggcggcagcgcagagatgccacagataaagacccgtttgggcagattttccggcgtgcttttcgcctgatccagcgtctggataaatcgcgcatagaggttggcgcggtgccattcaggctggcgcagggcctgggtataactcaccagatcgcgccacagtgcggcctgccagcgctgcgcctcgcccagcccctcaatggtttcgccacgctcccagctgttgagccagtcggcacgatagaccagatactggtcgaacagatcggccacgcgggagctgagctgaaacagtttacgcttgtcgccgtcgtcatggagatagtggcgcagagaagcaaactcttcatgcttcagcatctccggcagccggtgcatcagcttccagcccatgctggccttactgaaagcactttctaccgggatatcgggcagtacgcggacgaacatctcccagataaaactggcaggaagcgggaattcgatattggcagcaataccaaaagtttgcgccagctccatctgcagccactgcgccatacccggactctgcaccagcaccatttctgaggcgaaaggatcatcaagagggtcatgtttaatcaccgcagccgccagaatcttcagcacatcaagctgatttgagtgataaacgtgaaacatgaaaactcctgtgataactcagaacgtgactgcggtattgcggctctgtcactttaccgcgtatcgcggttgaaacccatcaaaagggcgaccgggaagagttaacatcgcagccgcgtcagggtggcacggcgctgataaggtcccgtcacgtcagcccgatccagggtgcagcctgaaggaccgctctgctgttgcagtattgaagtccagccgggactctcatgtcccatcagttgctgctcagccacccgccatgcttcacgctgataccactgctggctgaatcccagtgccagtgcgcgatgatagtgcaacagcatgctgctgcttaatgccattaacagcagagcaaacaacacttccggcaggctgaatccaccgcgcttactggcaggtggccgggggcgtgagcgggcagtaatcgatccagccgtgcggcaacgcggtaatctgattgccccgtaaccgtacccactgccagaccgccataccactgccgctggcctcccctttaagcagaccttcatccttttcacctcgttgtaaacagctgcgccagccctggcgatcatcctgctgacagctggccgcctcactggctgaccagctcagggagaagccccattgcagcgcagactgcgcccgccagaaaccctgaataaactgctgctcatccgccagcagtcgcattccctgctcagacatcttacggctggcatgcagcgtaaagctgccgatgaccataatcatcaacaccatgcccagagcgctgctgcctcgctgcttcacaggttctctgcctcaacccagctctccatcgtttcaagccagcgtccggcccgtgcctgcagcactatcctgacctgcgtgccctgctggctgacgctgaactgctccagcgtcataaacgcgggatcggagagccgctcccagcccgctgactgacactggtcaacacctcgctgcatctcaagctgctgttgtcgcaggcgataaccgtaatagtcactctctgcatagctcaccccttcccatttaccgttgctgttctcatcccagcgcagcagcaggcagtttctctctgatttgcagcgcctcactgccacactcaccgtgacaataaccggcacgccgcaccgctttttccagcgtcgccatcatctgctgtaactcctgacgcagctgcgcccgttgcatcacgccggcgttctctgccagcagcagcggcagaaaacggccagcacttaacatcacgacggcgctgattgccagggcgatcagcatctccagcaggctgaatccggccattttcaacgacacgtctcctcatccgtcatgcagaggcgaatacgggctctggccgagataatcagccgcattcgtccggcgctgttacccagctcaatgctgcccgcccgggccacattacgtcggccatagaagcccggttcaccccggatgccatagagcgaaacgccagcgtgcggcgccacgaattgcagccgttttcggctatcacaccctgcaacggggaggcttccggcaccgatgcaccagggatcgccaggccgtgaccataaaaccagatcgctattttgccggttggccttggcacgcagccgaagcaggaatccctgcagttgctgggcgctgtcgcgcagttgctgccgctgttgccagcgctgccagccatgcagcgcggcaagactcagcatgccggcaatcaccatcaccagcagcagttccggcagggtaaaaccgcgtaagtgtgctgttttcatagcgtcagaatgcgggtgatgaacagatgaaacaaggtgcggtttggcaggctgggaagcacgacgcagagaaccttccccaacagcatgaattggcagaagcgtgcgagcgttgccgcagatttaccggtttgcgggcaaaaaaaagccccggcgatgaagccagggcgttatcttttatcgcgaatcagatggcgacaggggctttgatcgcgggatgcggatcgtagccttcaatctcaaaatcttcgaactgatagtcaaacagcgacgccggtttgcgtttgataacaagtgatggcagcggacgcggttcgcgggtcagctgcaggcgcgcctgctccagatggttactgtagaggtgggtatcaccgccggtccagacaaagtcgcccacctgcagatcgcactgctgcgccaccatatgtaccagcagcgcatagctggcgatgttaaacggcaggcccaggaagatgtcgcacgagcgctgatagagctggcaggagagtttgccgtccgccacgtagaactggaagaacgcgtggcaaggagccagcgccatctcgctcagctcgccgacgttccaggcagaaacgataatccggcgtgagtcgggatcgcgcttcagctgctccatcacctggcttagctggtcaatctcctggccgctggccgttccccagctgcgccactgtttgccatacaccgggccgagatcgccattctcatccgcccactcatcccagatggagacgttgttatctttgagataaccgatgttggtatcacctttcagaaaccacagcagctcatgaataatcgagcggatatgacatttcttggtggtgaccagcggaaaaccatcctgcaggttgaaacgcatctggtgaccaaaaattgaaagcgtaccggtgccggtacggtcagcttttggcgtgccttcgtgcagcacatgttgcattaaatccagatactgtttcatttttcctcgcgaaattgtggctgcgggcgacgacgatacgcccagatcatcataataataccggcaataatcattggcacagagaggatctgtcccatactgattccgccttcaaacaggccaagctgggcatccggctggcggaaaaactcaacgataatacggaaggcgccatagccaatcaggaacaggccagagacgctgcccatcgggcgtggcttacgaataaacagattcaggatgataaacagcactatcccttccagcaccagttcatagagctgcgaagcatgacgcggcagcacgccgtaggtgttgagcagcgcctggtattgcggattggtggcggccagcgcgacatcttcgctgcgggagccagggaacagcatggcatagcggaagcccggatcgacacggccccagagctcaccgttaatgaagttgccgagacgaccggcacccagaccgaacgggatcagcggcgcgatgaaatcagccacctggaagaaattacgtcgggtgcggcgggcaaagaccagcatgacgacaatcaccccgatgaggccaccgtggaacgacatgccgccatcccagactttaaacagatagagtggattttccaggaacagcggtaagttgtagaacagcacatagccgatgcgtccacccaggaagacccccaggaaaccggcataaagcaggttctccacttcctcttttttccagccgctgcccggctgattggcgcggcggacagccagccacatggcgaaaacaaagcccaccagatacatcagaccgtaccagtgaagcgaaaccggtccaatcgagaagatcaccggatcgaactgcggaaatgcaatatagccgttattcatcattcaccgtctatttttcaaccctgaaaagggggtgttgtcaggcacataaattaaggctgcgcatcatagcacagccggttttgtgaattgtcccgcaaatgtaaacgcggataacgcccagagtctgacccgtcaggcgtacattgttgcagccagactggtcacggacagcgcgcaacaaccggagcgtacacgtagtacgtgaggattactcgctgtgctcgccccttcagggccgccctgacgggcgttcaggttgctaaagcagcctgtgtgagcactgcccgggaccagaatggcaaataaaatagtctgacccgtcaggcgtacattgttgcagccagactggtcatgtacagcgcgcaacaaccggagcgtacacgtagtacgtgaggattactcgctgtgctcgccccttcagggccgccctgacgggcgttcaggttgctaaagcagcctgtgtgagcactgcccagggccagaatggcaaataaaatagcctgaagtagcgcttagcgaccgccgcggattaatccacccagcccgcgacgctccataaaggtcgagaccagatgacgaacctcagtggcggtatgagcattcatcccctgctcgctgagttgctgcgcttcttcgtgatccagatggcgcagcaggtatttcacccgtggtacgtttttgccgttcatgctgagatggtgataccccagcccgaccagcagcgccacgcacattggatcgccggccatttcaccacacaggcacaattccagattggccagacgggcttcctgcgcaatcgtattcagtgcacgcagcatcgccggatgcagcgagtcgtagagattggccacgcgggtgttgttgcgatccaccgccagcagatactgggtcagatcgttggtgccaaccgagacaaaatcgacccttgacgccagatgcgggatcataaacagcatcgacggcacttcaatcatgatgccgatgcgcggcgcggggatcgtatagcccagcatctcttcgacttcgcgtcctgcgcgatcgatcagctttttcgcttcgtcgatctcatcgatatggctgatcatcggcagcagaatactgaggttgccggatgcggcgttggcacgcagcatcgcgcgcacctgcaccaggaaaatttccggctggtcaagcgtcaggcggatgccgcgccagcccagacagggattctcttcactgataggcatgtagggtagctgtttatctgcccccacatccagggtacgcagcgtcacaggcttgttgtgaaacagctgtaacatgccctgatactgtgccacctgctcctcttccgacgggaagccgtttctgcagcataaacgggatttcggtgcggtagagaccgatgccatccacccagttgcccagcgtctgctcatgctccgggcttaagccggcattcagcatcacctgcacgcgctcgccgcttttcagctcaccgggctgatcgaccacgccttccgccattttgctcagcgcattctcttcgctgatcaaacgctggtactcctgcaccagcaccggctcgggatcgatcaacagctcaccgcgatacccatcgacgatcagcaaacgtttgttgagctgatgaggctggatgtcagcgcccatgaccgtcgggatccccatcgcgcgcgtcagaatcgccgcatgggagttggctgcgccgtcacgcaccaccacgcccgccagccgctcatgcggcagctcagctaaggtggtggcggtcagctcatcggccaccagcacaaagcgttccggccaggcattggtgccgaccagcgtatcgtcaaggtgaaacagcaggcgctgacccagcacccgcagatcgcctgcgcgttcacgcaggtaggtgtccgtcaggctggcaaactgttcagcaaacttctcgatgacctgtttcactgcccattcagcgaccgagccgcgttcgatctcatcgaacagatcttttttcagtcgggcatcggttaacaggtgagagtaaaggtcgaaaatggccgcactctctttctgagcgctggcgctgaagcgtttactgaagcgacgaaattcactggtggcttcactcatggcgagcgacagacgctcacgttcgcgatgaacatccagcgttgaggcagccgaaacctgatcgagcagtggctgcgtctcatctacccagcccggtgccaccgccacgccaggcgcagctgcaatcgcgcgcacccgcgtctgccggaactgaccaaacagctgggccatctgcgactgcgacagcaatgccgccatctgggtggcaagggtgaccagaaacgactcttcgctttcatcaaactgacggtgctcgcgctgctgtaccaccagcacgcccagtaactggcgacggctgataatcggcacgccgaggaaggagcggtagcgctcctctttcactgcggggatatatttaaagctgggatgactctgggcgtcagcaaggttaatcggttcggccagacggcccactaaaccgacgatcccctcgtcaaacgccagggtcacggtgcggccacgcggttttttaagtccgcgcgtcgccatcaggtagtagcagtgacgatcgtggtcggcgaggtaaacggaacagacttccgtatccatcgccagacagatctcattaaccaggatgtcgagtgcttcattgagacgcggcgcactcgccactttttctacaatttcgcgcaactgagtgagcataaagggcgtggcctatcctctcttacgtcgatgggcaggattatttcgctgccccgcactctcctgcatagacatcaccacgccagcgaattccttcatcacccgacgataaacgtcgcgcttaaaggagacaacctgacgcaccggataccagaaactgacccagcgccagccatcgaaactcgggcgtgctgctgtgctgcacattgatatccgcgtcattacacattaactgcagaagaaaccacttttgtttctggccgatacataccggctttgtgtcccaacgcaccaaacgttttggcaacttgtaacgtaaccagttacgggtagaagcaagtattcgaacatctttccggtgtaatccgacttcttcgaacagttcgcgatacatcgcctgttctgcggtttcaccgggattgatgcctccctgaggaaattgccaggagtgctgtccaaagcgcctggcccataacacttgtccctgccggttacagattacgataccaacattcgggcggtagccatcatcatcgatcaccggactacctcaaagcaaaatttgaatgagctgattgtttcacactccttacaggcggtaaaccactggattcatggggggttaagccatcatcgccgggataactcacagaaaatggcaaagttataaacaatgaccgagaaaaagatcgatcttattcaccttttctgtggatagctttgtgcagaacgcgggagttatctgaataaccttttccgtgcgcgctgaagagccaaaaagaaccaacaacacatcattatgatttttaatgaaattaaatcgaaaaccttaccggtaaatcttttataaacagtgaatattttcatggtaactgacaattgcttaaaatataagcacactgctttttatccacagataatcgctcagggttaggccagagcggcgaaattatggccagatcgtgaaaagtcaaggctgtaaatggaaccagtaccgcactcagacggtggttatcccatttttctgtggataaccgggctggagatcctgttcattgttgcgggtaagatgggataaccctgaagcacctggggcggcgagcgtgcaatccgctaaaaaaagcacgatctatcatgttattatcgatccctgacgcggattatttatgtgagaaacgtgactcacctgctgttgtacaatttttaatcaatgcgagtattcaccatgagttaccagccaggaccacctgaagatgaagccagcctgctggcacgcgcgcaggatttagccggtttaaccctggaaaccctggccgcgcgcgccggtctgcccatgcctgcggatctcaaacgtgataagggctgggtcggcatgctgcttgagtggcatcttggtgccagcgcaggcagcaaagcggagcaggactttgcccatctgggtatcgaactgaaaaccatcccgattgatgcgcagggtaaaccgctggaaaccacctttgtctgcgtggcacctctgaccggcaacagcggcgtgacctggctcaccagccatgtgcgccacaagctggcgcgggtattgtggatcccggttgaaggcgggcgtgagattccgctgcgggaacgccgtgtcggcgcgccgctgttatggagccccgatgcggaagaagatgagatgctgcgacaggactgggaagagctgatggatatgattgtgctgggtcgcgtagagcagattaccgcacgacatggtgcctggctgcaaatccggcccaaagccgccaatagcaaagcgctgacagaaggaatcggcgatcagggccagccaatcatgacgctgccgcgcggtttctacctgaagaaaagcttcaccgggcccctgctggcgcgtcattttctcctctgattgtcgccacccgcgttgatgtgtcgcaattttgtgggagatcggcgaattgaatgcgtataatcgccgtttacttttcgtttaggattaaatgtcggtatgtttgagtggatttccgatcccaacgcctggctggcgctgggcaccctgaccatccttgaggtggtgctgggtattgataacatcattttcctgtcgctggtggtcgctaaactgccgaaacaccagcaagccagcgcacgtcgcattggtctgatgggcgcgatgctgatgcgtcttggcctgctggcttctatcgcgtgggtagcccgtctgactaatccgctctttacgctgatggatcatgcgttctcggcgcgcgatctgattctgctgtttggcggactgttcctgctgtggaaatcgagcatggagatccatgaaacgatcgaaggcagcgaaggcgaacacaacacccgcgtccattccttcctgggtgcgattgtgcagatcatgatgctcgacattattttcagcctcgactcggtgatcacggccatcggcctctccgatcatctgttcattatgatggcggcggtggttattgccgtgctgatgatgatgttcgctgcgcgcgctatcggtgagtttgttgaccgccatccgtcagtgaaaatgctggctctctctttcctgattctggtcggtttcaccctgatcctggagagttttgcggtccacgtaccaaaaggttacatttatttcgctatgttcttctcaatggcggttgagtgtcttaacctgatgcgcagtaagaaaaagcacgcctgataaagtcaagggcgagcctgctcgcccggttattttcagattcatacgattaaccctgccggcaaaaccatttattactacactgtttgcacttgaccatttgtgaggattaggcgtgatgaaagggttggcaggagtagcactggtgatggtaaccgccgcattcttaagtggatgcagttctgattatgtcatggcgaccaaagatggccggatgatcatgaccgaaggcaagccgagcattgataaagagaccggcctggtggagtacactgaccagacgggtcatatggtgcagattaacagcgatgaggtttctacgatcattgaacgttaagtgcccgatttaatcacctgccaccgattcccggctggcaggtgatttccccgacttttcccccttccttccccgccattgctcgcgctatagtccctgaggacacaacattccattccataaagaaaaggaagctggcaatgcactatcatcgtattccccacagcacgctggaagtgagtcagctggggttgggcaccatgacgtttggcgaacagaacagcgaagccgacgcccatgctcaactggatttagctatccgttccggcatcaactttattgatactgccgagatgtatccggtgcccccgcgtccggaaacccagggtctgaccgaacaatatattggcagctggcttaaacagcgcggcagccgcgacaaaatcattctggccagtaaagtggccggcccttcacgtggcaatgatgcgtcgattcgcccggatatggcgctggaccgtaaaaacatccgcgcagcactcgatgccagcctgaaacgcctgaatactgactaccttgacctctaccagctgcactggccacagcgtcagaccaactattttggcaagctcggctatcagtacagcgaaaccaccgctcaggtgacgctgctggagacgctggaagcgctgaccgaacaggtgcgcgccggtaagatccgctatatcggggtgtcgaacgaaaccgcgtggggcgtgatgcgctatctgcagctggcggagaagcatgaactgccgcgcattatcagcattcagaatccctacagcctgctgaaccgcagctttgaagtgggtctggccgaaatcagccagcatgaaggcgtagagctgctggcgtattccagcctggcgtttggaacgctgagcggcaaatacctgaatggcgcgcagcctgcgggcgcacgcaacacgttgttcagccgctttacccgctacagcggcgagcagtcacaaaaggcgattgccgaatatgtggcactggctcagcagcatcagattgacccgtcgcagatggccctggcctatgtgcgtcagcagccgtttgtggccagcacgctgctgggcgccactacgcctgagcagttgcagatcaatatcgacagcttcaatctgaccttaaatgcagagatcctggaaggcattgaggcgatccaccgtcgttatacctatccggctccctgagcgctctgttgccagctgccgcgatggcggctggcatctcttacaggtcgcgataatagagttttaccggcttagcgggatactccagcgcttggccctgtggcagccagccataacgttcgtagtagcccccaaacgttgaccataaccataaccgtggatagccttgtgcctgcgcataggcgatgacatgctgctgcagcgcctcactgacacctttgccgcgcaccgactcatcaacatagagcgccgccagccaggggaaaagatcctgacggctgatcaggtcgcagcgccagaatcccaccgtgccgactgccctgcccgcctccacggcaacgaaagtcaccggaaaatcagcaccgataaggctgctgttcaccacactggcaaagaacgcccggctggtggcttcaccaaatgcgtgccactgccagtcgatgatctgatcggcaaattggggggcatcgctgagcgatacaatctcaatcacatcagtttcccctgaaagatcgggactgaatcaaacaggtagccatcaaagtcaggcgcatcggcgtcggaaagctccagcagcgtattcttgacgttctcaaggtgctgccaggtggattgccaggcccccatcacatcacgccgacgcagagcagccaggattgtctggtgatcgccaagccacttcaggcgataggcgcgggtttcaaactgcgggcgcagctgctgccagagcgggctactgtcatgatgtcgccagatgctggtgacggtatcgagcagcatctggttctgactggcacccgccagcagcagatgaaacaacttgtcgttgtcctgactgctgtcgttggcggcgatagcacgctgctcctgttccagcgttcggcgcagattttcaatgtccgctttggtcgccatttttgcggcaaaggctgcaatattgctctccagcaactgacgtgcctgtagcatttcaaacgggccaacgtcgctgcggaagaaggcctcttcttcatcatcactggcggaaggaatacgcatcacatagacgccggagctctggcggatatccaccgtaccttccagctccagcatcaataatgcctcgcgcacgatggtccggctgacgccccaggtttcagccagctgacgttcaggcggcaggcgcgatcccaccggatagtgcccgtcacagatctgctgacgcaggtgctgaccaatttcctgatactgctttttttcttgcggcgcttcggctttgtccacactgtcaccctttgcaatcaatgcgctaacggcattgccgcggttccctgcgcgacaatgcccgcgaaaccggagaggctggctcgcaaactggggctcagtgtatcaaagccagcgcctgatcgagtacctttgcaccattcagcgtgccgtaagcaaccgtatcgatcaccgcgatgggcaactgatagctgtcggtgagttttctgttctcctccagtttgaagcgcacctgtggcccgagcagcacgaccaccacctcgttgccgtagttttgcagctcttcacgcaggttttgctccggaatggcgtagatctgaaatgccagtccgcgcgcggcagcctccttttccatccgcgtcaccaccattgaggtcgacatgcccgcagcacaggccagaacaattcgtttcatgctcgtttcctcgcgttatttcggctcatcatcaagccacagggtaaattgctgcgtgtcgcgcagcgtacggaaccagtgggcagatttcttcatacggcgctgacgctgcttatctaagtcgatttcgataagaccatagcgatttttaaaggcattcattggcgagacattgtcggtaaacgcccacagcatgtagccctgacagttaatacccgcctgactggcgcgtatcgcctgatgcaggtgctcgctgataaacgcgatgcggtaatcgtcctgaatctccccgtcggcatttttgaactgcgcttcgttctctattcccataccgctttccgccacaaaccacgggatattgccgtactcatcgcgcatccgctgcgccatatcccagataatttcaggctgaatttcccagccgcgcgaagggttcatccgtcgccccggcagttcaaagtgttcgtaataccaggcgggatgaaagggtgtctcgggatgccaggcgcgggatggtgccttcacgcgatgcggatagtagagattaagcccgacttcatcgacggtattggcggcaataatcgccagctcttccggggtggtttcccactcaatctgatgcttatcaagcagcgccagcagctccgccggatactcgcctttaatggcgggatcgagaaacacccggttgtagaacaggtcataaatatgcgccgccttctggtcgtgcggggctgacgatcgcggataggtgacttccggattgagtatggtaccaatgcgaccggcatagcctgccgcgcggaacagcttcactacccgggcggtagcaagattcttgtggtggttccactgcatccatttatgggtgttctgctcataaggccagcgcagcgcgtcgagatagacgcgggtctgcaccacaatcggctcgttaaacacaaaccagcgcgtgacccgaccggcatagcgtttaaacacctgttcgacataacggataaagagttcaacgacatgctttgactgccagccgccatactgctccagcagcgtggcgggcagctcgtaatgctccagacagagcatcagttcaatgccctggcgctgcatttcatcaatcagccggtcatagtaagccgcgtattcctcatcgaccgtagcggtttcgtaatcgatcaggaaacgcgaccagttgatcgaagtgcggtagtgggtcagcccgctggccttcattagcgccacatcctcactaaagcggttgataaagtcggtggcaaccgccgggccgtagccgttgtgccagacgtgacgatcctgctgataccaggcgtcaggccaggagtcctgccccgctttttttccgctccagccttccgtctgccaggcggaggcagcagctcccagaatgaaattctcaggtatgtggacagtctgacgactcataacacctccgttcggttagggttcagctcaggttgcaggctctttgcttccgctgcttctgctgcatccgcgcggcgggctgcgactttcacaaatggcagatagataagtactgacaccagaatgcagacgatctgcgtcaccaccgcacccatcgatccggccgttgacagccaggcattgataatcggaggcgtggtccatggcaccatcaccacggctttcccggcaaatctcatcaccgtagcgaagtagccgatagaacctgtcactagcggtgtgatgatgaaagggatagccagtatcgggttaagcataatcggcataccaaatataaccggctcgttgatattgaaaatgcctggcccgaacgacagtttggcgatttcacgcatctctttgcgtcgcgttgccagcatcacggcggtgagcagcccgatggtcaggccggagccgccgatgctcatataaacatcccagaaacggcatggtgataatgttcggtgcctcttttccctgctcaaaagcggtcatgttgaccataatcgcgcccagcaacagcggctcacggatcggcttcaccatctgattgccgtgaataccaatcacccagaacagctgggcgacgaacatcagaatcagaatgccccacaggctctgcaccaccgactccagcggctgctgcaccacctggtataccgcgtcgtaaaggtacatgccggtgacgcgatggaagataaagccaaaagtcgctatcagcgtcacggtgatgattgaggggatgagcgcggagaaagaggcggccacgttgggcggcacggtgtcgggcattttgattttcagccgttcaacctgttcgaggcggcagtagatctctaccgacagaatggcgataaacatgccgagaaacaggcttttggtatcggagaattgtttggccagcacgtcggtgaccaggtgcatctgcccatcgaccatcatctgtaaggtggtcggcgttacggatacaaagcagatgatcgccagcaggccgggaaacagcgtttttataccgttgatgcgcccaagctcaataccaatcaggaacaccgcaccaatgttgagaaagctgagcgtggcgtaattgatactgctggtgatgggcttgaggtcagctaaaaaagccagggcggcaaagctggcaaggccatttttgctgtccagcaccatgttagagatcaataccgagaaggcgccaacaatgatcaccggcatcagggtaatgaacgaggctttaatcgccatgatgtagcgataactgttaaagcgggtggcaaagctgcccagggaatcgataaggcggtcctgtagagacatgatcaaccctcagagatgtaagatcggtattcctgtaatcgtcgtggtcttccctgttagtggcataccaaaatgacgaatctcctcggttttttctgtgacgaacctcccggaaacgtttattggcattccagtatgattaaaacggccaatttggcataccaatagcggaggcgttatggattacgaacagaccatgatggaattgctgatcaatgcaggggaagcccgtttcgtcggcgatgatggcgattcagtgtgcgcgcaaacgcgactggaccggggctgacgcggcgctggcagcttcagataccgcggcaaaagcggcacataaaattcagaccgcgttgattggtgcagacgagggaagcggaaaattgccggtcacgctgattctggtgcatgcgcaggatcatctgatgaatgcaatgctgtgccgcgagctggcagaggagctggtcatgctgcgcaaagagatctatggctgacaggcggcgcgctggccgcccgggtgaggtgattagctgttttccagtgccagtagcgactcaatagtctgcgcgcggcggatctcgcgcggctggccctgctcaaacagcatttccgggatcagcggacggctgttgtagttagaagacatggatgcaccgtaagctccggtgtcgtggaacaccaggtaatcgccaacctttgccgccggaatcgcgcgtggttcgaccatgccgccctccagctgggtaaagacatcacccgattcgcacagcgggccagcgaccaccgtgtcgatagtctgctgctcatcaatggcccgctcatcgcccgccatcagcgagatatggtgatagctgccatacatggagggacgcatgaggtcactgaaaccggcatcgaccagcacgaagtgacggctgcccatcgacttaaccgcccgtacctgagagaccagcacaccggcctcggccaccaggaaacggcccggttcgatctccagctttatcgcgtgacccagatgctgagcgatacgctgccgcgctgcatcccacaggccgaaatagtgatcggtatcgatcgcctcttcgccatagcgataaggcacagagaggccgccgcccgcagagatcgcggtcagatcctgacccgacgccatcaccagttcaaccatcgcatcacagacctgctgcagatgcgcataatcgacgcctgagccgatatgcatatgaatgcccaccagctgcaagccgtgctgcttaatcgccgccagcgccccggctaaatcggcatgccagataccgtgcttgctgttttcgccaccggtattggttttctgactgtggccgtgaccaaaaccaggattgacccgcagccacaccgcatgtcccggtgagaccgcgccgagctgatgcagcatatcgatcgatccggcattaaccggcacctttaacgcggtcacccgctccagtgtcggctgatcgaacagatccgcggtaaagacgatctcatcaccgccaggctggtaacccgcggccagcgcacgttcgatctcacccagcgataccgagtccactttcacgcctgctgcgcgcatcaggcgcaggatatgcgtattcgagcaggccttctgcgcaaagcgcaccacatcaaatgcctgcagctgggcaatacgcgcctgaataatctgcgcatcataagcccagaatggcccggtgtagcggcgtgccagcggcagcaggttagcggcgctgagtgcggtttcggtactctgtaatgaacgtggcatgacaattctcctgtggcaatagctgcattaagccagaatcgtgtcatagcgaaaaatatctgttttaatagcatctatgcagaatggatataggaagggtgcgtggcgaacattaactggcggcatatcgagatttttcatgcggtgatgaccagcggcaatctgacccaggccgcgacactgctgcacacctcacagccgacggtgagccgggagctggcacgcctggagcagcagctgggattagagttgttcggacgggttcgtggtcgcctgcaaccgacggtgcagggattgcgtcttttcgaagaggtgcagcgatcctggtacggactggatcgcatcatggaagcggctgaaggactgcgccagtttccgtcagggtgagctgtcgatcgcctgcctgcccgttttttcgcagtcgctgctgccaccactgtgtcagccctttttacagcgctacccggatgtgagcctgaatgtgattccacaggagtcgccgctgctggaggagtggctgtcagcacagcgctacgatatcggcttaaccgaaacccagcacgctccggccggcactgaccgtctcgccctgctgacctgcgatgaagtatgcgtattgcctcagcatcaccctctgagtcagcgttcagagctgacgccgcacgattttgcgggcgaacagtatgtgagcctgtcgcgcagtgacagctatcgtcagttgctggatgcgctgtttcatgagcagggcgtcgagcggcggctggtgatggagacgcacagtgccgcttcggtgtgcgccatggtcagagcgggcgtgggcatttcaattgtgaatccgctgacggcgctggattacgccgacagcggtgtggtgatgcgtaagttcagcgtggcggttccgtttaccgtcagcctggtgaggccgcagcaccgccctgcatcggcgctggtcgatgcctttgtcagccatctgcaacggcaggtggctgactttccggcacgcatcgccgcccgcctggcttaagcgcgaaccccggcggttgcgcggcccgatttgcggaaggtgatcagacagatcagcaggccgattgccgccagcgcagcggcagcaaccggcaccgccgtcaggccatatccacggccaatcaccgcaccgccgacccaggcacccagcgcattgcccacgttaaacgccgaaatgttcagggttgagaccaggttaggcgcctctttgccgtgacgtaccacgttgatctgcagacccggcaccgtcgcaaaggtcgccatcgcccacaggaaacagggtgatctctgccagccacagcgcatggctggtccagctgaacagcagcgagaagatggcgatcagggagaagctgaggatcaggctaaaggagactttccagtcggccagtttgccgccaagaatattaccgaccgtcaggcctgcgccaatcaggaacagcgtccagctgacgccgcgatcgctgatgcccgtcacctctagcagcagcggcgcaatgtagctgaacagcgcaaacatcgccgcggcaaagaacaccgtcatcagcagcgacagccacagtttcccgttggccagtgcaccaatttcactcgccaggtgaaccggcttttcctgtttattgttgggcagactcacgatcagggcgataaacgccagcacgccaatcactgccacgccccagaaggtggctcgccagccaaacatctgtccgaaactggttcccagcggaacgcccagtacgttggctaaggtcagtccggtaaacatcagtgcgacagcggaagcctgacgaccggctggcaccagactggcagcgaccaccgcgccaataccgaagaaggcaccgtgacaaagcgcggtgacgatgcgtgccagcatcagcaggttataattgtaagccagcgcacacagcaggttgccgacaataaatatcaccatcagcagaatcagcgtttttttacgcggcagcctggcggtgagcagcgccataatcggcgcaccaatcgccacgcccagcgcgtagccgctgatcagccagcccgccgacggaatcgacacctgaaggtcacgcgccacctccggcagcaatcccataatgacaaactcagtggttccgatggcgaacgcactcaacgccagcgccattaatgctacaggcataacactctcccaatatcatttgcaggtgaactgcacagacgcgcagcccctcgacgcttattaaaatttgatctgcgtcacggtgagcattacagcacagtgctgatgcgcgacatagcctgcgcgcagcaaaggattattgccggggccgcaataatcctgccgctttgccggaacaaatggctttgtcagcctgctggctaagcccattaaagcgcacatgacgcagggtcaggttgtcatttcccgcgaacccgttacgctttttagtgcgtatttaattaataaatccttaacgttgccgatatatccctaatcaattgccaggtgatgtgatcaacttctgacgcagggagagagaatgcaacgactcatagccttaatggtgtttggcttaaccggctgctcggtgggtcattatgagtacagtaaagaagctgaaaaacgggtggatatgaccgtgaccggcattcccaccgtgctgggtttaggcacgctcggtaccaccatcccattgacgccggagtacagcctgaccgccgcccatgtggcaaagttttcgctttaccgggtcaaagcctggcatccgcaatgcgatctggccgtggtctaccataaaaacagcgaaatgaacctgccacccaactttcgtaacagccacatcggcgatcaggtcaatctctacggctacagttttatttcggccatgccggtcagttccagcgggcagaaacctgattaataccacgctggcaaacagctggaacaaatcagactgcgtcgtggtggcggcgaatgcgggggtggttaaagggatgtcaggcggcgcagtctataacgcctctgatgatacgctggcgggcgtgattattggctacagcaataacatcaacgacaatgtcagcggtaagacactctataagaacgttgcgctctatgtgccttactcgcgatttcagacatggctggatcaggcgattaaatcctgatatctgctgaacgaacagatgtaaaaaaggccggaatttccggccttaagcttggtgacaaagtcgggcctggttcgctgtaagaccgagcctgcacaggtaacacggtcagatcggaaagacgcaaaaactgtcatccatgaccgctcggcccacgccatccatggcgcgggacgctttcctcttctgaccgtgttccctgtgccgtgagtttatcagttgctgccaaattcactctgattcggctttgtcatcacgctgtcaggcctgaagatcaggcctgacagcgactcataacgattacttgctgcctggacgcagtgccgggaacagaatcacatcgcggatagtgtggctgttggtaaacagcatcaccatacggtcaataccgatacccagaccggcggttggcggcagaccgtgctccagtgcggtgacatagtcttcgtcatagaacatcgcttcgtcgtcgccagcatctttggcattcacctgctgcaggaaacgctcagcctgatcttccgcatcgttcagctcggagaagccgttaccgatttcacgaccgccaatgaagaactcaaagcgatcggtgatttccgggttctcgtcgttacgacgggccagcggagagacttcagccggatattcagtgatgaaggtcggctgaatcagatgcgcttcagcggtctcttcgaagatttcggttacgacacggcccagaccccagcttttctcaaccttgatgtgcagtgattgagcaatcgccaccgctttatcaaagtcttccagatcggccagatccgtttccggacggtatttcttgatcgcttcacgcatggtcagtttttcaaacggcttaccgaaatcaaactcctgctcgccgtaaggcaccacggtgctgcccagcacatcctgcgccagcgtacggaacaggctttcggtcagctcgatcagatctttgtaatccgcataagccatatagagttccatcatggtgaactctgggttatgacgtggcgaaataccttcgttacggaagttacggttgatctcgaacacgcgatcgaatccgcccaccaccagacgcttcagataaagctctggagcgatacgcagatacatgtcgatatccagcgcattgtgatgggtgatgaacggacgcgcagacgcgccgccagggatcacctgcatcatcggggtttccacttccataaagtcgcggcccaccatgaactggcgaataccggccatgatctgcgaacgaattctgaaggtgttgcgcgattcctcgttggcgataagatcaaggtaacgctgacggtagcgcgtttcctgatcggccaggccgtggaacttgtccggcagcggacgcagtgctttggtcagcaggcgcagttcagaacagtgaatcgacagtttcgccggttttggttttgaacagcttgccgcgcgcgcccaggatatcgccgagatcccactttttgaactgctcgttgtagatgccttcagccagatcgtcacgcgagacgtaaagctgaatccggccacccacatcctgcagggtcacgaaagaggctttacccatgatacgacgggtcatcatacgtccggcaacactgacttcgatgccgagatcttcaagctcttcgttgctcttctcgccatagctctcatgcagctggtttgagaggctgtcacgacgaaaatcgttaggaaacgccacgccatttgcacgcagcacgctcagcttttcgcgacgcgctttcagttcgttatttaactcaacggcggcatcagcgctctgcggttgttgttcagacatgtcggttccttataaccctgcttttaaactagcttcaatgaatcgatccaggtcgccgtccagcaccgcctgggtgttacgcgtctctacgccggtgcgcagatctttgatgcgtgcatcatcgagaacgtaagaacggatctgacttccccagccgatgtcggacttgttgtcctccagcgcctgtttctcagcgtttttcttctgcatctcaagctcgtacagcttcgctttcatctgcttcatcgcctgatctttgttcttgtgctgagaacggtcattctgacactgggtgacggtaccggttggaatatgggtaatacgtaccgcagattccgtccggttaacgtgctggccgcccgcccctgacgcgcgatagacgtcaatgcgcagatcggctgggttgatgtcgatatcaatatcgtcatccacttccggatagataaaggcggagctgaaggaggtgtgacgacggccgccggagtcaaacgggctcttacgcaccaggcgatgcacgcccgtttcggtgcgcaaccagccaaaggcgtagtcgcctgacacgcgaatggtcacagatttaatgcctgcaacttcaccttcagactcttcgataatttcggttttgaagcctttggcttcagcccaacgcagatacatacgcatcagcatgctggcccagtcctgcgcttcggtgccgccggaacccgcctgcagatcgatgtagcagtcggcgctgtcatactcgccagagaacatgcggcggaattccagctcgcccagcttgccctcaaggacatccagctcggcaaccgcttcgtcgaaagtctcttcgtcttccgcttctaccgccagttcaagcagaccctgcacatcttccaggccctgcgacatctgatccagcgtctgcacgatcgcttccagcgaggagcgctctttgcccagcgcctgagcacgctcaggttcgttccagacatcgggctgttccagctcggcgtttacttcttcgaggcgttctttcttggcatcgtagtcaaagatacccccgaagaaacgtcgctgcgctcactgaggtcctgaatacggtttttgaccgggttgatttcaaacatggctttagcgtctttcttatgttcgatgggacaggaaatttaacgcataagtttacccgaaactggcggcagtttgtagcgctgagacagcgggctgatgccggggcggcgtgacgcgttgcatttgcttatcgggctgcgacgacaaccgctcgcacagcaggttaacgcagggaaaaaacaggctgacgcgcctctgccgtgaccggagacgcgcgcgccttatgaaaatcaaagcggccagatatggtcaatgatcagctgtaccgagcggttaccgcgatactcattgatatccagcttataggccagctcgacctgacgaatgctgctgtcgggccacagggtggtatcgacattaaaggcgatcccgtcgatcagcggaccgccgtccagcggttcgaccatcactttcagatgtcgctcgcccaccagccgctgttgcagcagcttaaatttgccgtcaaaagcgggttccgggaacgcctggccccagggccccgcttcgcgcagcatctcagcggtctgcagcgaaaactcctgcggctgcaacgcaccatctgaccagatgatgccctgcagagattcgccatccagccactcaccgaccagatcggcaaagcgctgacgaaactcctcgtagcgtgcggtttccagtgataagcctgccgccatggcatgaccgccaaacttcagcatcaggccgggattcagcgtatccagacgctccagcgcgtcgcgcagatgcagaccggcaattgagcggcctgagcctttcagcgtgccgtcgcccgccggagcaaaggcaatcaccggacgatggaaacgctctttcagacgggaggcgaggatccccaccaccccctgatgccattcgggatgataaaaggccagccccagcggtagatcgctctgctcacgctccagcgcctgacacagcgccagcgcttcgctctgcatgccctgctctatctctttgcgcgtctggttcagcgcgtccagctcactggctaacatccgtgcctgactgagatcctcagtcattaacagcgccacgcccaccgacatatcgtcgagccggcctgcggcattgagccgtggccccagcgcaaagccgagatcgctggccgccatctgacgcgcatcgcgattagcaatctccagcagcgcccggatgcctggccggcattttccggcccggatgcggctgagtccctgccacaccagaatgcggttgttgacgtcgagcggcaccacgtcggcaaccgtgccgagcgccaccagatccagcatctctgcaagattgggttcggtgcgggtggcaccaaaccagccctgggtgcgcagatgggcgcgcagcgccagcatcagatagaacgcaacgcccacgcccgccagtgcacgtgagggaaagttgcagtccggcagattgggattaacgatcgcctcagcggccggtaaggtctcgcccggcaggtggtggtcggtaatcagcaccggaatcccgtgctgatgggcacattcaacgccggcgtgggaggagatgccgttgtcgacggtcaggatcatcgccgcgccgcgcgcccgcgcctgctcaaccacttcagggctgaggccataaccatcttcaaagcggttaggcaccagatactgcacgttgccgccgcccatgctgcgcagcgccatgaccgtcagcgcggtactggtcgcgccatcggcatcaaagtcacccaccaccataatgcgacgcccatccagcagcgcctgatgcagcagttccactgcgctctcaatcccgcttaaggactggaacggcagcaggtttttcgccccgcgctccagctctgccgcgtcgcgcacgccgcgttgcagatagagtcgtttcagcagcggcggcagcgtcgccggaagcgcatcatcaaccgtcacctcacggcgacggagttccacatcctgttttaccaccgattaaccaccacgcttctgattgtccagcacctgcttcagctcctgcggcgactgataacctgggatcatcatgccgctgtcagtcagcatcgcgggcgtgccctgaatgccgaacagcacgccaagtttatagtgctgggcgatatcgattttgcagctgtctggtgcggccatcttcggcgcattgcctttcatcgcctcatcaaacgctttattgcggtcagcgctgcaccagatcgctttcatcgctggttcaatctgaccattcagcccttcacgcggaaacgccagatagcgcacggtgatgcccagcgcattgtagtccgccatctgctcgtgcagcttgtgacagtagccacaggtgatgtcggtaaagaccgtgatcacgtgctgctctttaggcgctttgtagacgatcatctccggcaccagcgcttcgacttttttgtccagtagctggttggtgacgttgaccggctgtttgccgctgacgtcatagagcgggccctggatcatatgtttgccgtcgtcggtcacgtagagcacgccgctttctgacagcacggttttaaaacccggcagcggtgacgggctgatctccgtctggttcagaccgagctttttaagtgattgctgaatggcgctgtcatcggcctgtgcgagaccggaaaaggcgctggctaaaagagccagcatggcaaaatgcttgttcatttttgtccttatcgccgcggtttcaggcccgcggatggtgttgttgatgcaactgacgcaggcgctcagtggcgacgtgcgtataaatttgggtggtggagagatcgctgtgtcccagcagcatctgtacgacacgcagatcggcaccgtggttcagcagatgggtcgcaaaggcatggcgcatcacatgcggtgataacttttcgctgtcgatccccgccagcgtggcgtaatgcttgatgcgatgccagaaggtctggcgcgtcatctgctgcgcccgattactgggaaacatcacgtccagcgtctgaccgttgagcagccacggacgaccatgttccatatattgctccagccagtaaaccgcttcttcacctaaaggcaccagccgctctttatcccctttaccgataacccggacaacgccctggcgcaggctgatgtcgctgagcgtcaggccaatcagttcggagacgcgcaggcccgtggcgtagagcagctccagcatcgctttgtcgcgcagctccagcgggatatcgatattcggcgcctgcaacagccgctcgacctgcgcctcactgagatctttcggtaaacgctgcggcagttttggtgctgacagcagcgcgctgggatcgtccgggcgcagcttttcgcggtaaagatactggaacaggcgacgcatggcgctgagcagccgcgctgagctggtcgccttgtagcctccctccagccgttcagccagaaactgctgcagatccagcggcgccacgctaagcagcgtcagctggtgatgcgccagccatccggtcagcgtctggagatcctggcgataagaggagagagtgttctgcgccagattgcgttcaatccagagcgcatcaagaaactgttctgtcagatcgctgtcctgcacgttatctccgccgtctggtgtaaaatcatgctcattatgcctgattcagcagcgcttctggtacaattgcgccaaagtcagtatttacagagtgttatctgcatgaaaatcggtcttttttacggttccagtacttgttacaccgaaatcgtagcggagaaaattcgcgattttattggcgaagagttagtgacgctgcataacgtgaaagatgacgacccgcgcctgatggagcagtacgacttgctgatcatgggcatcccgacctgggatttcggtgagttgcaggaggactgggaggcgatctggccgcagttgcccgcgctgaatctgcaaaacaagattgtcgcactgtatggcatgggcgatcagattggctatggcgagtggtttttagatgcgctcggcatgctgcacgagttgctgcagccgatgggggtacgttttgttggctactggccgcttgaaggctatgagttcaccagcccgaaaccgctgagtgccgatggctcgcagtttgtgggtctggcgcttgatgatgtgaatcagtttcgaggtcaccgatgagcgcgttgagcagtggtgcgagcaggtgttaaccgaaaccgccggactgctctgacggcccttctgccggtgtcgaaccctagcctgaacaggtgagcggctttaatcgctcttgcctgtcattattgaaccgcaatgcaggcagatgaacggcttcagacgctcttgcctgcactgcttccattaatgccgcgccgggctgaagcagcaggcgcgtaacgcccgccattcgccaggctgcatattgtcctgcatcagccaccagcgcagcgtggcaccctgttcgctcttcgccaccagcagcacgccaacgggtaaccagcgtaatggctgagttggccgccagcgttttccctgccagatccagcaatggacgctttcccgctgtaacgtaccgtgcggttgaatcaatcgccaaacgctgcgccagccctcagccagcaacagcagaataatcggcgctttaaccagccagccgcctgcaggcagcgtcatcagcaccacgccagtcacggctgctatcagccaggcgcagactaacccgcacgccagacgagagggccgcagcttacattgccaccgggccgcgagcatggttacgctgctggatcaggttcaccatccgcttaagctccggatcctttggctcaccgtgattcatcagccagttaaacagatcgggatcgtcactctttagcaaatccacaaagacctgcttatcggtgtcgctcagcgtctcatactcaaatttgaagaacggcataatagccacatccagttccagcatgccgcgacggcaggcccactgaatgcgtgatttatcattaatatccatgcatcaatttccacaattcacaacgtggcgcctagtgtaacctggtttaatgcggctcgcaggcgcagcgtcgcatgctgtgcaacctgccacatttcaggctggatcttttcagggttatcacgccttttgtgcgccgttttccgtaaacaggttgcattgccagtcggctcttttaacattgaagatattattccggatgaaccttcttatacaggatatctccatgcccacatttactttaccgccgcgccagcctgccgcgtcgtctcgtctgccgttaaccctgatgtcactggatagctgggcgctggtttccattaccggcgccgacagcacctcttacctgcaggggcagttaacgctggatgtcgccgcgctggatgccgaccaccattcgctcgccgcacactgcgatgctaaaggcaaaatgtggagcactatgcgcctgttccatcgcggtgaaggctatgcttatctgatccgtcgtgagctgcgcaacacccagctgcccgagttaaagaaatacgccgtgttttcgaaagtgtcgatggtggctgatgatgagtcagtattgctgggcgtggccggttttcaggcgcgcgccgcgctggcaaatctgtttgatagcctgcccgacagcgaaaaaccggtggtgcagcagggagaaaccacgctgctgtggtttgcccatccggccgaacgttttctgattgtcacttcgctggcccaggcagaagcgctgaagcagaagctcaatgacgatgcacagtttaatgacagtcagcagtggctggcgctggatattgaagcgggcattccggtgatcgatcccgccaccagcgtgcagtttattccgcaggccaccaacctgcaggcgctggatgctatcagctttaaaaaagggtgttatgccggtcaggagatggtggcacgggcgaaatatcgcggcgccaataaacgcgcgctctactggctggcgggtcaggcaagtcatctgcccgaagccaatgccccgctggagttgcagatgggtgaacgctggcgtcgaaccggcagcgtgctggctgcggtgcagttagatgacgggattagctggattcaggtcgtgatgaataacgatctggagccggacagcgtgctgcgggtggaaggcgatgaaggcggacatctgaccattcagccactgccctactcgctggatgaaagctgattgagcgtatggcccttccgctaagtgaagggccagtgccacaattcagaggctcacttcagcgcacataaaagtagatagcgcagaagtgacagagactgccgcccagcacgaacagatgccagatggcgtgattaaacggaatgcggcgcgccacatagaaaatcacccccagcgaatagataatcccgcctgcggcaagcagccagatgcagcccggcggcaggatcatcgccagctgataaaccacaatcagcgacagccaccccatacagagataggtcaccagcgacagcgctttaaagcgatgcgcaattgtgagcttgaacaggataccggccagcgccagcccccagatcaccgccattaatccatacgccagtggcgtcctcagcgcgaccagcagaaacggcgtataggttccggcaatcagcagatagatggcgcagtgatcaaactttttcagccagggtctggccgggccagccggaatggcgtgatagagcgtcgaagccagaaacagcaggatcatgctgccaccatagaggctgtaactgataaaagtgatggtgtcggcctgcctctccgttgcctgattgagcatcagcaccagtccgacgataccgaacaggcagccaagaccgtgactgatactgttggcaatttcctcggcgaacgaatagcccgcagcgtgttgatgtttgtgagagagtgtgggggtcataacagattcctgatcagctccatagcagtgatatcgttatccagcgtagccaacaattttttcagtgtacacttgtacgctaaaattatcttggtgaaattcactatcccttaaaccgggtgatgaatctggtaaactggccgccagtcaactgttcaatgagtcattcatgttttcgcatagcgatctcgcccgccttaacgatctggaaatgcaggtctatcagttcatcattaagcaccgcgaaggcgtcagctatatgacgatccgcgagctggctgagcaggctggcgtctccaccaccaccgtgctgcgtttctgtcgcaagatgggctgtgaaggctggtcggaattccgcatccgcctgcgcttaaacgaacagcagagtgcgccaatgctcaacacggcgggcgtcagtgaaatgctgagcttttttaagagcatcaataatccggagtttgaacagctcatcgctgaggccgcgcagaagattaatcaggctgagcgggtcttctttattggcgtcggcacctccggcagcctggcaaaatatggcgcacgctttttctctaacctcggtaaattcagccacgcgattgacgatccctattatccggtcagtcccgatctctatgaaaacgccattgccattattttatcggtctccggtgaaacggaagagatcctgcgcattgccagccagttcagcctgaataagtgtaaaatcattgcgataaccaacacggagagctgctcactggcgaagatcggtgatttcaacctctgctaccatgtgcccatcatccgtatggcggacaattccgacattacgactcaggtgccagtgacctatattattgaagcaatcggccgccagctggggaaataaaacagcctgttttttggatgtaacaaacgcaattattgccgcgctgttatatcgtgactttcattattgccttgctacactcagctcaatttcaatatccgtaatggggtgaagcatgagtgcagaattgcagttaccaaaaggctttctttggggcggagcggtggcagcgcatcaggttgaaggcggctgggatcagggcggcaaaggcgtcagcattgctgacgtgatgaccggcggttcacacggcgttgaccgggtgatcaccgacggcgtgcagccgggtcatttctacccgaaaccacaagggtgtggagttttactcccactacaaacaggatgtcgcgctgtttgccgagatgggcttcaaatgtttccgcacctcgattgcctggacccgtatcttccctaacggtgacgagcaacagcccaacgaagcaggcctgcaattctatgacgacctgtttgatgaactgctgaagtatggcattgaaccggtcatcaccctttcgcacttcgaaatgccttatcacctggtcaaagagtatggcggctggcacaaccgcaaagtggtcgacttctttgtgcgcttcagcgaagtggtgctgaaccgttataaaagcaaagtgaaatactggatgaccttcaatgagatcaacaaccagcgtaactggcagtatccgctgtttggttactgctgttcaggcgtgatctttaccgaacatgagaaacctgaacaggcgatgtatcaggtgatgcaccaccagtttgttgccagtgcaaaagtggtgaaactcggccacgacatcaatcctgactttcagattggctgcatgatcgccatggtgccggtctatcccttctcctgccacccggacgatgtggtgctggcgcaggaatcgatgcatcagcgctatgtgttcagtgacgtgcagatgcgcggctactatccggcctacaccctgaaagagtgggcgcgcaagggttacgacattcagatggaagcggatgatgccgagacgctgcgccagggctgtgcagactatgtcggtttcagctactacatgagcaacgcggtgaaaaccgatgccagcggcgttgacgatccgatcaccggctttgaaggtgtggtgaaaaacccgcatgtgaaagcgtccgactggggctggcagatcgatccggttggcctgcgctatgcgatgaacgagctgtatgagcgttaccagaagccgctgtttattgttgaaaacggctttggtgctatcgataagccaaatgccaatggcgtaattgaagatgattaccgcatcgactatctgcgtgcgcatattgaagagatgaagaaagccgtggcgtacgatggtgttgaattaatgggctatacgccgtggggctgcctcgattgcgtctcgtttaccaccggccagtacgacaaacgttacggttttattcatgtgaataaaaacgatgatggcagcggcaatttttctcgtgggaagaaaaagagtttcagctggtatcagcaggttatcgccagtaacggcgaaaacctgtaagtcatcacgccgcatcagcggcgaagtgagttaacgcccaccggcagcgtcaatgatgctgccggtgacgtaagaggccgcgtcgctggccagccagacgatcgcttccgccacctcttctgcttcaccgccgcgtcccatcgggatcacgctggcaagcctgtccactctgcctggctctccgccatcggcatgcatctctgtatagatgaatcccggacgtacgccgttgacccgaatcccctgctgcgccacttccagcgacaatcctctggtcagcgtgtccatcgccccttttgaagcggcgtaatcgacatattcgccaggcgcaccggtacgcgacgctgctgatgagacgttgacaatggagccgccctggccgccgtgatgcgtgcccatccgcttaaccgcctcacgacagcagagaaaagacccaatcacgttggtggcaaagaccttgtgcaggcgtgccgcatccagctgctcggtgcgacactgctgaaacaaaatcccggcgttgttcaccagcaacgccagcggtttcggactgctggtcgagctgcgcaaacatcgccatcacctgggcttcatcactgatatctgcctgaatagcaaaggcttcaccgccctgctgctggatctgcgccaccacctgttgagcttccgcttcgcgctgacggtagttcaccgcaacccgataacccccggcggccagtaacagcgctgtggcccgcccgataccgcggctgccccccgtaaccagtgccagtttcatgctgattctccagtataaagggccgacgaatcggccctttatggttaacgtttgcctgcggggaaattactgatagtcgctcatcggcacgcaggagcagaaaagattacggtcgccaaacacatcatccagacgttttaccgtcggccagtatttgttgtggctgcccgccgggaagactgcaagttcgcggctataaggatgtgaccactcactgacgatttccagctgagtatgcggcgcattaaccagtggattgtcatccagcggccattcacctgacgtcacccgatcaatctccatgcggatcgccagcatcgcgtcgataaagcgatccagttcgattttgctctccgattcggtcggctccaccatcagcgtacccgctaccgggaaggacatcgttggtgcgtggaatccataatcgatcaggcgcttagcaatatccagctcactgatgccggtctgctctttcagcggacggatgtcgagaatacattcgtgcgccacgcgaccgtcacggccggtgtagagcaccggataggccgactgcagccggcgggcaatgtagttggcattcagaatcgcgaccgaaactggcctgtttcagcccttccgcgcccatcatgcgaatgtacatccagctgattggcagaatggatgcactgccaaacggcgctgcggatacggcgccctgctgcgtcagtacaccgtcgatctgtaccacgctgtgccccggcacaaacggggccaggtgcgctttgacgccaatcggtcccatacccggaccaccgccgccgtgcggaatgcagaaggttttatgcagattcaggtgcgagacatccgcgccgatatagccaggcgtggtgatgccgacctgcgcattcatgttcgcgccatccagataaacctgaccgccatactgatgcacgatctggcacacttcgcgaatggtctcttcataaacgccgtgggttgacgggtaagtcaccatgatgcaggagagtttgtcgcccgcctgagccgctttttcacgcaggtcgccaaggtcgatgttgccctgtttatcgcaggccaccaccaccacgtccatgcccgccatctgggctgaggccgggttagtcccgtgcgccgagcttgggatcaggcagagatgacgatcgccctcgccacggctttcgtgataacgacggatcgccagcagtccggcatattccccctgcgcgccggagtttggctgcatacagagcgcatcatagccggtgagctgcaccagccactgcgaaagctggccgatcatctgcagatagccggaagcctgttcagccgggcagaatggatgcagctccgcaaattccggccaggtgatcgggatcatttctgccgctgcattgagcttcatggtgcaggagcccagcgggatcatcgcctgattcagcgccagatcctttttctccaggctgtgcatgtagcgcatcatctcggtttcgctgtgatgacggttgaacaccggatgggtcaggatctcgctgtggcgttgcaggccagcaggaatcgcgtggctttcgctggccacttcgctgtcgagcttttccaggtcctgaccgtgttcatcacccagcagaatggcaaacagcgccagaatatcttcgcggcaggtggtttcatccagcgtgatacccacggcgttatggatgtcgctacgcaggttaacgccaaagctcagggcgcggttcagcacagcggctttatccgccacctccaccgtcagcgtatcgaaccagtgctgatggcgcagcttcaggccgccctgttgcagcccagccgccagaatgttggtgaagcgatgaatgcgtgaggcaatgcgtttcaggcccgccgggccgtggaacaccgcatagagaccggcgatgtttgccagcagcacctgcgacgtacagatgttggagttggccttttcacggcggatatgttgttcacgggtctgcatcgccatacgcagcgccgtgttgcccgctgcatcacgtgaaacaccaatgatacggcctggcatagagcgtttatgctcgtcgcggctggcgaagaatgccgcgtgagggccgccgtagcccattggcacgccgaagcgctgagctgaaccaaagacaatatctgcaccctgtttgcctggcgcttccagtaacaccagcgacataaagtccgccgccacgctgaccaccactttgcgggctttcagtccggcaatcagcgcgctgtaatcgtgcgcttcgccggtagtgcccacctgttgcagcagcacaccaaacaggtcgtcatgatcgggtgctttgtccgcgctatcaataatcagttcgaaaccgaacgtctccgcacgggtgcggaccacatccagcgtctgtggatggatatcatcggcaatgaagaatttattggcatttttgagcttactgacgcgttttgccatcgccatcgcttcagcggcagcggttgcttcgtccagcagtgaggcggacgcgatatccatgccggtaagatccagcgtcagctgctggaagttcagcagcgcttccagacggccctgggagacctcgggctgatacggagtataggcggtgtaccagcccggattctccagcatattacgcaggatgaccggcggggtgatcaccgcgctgtatcccataccgatccaggatttgtaacgcagattctggctggcaatcgctttcagttcggccagagcctgctgttcagtggcggcttcgccaaccgctggcgggcctggcagctgaatgtctgccggcacaatcgtgctgattaacgcttccagcgaacgggcaccaatagcgtcaagcatctgcgcctgctgctcaggtgaaggaccgatatggcgctcaatgaatgcaccgttgtgttcaagctggctgagagtctgagtcattagcagtaaatcctgaatcgggctgggggaaccggagagcaaacataaatctgcggcctctgtgtgaggccgcctgacgactactcgtcgatggaggctttgtaagcatccgcatccagcagcgtgtcgatttcagacgcgtcactggctttgattttgaataaccagccgccttcataaggctcgctgttgacctgctccggtgagtcagtcagtgcttcgttgaccgccacaatctcaccgctgatcggcgcatagatatctgaagccgctttaacggattccgcgaccgcgcactcttcaccggcggcaaacgtcgcgcccacttccggcagatcgacaaacaccatgtcgcccagtagctcctgcgcgtgttcagtgatacccacggtgtagctgccatcttcttctttgcgcacccactcgtggctgtcgcggtacttcaacgtattcggcacattgctcattggccatttctcctgaataaaatttactgagcgaccggtttaccggcgcggacaaaaacgggacgggtaacctggaccggcatctggcggttacggatctcaacgatggcggtgctgccgactgaggccggtacgcgcgccagggcgatgctgcaacccagcgtcggtgagaaagagccactggtgatgatcccctcctgcggctgcccctggtcatcggtgaaacgcaccggcaagccgttacgcagcacccctttttctgtgaggatcagccccaccagcttttcggtaccgcgttcacgctgcagttccagcgcttcccggccgatgaaatcgcggtcagcaggttcccagcagaccgtccagcccatgttggcagccagcggtgaaacgccttcatccatctcctgaccatacagattcatacccgcttccagacgcagcgtgtcacgtgcacccagtccagcaggtttaacgccagcagccagcagacgctgccagaaatcggccgcctcctctgcgggcatagcaatctcatatcccgcttcgccggtatagccggtggtggcgataaacaggtcacctgactgcacgccgaaaaatggcttcatgccggcaacagcctgacgctgctcctcgctgaacagcgtctgtgccttctgctgcgcctgcggaccctgcacggcaatcagcgccaggtcgtcgcgttccgtcagcgtaatgccatagccctgcgcgtgttgcgtgatccaggcgagatcgttttcacgggtggcagagttcaccaccagccggaagaactcttcgctcataaagtaaacaatcaaatcgtcaatgacgccacccgaggcattcagcatcccggtgtagagcgctttgcctggctgggtcagttttgccacatcatttgccagcaggtagcgcaggaattcacgggtacgcgggcctgtcaggtcgacgatggtcatgtgagagacatcaaacataccggcgtcggtgcgcactacatgatgttcatccatctgggagccatagtgcagcggcatcatccagccatgaaaatccaccatgcgggcaccgcaggcctgatgctgttcaaacagaggtgtttgctgagtcataaccatcctgtgcagaagcgagtgagtgcaaaagtgcgccggaattcagtgccgacgcaaacgttctcttatggctgacgttaccaccgaatctgacgattaaccataagcaaaccggggtcgaaagcagaggcacagcctaaccaggaacggctgccaacaggatataaaactgcaattttgtgattaatcgcgcaataaatgcagggaatttaaatatacgcagcaaatttatgcgggatggcattcaggatgttaaaaaaatcccgcgcccagcggacagaagaatgagaaaaagtaatgcgaattagcccgcaaaattagaataaatcaaacgaagacctgtgctggtgcagcgttgcctttttgtggtgcagagcggtgtcaggcataaaaaaagccagcagaagctggcttatcagaagggcggatttagcgtagccaggcgggcagatcattcaggcccatcgcctgcttcagcatcatgggtttgacacccggcagacggtcagccagtttcagacccacgtcgcgcagcaattttttcgccgggttattgcctgcgaacatctcacggaagccctgcattcccgccagcatcattgcggcgctgtgcttacggctgcgctcatagcgtcgcagatagaggtgctgaccaatatctttgccctgctgatgcagacggcgaatctcaccgatcagctcggcggcatccataaacccaaggttaacgccctgacccgccagcggatgaatggtgtgagccgcatcgcccaccagcgccagacggtgtgccgcgaagttgcgggcatagcgcgccaccagcggaaacgatttgcgctcgctttccagctggcacaggccgagccgcatatcaaacgccaccgagagctgctgattgaacagcgcttccggcatggtttccagacggctcgcttcctgcggcgagagcgaccagacgatggaactgagatgcggatcctgcatcggcaggaaagccagaatgccgtcgccgtggaacacctggcgcgctactgcgtcgtgcggcttctcagtacggacattagccactaacgcatggtgatcgtaatcccagaaggtcagcgggatatcggctttgttgcgtagccaggagttagcaccgtcagcggcaatcattaatcgcgcacttaacatgctgccatcctgcagggtaacgaaggcttcgttatcaccaaacgcgacctgctgtaactgcgagggtgccattatcgtcacgtcgctgcaggcgctggcacgttgccagagcgcattgtggatcaccgggttttcaataatatggcccagatgcgacaggccctgatgctcatcatcaaaggcgatggagccgaaactgtccttatcccacacttccatgccgtgataagcgctggcgcgcagcgagagaatggtcgaccagacatccagcttctgcagcagccgtttcgctggcggcattgattgccgacacgcgaactgacggtgacgcactcagcgccagcggtggctccggtgatttttccagtacggcgatgcgcagtccgctaccctgcaagccgcaggccaccgccagtcccaccataccgccaccggcaatcaccacatcaaaagtttgcatctgagcctctttattaacgcttaacccagccaagcgtgcgctcagccagttgatttcttaaccacggtagatgatccatcgccagcaggcccaggttacgtcctgccaccagcgggccatagcgattcgcaaagacgcgaaccagtccgtcggtgataccgatggtggcggcgcggtcgggctgacgacgctgctggtaatgatgcagcaccgcatagctgccggggtcctgctgctgccgatgggcggctgccagcgtttcagccagtgacatcacatcgcgcaggcccaggttgaagccctgcccggcaatcggatgcagcgtctgcgccgcattgcccaccaccgccacgcgatgcgtcactggcgacatcgcccggtgcagcgccagcgggtaatactcacgctggccggtgtgggtgaatttacccagccgccagccaaaggcacgctgcagctggctgaggaattcggcctcgctccactgctcaatgcgttcacgctgcgaaaccggatgacaccagaccagcgacaggcgattgccggacatcggcaacagcgccagcgggccatgttcggtaaaacgttcaaatgcccggccctgatggggcagcgcggtggaaacattggcaatcacggcaagctgttgatagtcgtctctttgccactgaatgccgcacgaagccgccagcgcagagcgcgtgccatccgccgccaccagcagtttgccgctgagttgttcgccactgtccagcgtcacctcaacctgctgctcacggcggttagcctgggtaacacgagccggacagcgcagcgttacgccgggtgcttttttcagctcagcaaacagacgctgaccgacgtcaaacagctcgacaacctgtcccagcgccggaatagcgtagtcagccgccgccagcgacacaaaaccggcgtgaccgcgatcggagacatgaatgtcggtaatcggcgtggcacaacgggcgatgtgctgccacagattgatgtccgcaagctgctggcaggtaccggcagagagcgcaatagcgcggccatcgaaaccgggatgcgcccggctgccgggctcgctgctttcaatcagcgttaccggcagtgtgccctgggtcagatgggagatcgccagcgccagcgtcgccccggtcatgccgccaccggcaatcagaatcgtcatgcctgttttgccgccgccatcaatgcttcaatctcatccgcctctttcacgacgctgtcggtgagattttcaatgccatcttcagtgatcacaatgtcatcttcgattcggataccaatgccgcgatactgcgcgggcacgtcggcatccggtgcgatataaagacccggctcgacggttaacaccatgccgggctccagtacgcggtcgcggctcggggtgccgtagtggccgacatcatgcacatccagtcccagccagtggcccaggccatgcatatagaactgacgatggacttcctcggcgatcaatgtatcgacgtcgccctccaggatgcccagctccaccagcccggtgaccatgatacgcaccacttcatcattcacttcacgaatgctgatgcccggccggaacagttcaagcgagcggttgaggcaagccagcacgatgtcataaatcgcgcgctgcgccgggctgaatttgccgttaaccgggaaggtgcgggtgatatcgcctgcatagccgtggaactcacagcctgcatcgatcagcaccagatcgccgtcgcgcatttcgctttcgttttcggtgtagtgcagaatgcagccgttaactccggcacccacaatggtgttataggagggaaaacgcgcgccgtgacggttaaattcgtgctgaatttccccttcgagctgatactcgaacaggcctggccggcaggtttgcatggcgcgggtatgcgccagtgcactgattttcccggcgcgacgtaacagttcaatctcatccgcatctttaaacaggcgcatctcatgcacccagggacgccagtcagtgagggtatcgggcgcactgagatgctggcggaagccgcgacgcagcttatccagcgcgctgaacaccagtgtgtccgcgtgggcatattcgccctgcgcatggtaaaccacatccaggccattcagcagcaggtgcagctggtcaccaatatcattccagggtaaagcgcgatcgacgcccagtttgtcgggtgcggcctcctgacccagacgacggccagaccaggtttccgccgcaggatcgcgcacgcgattaaacaacacgctgtggttatgattctcatcgcttttgatcagcaccagcaacgcctgcggctcgttaaaaccggtgaaataccagaagtcgctgctctggcggaacggatattcggtgtcattactgcgcatcacttctggcgcagcaaagattaacgctgcgctgccaggcaccatcttcgccagcagcgcctgacgacgctgcaggaatcgttccagtgaaatcatctctgcactccctgtaaactgaccggttaaactcgttgacctgaaattagtgtagcgtcggtttttgcacttctggcgcggttggctgcgggcgggtgaacgtatcgtggcacagcagcgcggcgacacgaaacgtactcaatcacctcctccagcgactgctccagctcctcctggtcttcatcttcttcgtaaccgagctgtgcgatagtgcgcagatcatcgatcgcttcgccggtttcgccggtgactttatccagtttaggctgtgttacgcccaagccgagcagaaaatggttaacccagcccgccagcgcgtcggcacggtcaaatacagtgatgtcgtcgtcagcaggcagcagcagctgaaacaggaagccttcatcttccagcgtggtcgccgtatgctcgtgtagttccgccagtggcacggcaagagtgtgtgaaaacgccatgccttcgttagccagatcgtgtaccagcgtcttccagctggtgtcctggttaccaccgcagaggatcccgctcagcaggccatgcatttccgcgggcgtcattccaacgccctgctgtgagagcaccgccgcgagcgcgttgtaatcgggggttgcgttctgtaaggacataagttttcatcgtcgttggcagaataagttcgtgttatgctaccactagctgcctcaaggtttccagaaaaggggttgtatcttatttcgtgggtctatatagttgcccgcctcccaagccattgactgctaagggagttgcgagcgaagtaatcagtcaggaaggtggcatgtctgcacaaccggtagatttacaaatttttggtcgttcgttgagagtaaattgtccgccagagcagcaagatgcgctcaatagcgcggctgaagatctcaatcaacggttgcaagatctaaaagttcgcactagagtcaccaatacagaacaactggtgttcatcgccgcgttaaacgtctgccacgagctagcgcaagagaaagtgaaaacgcgcgattatgctgctaatatggaacagcgtatccgtatgttgcagcagacgattgaacaggcattagttgagcagggtcgcatctctgagcgtgagggtgcgaagttcgaataaaacttcatggttgctatacttaagtaacggtgaggtaaattttctctgagatgtttgcatgtgggccagtcccctgagccgatatttcgaaaaaacagaatgtgacgctcgtaacctgtgtgcatgctcggttcgtccgagaagcctgatggttatgacggcatgttcaccttgaaccaagggttcaagggttacagcctacggcggcatctcggagatctctcttcctgtagtcctgcttttttcccctgactgacatgttatagtcgctcaacagcgacttatccggcggggaaatcatgtctgaaccttccatgtctgaaccttcaatgacccagcgtcaggcgattcgccagcatgtgcgacatctgcgacgggcacttaccgatgagcagcaaacgcaggccgctgagcagctcgccgaacacgcgctcaactacgccccggtgactgaagcgcgcaatatcgccctgtttctgtcggtggatggcgaactcaatacccgtccgctgattgcccgcctctggcatctgaagaaaacggtctgtctgccggttttacaccccttctctcccggtaatttgttgtttctgcgctactcgcccgataccccattgctcaaaaataagctgcgcattcctgaaccgccgctggatatccggcaggtgatcacccttgatcaactggatctgatgatggtgccactggtagcgtttgatcagcatggacagcgtctggggatgggcggcggcttctacgatcgcaccctgcagaactggcggcaccacggttttttgccggtgggcctggcacacgattgtcagcaggtcgatagcctgccggtggcagaatgggatgtgcctttgccggcggtaatgacgccatcaaaactctggcagtgggagtagaagagtcgcttttgcagacaagtgaaaacccatacctgggcgcatctggcagcaatgaaatagcttaacgcgcagggaacatggtcagaagaggaaagcgtcccgccgcccggataaaaacgctgggagcgtttttaaacaacgcaacgcgttggcccggttacgggcgcacctcagggatgaggtgcgtaatcgcgcgggccgggcatgccatggatggcggcttttgcatctttccgatctgaccgtgttcccttcgcagtctcggtcttacagcaaatcgggacagcctgtattaactacctgaagagacgcgactaagcgcccgttcaggttggtagcgcttagtaaagcagacgggcgcgaatggtacccggaatcgccttcatcagttgcagcgcgttctcagccacttccggctctgcatcaatgtcgatcaccacatagcccataaacggcgaggtttgcagatactgggcggcgatgttgatgccctgctcggcaaaaatctggttgatggccgtcagcacgccagggcggttctcatggatatgcagcagacgactggcgctgataccgtgaatcggtagtgacacttcggggaagttaacagccgagagagtcgagccgttatcggagtatttcgccagcttgcccgccacttcaatgccgatgttctcctgcgcttcttccgtcgagccgccaatgtgcggcgtcaggatcacgttgtcgaactcactcagtggagagataaacggctcgctgttggtagctggctcgctcgggaagacgtcgatggctgcgccacccacatgcttgctggccagcgcatcgcacagcgccgggatatccaccaccgtgccgcgtgaggcgttaatcagcagcgcgccaggcttcatctgcgccagctgctctgcaccaatcatatcctgtgtagagacggtttccggcacgtgcaggctgacaacgtcgctcatgttgaggagatcggccagatggcgtacctgcgtggcattacccagcggcagcttgttttcaatgtcgtagaagaaaacatgcatacccaggctttctgccagcacgcccagctgcattccgatgtggccgtaaccgataatacccagttttttgccacgcgcttcaaatgagcctttggcaatcttattccagatgccacggtgtgctttcgcattcgcttccgggatgccacgcagcatcagcagcatctcaccaatcaccagctccgcaaccgagcgggtatttgagaacggcgcattgaacacgggaataccccggctggcagccgcctgcagatcaacctggttggtgccgatacagaaacagccaacggcgaccagcttttcagccgccgcaaaaatctcttcagtgagctgggagcgggaacggataccaataaagtgtgcatcacggatcgatgcttttaacgcgtcggaatccagtgcgcccttatggaattcgatgttggtatagcctgcagcccgcaggtttctccagcgcgctctgatggacaccttccaccagcaggaacttaatcttatctttttccagtgatacctttgccatttcccgatcctattcagcattcaatgaggactaccataagccagccttctgtcaaaatatcaaaaaaatcgcgtcgggcaatacaaacgattgcccagccgccagcacggcagcggctgacggcagcacattgccggacaaaataaggaggtcggactggaagagagaacgaacccactgccgatgacggttatgtgacataagtcaccaaatttcaccgcagcgagaaaagatgatttgcaggcagaaataaccgacgccgcatcgacgccggacagatcattttttgatggttttcacgccatcaggcccgccaatcagtgcaatatcggcaccacgcgcggcaaaaaggcccacggtaacgacgccaggcaaggcgttgatggttttttccagctcaatgggatcgagaatgcgcagattatgcacatcgagaataatgttgccgttatcggtgaccacgttctgacgatactcaggcaaaccgcccattttcaccagctgacgcgccacataactgcgcgccatcgggatcacctcgaccggcagcgggaaacggcccagcacatcgacctcttttgaagcgtcagcgatacagataaaggtttcagccacggcggccacgatcttttcgcgcgtcagcgccgcgccgccgcctttgatcatctgcatctgtgggttgatctcatccgcgccatctacgtacaccgacagcaggtcaatctcgttcaggtcgaacacctgaatacccaggctcttcagcttctgggttgaggcatccgagctggagacggcaccttcaatctgatgcctgaccgtggcaagcgcatcgataaagtgggcagcggtggatccggtgcccacaccaacaacggtgcccggctgcacgtactcaagtgcagcccagccaacggcttttttcagttcatcctgggtcatggtatgtttaaaacctgtgcgacaacgaagtgcgcgtagtataaaacaaggcttgctgaaaatgctcggctgaccgacgtggatttatcgctttggaagccagcccacaaaaaacaagagagccatcacaggtgatacttttgtggcatagtgacatccatcctgaaggagagagaagaataatgaaacgcccggattatcgaacgcttcaggcgctggattcagtgatccgcgaacgcggatttgagcgtgccgctcaaaaattatgtatcacccagtcagcggtttcacagcgtatcaagcagctggagaatctgtttggtcagccgctgctggtgcgaaccgtgccaccacgtccgaccgaaacagggtcagaaactgctggcgttgctgcaccaggtggaactgctggaagaggagtggctgggcgatgagaacagtggcaccacgccactgctgctgtcgctggcggtcaatgccgacagtctggcgacctggctgctgcctgcgctgaaagatgtgctggcagattcccctgtacgcctgaatctgcaggtcgaagatgaaacccgcacccaggagcgtctgcgtcgtggtgaagtggtgggtgcggtgagtattcagccgcagccgctgcccagttgcctggtggatcagctcggtgcgctcgactacctgtttgtggcgtcgcgtgactttgccgatcgcttcttccccaacggcgtcacccgctctgccctgctgaaagcgcctgcggtggcgtttgaccatcttgatgatatgcatcaggccttcctgcaacagaactttgatctctcaccgggcagtgtgccctgccacatcgtgaactcctctgaagcctttgtgcagatggcgcgacagggttcgacctgctgtatgatcccgcatctgcagattgagcgtgagctggcgagcggtgagttaatagatctgacgccaggcttgtgtcagcgccggatgctctactggcatcgttttgcgccggaaagccggttaatgcgtcgggtgaccgatgcgctgattgcgcatggacatcgggtgctgcgtcaggatgacgtcgcagcctgaaaacaaaaacggggcgaaagccccgttttgactgctgacaaattatgccccgaacggctgtaaggatggattggctcagggaacaaggtcagatcggaaaggcgcttaagccaatccctggccgctcggcccgcgccgtccatggcgcgggacgctttcctcctctgaccatgttcccttcgctttgaatttattcattgcggtcaaatcctgagattcatcggcagtcttaacggggcatcagccccgttttgcactatggcgtattgggcttgatctcaaacaccacatcaacctgatcgtcaaagttaatgctctgctgatcgtaggtctcctgcgccgaggtatctgccgctgcagccgctttatacatacggttcatcggcatcggctgatagttagcgacctgataacgaatgctgtagatcgatcccagtttcgcgttaaagccttcagccagctgtgatgcctgctgcgtcgcatttttaatcgctgctttacgcgcctgctctttgtaactctccggatttgccacgcctaactcgacgctacgcacctcattcagaccggacttcagcgccccgtccagcagatcattcagcttgtccagctgacgcagggttacctgcacctgacgcaccgcacggtagcctttcaggacggatttaccctctttggtgtaatcgtactcaggctgggtgctcaggtttgccgcatcaatatctttcttctcaatgccgtttttctgcagaaaatcgaaatattgtgcaacccggctatccgcctgctttttcgcatctgcggcatcttttgacgacacgttcaccacgatagagagcgtggcgatatcgggacgggcatcgaccgttgccttgcctgaggtcaccacgtgtggcccgttcggtaactcatcagcgtgtacgccaggcaatgccccggcgctcatgattgcggccagagccaatgctttcagtttcatgaaagtcctccttgaaaaggtactatgacggcttccaaccggcgaagcccaacagcgcatcggtatgcgccatgctttgagtggtcattatggcaaaagttcggcctccgcgcggcaataaccgcatcggatcgatgttgggatcaaaatccggcaatgccctggcgcgccagttgcagggagataaaccacatcaccgcgcccaccagcaggttgatgatgcgctgggctttggcggtgcgcaggcgtggtgacagccaggcggccagcagcgccagaccaaagaaccacaggatcgacgcactaatggtgcccagcgcaaaccactgacgcgcggtggtggtcggcaactgaccgccaagactgcccagcaccacaaaggtatcgagatagacgtgcggattgagccaggtcactgccagcagcgtcgcgataatgcgtcccctgctctgctttaatggctcaccatccgccagatcggcgtcgccgcgaaaagcgctacgcagtgcgccccagccataccacaacagaaaggctacgcccgcccaggtgatcaccatcagcagcagtggagactggctcagcaaggcgctgccgccaaagatcccaccgcaaatcagcagaatatcgctcagcgagcagagggccgccgtcatcagatgatattgacgctttacgccctgattcatcacaaaagcgttctgcgggcccagcggcaggatcagcgcggcgcccagggcaagcccctgaaaatagagagataacacaggattatttcctcacatcgttagaggaggagaagtataaagagagaggatgattagcggaaattgaaagaattaatctgcgattagcaaaatgaatgggcgacagacgccgcccactgaaaaattactgtggctgaacctgggttgcttctgcttcaggcgtcggcttctgatgcagatgcacatccatctgcggataaggaataccaatcccttttccatccagcgcacgcttaaagttcttcagcagatcccagtaaacgtcctgcaggtcgccgctgttgctccagcaacgcaccacaaagttcatagaggaggctgccagttcgttaagaccgatctggatacctttatctttcagcacgcggctatccgcttcaacaacctgttgcagtaaggcgatcacttcatccacatccgcctcgtaagccacgccaatgataaattcattacggcgaaccggttcacgcgagaagttgacgatgttcccgctgatgatcttgccgtttggcaccaccacgattttgccgtctgccgtttctcagcgtggtggagaaaatctgcacatgcagcacggttcccataacgccgcccagatcgacgaactcgccggtgcgaaacggacggaaggtgaccagcagaacacctgcagcaaggttagagagtgacccctgcagcgccagacccacggccagacccgcagcacccagcacggcaatcaccgaggcggtctgcacaccgatgcgtcccagcgctgcgataacggtgaaggcgataaccccatagcgcaccaatgcggagaggaagtccgccacggtagcgtctatgtgacgggcgcgcagcaggcgatttacggcattagaaatgatacgggcgataatcatcccgataataatgatggcaatagctgcaacgatatttacggcatagctgatgatcagcgcctgattgcgaaccagccagttacctgcgttgtttaagccgtcgacgacgtgtaactcttccattaataagccctgttgttagattcccaccgggaatgaaaaaactgccagatgacatccgacaccctgccatcaagggtaatcaattatccccttaagcgccaaaccgaccggcgtttaaccctgtttttccagaaattgtgcataaaaaaaggccctttcgggccttttttgtacggtaacgactcttcagttacagcacgtcgacagcgttaagctctttgaaagcctgctccagacgcactaccatagaggcctgggctgaacgcagccagacgcgtgggtcgtagtattttttgtttggcttgtcagcgccttccgggttacccagctgcgactgcagatagccctcgttctttttgtagtactgcaggatgccgtcccaggttgcccattgggtatcggtatcgatgttcatcttgatcacgccgtagctgatagactcttcgatttctgcagcagaagaacctgaaccgccgtggaaaacgaagtccagcgcgttgtgcggcaggccatgtttttcacacacatatttctgcgaatcgcgcagaatggtcggagtcagtttcacgttacctggcttgtaaacgccgtgaaacgttaccgaatgatgccgcaatagtgaagcgcgggctgatagcattcagtttttcgtacgcgtagttcacatcttctggctgggtgtacagtgcagatgcgtccatgtggctgttatcaacgccatcttcttcaccaccggtgcagcccagttcgatttccagcgtcatgtcgagtttcgccatgcgcgccagatatttgctgctgatctcgatgttctcttccagtgactcttctgacaggtcgatcatgtgagaagagaagagtggcttaccgtttttctggaagtactcttcacctgcgtccagcagaccgtcgatccatggcagcagtttcttggcacagtggtcagtgtgcaggataaccggcacgccatactgctcagccatcaggtgaacatggtgtgcacccgcgatagcgccgaaaattgccgcgccctgtggtttgtcagtcttgaagcctttacccgcgataaatgcagcaccgccgttagagaactggatgatgattggcgctttaactttcgccgctgcttccagtgccgcattgatggagtcggtgccgacgcagtttacggctggcagtgcgaatttgttctctttcgcaactttgaagatcttctgtacgtcatcaccagtgacaacgccgggttttacgaaatcaaaaattttagacatgattgtgtcctgtttcgtgaccgttgttccccttgaggaacgtcgatttaaacgcccagacgggcaagacttcaggcgatgccgccaggcatcgcccccaaaggattactgcttcgcacgctcttccagcatggcaactgcaggcagttttttgccttccacgaactcaaggaacgcgccgccgccggtagagatgtaggaaattttgtcttcgatgccgaacaggtcgatagccgctaaggtatcgccgccgcctgcaacagagaaggcatcgctgtctgcaatggcgttagccacgatctcggtgcctttacggaaattagggaactcaaacacgcctaccgggccattccacaggatggttttggcatccttcaggatggcagccatcgcctgtgcggtttcatcaccaaagtccataatctcttcgttatccgcaacttccgaaacctttttcacggtagcggtagcagtttcagagaattctgtgccaacgcgtgaatcagttggaaccggaataccgtgctgatcgcgcaggcctttagccgcttcaacgaagtctggctcatacagggatttgccgacgttgttgtcgatagcgacgaaggtgttggcaatgccgccgcccacaatcacggtgtccgcgattttgaccagagattgcagcacatcaaatttggtagagactttagaaccccctaccacagccaccagcggacgctccgggttgctcatgactttacccagcgcttccagtttctgcagagagcagcgggccagcacaggcgataggggcaaatttaccgacgccgtgggtagaagcctgtgcgcggtgcgcggtaccaaaggcgtccatcacaaagacgtcgcacagagcagcatattttttagacagtgcttcgtcatctttcttttcgcctttgttaaagcgaacgttttccagcacaaccagttcgccagcgccgacttcaacgccatcgaggtaatcttttgccagggtcacggtggtgccgctaagcttgtctttcaggtagttaactaccggcagcagcgagaactcttcattgtattcaccttcggtcggacgacccaggtgagaggtaaccattactttcgcgccctgtttcaacgccgcttcaatggttggcagagaagcacggatacgtgcatcagacgtcactttaccttctttaaccggtacgttcagatcggcacggatcagaacgcgtttaccagccagatccagatcggtcatcttaattacagacatggtgaatcctctcgttgattctcataagttttgccagacgcataccgcgtcttacctgaaaccgcttgcggccatcgctaacgtcgtgtcgagcattcggttagcaaagccccattcgttgtcacaccagaccagggtcttgataaggtgttgaccgctgacccgcgtttgtgttccgtccacaatggcactgtgcggatcatggttaaaatctactgagactaacggtaattccgtatagtcaactataccacgaaatgtcccttctgccgcgcttcgcaacagggtgttaacttcacacgccgtcaccgcctgatgcacagaaacgctgagatcaatggccgtcacgttaatcgtcggaacgcgaacggctatcgcctcgaagcgatcgttgaatttcggaaaaatacgggtaatgcctgccgccaggcgagtgtccaccgggatgatcgactgactggctgcacgcgtacggcgcagatcgctgtgataggcgtcgatcacctgctgatcgtgcatcgccgagtggatcgtggtgacggtgccggattcgataccaaacgcatcatccagcagtttaatcaccgggataatgcagttagtggtacaggaagcgttggagacgatgcggtcactggcggtgagtaactgctggttaacgccatacaccactgtggcgtcgagatcgtttccgccgggatgagagaacagcacttttttggcgccagcctgaagatgcgcttcgccatcagcgcgtgagccatagacgccggtgcagtccagcaccacatccacgtcgagttcacgccacggcagatcggcaatggctgcacggtgcaaaatgcgcagggtatcgccacccacccacattacatcgcgctcctggcggacatcgaaagcaaaacggccatggctggtatcgtatttcagcagatgcgccataccggtagcttctgccagctcgttaatcgcgaccacggtgatctctgcacgtcggcccgtttcatacagcgcgcgcaggacgttgcgtccaatccggccaaaaccatttatcgctacccgtaccgtcatttctctcctgccacgtcagactgaaaaaaacgtgccgttagcctgagcgtttcactgcattttgtacaggagattcttacccggcattgtccgaaaccagggcgatttgcctggcgactgaaacggttcagctacaataatagaaggaaggaataacaggaatgattgtgatcaatctgactgcttaaatttggatctgcgtcacaaattaaggcaaaaggcggttattactgcaggaataaaaaaataaaagggacgaaaatctcgtccctctgtttttacagccgggcggaaacaggcccgcctgaccggttttacgccagcagcgctttcgctttcgcgacgacgttgtcgacggtaaagccaaacagttcgaacagctgatcggcaggtgcagattcgccgaagctggtcatgcccacgatagcgccgttcaggccggtgtatttgaaccagtaatcagcgatgcccgcttcgattgcgacgcgtgcgctgaccgcttttggcagtacggattcacggtactcatcactctgcttgtcgaaggcatccgttgatggcatagagaccacgcgcactttgcggccttcgctggtgagtttgtcccaggcaccgacagccagttcaacttcggaaccggtggcgatcaggatcagctcaggcgtgccatcgcaatctttcagcacgtaaccgccgcgcgctacgttagccagctgagcagtgtcacgctcctgctgcgccaggttctgacgggagaagatcagcgcagtcgggccatctttacgctcaatggcatatttccacgccaccgcggattcaacctggtcacatggacgccacaggctcatgtttggcgtggtgcgcaggctcgccatctgttcaaccggctggtgcgtcgggccatcttcgcccagaccgatagagtcgtgggtgtagaccatgatctgacggatcttcatcagtgccgccatacgcgctgcgttacgcgcatattcaacaaacatcaggaaggtcgcggtgtaaggcaggaagccgccgtgcagcgccaggccattggcgattgcggtcataccgaactcacgcacgccgtagtggatgtagttacccgcagcatcttcgttgatcggcttagagccagaccagattgtcaggttgctgggtgccagatcggctgagccgcccaggtattccggcagaattttaccgaaagcttcaatagcattctgtgaggctttacggctggcgatcttcgccgggttcgcctgcagctgctcaacgaacttctgcgactcttcctgccagttagctggcagtttcgttgctgacgcggcgtttaaactcggcagccagttcaggatgagcctgtgcgtaagcggcgaatttctcattccatgcagactctttcgcctggcccgcttctttcgcgtcccactcagcgtagatatcagaaggaataacgaacggcgcgtggttccagcccagctgcttgcgggtcagtgccacttcatcatcacccagcggtgcgccgtgtgaatcatgggtaccggctttgttcggtgaaccaaaaccgataacggttttgcacatcagcagtgaaggcttgtcgctgacgcttttcgcttcttcgatcgctttcgcaatcgcatccgcatcgtgaccatcgacgccgcgcaccacgtgccagccataagcttcaaagcgcttagcggtgtcgtcggtgaaccagccatcaatgtgaccatcgatagagataccgttgtcatcataaaacgccaccagtttgcccagcttcagcgtaccggccagtgagcagacttcgtgcgagataccttccatcatgcagccatcacccatgaagacataggtgttgtggtctacgatgtcatgacccggacggttgaactgtgctgccagcgtgcgctcagcaatggcaaaacctactgcgttagcgatgccctgccccagcggaccggtagtggtttcaacgcccacggtgtagccatattccgggtgacctggagtttttgagtgcagctgacggaagttttccagttcgctcaggggcagatcgtagccggtcaggtgcaacaggctatagatcagcattgagccgtgaccgttagagagcacgaaacggtcgcggtcagcccacagcgggttggttgggttgtggttcaggtagccgcgccagagtacttcagcgatgtccgccatgcccattggggcacccggatgtcccgatttcgctttctgtactgcatccatacttaacgcacgaatggcgttggcaagctctttacgagagggcattttctactccaggtcggattaatgcttcgcaccttaacttattgttattaatgagttaccgggcaaaacaaggaaaaagttgcccatcaatgtacatgagaaacggggcaaaagtacatgctgtaaaacgctaaatgcagccgcttcgtatggcttttccagccatatctgctagcaaagtgcagactggcacgctataaccaaatcgtttattcacctgtctgagtttcaggtgtttgtttttcttaccttgttatgaatgggatacagcatgaaaatcaaaaaaatggtgttagcgcttggactgaccacgctgctcagtggctgtcagggtttagacaacaatgcgctgatgcagtcgggcgcgcaggcgtatcaggcttataccctcagcgacgatcaggtaaagcagctgagcgataaatcctgtgagcagatggacaaagataatcagattgcgcctgctaacagtgattatcagcagcgtctgaacaagatcgcggcggcgctgggcgataacatcaacggcgtaccggctaactacaaggtttatcagaccaaagatgtcaacgcctgggcgatggcaaacggctgtattcgtgtttacagcggtctgatggatatgatgactgacaatgaagtggaaggcgtactgggtcatgagatgggccacgtcgcgttaggtcatacgcgcaaggcgatgcaactggcatatgccacaactgcggcccgcaccgcagccgcctcggttggcggcgtgattggttcactgtcgcagtcgcagctgggtgaaatgggtgaaaaactggtgaatgcgcaattctcccagacgcaggaatcacaggcggatgactactcctacgacctgatgaagaagcgcaatatcgatccaatgggcctggccaccagctttgaaaagctggcgaagatggaacagggacgtcagagttcgatgtttgactcgcatcccgcctctgaagcgcgcgccgcgcatattcgtgagcgaattgctgccgacagcaagtaattccgcctctgagcgcgcatgcatccggcgtgcgcgcttagccgtgcgaagtccgctagcgcttaaatatctgatccaccatcgagcccagatccagcttattgtcatgcagcgcctgttcatccatgtgtccctgcggcgacattttatcaatcagctgcggcaatagcgcggccagcgtacccgatgcacctttcacatcggtgccgagtttgtcggccagtgactgcagttcatcctgaccaaaagcagactgaatctcactgtggccaaccggatggttatcgccggtgccgatccaggaaccaaacacctcacccagcccgccctgctggaatttttgcagcagcacttcaataccgccctgctcctgcacccaatgccagacagcctgtaactgtcccggcggatgcccttcactctggttgccatccagtgcgccagccagttcatcaagaaagcccatgattatctccactacgccatttttacgctgtaagtttagttgcagataggagttcgcgcctgacggttacccgtcggggtcagaagggaatcgatcggatcatggcaaagagaggaagatcacagcagcggcgtccgcccgatggacaggacgccgcgttcagcgcctgccggactgaagccggcaggcagcaggcatcagcctttgtttacagcctgaacatgcagcatatccagcgccagcgtagccgctgccagtgccgtcagatcagcatgatcgtaacccggtgcgacttccaccagatccatgccgacaatgttcatgccctgcaggccacggatcagcttggtcgctttatcggtggtcaggccgccaatcaccggcgtgccggtgccaggcgcatgcgccggatccagacagtcgatatcgaaggtcagatagaccggcagatcgccgacggtgcgtttcacttcggcgaggatatcgtcaacgctgcggtcgttgacctgcgccgcatccagcacgttgaagcccaggctcttgtcgaattcggtgcggataccaatctgcactgagtgctgcggatcgatcagaccctctttcggcgcggtaaagaacatggtgccgtggtcaaaggtcgggccgttggagtaggtgtcggtatgcgcatcaaagtgcaccagcgccatcttgccaaagtgttttgcatgggcgcgtagcagcggcagtgtgacatagtggtcgccgccaaaggtcatcatgcgcttgccattggccagcagtttttcagcatgggcctgcaatttgtcggagagatcctgcgaatcaccgaaggcgtaaaccagatcgccgcaatcgacgacgttcagacgctgacgcaggtcgaaatcccacggccagcggcagccttcccaggccagattggtggagatctggcgaatcgcacccggacccaggcggctgcccggacgacccgaggtcgcggcatcaaacggcacgccggtgataacccactcggcgtcgctgtcgtaaggctgaaaattcagcggaaaacgcatgaaaccaaaggcgttagaaaccagggagttgtcgtactgattgccaagcgtgttatacataattgctctctctatgtgcgtaagtcgggccagcccgcaaaccattaaggttgagatgaaaaaaatcccctccgcgtcgttaggcccgacgaggaagggattgagtgagtcagattatcgacatagttaacggcaactgcaatatgcgattaccggtcgccaggatcgattattcatcttctaaataggtatagccgtagaggccgctctcgaactcttcgaggaactgcgcgcgcagctcttcgtcgagatcggatgcctgaacctgattgcggaacagcgccatcagctcgttgggatcaagctgcacgtaacgcagcatgtccgccacggtgtcgccttcatcggagagctgcacttccacatcgccattttcgcgtgcgtagacatccaccgcttcggtgtcaccaaacaggttatgcatgttgcccagaatttcctgataagcgcccaccataaagaagcctagcattggcgggttatcaaggtcatattccggcatcggcatggtcgtcgcgataccgtcgccatccacgtagtgatcgatggtgccatcggagtcacaggtgatgtcgagcagcacggcacggcgctccggcttcttgttcagcccttccagcggcagtaccgggaacagctgatcgataccccacgcatccggcattgactggaacagcgagaagttaacgtaaatcttatccgccatccgctcctgcagtttcgtcgatgattggacggtgtgcacggttgctcggatcgagatgctgctgaatatagtggcagatgctcagatagagctgctcagcccatgaacgctgcttgagatcgtaggtgcctgacgagtagccggtatggatatcaaacagatccatctggctgtcatgcagccattcacgcagcgaacggcgggtacttggctcgtgcatctcctgccaggtttcccacatgctgaggatcgggcgcggcgcatccgcatccggcgtttcaggttcgctgaactcgttgcgctccaccccaatgatgttggagaccagcaccgtgtggtgcgcggttaccgcacggcccgactcggtgatcaccgtcggatgctccagaccgtgctcatcacaggcagcaccaatcgcccagattacgttgttggcatactcattcaggccgtagttgaccgagcagtcagactgcgagcgcgttccttcgtaatcgacgcccagaccgccgccgacgtcgaaacatttgatgttgacgcccagcttggccagttcgacatagaagcgcgccgactcacgcacgccggtagcgatgtcgcggatgttggacatctgcgagcccagatggaaatgcagcagctgcaggctgtcgatgcgacccgcttcgcgcatgatctcaaccagtttcagcacctgggtggctgacaggccaaacttcgacttttcgccgccgctcgactgccatttaccggagccctgcgaagccagacgcgcacggataccaagacgcggcaccacattcagacgctctgcttcttccagtaccagccgcacttcggtcatcttctccagcaccagatagaccttatggcccatcttctcgccgatcagcgccagacgaatatattcgcgatctttatagccgttacagacgatcactgaacgggtctgaccggcgtgcgccagcaccgccatcagctcggcttttgagcccgcttccagtcccagcggttcgccggagtggatcagtgactcaatcacgcgtttgtgctggttaactttaatcgggtaaaccaggaagtagtcgcctttgtaaccgtaagattcacgcgcacgtttaaaggcggcgttaatggaacgcagacggtgttgcaggatctgcgggaagcagaataaagcaggcagacgctggccctgcgcttcgcgctctttgaccagacgagctaaatcgacgcgcacgtcaggacgatccggatcgggacagacactgatgtggcccagttcgttaacgtcgtaatagttgttgccccaccaggcgatgttgtacgtacgcaacattttgctcgcatcctgatcgttcattgcaacctcctgcatggagcggagtgtaccctgttcgccagctgacgaacctttgatattcttcatgtcgtcagacatcgcgaacctcaattttccgttgaaagatgaaactgttaaccggctttatggccgctaatctgaaaacctgttgccacattaaacgcaatgtcctgttcacctgacgttgccgtcagcgcgattcacgcatgagagttaagtgtaaaacacccgggccatctccgtttaaacagagaacatttaactgatctgtattgaccatggataacctgcgtcgtttccgctgcgcgtgcgcagagaagagacaaaaccgatcgagcagagataaagattagcctgcgcctgtgtcggtaaaattaccgcatcggacatcgcgtcggcaggaaagagaaacagatgggaggcaggagagagccagcgcagcgccgcagcgcagagaaccggaagaagaaaaagcgtggttcattacttgtatcacctccgcatatgccaggggcacatggaaaacaacctgggtgaaagccagaccagagtctgacaggcgcgacgcaaacagtggcgtcatccttgctgctgctatcaaagcagcggcgttttatacagtttacagccgtaaaatgcaaaaatattatcggggaattgcgtgtagcgtcagcaaattatgccgataacagagacaggttaaatgctgaaacagaaaaagggctggtaattggtttaccctctatcctaaaatagccgtccagatggttttccatctaaacaggttactatccaggcggtgttggcctgctgtgctgacacaacctcactgctcgcggctttgcctgaaggggcgtcaggtcagaccacctcactggcgctatgcagtcgtactcaaaccatatttaaggtaaagaacagaatggctaaacacctttttacgtccgagtctgtatcagaaggacatcccgataaaatcgccgaccagatctccgatgctgtgctggatgcgatccttgaacaggatcctaaagcgcgcgtggcctgcgaaacctacgttaaaaccggtatggtgctggttggcggtgaaatcaccaccagcgcctgggttgatatcgaagagatcacccgtaaaaccgtacgtgaaatcggctatgtccattccgatatgggctttgacgccaactcctgcgcggtattaagcgcgattggtaaacagtctcaggatatcaatcagggcgttgaccgtaccgatccgctggaacagggcgcgggcgaccagggcctgatgttcggctatgccaccaacgaaacagacgtgctgatgcctgcgccggtgacctatgcgcaccgtctggtacagcgtcaggctgaagtgcgtaaaaacggcaccctgccgtggctgcgtccggatgccaagagccaggtcactttccagtatgacgatggcaaaatcgtgggcatcgatgcagttgtgctctctacccagcacgctgaatccatcagccagaaagatctgcaggaagcggtgatggaagagatcatcaagccggttctgcccgcagagtggctgagcgcctcgaccaaatatcacatcaacccaaccggtcgctttgtgatcggcggcccgatgggcgattgcggtctgaccggtcgtaaaatcatcgtagacacctacggcggcatggcgcgtcatggtggcggtgcgtttctcgggtaaagatccatctaaagttgaccgctctgcagcctatgcggcacgttacgtggcgaaaaacatcgtagcggccggcctggctgaccgttgtgaaatccaggtctcctacgctatcggcgtggctgaacccacttctatcatggtggaaaccttcggtaccgagaaaatctctaccgaacagctgacgctactggtgcgcgagttcttcgacctgcgtccatatggtctgatccagatgctggatctgctgcacccaatctataaagagaccgcagcttacggccactttggtcgtgaacatttcccatgggaaaaaaccgacaaagctgccctgctgcgtgaagcggctggcctgtaaggttaccgactgcagataaaaaccctgccactgcggcagggttttttattgccttttcagccccattgctaaccggagcaattttgctcccgctacccttctgaacgaacaggccagcgcaatttctggtgagcgcgtgacgacaaaaaaacgcatctgcccgacatcttcttctctctgcagcaaattttcagttctcagctacacttcttttcgctttttctgacgactaaatgttaacgattacaaattgaaatgctttgtttatccgatatttaggaattaacgcacgtagttattctgctgaaaatgcgttattttcagcgtcgtctgatagccagtaaatagagcattgtcagaaacttaatgagtgctatacctcactggttaattaatctttccgggaaaaatatgctgaatttcagggtttcagcgtgtgtaagcgattacactgatgtgatcaggctcacttttttcccgcaaaaggttttttaacattgataaaaacaatgatggataaacctggaggctaaaatgcctggcaatacacacaaaagcagaacttcaaataaggcgatgaccttatttgtctgctttctggcggcccttgcgggtctgctgttcggtctggatatcggcgttatcgccggtgctctgccgtttatcgcaaaggactttaacgtcacccctcatcagcaggagtggatcgtcagttccatgatgtttggtgcggcggtcggtgctatcggcagcggctggatgtcatcccgcctgggccgtaaaaaaagcctgatggccggtgcgattctgttcgttatcggttcactctggtcggcgatgtcgccaaacccggaaatgctgatcagcgcccgcgtttctgctgggtctggcagtcggtatcgcctcttataccgccccgctttatctttctgagatcgctccggaaaaaattcgcggcagtatgatttcgctttatcagctgatgatcaccatcggtattcttggtgcttacctgtccgatacggcgttcagctttaccggcaactggcgctggatgctgggcatcatcactattccggcactgttgctgctggtcggcgttttcttcctgccaaacagcccacgctggctggcggcgcgaggcaacttccgcgatgcacaacgcgtactggatcgtctgcgtgacaccagcgagcaggcaaaacgtgagctggaagagatccgtgaaagcctgaagatcaaacagtctggctggggtctgttcaccagcagcagccacttccgtcgtgcggtctatctcggcatcctgctgcaggtgatgcagcagtttaccggcatgaacgtcatcatgtactacgcgccaaaaatctttgaaatcgcgggcttcaccaataccacccagcagatgtggggcacggtgattgtgggtctggttaacgtactggcgacctttattgccattggtctggtggatcgctggggtcgtaaacctaccctgattctgggctttatggtgatggcagccggtatgggcgttctgggtacgatgctgcacttcggcattcactcgccgggcgcgcagtactttgcggtaggtatgctgctgatgttcatcatcggttttgcgatgtcagccggtccgttgatctgggtactctgttccgaaattcagccgctgaaaggccgcgatttcggtatcactgtctccaccaccaccaactggatcgcgaacatgatcgtaggtgcgaccttcctgacgatgctgaatacgctgggcaatgcgaacaccttctgggtctacgcactgcttaacctgttcttcattctgctgacggtgatgctgatccctgagaccaaaaacgtctcgctggaacacatcgaacgtaacctgatggcaggtaaaaaactgcgcgacatcggttcacgcgactaactttacccggtaaaaaacgcggtaaaaaaaacggcggggtttccagagaaaccccgccgtttttatttgttcaacgccccactacgctgtggttacccgcgttacctgcaggggccgccgtatgcagcagagcgccagtgccataatgaaaatggtcgcggtctgattatagggcagcaccgaatcggtcagtccggtggtaaatagcgccaccatcggcagcgccacgccgcgcagatcacacttcttcatccagcccgccagcacagtcagatagagcagcgccagcgacgccgtacccagccagccctgcaatgacgtcacctcgaggaactcgttgtgcatgttgtatttaacgttggtgaagccttcaacattgagaggatagtgcgcagtgatgaactgacgcgcctcagtggttcgcgcatccagcgtcgcaaaaccgccatggtgctcaataaagttgaccgccccgccccagatggcgacacgtgcgcccagcgaggtcgaactgtttgaaccaaagttctcaatatcctgcactccctctacccagcggttgctggtcatcagaatcagcaccgccattacgcccaccagcagagcgctaatccgccagttagtcagcagcgacagccggtaggtctgcaccaggaacagcagccccactgcaatcagcgcaatcagagtcacacgggtgccgcacaggtagagcaaggcaaaggtcactgccagcacagcgatatcggccaccttccagtaagcgtgcgtctcatagcggcttagccagagccaggcacaatagataaacagaatcatgtaggaggacatggaggcggcttcggtggtgagcttgatgcggatattctcagtgtagagatgctcgtggataccaaagcccagcgtaatcagcaggccgataaggatgagcccttttccgacgcgtagcgtggtcagggagacccgatccccataaacagccagactgagcagcacaaaggcacccatcaacagccgcttcgcccccagcagatagttgcccatattagtgatggcatcgcttgagggcgcggtttcgatccccttcacgtgaatcgcccagaacagccgaatcagggcaaagataatcagcacagcaaacagggcgatataaaaaccgttctctttaaactccacccgcctgcgcaccaggccatacagcacggacgcgacagagagataagagaccagatagaatattttttgcggcaggccggtaacaaacatattcagcgacagcgccaggcagagcgcaataactgaaaaattaaccattaacgttaatccattgcgactgattttattcgtcatgcttaacctcagtaaggcggttaaacacactcatcaggtgcttcatataattttcctcataaaaaccggtgatgctcgctttaatagcctgatgatcggggaagtagaaatccccgctcatggcgttgagaatcgcggccagcgccatgctgtcatgggtgggatagagctgaccattaataccgttctgaataatttccgccgggccgctgatacagtcggatgaaacacagtagacgccgcgtgacatcgcctcaagcaggatcaacgggaagccttcgaagttagaggtcatgaccaggcaggtgacctgtctgatatggcggatgacatactcccaggcattctcctgccagccatgccaggtgatgcgatcctggatgccgagttgcgtcacgtagtgctgacattgcgtcagatcttccccgtcacccactatctccagcgtccagggcgcatccagctgctgcagggcatcaaacagatctttaagctgtttctgccgctgataatggacgcgaccaatatagagaaacttcagcgcctggggtctgccgattaccgtgtcattgcgtttgatcgggttatagatcacgtcaacgtcagtggcgcgtgcgcccagttccaccagctgctctttaatctgattactgatcgcaaaatggtgatcggcccgcaacagataatggggacgataacgttcacgcggaggcaggtgcatccagctcgacaacacgattttacgtcctgaaagcgtgattgcccggcgcgtcatcaggcagggaatggtgttgagggtcaggacatgatcgggctgataaagacgaaagaaggcggccattctcagcgtatgaataagattttttattttcttattccgcagcgtgcagacgctctcagccagaacagcattggcggtccaggcgcgggagtggctctcctctccgctgttgataataaacagccctgcttcggtaccgggttccgcattcagggccttaatcaactgcccagtcacattttccatcccaccacgaccggccatcagatccgtcaccagcacaatccgttgtttcctgacgttatcattatttttcattggtttatccatgccctgtgccgttcgcttttcatccatccactctgcggtgaatctcattaatagaatattctaaaaaagcccataacaatatttaaaccagaaattttcccccagccagaaccacacttgtcgctggcgacgttgagttcctgcgcggcggcgattattctgagcgccatgaaaacgcctcgtctccccattgccctgcagcaggccgtaatgcgctcgctgcgccagtcgcttgaacgtgcgaatcaggcgctgaaaacccgttatccggaaccgaagctgctctaccagcagcgtggtacggcggcgggcaccgcctggctggcgtcctgggaaattcgcatcaatcctgtgctgctgctggaaaaccagcaggcatttatcgatgaagtggtgccgcatgagctggcgcatctgctggtctggaagcaatttggtcgcgttgcgccgcacggcaaagagtggaagtggatgatggagcaggtgctgggcgtttccggcacggcgtactcaccagtttgagatcgcatccgtgcgcagcaacacctttgcttaccgctgtcagtgccagcagcatcagctgaccgtgcgccgccacaatcgtatactgcgcaaagagagtgaatatcgctgcgtgcactgtggcagcctgctgatcgcgggtgaatttgtcgcgtcctgagaagaatccccattccgccctattccacattctgttaccctgccgccctttttcgtactgagtagaaatctggaatatgtctcgcatactaagtctggcggttgcgctgctgtttgcgcccgccgctgacgccctcaacctgaataactatcatcaaaataactttcagcaggccaaaacctttgcggcggcgatcaacgccgatgcaccgggttctttttactgtggctgtaagattcagtggcagggaaaaaaggggattcccgatctcaacagctgtggctatcaggtgcgcaaaaacgccaatcgcgccgcacgcattgagtgggaacatgtgatgcccgcctgggagtttggccatcagcgtcagtgctggcaggatggcggtcgtaaaaactgcagcaaagatcccgactaccgccgcatcgaaaccgacctgcacaacctgcagcctgcggtgggtgaagtgaatggcgaccgtggcaacttcgcctacagtcaatggaacggcagcgagcaacagtacggccagtgtgagatgaagatcgactttaaactcaaacaggcggagccacctgcgcgggcgcgtggtgccattgcccgcacctatttctatatgcgcgaccagtatcatctgcgtatttcgcgccagcagacgcagctgtttaacgcctggaacaagctctatcccgtgacaatttgggagtgcgaacgcgaccagcgcattgcaaaggttcagggcaatcacaatccttatgtgcagcaggcttgccagcgctaaaatccctgccctacactagctctttttccaatgacgccgctgcagcgcggcgtccggtctcaggaaccttatgcgtatacctcgcatctatcacgccgggccattaagcatcggcagtgaaattaccctggatgaagatgcatccaatcatgtgggccgggtgctccggatgacggcaggtcagcgtctggaactctttgatggcactaatctgacttttgcagcagagatcacgcatgtagataaaaagcgtgtaaaagtatcggtcacagagagccagccggacgatcgcgagtcaccgttacatctgcatttaggtcaggtgatgtcgcgcggtgaaaaaatggaattcactatccagaaatcgatcgaactgggcgtgaatgtcattacacccttgttttccgagcgctgtggcgtaaagcttgatgctgagcgtctggcgaagaagatccagcagtggcagaaaattgctattgccgcctgcgagcagtgcggccgtaatcgcgtgccggagattcgtgaagcgatgacgctggaagcctggtgcgcagaagcagatagcggactgaagcttaacctgcatccgcgcgccagccacagcatcaacacgctgccccagcctgttgagcgggtaaggttgctgattggccctgaaggcggtttgtctgcggacgagattgcgatgacggcgcagcacgattttactgacattctgcttggcccacgggtattgcgtaccgaaactaccgcgctgacggccattacggcacttcaggtgaggtttggcgacctgggttaagcgatactttcagcggaaagagagcaggcatgatgtcctgaccgatcggcccactgcagaccgaaccagacgaggcggtaaatgccgcctcaccgaggagataataatgattaaacttggcatcgtgatggaccctatttcgtccatcaatattaaaaaagactccagcttcgctatgctgctggaagcacagcgccgtggttatgaaattcactacatggagatgcacgatctctcactgcgcggtggcgtggcctcggcccgcacccgcctgctgaccgtcgagcagaaccctgagaaaactggtatcagttcggcagcgagcaggtgatcccgctggctgacctgaatgtggtgctgatgcgcaaagatccgccattcgataccgagttcatctatgcgacctacattctggagcgcgctgaagagctgggtacgctgatcgtgaacaaaccgcagagcctgcgtgactgtaacgaaaagctctacaccgcctggtttgccgagtttacgcctgacactctggtgacccgcagcaaagcgcaactgcgcgctttctggcaggagcatggcgacatcatcatgaagccgctggatggcatgggtggtgcgtcgattttccgcgtgaagaaagatgatcctaactttggcgtgattaccgaaaccctgaccgagcatgagagccgtttctgcatggcgcagaattatattgcggcgatcaccgagggtgacaaacgcgtgctggtcgtcgatggcgagccggtgccttactgcctggcgcgtatccctcagggcggtgaaacgcgtggtaacctcgccgccggtggtcgcggtgaagcgcgtccgctgagcgaaagcgactgggaaatcgcgcgccgtgttggtccgacgctgaaagcaaaagggctgatttttgtcggtctggacatcatcggtgataaactgactgaagttaacgtgaccagcccaacctgcattcgtgaaattgaggctgcgttcccgatctccatcaccggcatgttgatggatgccattgagaagcgcctgggctgagcatgacgccggggcgaagctccgtgatcaacccaataccggtgcggccgtcgcgtgccggttatttttttggtacatcgtgtgagaatgaatttacaacatcactttttgattgccatgccttcattgcaggatcctttcttcaaacgttccgtagtctatctctgcgaacataacgaagagggtgcaatgggactgatcatcaataaacccatggaaaacctgacggttgaaggcattctgaagaagcttaaaatctctgctgacgatcgcgatccggcgatcaagctggataaaccggtgtttaccggcggtccgctggcggaagatcgtggctttatcctgcactccgcgcaacgcacctttacctccagtattcgtgtttcagataacacgatcatcaccacgtcccgtgacgtgctggagtcgatcggtacggcgtctcagcccactaacgtgctggtagcgctgggttactgcgcctgggaaaaagatcagctggagaatgagctgatggaaaatgcctggctgaccacgcccgctaacagcaacatcctgttccagacgccgatttcagagcgctggcgcgaagcggcgcgcagtattggcgtcgatattcacaacatggccagcgacgccggacacgcctgatgtcaactcaaactctgttaggattcgacttcggcaccaaaagtattggtgtcgccgtaggtcagcaactcactggcagcgcccgtccgctgaccgccctgaaagcgcaggatggcatcccggactggctggtaattgaaaaactgctgaaagagtggcagcccgattttgtggtggtgggattaccgctgaatatggatggcaccgagcagccgctgaccgatcgcgcacgtaaatttgccaaccgcctgcacgggcgctttggcatccgcgtggagctgcaggatgaacgactcagcacggtagaagcgcgtgctggcctgtttgaacgcggcggctatcgtgcgctcaataaaggatcggtcgactcacagtctgctgccatcattttgcaggactggttcgaaaaccattactgacatcctcactcaatcagtccggcagcctgacgcgccagcctgctctgctcaaacgtctgcataccggcctgtgcgccggtttgtaacagcgcagggatctggtgcatcttgccttctctgatcagattggtgatgcccggtgtggcgatcagtacctcaaacagtccgatgcgcgaaccggcaactgatggcaccagccgctgtgcaattaccgctttcaggctgcccgccagctgagtacgcaccagctgtttctcctctgccggaaagacatcaaccagccgatccaccgcctgcgctgcgccacgggtgtgcagcgtcgccagcaccagatggccggtctccgcagcagtcagcgcctgacgaatagtgtcgctgtcgcgcagtttcgcccagcaggatgacgtcgggatcttcacgcagtgctgcctttacccccagcgagaacgaaccgcagtgcaggccgatttcacgctgctgtatcagcgactgctggctgtgatggataaattcaatcggatcttccagcgtgatgatatgccgcgcctgctggcggttcagcgcatcgaccagcgccgccagcgtggttgatttaccgctgccggtcgcacccgtcaccagaatcagcccatcctgctgctccagcagcgtcgggacaatggcgggcagttgcaggctcgcaagcgtcgggcatgccgtggcgatgatgcgcagtgccagtgacaggccgttgcgctgcataaagagattggcgcgcagacgctgaccatcggccaggctcagagcgaaatcgagctgccctgcgcgctccagttcctgacgctgcgggtcacttagccagcgggccataaactgcgccatccatgcaccagaaagcgggcactgctgcggaatcgcctccagccttccctgccgccgccagtagggcaaatgtccgctgcaaaggtgcagatcggcggcattatgctttacactaagccccaccatttcatccagattcataatttctcctgactatgacctcaatccagcagaacctacagcaagtgcggcagcgaatcgctgctgctgccgcgagttgcggccgcgcaccagaagaaattaccctgcttgcagtcagtaaaaccaaacctgcgagcgcggtcgaagaagcctttgccgctggccagattgcctttggtgaaaattacgttcaggaaggggttgaaaaggtccaggcactggccgcacatcctgagctggagtggcacttcatcggcccgctgcagtccaataaaagccgtctggtggcggaacatttcgcctggtgtcacaccattgaccgccagcgcatcgcgcagcggctcaacgatcagcggcctgcttcgctgccaccgctgaatgtgttaattcaggtaaatatcagtgacgagaacagcaaatctggcatcatgctggaggccgtttccgggctggcggagcagatcgctgccctgccgcaactgcggctgcgcggattaatggcgattccggcagcagagagtgattacgcgcggcagctggcggtgtgtcagcagatggcggaagccttccggcagctgcaacagcactatccgcatgcagacacgctttcgctgggaatgagcgatgacatggaggcggcaatcgccgcaggcagtacgatggtgcgtatcggcaccgccatttttggcgcacgagattatgcgcacaactcacaacaataacagaggaacttcatgttaacactgacgtttttagtaaaaacgctgatcgatctctacgtcatggtgctgctgttacgcatctggatgcagtggtcccgctgcgatttttacaatccagtggcgcagtttgtcgtaaaagtgacacagccgattgttaagccgctgcgccgtatactgccggcactgggaccgatagataccgcctcgctgctgctggcatttgtgctgactacgctgaaatacccgattttattgctgattcaggtgggcgtcttctcggtcgacccaaccaatctgctggtcggcctgctgtcgctggttaaatccgccggctatctggtcttctgggtgattattattcgctccctgatgagctggatcagccagggccggggtcctgtcgactatctgctggtgcagttaaccgagccgatgatggcacctgttcgccgtattctgcctgcgatgggcggtatcgacttctcagcgatgatcgtcatcctggtgctgtatgccctgaactttctcggcatggacctgttcccgggtctctggtatctgctgtaaatgaatcaaactggaactgttatgcaaaaagttgtcctcgcaaccggcaatcccggcaaagtgcgtgaactggcggagttactctccgcctttggtctggatatcgtcgcacagaccgaccttggggttgaatcggcggaagagaccggcctgacctttattgagaaacgcgattctcaaggcgcgtcacgcggcacagatcaccggattaccggccattgccgatgattccggcctggccgtagatgcgctgggcggcgcgcccggcatctactcggcgcgctacgccggtgaagaggccagcgatcaacagaacctggagaagctgctgcaggcgctggaaaacgtaccggacggtcagcgccaggcacaatttcactgcgtgctggtctatctgcgtcatgcggaagatccgaccccgctggtgttccatggcagctggcagggtgagatcacccgcgccgccgctggtgccggtggttttggttacgacccgattttctttgtcccggcactgggtaaaaccgcggccgaactgagtaaagcggaaaaaggtgcagtttctcaccggggtaaagcattgacgctgttgctggaagcgatgcgtaatgcctaatctgccgccgttaagtctctatatccacattccgtggtgcgtacagaaatgtccttactgtgattttaattcccacgcgctgaaagatgaggtgccgcacgttgaatacgtgcagcacctgctgcgcgatctggagatcgatttaccgctgatcaatggccgggaagtgcgcacgatcttcatcggtggcggcacgcccagcctgctgagcagcagcgcgatgcagatgctgatggatggtgtacgggagcgtctgacgctctcgcccgatgcggaagtgaccatggaagccaatccgggcaccgtggaagcggaccggttcagcgcctatcagcgcgccggtatcaaccgtatttcgattggcgtacagagtttcagtccgcaaaagctgcagcgtcttggccgcattcacggcccggaagaggcggtccgcgccgctgaactggcagagtcgctctcgctgcgcagttttaaccttgacctgatgcatggcctgcccgatcagtcgctggaagaggcgctcgatgatttacgtcaggcgattgcgcttaatccaccgcatctctcctggtatcagctcacgattgaacccaacaccctgtttggctcacgcccgccggtgctgccggatgatgatgcgctatgggatattttcgaacagggcgatcagctgttgcaggctgccggttatcagcagtatgagacctctgcctacgcgaagccgggttatcgctgtgagcacaacctcaactactggcgctttggcgactatctggggattgggtgtggcgcacacggcaagctgacgcaaccggatggccgcatagtccgcacggtgaaaacccgtcatccgcgtggatttatgcaggggaactaccgcgaaaaacagtatgacgttgccgatagcgacaagccgtttgaatatttcatgaaccgctttcgcctgctggaagccgcgccgcgcgacgagttcagccgctataccggtttgtcagagcaggtgatccgtccgcagatggatgccgcgattgccgcgggttacgtgactgaaaccgcggagcagtggcagattacggagaaagggaagctgttcctgaattcgctgctggagctgttcttagcggaagagtaacaaaagcgcctcagcccgacaggctgaggcgttgacctattttttcagtgcgccggtaagctgtttacgctgatcttccagcgaaataacgcgattacacacctcgtgaccgaagttctggaaatcctgctcctgcttgctccactcagcctgaatcgactgctgcaaaccgcccagattacccataatcgcctgcagcggattactgccgccgctgccctgcttactgcccatctcgttcaggctatcctgcatcacgccgcccagtgtcgactgcaccagcctttcaccttcggcgcgaacctgatcaatcgcctgatggtggaacgtcagcccatcttcacggtgttcaatgatgcggttcatctgctgtttcagctgaccattcagcgtggtcaggcgattacgcacgttgctgtcggtgcccagtttttcaacgatgacctgatccagtgccgcacgccctttctccagacgtgatgtcgccccgctgtcgatccacggcagatcgcgacgcagcgcattctgatagtcgatcgctttctggcgtccggccgtatcgagcgtgaccttctgtccattgaactgcacgtcgccctgcggcgagatttccatattgccgttggcaccgaccacctgcacgctctgcggcttaatcaccacatcgtcctgcggcttaacgctgcattcataggctgcctgagcctgggttgctgccaccagcagcacagcaagaagcgctttacgcatcatatctactccctaagatcgggtctgaaaccctttgatcgggcctcagcccgacactgtgtgacgacttagtcccaccagacgtcaaagagttcagtcatctgaacgtcctgcagcttgcgatcttccagccatttacgaaccagagcacgatgctcatcggtgcatttgccggttttctgcaggcaaaccagaccttcccacaccaggtaaccgctgccatcgaaggccaggccgttagggtcgatcacttcattgatgaactggttcagcgtctcatcaatttcgctttcgctggtgccttccgggaagcgccaggcaaccgagaagcccagttcctgaaactcatcaatgtgcagttttttacgtaaacggcggctgcgttgtgtggccattatttcaccctctcaaacattaaatcccatacgccgtggcctaaacgctgcccgcgctgctcaaacttggtcagtggacgcgtctcaggacgcggcacataattctgttgttctgactggttgcggtaaccatcgatgctgttcatcacttccagcatatgctccgcgtaggcttcccagtcggtcgccatgtggaaaacgccgcccagcttcagtttacgcatcaccagctcggcaaaaggcacctggacaatacggcgtttattgtgacgcgctttatgccacggatcggggaagaagagctgaaccatgcgcagcgagttatccggaatcatcttctccagcacttccaccgcgtcatggcacatcacccgaaggttctgcacatcggcttctttggcggcggccagacaggcacccacgcccggcgcatgcacttcaatacccaggaagttctgatgcggcgtgttctgcgccatcgttaccagcgaagcacccataccaaagccaatttccagcgtcaccggggcttcgcgaccaaacagcgcgggcagatcgacaggctccggctgatattccacccccatgaccggccacagggtgtccagcgcctgctgctggcctttggttaagcggccctggcggcgcacaaagctgcggatccggcgtaatggccgcccgttctcatcaaattctggggtgatgacgtcattaatcatgtaaaagcctgctggttagcctgttccgggaaacgggcattatgcaaagttcataagcagaagcaagcctttgcaatcttccggtttacacccaggtgcgcatgtgctggaattcctgcctgagtgtagagtaaacacggaaaatttccttcttatgatgcaagcgccgcagttcgcgcaacaggtgctggactggtatcagcgctttggtcgcaaaaccctgccgtggcagctggagaaaacgccttacaaggtgtggctctccgaagtgatgctacagcaaacccaggttgccacggttattccctattttgaacgctttatggcgcgcttccccacggtcaccgatctggctgcggctccgctggatgaggtgttacatctctggaccggcctcggctattacgcccgtgcgcgtaatctgcataaagccgcaaagcagattgtcgaggttcatcagggcgagtttcccgcgtaatttcgatgatgtctctgccctgcccggcgtaggccgctccacggcgggcgcgatcctgtcgctgtcgctggggcagcatttcccgattctggatggcaacgtcaagcgcgtgctggcccgttgctatgctgtcagcggctggccgggtaagaaagaggtcgaaaagcggctctggcagatcagcgaagaggtcacacccgccgagggcgtcagccagtttaatcaggcgatgatggatctgggtgctatcgtctgtacccgatcgaagccgaagtgcgaaatctgcccgctgaacagcggttgtgaggcgtatgccagcagcagctgggcgagctatcccggtaagaagcctaagcaggtgctgccagagcgcagcggctggttcctgatgatgcaggatggtgatgatgtctggctggagcagcgcccgcctgtgggcttgtggggcggcctgttctgcttcccgcagttcacaacggaagcggcgatgacagactggctggcggcccgcggcatccatgcaaaaccgcagcagcttactgcgttccgtcacaccttcagccatttccatctcgatatcgtgccaatgtggctgacgtggccttctgtcggggcggcgatggatgaagcaggcggtctctggtataacttagcgctgccaccatctgtgggattagccgcacccgttgagcgcctgttacacgagctgcgccatccccgacaactggctttgaacagttgtgagattaatgaggaagaataatgagccgcactattttttgtacttttttacagcgcgacgcggaaggacaggattttcagctctacccgggcgatctgggtaagcgcatttacaacgacatttccaaagaagcctggcagaagtggatggcgaaacagaccatgttgatcaacgagaagaagctcaacatgatgaatcccgaagatcgtaaagtgctggagaaggagatgatcaatttcctgttcgaaggtaaagacgttcatatcgaaggctatacaccgccagaagcgtaaacattccgggcctcatcgctgaggccggttatccaggtcaggcttgcactcccaatgaataaaaaattaatcgccctgctggtgatagcaccacttttggtttcctgttccgggtcaaagaaacagcagtcccacgaggagtgggtaaaagataccaacgcctttgatattctgatggggcagtttgctcataatattgagaatatctggggtatcaatgaggtcctgatcgccggacccaaagattacgtcaaatatagcgacaactattacacccgcagccacattaactttgaaagcggtaagctgaccatcgagacgatttctggcaccgatcctatggccagcctgcgtcaggcaatcgtgaccaccctgttgattggcgaagatccgggtaatgtcgatctctactctgacgccaacgatattgaaatcagtaaagagccgctgctgtatgggcaggtgctggataataccggtcagccgattcgctggcagggtcgcgcggaagcctttgctgactatctgattcagaataaattgcagcgccgcacctcgggtctgcatgtgatttacaccatttcgattccgatggtgccgaaccacctggataagcgtgcgcacaaatacctgccgatggtgcgtaaagccgccgatcagtatggtgttgatgcctcgttgattctggcgattatgcagaccgagtcgagctttaacccctacgccgtgagccattctgatgcgctgggtctgatgcaggtggtgcagcatactgccggtgttgacgtgttccgcatgaagggtaaatggggcaagccgagccgcagctatctgcttgatccggagaacaatattgatgcgggtaccgcttatctgtcgctgttgcagcgtagctatctgggcggtattcaggatccggtgtcacgtcgttatgcggtgatcaccgcctataacggcggcgcaggcagcgtgctgcgcgtcttctccagcgataaagatcgggcgttttcgatgattaacggcatgtcaccgagcaaggtttattcgaccctggcgaaccagcatccgtcggcggagtcgcgtcgttatctttataaggtgagtaccgcgcagaagagttatcggggattctgattggctcagcgcttaagcgggggagtgttcgctgcgcgaacgggcttgggtgcagcgcctgaagctgggattgttcgctgcgcgaacaggctatgagaaggtttcgttcgcttagccgcgggtatgcactgagcgggttccgcccgccaggcgatcaggagtgaagcgcctgaagctgggagtgttcgctgcgcgaacaggctatgagaaggtttcgttcgcttagccgcgggtatgcactgagagggttccgcccgccaggcgatcaggagtttcagatcgcccgagcaggcggacgtattaaggggcggacgcccgccccttaataatcccggcgtccggctgcctgcgcgccccgctgtgcggggtaccttcgtcacgccctgcagccgacggaccgtccggactcgccatccctggctcgtgccgtcctttcgccgacgtcctgtcggctcatcctggcctccggttgttcctcagcgcttcggacgcctctcccaaaccccccgcctgtaatatcttttatattctgggatgaagtgtcgtctgctggcctgaaagccaaagacaatctcgaaaatcttcagcgataagttactgaatcttttgagaagagataacagcagggggtttagggaggccgtcctttcgccgcgtcctgtcggctcatcctggcctccggttgttcctcagcgcttcggacgcctctcccaaaccctcgcctgtaattatcttttcatttcgctgttgccgtgctgtctgatggtctgatagcgaagaccatcccggaaacttacagcgacagcgaacctgccataaaaaagcagagataacagcgaggggggtaaggaggccgtcagaaccgctgagcggatgagggatttcaggacgagcgacagggatgtcgcgaagaggcgggttcgcgccatggatggcgcgtcccgccggtccgtgagaaatcctgaagtagcgaagggaccgcgaagcggcggtgaagcaggccggagcccggggtcaagggggcgcggcgactggcgcccccttgtcggtcgcctgcagaggcgaatctgaaactgcccggcttaccaggcgaacgaaaatctctcatagcccgttcgcgcagcgaacccagggcctgccaggcgaaaccttctcagccccgttcgcgcagcgaacaaaaaggcaggcgggccgctacccgcctctgcccacgctcagatcagcgccccactatcatattcgccaccagatacttccgtccctggtcatcctcttcggtgtaaacgccctgcagctctggtgagaagccaggcagcagattaagcccctcttccagcgccagaaagtaacgctgcaccgcgccgccccagacttccccagggactacgcacagcacacccggtggataaggcagtgcaccttctgcggcaacccggccttgcgcttcggctatcggcaccagctccacttcgccgcgaatataagcctgatgcgcatcctgcggattcaccctgaccggcgggaactccgcggcgcggaacatcaggcgctgcagatccttgacgttgtgactgacgtaaaggtcgtgcatctcctgacagaggcgacgcagggtatacccggcatagcgttcggcatttttgcggtaaatggtcggcagcacttcggccagaggcgcatcctctttgacgtgctgctcgaactgcgccagcatcgccaccagattggccatcttctccggactctctgccggggtcagcaggaacaggattgagttgagatcgcacttctccggcacaatgccgttttcgcgcagatagttcgccagaatggtcgccggaatcccgaaatcactatactcaccgctggccgcatcaatccccggcgtggtcagcagcagcttgcagggatccacccgatactgatcgcgcgcatagcccgcgaaaccgtgccacttcgcctgcggttcaaagctgaagtagcgcagatcgcgggcgatcgtctcagtgggcgcatcctgccagcgctggccatctaccgtctccggcacaaacggcaggatcatctcacagcgatccaggatcgctttacgcgcctcaatacccagcgtgacgcactcatcccacatgcgacgccccgcttcgccctgatgcattctggcgttgatatccagcgcggcaaacagcggataaaacggactggttgatgcgtgcagcataaaagcgttattcagccgcttatgcgggcagaagcggcgctgtccgcgaatatgattatcttttttatggatctgcgaagtctgcgaaaaacctgccagctgcttatgcactgactgcgtgacaaaaatgccgggatcgttctcattcagttgcagggtcagcggcgaacagccttccatcagtggaatgaactgctcatagccgagccacgcggaatcaaacaggatgtaatcacacagatggccgatgcgatccacgacctggcgcgcgttgtagaccgtgccgtcgtaggtgcccagctggatgatcgccagacggaaaggccgctcttcagccgcgcgctgcggagccacggccgcgatctgctcgcgcagataagcctcatcaaagcagtgcgcgtcaatgccgccaataaagccgaagggattgcgcgtcgcttcaagataaaccggagttgcgcccgcctgaatcagcgcgccatgatggttcgacttgtgattgttgcggtcgaacagcaccagatcgccacgcgtcagcagcgcattggtcaccactttgttggcacttgaggtgccgttgagcacaaagtaggttttatcggcgttgaacacctttgccgcatacttctgcgcatctttggccgagccttcgtggatcagcagatcgcccagtttgacatcggcattgcacatatcagaccggaaaacattctcgccgtagaagtcgtaaaactgtttgcccgccggatgctttttaaagaacgcaccgccctgatgtccgggacaggcaaaggtgctgttctgcatatcgacatagcgggtcagcgtttcgaagaaaggtggcagcagcgccgcttcatacgcctgcgcagccgcttccagcgcgatccactcctgcggatcgccattcagctcaccgctgacgccgggcaggtgcatcacctcttcttcaaacgcgttagcgacaaataccggcaaattaaagccggtatgacgcagcagcgccagcacgccgctacgggtatccgccagcgagacgacaaccgccgccacatcggtgaagtcggtgttatccagcgtcaccacgtctcgcgcagtgttcagggtcagactgggcgccacagcggcgctggcagcaattttcagtggagtcataacagaatccctaacgtcagggaggaagtgccagaggcacaattatggggacagtgccccggcgaatacttaacagtcagaaggcgttacgcagcccgtggaaagcagatccatagccgctgcccggctggcctcaccgcatggtgaataacggagatatcggaaaagaggataacccggtgagcgccggaaaaagcgaacggtaatccgggcggatgcgcggtgaaccggacatggcgacgtcctctgtggcaaagaagcagggtcaaaaagtggcggtcataatgtcatctttttcaggcatggacaacccgaaccaggtaattattcagtcacatccttagcatgtaacaatatgatttttatagtttatttatcatgaaaaattcataatgcgactaattatctgaattatatgcagatttatgcacttaactcactgccgctttcagcctgtttttccgctcgtgtcgtcttcattgccgggagacggggccattgccctaccgcattgcatctgccaggcgtaaactgatcttctctttcccactctgccggaggctgcatgttcaaggcactggtcattgaaaatgacgaacaaggttaccgttccctgctgaaagatctccccgaatctcaactgcctgaccacgatgtcacgctcgacgtcagctactcatccctgaactacaaagatgccctggctatctgtaacaaaggcccgattgtgcgccacttcccgatggtgccaggtatcgattttgttggccgggtgacggccagccgccatcccgactggaaagaggatgatgtggcgctgctgacgggctggggcgtgggcgaaaaacagtggggcggcctggcacagaaagccagcgtcagtggcgactggctggtgcgcccgcccgccacgctgagtccgctgcaaaccatggcaatcggtacggcgggactgaccgcaatgctctgcgtgatggcgctggaaaaacagggcattacacctgaacaggggccggtactggtaaccggtgccagtggcggcgtcggcagctatagcgtcagcctgctggcgcgtctgggttatcaggtgatcgcttccagcgggcgcaccagcgaccatgcctatctgattgatacgctgggcgcggcatcggtcattgaccgtgaagaactctcccaacccggcaagccactggcaaaagagcgctgggccgccgcgatagacagcgtaggcagtcacaccctggcgaatgtgctggccgccacccagcgcgacggcgcggttgccgcctgtggtatggcgcagggactcgacctgccagccagcgtcgcaccctttattttgcgtggcgttaccctggcgggtgtcgatagcgtgatgtgtccgaagccgcttcgtcagcaggcgtggcaacgactcggtgagctgatggatagcgaacggctcagtaagctgagccgggtgatcccgctaagtgaagccagagaaggtgcgcaggcattgctggatggtaaagtgcagggtcgtctgattgtcgactgtcgctaatcctgtttaaaggcgcgtttcgcgcctttaacgatcggctcgctgcagccgttttatgagtccttccagcgcgaactgtgtcccctgctccatcaccgatttcggatcgccgctgaactgatggcactccgcttcgtctctgccgtcaggcaatacccagccaaaccagatggtgcccgccggtgtaccatcttcgccgccatccggtccggcatagccggtaatggataatcccactggctcgccagagcgggcgcaggcgccctgcaccatctcccgcgccgtctgttcgctcaccgccgtatgctgtttcagcgtgtcagggcgcacccccagcagacggattttggcattttcgctgtaggtcacaaagccgctggtataaaagtctccgctgttttccaccgcggccagcgtcatgctgatcagcccggcggtacaggattcggcggtcgccagatgaagtccggaagagagtaaaatattacccagttgctcagcggtctgatctaatgattttgccattatggtctccttgaatctgtccggaactccaggtatagcgcaaaatcagcgaataaaaccgcgcaaggcgatgtttttaaagcgaaacggtctaaatgcgcagctggatatgcggctgtccactcccggcatgcgccactacctgcagatcggcctggtaccagcgcgtcagcgtcgattccgtcatcaccgtctgcggtgagccttgtgccaccagtcggcctgcgtgcagcagcagtatgcgatcggcccataatgaggcctgattaaggtcatgtaacacggtacagacggtgagatctcctgcgcgcgtcagctggcgtagtaaacgcagggtttgctgctgccagaagagatccagcgccgaagtcggctcatccagaaacagccagccgcgtggtcttccctcatgccagagctgtgccagcacccgcgccagctgcacccgttgttgttcaccgccagagagctggcggtaatcgcgctgcgccagcccttcacaaccggtcagccgcataacctcagccacaatctgcgacgtctgcgcctccggccagggcgcacggcccatcgccacgaccgactgcgcagactgtgaaaacgtcaggttgttctgctggcgcatcactgcccggcgtcgtgccagctgctcacgcggccatgccgtcagccgtcgatcgcccagccagcactcgccccgatcgggcgacagaaatcccgtcagcatccgcaatagcgtcgacttacctgcgccgttggggccaatcagcgccaccagctcgccacctgacagcgtaacatcgagattatcgataacagttttgccgccgcgcgcgagacacaatcccctggcctgtaaaatgtccatcactccagccctcgctgttgacgcagaatcagccagagaaaccacggaccaccaatcaggctggtcagcaaccccaccggcatctcggccggaaaccaccagagtgcgcgccagcgtatcggccagcagcagcagaatcgcccccgccagcgctgagccgggcagcagccagcgatgatcgccgccaaggcaaaaacgcatcacgtgtggcaccaccagtccgacgaagccgatcacgccgctgaccgagaccgccgtaccgaccagcaacgcactgaggatcagcagctgatgctgagtacgcttcacatcaacgcccatgtagtgcgcatcctcttcgcccgcctgcagcaggttaaggtggcgggcgcgagtctgtaacagcagcaaggctggcagaatcagcagcaggcagatcagcagtgcgggccactgtgcctggctgaggcttcccatgccccatagcgacagctggcgcagctgctggtcgttgctcagccatgacagcacgcctaccgctgccccgcacaacgcattaatcgcaatgccgaccagcaacagccgcgaaagattgccgcgcgccagccgactgaaactgaagatcagcagtgtaaccagcaggctgccgataaacgcggcgatcatcggtagccacaatgccagcggtgctggcaacgtcagcggaataatgattgccagcgccaccgccagtcccgccccgctgctgatccccagcagaccgggatcggccagtgggttacgaaaaacaccctgcatcactgcaccagagactgccagcgccatgcccatcaccaccgccagcagcacgcgcggcagccggatatccagccagatctgccagataagatcgctgagcggtgcctgccacagcgcccgcactgaaagcgacatcgcccccagatttgccgccagcaccatcgccaccagcaggaagatcagcatcagcaccaggccgcgcagcgcattatccttaatcatggttcagcgattccgccgcctgacgcaatttcacgattgcccgcggcgtatcaagaccaaaccccagcagtgccatggtgtcgatcaccagcagacgatgctgttgcccggcaggcgtcagcgccagacccggtaactgccacagctgcgcttcgccgcccagggttttcaggccatcctcgcctattaccaccagatccggcgcggcggcgatcaccccttcctgcgacagtgcctgatagtgcggcaccgggcccatagcattctccagcccggcgctgcgaatggcgccatcggccgcagtctgatttccagccgccatcgacttcatgccgctgttggccatgatgtagagcacttttaccggcagcggttgctgcggcaactggcgaatctgctgcgtcatttgctgcgccagtgcctgagcttcgctttcacgctgcagcgcctggcccacagtgataattttctgcggaattgcctgcaggctgctgtcgccgctgaccgtgaccaccctgacgcccgcgcgggcaatctgttgcagcaccagcgacggttgcgcctgcgcgctggcgatcaccagtgtcggtttcagtgccagaatgccttcggcgttgagctgacgcatataacccacgtccggcagtcgggcggcctgcgccggacgcagactggtgctgtcgcgagccaccagctgtgactgggcatccagcgcatagataatctgagtaacgtcaccgccaatcgacaccacccgctccgccgccagtgatggcagcgtcatcagcagccataacagcatcactcttttcatgccgccgctcccggcgtgcggagtgcgccaatctgctcgcgccagcgtgactgctctggcgtaccttccgtgcgctgaccgtagagctgggcgatctgcgtgccgtcggcggcaaacagttccaggctggtaacaaagccatcgcccgttggcttgcgtgttacccagctttcgctgatctgatcagccatcagatgcagggtgaactgcggattgaagatgttgagccagttttccattggctgcagcttctctaccctgccggtgaaaatctgagtacagccacggttgccgacaaaaatcataatttcattgcccgcctgctgtgccatctgtagcaggcgctcaagcgcgtcgttgccggtctgccaggcgagatcctcacccaccgcgcgaaacgcctgcggccgtgacacctggtgacgcttcagcaacgcgaaaaactgatgaacatcggtcatggcgcgccattcacggtcgatggcggtggcatcaatcgcctccgtcaggggagccgcggcaaccggctcaaccacgagcggcgtcgccgcggcgtcggtaaagtcggcgatcagcgtctgccacactgccatgttggtctgctccgtggcgtaaactttcagcaccgcatcgccatgacgatcaaaaatctgaatgctgtgacgaaacgccctgcccggtcggctcctgcagagcaaaggcgctgcaccactgaccgacgaacaggcgcagatcgagcgcacggggattaagcaccaggccaccatgcgcgccaatctgcacattgtggtattcacccagatgttcatgtaccgcataagcgttacgggtaatgtttttggtttcgccgactgcgcccagtgccttcagcaacgccggaaaatcgcgtttcagcgccacggcatcaacgccgatgcgcgcttcacacaattccgcttcgctgatgccgatcagcgtggccaggtcgcgggcatatttcttcggttgttcacctttaaggacaagatagtgctgataaatcgggttcatgactcaggctctcttagtagtgccctgcatcagcgcagggctacggctatcaaaaatcgacgttaacacctaactggaaagtacggcccggcatcacggccagcgcctgatcgttgcgctcctgctgagtggcgctggtcagttcacggctgctgaggtaatcccggtatttgcgatcggttatgttgtaaagcccgccactcagcctgacgttgtgcgcgacgcgccagtaagcggtcatatccaccatgccataacccggcacccgcatgtaatcggtgctggagtcggccaggctgctgccgttgttagcgaagctttcgcggttagtcgcgctggcttgcttacctttgacaaaggtagcggtaacggcggcaccgtagccgcgcgcctcatcatcccaggcgagtccgacgatcgctttcatcggggcgacactctcaaggtcgatgtagcggtcaccaaggtagctcgactttgcagcgccctgcgtataaccaaacgccagattggcgctcagaccctcgacctcgctgaaccagctgccgaagttcactttactgctgatttcagccccgtagatgtaggctttatcgcggttctccgcctgataggtggtgtaaatgttggcaggcacattgacgaactgacccggattagccgcccggctgtagcgggtaaaggcaataaagtttttatagtcgttataaaaagcggcagcgttaagcgtgacgccttttgccacctctccttttacaccccactcgtagttgttgctggtttcggttttcagatctgcattaccaatcagcgcatactgcgcggtgccggcatagctggagccaaggttccatgaaccataaagctgcgtatcgttggggaactgcgcgccacgggtatattgcagataagtcatcagctttggtgtcagatcgtactggaaggcgatcgacggcaatacctgcgtgtcgctgtttggcgatccatagagcgctgaaacttcgctggcgtcgagcacgctactgttcgtggtcagcgtcgccacatcacgcggtcgggtgttctgataggccacgcgcgcgcccggcacgatggccgcccgatgtccgtcagcatcgaagctgatggtatcctgcagataaccacccacgctgtagctgcgactgttagcctgcggctgcatgatcgcagtaaaagcactggctggcggtgactgacggaaaggtcgctcagtatccaccaggcgcgcattcagcccggcactcagttcatgtcgcccgacgcttttaagcgcgcgggtgtcaaaaccgtagctgtcgctgttgtagtcggaatagacggtttgcctggcggtggcactcgacggcatccgggtgttgtcatgcgcctgggtctgctgccagtaaatgcgggtcgtcaggctgtcgatcaggtcattgtaaggggtgtactcatccgccaggctgatgccccagcggcgggtatcactctgctgctgtgccgtcccccagactgtattgcctgaagtgctccagctgtcgtaatggctgtggtgggttttgtgatagtaatcgaccgtcgcgctgagcttatgagcatcattgggctgccagatgccggaggtcataaaggcgtcggagtgccagttagcgggatacgcatccagcgtgccgctgttattacgggtctgctgaccgtcgcggcggctgtaaacaaagatgccacgcagttcatcgtcaccggcagcggcggtgatgccgttatgccagctgcgactggatgagtcatagtcgctctgataactgaacgcggtcgcttttccgggatgcaggtaatcgtcgggagacttattacggaacgagacgttgccgccaatcgaggtgttcggctgttccactgctgtggcgcccttctcaatctcaatacggccaaacatataaggatcgatgtaatcgcggccaatgccaaagctgtcgagacctgcgcgtcctacatagctgcggccagtggcctgcggcaacggaatgccgtccacatccagaccgacgcggttgctttcgaggccacgaatgttgtagccggtataaccggcccgatcaaaaccgctcttaccggctgatgaaccaccacgggtaccggtagcactgatcagcggttcatagcgcatgatcgatccaaagtcagtggcaccacgctgttgcagatcgctggcagagagcgaggttttactgcctgccgtttttttgatttccggtgccgtcaccgtcattaccggttcggcactgctgccatagcggtcagaaagggttagcgtggcagattcactgcccgcagcataagtgcaggtggtattgatgaaggtggcgagcaacgccagttgagtcagacgcggttgcgtcaatctccgaaaacgtggtgacataggcgcgaattacctgattaattgttagtattcgctcacttgcttgctggcaacagtaaaacggctccgcataaaagccgtgaaaagtcagaacatcatgctggtgtaataattatcgcccggaatttaatgcaactgataatcattatcaatattatttacatttagatataaaccacagcgcacaaattgttaacccgaatgcattggcatttatcaacacgtaaaggaatagagttatggcgcaaaaacctgtggttgttattcactactgtatgcaatgcaactggctgatgcggtcagcgtggatggcacaggaacttctgcatacgttcgctgaggatctggcggaggtaacgctgaaaccgggcaccggaggtatctttgagattacgctggatgagcatctgctgtgggaacgtaagcgggatggtggcttcccggatgcgaccacgctgaaacagcgtgtacgggacatctgcttcccggatcgtacgctgggccacatcgacaaacacaaaactgaagtcagctaactccgcgattagctgagggtgattttttctgccgcgtcgtgcagcgctttaatcagcgtctgcagcgcggcttctgagatatcttcctgcgcaagccgccggttcagcgcgaccttcagcccatgaatcgcctgctcaacagcaggaatgctgcggttattgaccagaatcgccagcgtagagagacgtgtaatcaggctgctgaccgtttcacggtttctctgccagatgcgcctctcccgctgccgtcaggcggtaggctttacgcgttgcctgcgcatccaccacctgaatcgcctccatctcttccagcagcgtcaggttggggtaaatgatccccggactgggcgaatactctccctttgacagctcctcaacagacttgatcagctcatagccgtgcgcggcattctgcgccaggaaatggagcatcagcaggcgaatctcgctcgcttccagcatcttttcacgtcgcttgcgccgtccgctgcaactgcctgcgcgcgcagtttgatcgtcagatgaagtggaagtcggatgctgtttcatggcctgccctgctgcgaaaaagtgggattgatggtagtgcgccgcctggcaaaactcaattgccttagcgacttacttctggtgccagtaggccaccgcccgtacgaagtcactgttgaggccgcgctgcaccgtgaagtagtcacacagcgctttaacaaactcaccttcgccggtcagccagacaaagtaatcttccgtcgggatagtgatctgatccagccgggcaatcagctggctgagctgcgctttctgcatctggccgctgccgagccagtttgtcgtcacatcagccgtatcagataaatagtcgcggcccgtcgcttcatcggtaaaggcatagagatgcagcgcctgcgcccgggcgtcacgctgacggcgcgcaaaagccggcagcccggtttcatcacagacatagagctggaatgcgtaatcggtcggcaccaccagcgagccgcgtggcccgccgacaatcaaccgatcgccaggctgcgcctgagttgcccagtcactggctacgccctgctcatgaatatagaaatcgagggtcagtgaagattcaccatcgaattccagcggtgtgtaatcacgcgcctgcggacgcaccccttccggccagacaatccccgcatcggtgatttgtggcagagccagtgtggctccttcagcggaagggaagaaaaccttaatgtggtcatcaaagcctggcgacgtaaagcccgccagatcgctgccgctgaaccggatacgccagaatttaccggcaatgttagttttactcgcgacctggatatggcggaaacgcaattcattacggacgcgctgtggtacacgctgatcggctgatacaggcaaaatttctctcctgaaacgggatggatgcccgtgactcaagggcatgctgataataatggaataacaatcattctcatctgaagtgccaagattagctatgatatatcttcactacaagaacgaaaaatgcgatccagcggcttaagatatattttatgccggtacgggtgtgcgtagtgcagacgaagagcggccctgataagagcattcagagagaggtaagcagcaggtgcggcgtgtttacgggggcaggcagagaaggcggaaactgtccggctcctgacgagccgggcatgatgttgcgccgcacattctggcagcgcgtgaccacttacagtgtgtcgttgaatcctgagagggaaggattgctgctggtgtgttccggcagctcaccatcacccagaatttcatgctgggtggcctgagagtgcggatgcagtccggcaggaggtgaaaaaggttcagcctgttgtgccatcgccatgacaggcaatgccaggatcagtgaaatcattaagcgtcgcatagttgtcttcgtttgtttttttgaccagaaaaggcctgaaatgcaggtaaatattccagccctgacacagatgcacgatgattcaggcatggcagggtttcgggagaggattttacgccagaacggcgagttattttataaaatcgtgcggtttgtcacggtttaccgcacgaattatgcattaacagggtcgggagtcactcgccctgccctgctggcgtaatgctgatcagttaagattagatttataaaagctatcacggtcaaacgtggcagcctttttttccgggcgagcgagccgcagtgcgggccagagcaggctggtgccgggcaggagcaggcaatccgcagcgctgaacagaatgagtctgccaggagagcccgcaggacgcgggcgaaaggcggggcggcacaggatgtgccatccccggcggtccgtcaggcagaggaatgacgtgaaggaaccgcatagcggcgcgaggaccgccagcccctgcccggcaccagactgcgttatcacctgtcgcttaactgactggcattatgccctgctggctacgcctgcatcaccggaatagaaaaaacgccgctcagccagtcgggcttacagtgcgcaaaatcgagacgcaacagatctttaccgggacgacgtgacacacccagtgctggcagatgctgatagtagatatcctcgataaagcgtgtcagctgctccgggctgccgctccagcggatcgacgcatagagtccactaacctcgctccagctggcggtgttgtcacccagcagcccggcatgttgcggctccagcgcctgaaacaggctgatattttgctgatcagcagagctatggcccgggccatactgaaagcctaaccagccatgcgacacgcggccgcccgccagcgccaccagttgccgcgcctgttcagccacccggtgatcgcgatcggcaatgtaatcgccaaacttacactcccactccagcgtttctccgcacagatgcagctcttcctcacgctccaccagcgttgcacgctctgccagcgatcgcaccagaatgcggccatggaagtttttaaccggcaaatggggaatacggcgaaacgcgccaggcgtcagcgaaaagtgacctttgaatacccgggtaaaattttgctggttatcaaaaccaaaacgtacggcgatatcgatcagcgtcatgcgggtcagacgcagcgccatagcggccatcgtcagacgccgtttacgggtgtaagccgccagggtctgtccggtcatctccttaaacatgcgctgcatgtgccatttggaataacctgacttgagggtaatctgatcgatattaagatcgtcggtgagattggcttcaatccactcgaccagatcgttgatgtgctgttttttaatggcctgactgagcatgatggcgatttacgacgcgggttaggactgggatttcagttacaaaaggataacaaaaatcgcaaatcggtgtaaggaaagggtaagcattgcgcgcccgttcagggcgtttccgcattaattgcttaggttactaactaaaaaaggctgacttacgtcagccttctgattattgataaaaactgcgccggatagctttaagacggagcctgcgacaactaatgactgcgcattccggccgctgtcatcatcatgcggaacagcgaggcgacaacgcccagcgccagtacgctggcggcatagataaacaccagccacatcacacgcttccaccatggcgctttcgtttcttgattgtgattgtggtctttcatgctgctgaggcttttcatatcaatgatatcctgcgtctgctttgatttttccacggaacacgtagtagctccagaaggtgtagcccaggatcatcgggataatcagcaggctacccaccagcataaaggcctggctctgcggcggtgaggcggcagcccagatggtcactgatggcggaataatgtttggccagatactgatgcccagcccggagaagcccaggaagatcagcgccagcgtcagcaggaacggtgaatagtgcgcctcgcgcttaatggcgcgcacaatgccccacgaacagagcagcaccaataccggaaccggcaggaacaggaacaggttgggtttgctgaaccagcgatgcgcgatatccgcatgcgcaaacggtgtccacaggctgatgatgccgataatcactaacagcgcaatcaccagcggcgtagccagcgcagacattttacggtgcagctcattctcggtcttcatgataagccatgtgcagcccagcaacgcgtaggcaacaaccagacccacgccgcagaaacagcgggaacggtgccagccagtccattgcggaaccggcaaaacgacgtccctcaaccggaataccatccagcaacgcacccacggccacaccctgactgaaggtggcgatgactgaaccggcaataaacgacttgtcccagaacgcccgatggccttctaccgccttgaaacggaactcaaaggcgactccacggaaaatcaggccaatcagcatagcggtcagcggaatcgacagcgcatcggcaatcaccgcataggccagcgggaacgcgccaaacaggccagcaccccccagaaccagccaggtttcatttccgtcccagaccggcgcgacggtgttaaccatcatgtcgcgctcgccagcatctttattgaacgggaacagcagaccaatacccaggtcgaagccatccatcacgatatacatcagggttgcgaaaacgataatcgcaaaccagataacggaataatcgatcatcttagtggtctccatccttaaaggtggcagcggaaagcggacgcgccggggttttcttctgaccaggaccaccctcttcagtgatatggccttcgccggtaaccggtccctgcttaatcagacgcatcatgtagtgataccccacgccgaacaccgagctgtagaccagaataaaggccagcaggctgatgctcatgtgcatatccccatgtgccgagaccgcatcaatcgtgcgctgcacgccatagaccacccacggctgacgaccgatttcagtggtaaaccagcctgccagaatcgcaatcagacccgacggccccatcaatagcgcaaaccacaggaaaggacgcgactcatagagacgccctttaaaacgcagccacaggctgactacgcccagcgtaatcatcagcaggcccagcgccaccatcacgcggaaggaccagaagatgaccgttgaattaggccggtcctctttcgggaaggacttcagcgccgggacctgcttgtccaggctatgcgtcagaatcaggctgccaagataaggcacctccagcgcatacttggtacgttcctgctccatgtcggggatcccaaacaggatcagcggtgtggcttcacccggtgggttttcccagtgcccttcaatcgccgcgattttggcaggctggtgttccagcgtattcagaccatgagcatcaccaatcatcgcctgaatcggcgcgacaatcagcgccatccacaacgccattgagaacatcttgcggatagcgggattgttattccccttcagcagatgccaggccgccgacgatcccacaaagaaagcactcgccaggaacgccgctacggacatatggaacaggcgataagggaatgaggggttaaagacgattttgaaccagtcctgcggaaccacgatgccattctgaatgatgtagccctgaggcgtatgcatccagctgttagaggccaggatccagaaggtggaaatcagcgtaccgagggcgaccatgcaggtggcaaagaagtgcagcccgggacccacgcgattccagccaaacagcatcacgcccaggaagcccgcttccaggaagaacgccgtcagtacttcataggtcagcagcggaccggtgatactgccagcaaactccgagaagccgctccagttcgtcccgaactgataagccatgaccagtcctgataccacacccatgccgaagttaacggcaaagattttcgaccagaagtggtagagatcgcgataggtgtgatcgcgggttttgagccacataccttcgagcacggccagaaagctggcgagaccgatggtgatggcgggaaagataatatggaaggaaacagtaaatgcgaactgaatcctggccagatgaaaggcatctaatccgaacattgcttacctctttgccacatagaacaccatgtatttacttataattaacaacttaagcctgatgcgcctggttctctgcgcttattgaaattcccgccgcaaatttaaaactattcgcggcgaggaaatagaaacagtggggttaatgaaaactataacagtctttattgattctgatcattgtttttgacgggaattatttatttaaaaataaggcctaaaggttaatcagagcgtgtttatgtgtcgttaatgttacggtaatttgtactttaaaaatcgatagcgctaaagcgaaccttgcctgaaaaatgccttcaacaggctgttttcaggcactattttgttataaaccctgattgagtaaaggtcaaattttagagcctccaaattaaatacccttattttttaacaggttaaaagagtaaatagttacctctgccgctttgtttgcttttttgcttttgcctggctaatgcagctataacttctgacagaaaaaacgcagaacggcgcttttaagcgccatcagagatgttaataaaatgagtcaaaaagaaggtatgaattaacagcgcgctgcgggtagtcgattattccgggccagagattcataaaacgatttaataaccagcaaccgtgcgaaaagatcgactggattatttgggctgccgttacgttatcgcgctttcaggaagtgagataacagacaaatggggtcagaaattttgcagcgagtatacccatgccgtcacgttatgacggctgatacagggtgattttactctgccgcagatttttcgcgctgtgccagaatccggctcaggttcagctccagccagtcagccagccccacaacctgttcaccgacttcgcgtccaagcggggttaagcgatattccacgtgcggtggcaccacatcgtaggcgatacgctgcacgaagccatcttcttccaggtagcgcagattctgcgccagcatccgctcgctgacgccaccgaccgtccggcgcaacgcgctgaagcgcagcgtctggtcctgcagggccagcagaattaatacgctccagcggctggttacgcgtttcagcacgtcacgtgacgggcagttgacgttgagcaattcgccgcggataaatttttcactcattttttcagacatttaacttatccacctcaaactaacaattctgtaagtacttactaaaaattagtctatacactagtctgaatttcaccaacagccacaggagtattaacatgattgcagttacaggtgccaccggccagctgggccgtttcgtgattgatgcattactgaaaaaagtcccggcgggagaaattgttgccgccgtccgtacgcctgccaaagcggccgatctcgcagcgctgggcgtcattgtccgtcaggccgattatggtcagccagagacgctggaggccgcttttgcaggcgtggataagctgctactgatctccggtagtgaagtgggccagcgtgaagcgcagcataaagccgtcattgaggctgctcgggcggcgggcgtgggctttatcgcttacaccagcctgctgcatgcggatacctcgccgctgggcctgggcgttgaacaccgcgcaacagaagcgctgctgaaagcctctggcatcccgtttcgccctgctgcgtaacggctggtacagcgagaactacgcagcgagcatcccaccggcgctggcgcatcatgcgtttattggcgcagcaggcgaaggtcgtatcgcctcggcagcgcgtcaggattacgccgaagcggcggcagaagtaatgacccgtgaggatcaggcgggcaaagtgtatgaactggcaggtgatgacagctacacgctggcgcagtttgctgcggagattgccgcgcagagcggtgaaaaggttgattacgtcaatctctctcagagtgagtttgcggcggcgctgaaaaacgcaggcctgccagaaggtctggcggaaatgctggcggattctgatgccggtgcagagaaaggcggtttgttcgatgactcccgtcagctaagccagctcatcggtcgccccaccaccacctggcaggcagtcattcgcgcggcgctggcaaatcgttaattctgtcgttcatgagcggacaatcgggtccgctcacctcactctcctgtccgaattcccgttgggtatgccactttctgcactctttgcggctgctgtttcttttacaaaatgtgaataaacgccagttttcttcagcttaaatttttttattcaggtcgctaagagattcatctgaaatgcgttttttgtgaacagcgctatatttggttgaattgtctggaatttatccaaaaacctcgattaatcgacaatatttattacgttcatagatattctgcattgttgttccgggggaggagaggtctataatttgtcctttgtgcaaccacgaccgctcaggaggccgttattaatacccatcgccagcaacaaaatgcacttgaagaggttcgtgccggggcggaagttgagtatcaatacgatccccatgaactgaagctggatcgcatgcaggattctgaaccggagccggagctgattgaaggcttgccggcgccggatgcgctgacccctgccgatcgttatctggaactgtttgaacatgttcagatgtcgcggattttcgaggacagcaaaaccttccccgactgttcgcccaagtacgatccgctggatgtgctgatgcgctatcgtcgacagaaacgcagcagtgatttcgacctgtcgcgttttgtcgccgatcacttttatctgcctggcgtaaacgaaagcttttatgtctccaacccggataaaacgctcaatgagcatatcgacgacctgtggccggttctgaccaaaatgccgcagcagcatatgccgcactcatcgctgctgccattacccaaaccctatgtggtgccgggcggacgttttggcgaaacctactactgggactcttacttcaccatgctcggcctggcagaatcgggccgcgacgatctgctgcgtcacatggcggataactttgcctggctgatcgataactacggtcatgtgccaaacggaaaccgtacctattacctcagccgctcgcagccgccggtgtttgccctgatggttgagctgttcgaagaagatggcgtgcgcggtgctaagcgctatcaggaacagctgatgaaggaataccagttctggatggacggtgccggttcactgatgccgaaccaggcttatcgtcacgtagtgcggatgccaaacggctcactgctgaaccgctactgggatgaccgcgatacgccgcgtgatgagtcgtggattgaagatgtggaaaccgcccgcgaatcgaaacgtccggccagcgaagtgtatcgtgacctgcgtgccggagcggaatcgggctgggattactcctcgcgctggctgcgtaacccgaaacggctgtcgagcatccgtaccacgcagtttattcctatcgatctgaactcgttcctgtacaagctggagctgatgatcgccaccctgtcgcacgcgaaaggggaagagctgaccgcactggcctggcagaaaaaagccgaagcgcgcaagcgtgcgattacccgttatctctgggacagcaccgccggtgtgttccgtgactacgactggcgtcgggagcgtttcggtgcctttaccgtcgcctccgtggttccgctgtttgtcggtcttgcaacgccgcatcaggcgcacctgcaatcgatctcgctacgccatctgctattgagcaacggcggcctgctgacctcaatggtggaaagcggtgagcagtgggatcgacccaacggctgggcaccgatgcagtggatggcggttgttggcctgaataattacggtgaagagacgctggcgactgaagtggcagtgaactggctcaacacggtcaacaacttctatcagttgcaccataagctggtagagaagtatgacatcagcggcgagcgcgctcgtcctggtggcggtggtgagtatccgttacaggatggattcggctggactaacggcgtcacacgtaagctgatgacgatgtatgggcatttaatggctgactgagtagcgcagccggtaaacctttaaaacgcaaaaagccgggctatcccggctttttcatgtttcatgcaggctattcagcgctacttcttcgcttcagtgcctggttgtgacgcccgttgcaggaactgctgtgtcacttcaggcaggtgctgcagcagccactccgccatcgccacttcctgatcgcggatctcattcagtatgcgtacgccctgcgcatcaccgacctgctcagccgcggcgatcaggctggtgtagctggcgatctcggcattttcgaatacatagccactgatagcgcccttcaccacttcatctgagttaaacatgccgcccacggcctggccggtggctgccattttgcccatcgcatctttcattacagagtgatcgataccgtggctgtcgagcagctgttccagcagagtcagctgatgtttagtttcatccagatgttgcgccagacgctgttccagcgccggatagtgttcaagacgacctgacatcttgctcagcatgctttctgcttgtttttccatcgcatgcgcatcgcgcagccagtcgtgataatgttcaatcgcagtcatgtgttgctccttaagagacggtaatagactcagctaccgaggtgagcttctcatccgtttgcttctcttcattcagggtttcttccagcagctgcgcggctttggtgtaacccagcttcagcgccagcgcatgcaaagtgccgtatgtagcaatctcatagtgctcaactttctgcgccgcaccgatcagcccctgatcgcgaatctcgcctttctcgaccgagtcgataatttcctgcgcttcttcaaccagaccttccagcgcatggcatttcattcgtttgattttgacttcaggtgttacttccaccagtttcgtcgagtcgttcaatctgagcacgggtctcttccagatgctgattaaacgcagcgataagattttcgtcactggctgcacgcgccattttaggcaatgcacgggttatctgcttctcagcgctgtatacatcggataagtcatggatgaacagatcgtttaacgttttcactgtcataagatagcctcattgattaaaaagctgcgtctgtaataacgcagcgccagtcatatcgttgacacctgaaaagtctagtggagattcttaatatcgcacgcagcatcagtatgaatttaagacaaaagtggcatataaaatgcattttcctttttacagcaaagatttagctgaataatgtttttatcgttgccgcttcgttagctgcgctggattttgtacaaagtaataaatcgttgtatacattttttaagattaactgcataaaaaagtaccagtcaaaaacttacctgtacaaagttgtatttaaccgtatagctttaatcgatcggaaataaaaaaccggaagggtaaacccttccggttcaattaacagctcccgccattgccaatgatggagcaatgacataattcagggtgtaattatcttcacgaggaactaaacagattcaaaatgcccggctaacagagtaaccctgccgtcacagcagtgttaaagacgttcagctccggcggctaaccttacctcccttgcgccccgcttcaatggcacgttcaggatcgtttcttgaagttaccgccgcttttctggcctcctttgcgtcctgcttcagcagcacgctctttgtcggccgcaaaattcccggccccaccgcgatattgagtcatatgcgtcctctttgaattttaaaaattggaatttgcacagttaacgcttcatcaggccgattcagcaacataaatgtagacagaaaatcggaccgatcaagtgagataaataaaaaacccgtcacagttctggcttaatgatcgtactaccctcaaccgaaatgataacggattccaaccatcgctcttttcaattcataaaagagccgcggcatgaaaaacctttataacgaaaatcgccgcgccctattaatcgatctttttcaaaaaaagtccaattgaaaaaaatataagcgaagcggtaaatagatagattaatcaacaccaggtagtgaagatgatcaacaaacgatcaatttccccaagcgaagcgctaaatagaaatttaaaaccctgcttttacgtcaaaaataagcgaagcgtgacgcattgatggcaccagttaaaaatagccggaatcgatcaataaacgatcaactctgctgatttaatgaaaatttttattaaaaagagaggtcagatttagcgatgaaatttgaatctaagcgaagcgaatgaatttctgcttcctgagggcaaaaaacgggttttcggaatagtactaaaaagcattttctgcggggatacgcataaattttgcatgcctgcgaaaaggggaactcaacgttatgaatgagatagcgcaaagccatgaggggggagattgtgcgttaatggcaggcaaaacatatgccctgttcagcagagtcagagggagtcgggaaaagtggaatcaaaagcgacaccgcgcttgccatttttcttgatgcggtacatcgcttcatcagcacgctgcagtgcagtatcaaagtcatctttgtcctgcgcctgagacacaccgacagacgccccaatgagggcatgcccgtttgccatatcaaaaggtgtcattaccgcgtcaagacaggcgtgcgccagtgtctttacccgcggatggttcagcgccaagggtattaacaatacaaactcgtcgccgcccagtcggccaatgatcacttctgccggagagagttccgtaaaccgctgacttaactggatgaggacttcatctccgctgcggtgccccagggtgtcgttgacgtgtttgaagttatccaggtcaataaagaccacgcagagcggtccctgagctttcatttcacagaaataattctgcagagcatgacgattgttgagcagcgtaaggggatcgtgcagcgccagcagggcgagctgctcctcatattgcttctctttggtcatatcgatgtgagtaccgatcactttaaccggctctccgtacgcattccattcgctgacccggccccgatccagcacccacgtaatgctgccatttttggcgatcatgcggtgcagagcctcgtaataaggcgctttcccggcgatgtggtcgttgaatgcctgtagaaacgtcggcggcatcatcgggatgcaggctctctttccaggattcaaagttggcgtcggtctctttcggctggaagcccagcatcgccccccagcgccggttgaagatcaccagtttgccgctgggaatatccagctgccacaggaacaacccggtaccatccagcgccgcattgagttttgtgcgggcgtcatgcgctatacgcttcagacgcgcattgtgctttttgaggttctgtatctgcagacgcagcgcttcttctgacataaccgtgtgagaggaggaaaaaggggtattgtgcctgtcaggctgattctgtaaagggtggcttataaaacacgattagccgcggtcaattgcaggctggacaggatatcaggcggtgccagtctggcaatgcagcacagaggcaaacctggcaattggtttcgccatgaaatctgtttgtgttgctacagggttgagaagtggaatgggcgcgggagaggcgaaattcggaatgttcgggaatggcgggagtctgtcgaaccttcgataacgggttcgccccataaacgcaaaaacccgccagaggcgggttctttaaagatggtgcccgaacccggaatcgaaccagggacacggggattttcaatcccctgctctaccgactgagctattcgggcaacggggcgcattaaaccaaagcggcccggcagcgtcaaacgcttttcaccaaaatcaaatcgactgaccgcttttccatcaacccaaagagtgggtctgacctgccgccataaacctctctgttggccggatatattttagtcagaaagcaggcagagtctgcattgtgacgcgaaattgccgatatagcatgcgagaccaacactaataataaggatcgccatgttttccaccattacatcaggtatcgcttcccgtcacagctggcagaagcgttcacactcagcggcaacgctgagctctctcaacggctccatcgccatgattgaattctctcccgatggctccattctcagcgcgaatgcgctgtttctggcgcgcatgggctacacgctggcggagatcgaagaccagcaccacagcctgttttgtaccgcagagcagcttaagtcgcgggactatcaggatttctggctgcgactgaaccggggcgaaagcttcagcgataagttcctgcgcgtggcgaaaaacggccgaccggtatggctcgaagccaactatgtgccggtgcagaaccgccatggccgggtgattaaaatcgtcaaactggcaaccgacatcaccgatcatatcaacgatgcgcaggagcagcgcgccatcaccaccgccatagaacggtcgatggcggtaatcgcttttaacctcaaaggtgaagtgctgaaagccaatgacaacttcctgaaaaccatgggttatcgtcgtgaggaggtagaaggtgttcaccaccgccgcttctgctcgcaggcgctgcgcgacagccgcgaatatagcgagttctggcagcagctgaaccgcggcgaatttgtctcaggtcagtttccccgggtcaataaacggggcgagactatctggctgcgcgccacctataacccggtgtttgacgaacagggcagactctacaaaatcgtgaaattcgccactgatgtgaccgcgcaggtggaaaagaatcagcaggaacatgatgcggcacagcgggcttatcacaccgcgctgcaaacggatgaaagtacaaagctgggtgccgatgttatcgccagcagcgtgcagaccatgaacgccctggcgggtgaactgcaggggatctccggtgatattaccggcctgagtgaatcctcagagcgtatcggcgcgattgtagaaggcatccgccggatagccgatcagactaacctgctggcgttgaatgccgctattgaagcggcgcgggccggaacccatggccgcagctttgcggtagtggctaatgaagtccgcacgctggcagcaaacatcaatcgcgccaccaccgacatcgaaaatcggatacagcaaaaccatcagctggcgagccgggcactgaaagggattgaatccaacctgaagcgcgccgatcagggcgtacagctggcccaggaggcgggcggcgtgattgcggaaatccgtgaaggcgcaacggatgtagtacgcgccatcggccaggtgaccaaaacgcttaaagtctgacgctctgcgggggcaaccgcccccttttaaggtgttgcctgaaccggcgcttctggcaccggcgggataaagatatgatccagaatcgcccgcattacgggtgccgcagtaatcccttcgttgccaccattctccagaattaacgctaccgccactttcgggtcattaaagggcgcaaaggcggtgtagaagatatggtcacgtaaccgtaccggtatcatcttcgcgttataggtctggttctggcgcaggctgaacacctgcgacgtcccgcttttcgcagcgatgccatagggtgccgtgtggaaatatttatacccggtgccgttgggtgcgttagccatgccaaacatcgcgtggcgtaccagcgaccagtaaggtgaatgaggatcgccaatctgtgcttcatgctgctgcggatgatagttctccaccagcgtgccgcgctgggttttctccagcagatggggagcaatgacccgaccgttattaatcagcgccaccatcgctttcaccatctgaatgggtgtcgcaatccagtaaccctgcccaatgccaaccgacactgtatcaccctgataccaggcctttttatgcaccttctgcttccactcacggctcggcagtaaaccgctgtactcctcattcagatcgataccggtcgatttaccatagccaaactggctgagcatggtgtgaatgcgatcaatgcccatcataaacgccacctggtagaaaaaggtatcggcggactcttcgattgcccgcgtcacatccagcatgccgtgtccggtttttttccagtcgcgatagcgccggtccgtgcctggcagcgtccaggtgggtgcgccaaagaattgcgactgcggcgtaatcacatgagtcagcagcgccgacatcgccatgtaaggcttcaccgtggaggcgggcggatagagtccctgcgtgacgcggttaatcagcggcaggtctttatcctgtagcagctttttataggcctgatagctgatgcctttcacaaacggattgggatcgtagctggggctggagaccatcgccagcacggagccgtcgtgcggatcttcaatcagcagcgccgcacgctgccccgccagcaggctttccacatactgttgcaggtgcagatccagcgtcagcgtcaggtttttacccgcgaccggcggtacctctttcagcacccgcacaatgcggccatgattatccacttccacttcctgataacccggcttaccgtgcagcagcgcttcgtaataaccctcaatcccctgcttaccaatgttatggtcagccgcatagttttcggcgatgccttccgcatttagccgtttatagtcgttatcgttgattttcgacacatagccgatcacatgcgccagatccgcgccatagggatattcacgatcctggtaggtctcaatgctggcgccggtgaagtgaaactgattgaccgcaaagcgggcgacctgctcttcagtcagctcctctttcagcaccaccggcttgtaacggctggtctgcttcagcgcatggcggaaggtgtcgatttcgtccggcgtcagattaacgatcggcgtgagtgcccgcagcgtggcgtccatgtcgctgattttgtaaggcgtcagcgtaatggcgtaccagctgacgtttcgcaccagcggaatgccgttgcggtcataaatcagcccgcgcgtcggggcgatggggatcattttgatgtcgtttctggttagagcgcgtctggtaatagccatgatcacgcacctgtaagcgaaaaaggtttacgccaagaatggtgaaacagagacagaccagagcaaaggctattgcagcgcggcgggcaaacagcttctcttcagcttggaagttacgaaagttcatcagggagcattatcaggcgattaattattatctgttattgcgcaccatgataaagcgcgatcgcgggcgtgccagcgcgaagatgcacaagcctgagcaaaagtgtgtcatttgatgtgaatgttaccgggacggcgaggcgggaaaatgcagatcccccggttaagggggatctgcgcaaggggatcgggcagcaggcgtcaatgcctgccacgctgattaatcacccagcagaacagactccagcgcaatcttgatcatgtcgttgaaggtggtctgacgctcagcagcggtggtctgctcgtgcgtacggatgtggtctgatacggtgcagatggtcagcgctttagcaccgaactctgcggccacaccgtagatacctgcagcttccatctcaacgccgaggatgccatatttttccatcacgtcgaacatctgcggatccggggtgtagaagagatcggcagagaagatgttacccacgcgcgcttcaacacccaggtttttcgccgcatcaaccgcgttacgcaccatgtcgaagtcagcaatcgcagcaaaatcgtgatctttgaaacgcatacggttcactttggaatcggtgcaggcacccataccaatcacgatgtcacgcagttttacatcggcacgcacggcaccacaggagcccacacggatgatctttttcacgccgaagtcggtgatcagctctttggtgtagatggagcaggaaggaatacccattccgtggcccattacagagactttgcggcccttataggtgccggtgtagcccagcatcccgcgcacgttgttcacttctaccggattttccaggaaggtttcagcaatgtgctttgcacgcagcggatcgccaggcatcagcacgacgtctgcgaaatcgcccatttcagcattaatatgaggggttgccattgtttaatccttgttaaattgctgatttacagcatgttcttgccatagtccatctcggacaggccaaaatagtgtgcaattgtctgaccaatatcggcgaaagtttcgcggtaaccgagtgaacccggctcgactttcggtccgtagataagaatcggaatgtgctcacgcgtgtgttcagtaccttcccacgtcgggtcacagccgtggtcagcggtcaggatcagaatgtcatcttctccgactaactccatcagctcaggcagacgacggtcaaacagctccagcccgcccgcataaccggcaacatcacgacgatgtccccaggttgagtcgaaatcaacgaagttagtgaaaacaatcgcctgatccggcgcagttttcatctcctgaatcgtggcgtcaaacagcgcatccagaccggtcgctttgacctttttggtaatgccctgctcagcatagatatcggcgattttacccacggagatcacatgaccgcccttctcatccaccagctttttcagcatggtggcggatggcggctcgactgccaggtcgtgacgattgccggtgcgctcgaactgacccgctttgtcgcccacaaacggacgggcgataacccggccaatgttgtagccaccttcggtcagctcttcacgggcgatttcgcacagcgcatagagacgatccagaccaaaggtctcttcgtgacaggcgatctggaacaccgagtccgcagaggtatagaaaatcggcttgccggttttcatatgctcttcgcccagctggtcgaggatcaccgtacctgaagagtggcagttcccgagatagcccggcagatctgcgcgctcgaccagtttgtccagcagtttcctgagggaagctgttctctttgtcgctgaagtagccccagtcaaacagcaccggcacaccggcgatctcccagtggcctgacggcgtatctttacctgacgaaagctcgctggcgtaagcgtacgcgccggtgattttcgcctcaggatccagacctgccgggaagcggccggtcgacagctctgcggctttgcccagacccagcgcggttagattaggcagatgcaatgggcctttacgtcccttgtctgcttcacccctgaaacaggcttcggcgatgtgacctaaagtatccgaacctgcgtcgccgaatttatcggcatctttactggagccaattccaaaggaatcgagaaccataataaaagcacgtttcatgcaagtctcctgcgcattggcgcgtgacaagtcaaaaaaaagcgatcagatcagtatacccgaatgcatcgcagctggcaccggttaccggtcagttagctcatatcgctcacacgacgatagacaaccggcgtctcagccggggcggaattaccgagcaccagcgcggctttgaccgcggcggcggcctgctgccatttgtcttcgctgctggcgtgaatgatcgccagtggacgctgcgcatcggcacgttcgcccagggtgatcatgtcgcttaagccgacgctgtaatcaatactgtcgctggcacgctgacgtccgccgcccattgccaccaccgccagacccagcgcacgggtatccatgctgctgacgatgcctggctggtcggcatacaccggcttgctcagcatcgcctgcggcagataagcgtcgtagcgttccacgaaatcggcaggtccctgctgggcagcgaccatacgaccaaatacctcggctgctttgccgttatccagcaccgtcatcagtttctgacgcgcttcggtgtcgctggcggccagtttgccggagaccagcatttcgctgcagagcgccagcgtcacttccagcaggcgcggattccgctcttcgccggtcaggaagcgaaccgcttcacgcacttccagcgcgttaccggctgaggaggcgagaacctggttcatatccgtcagcagtgcggtggtctggcagcctgcgccattagcgacgccaacaattgactgcgccagactttctgacgcctcataggttggcataaacgcaccggaacccactttgacatccatcaccagtgcatccagcccttctgccagcttcttcgccagaatcgaggcggtaatcagcgggatcgaatcgacggtggcggtgatgtcacgcgtggcgtagaaacgcttatccgccggtgccagcgagctggtctggccgataatcgccacacccacctgcttaatgatctcgcggaagcgatcatcgctcgggaagatatcgaagcccggaatcgcttccagtttatccagcgtgccgccggtatggccaaggccacgacccgagatcatcgggacatatccgccgcaggccgcgaccatcggccctaacatcagcgacgtcacatcgccgacgccgccggtcgagtgcttatccaccaccgggccattgagattaagtgatttccagttcagtaccgtaccggaatcacgcatcgccatagtcagcgcgacccgctcaggcagcgtcatgtcgtggaaatagatggtcatcgccagcgcggcaatctgaccttccgaaacggtgttatcacgcacgccattgatgaagaagcgaatctcctcttcagtcagcgcatggccgtcacgttttttgcgaattatttcttgtggcaggaacaaggtaaccccctggttcagggaaatcaggatggggaacaggcggtcagcgaccgcctgaaggatcagtaacccgctttgctggtgtcgctgtcatgacccagggtgttgagcaggctcgccagcaggcttgatgcaccaaagcggaaatgacgcgcatcggcccagtcggcacccagcgtctcttccgccattttcagatagatcgcggcatcttcagcggtgcgcacgccaccagcgggcttaaagccaacctgctggctgacgcctttatcacggatcacgttcatcatgatctgcgccacttcaggcgtggcgttaaccggcactttaccggtagaggttttgatgaaatcggcaccggcatcaatggcaatctcagaggcctgacggatcagcgcttcctgcttcagttcaccggtttcgatgatcactttcagcagcacatctgcttcggcacaggcggttttacaggctttcaccagatcgaaaccgacctgactgttaccggcgatcagcgcacgatacgggaacaccacatccacttcatcggcaccgtaggcgatagcggcgcgggtttctgccagcgcaatatcaatgtcgtcattgccgtgcgggaagttagtcaccgtggcgatgcggatctccggggtaccctgctcgcgcagcgttttacgggcaatcggaataaaacgcggatagatacagattgcggcggtgttgcctgccggggatttggcctgatgacacagggcgatcacttttgcgtcggtgtcgtcgtcattcagggtggttaaatccatcagtttcagggcgcgcagggcaaggtctttgatatcggtcatgaggctctccaaaggatcggggtgcaacccaccggctcgccggcggaatgttataataataacactctgatgccgcctgatatgtgccaggagtcacataggaataagaaattagtgcaacattgccacgtttactgtgactaacattacagataacagggcttggtggttattatacgccagcgggtgcaatgttactattatcacatttaagcgcgaaggctgcaggtcgggtgagacgcgggcggtcagttgcgcagcgccgggaaagcgggatcgagctgaaatagctgctgactgttgtgccacagcgcatcggcaatctcctccggtgactcttctcgcaggctgcagagcacctcccacacctgacgcgcccgctccggacgattaggctggccctgaaagccctgcagcggcatatcgggtgcatcggtttccagcagcagcgaagagagcggcagctgcgccacggtctggcgggttttgctggcgcgttcataggtaatggtcccgccgatgccaatcgcataacccagcttaataaaggcctgcgcctgctgcagactgcccgcaaaaccatgcaccacgccacggcgcggcagatcgtaacgacgcagaatctgcgccagtttgtcatgagtgcggcgcgaatgcaggatcaccggcagctgatacgctttcgccagcttaagctgctcctcaagaaagcgttgctgcttatcaaactgcggatcgtcgcgatagagatccagcccgatctcgccgatcgccaccagcttacgcggccgctgttgcagtaaggtttccagctggtcgagatgggcctcctgatgattttcgatgacgatcggatgcaggcccagcgcggcatagagcgccggttgcgccgcggctaacgcgcagacccgctcaaagcggctggcatcgatcgccggaacgataatcttttccacgccagcttctgcagcacgtgccaggctgccagagatatccccttcaaacggcgggaaatcgaagtggcagtgcgtatcgataaacttcatgccagcgatcctttgtcgtaatcagcatcattatccgccagcggcggtgtgatgatgaggcgggtatcgggtgcattggctaccggagcaggcggcgtaacgatacgcgccgtggtcatcggttctgcatcactcagccactggcccagcgtggcgaggaaatagcgaccgcaacgccgtcccagatgataatcctgattcagtgaagcgatgcggctccccagcgcactgctggccagcgcatgcggcggaaagatttctataatgcgcaaatcatcgggaggattctcaatgaactgctgaatttcccgatagctctgttcatgcttattcagcacgttgatcatcggctgcagtgcgccggtgctgagccagcgttccatccgcttaaaccatttcggggtgtagaacatctgcgagggcacggtgcggatcaccacaatggtatcagcgccacggcgggcggcttcacgcaccggaatcgcatcgctgatgccgccatcgagatagctgatcccttccagactgacccccagccggtaaaaaccgggaatggcactggaggctttgatcagatccagccagttatcggcggtcgggttgaagtagccgggcgtgtagtcgtcactgcggcaggcgcacatataaaactcgcggccgctggagaaacagctgctccgcgctgctcatcgccagcggaaattcactgcgggtaatatctatcagccagtcgaggtcgatcagattgccaccacgcacaaagcgcagcggatcaaaaaagagtttactggtggtatagcgggtaatcacacgtcgggcatagccgggctgaccacagacaaaggcagaaagattttgtgcaccggcagaggtgccgagcatcagctgaaaggggttgaatcgggcacgctgaaattcatctaacacgcctgcggtgaaaatgccgcgttgaccgccgccttcacaaaccagcgcaattttctgagatttaaacggagtcagggccagaggttcaatggcgccgagcgtgacaggaatgcgtatacccactgtgcgaacctcaaaaagcggttccgggtctgctggaggatcgatccgttaaagacggcagcattccggagaaccagtcatatgttcctttaaccggcaggccagcagggctggcttgccttgcagcgatgtgaaggtgtccctctcttcacgtcagtcgctacagatgactggtctccgctctatgctttgcgttgcattacactgcaggactcatcggctaaagctttttacggccggtaaacaggctgatgaggaacaggataataccaacgacgaagacaactttagctgcccatgctgctgtgcccgctaaaccgccaaaacctaacgctgcagcgatcagtgcgatcaccagaaaaataatgccccaacgaaacataagcctctccttaccctatttaaaaatcgaatattttaaaatcgatctgcttatttcatccccggatgggtatcttttattcgtacggccacagaagtggccgtacgcaagcttaagatttaaccgtcaggtcattcttaacgcttttcacgccttcaatggctttagcaatgctttctgcacgatctgactgtgcctgattagcaacctgccctgaaagctgaacaacgccgtctgtggtctcaacttttacgttgcgcgacggaacaatgtcatccgctaatagcttagctttaatttcgctggtcgtggcggtatcgcccgcataacctttcattgatgatgctttgctgtctctgacgtgtagtttgtcactgacggatttaacaccttcgattttctgcaccacagccacagccttctcagcctgatcctgtgaggtgacgaaaccgcttaaggtcacgacgccgctatgcgtttttaccgagatatccgtgcttttaattgcgtcatcatctaccagcgccgctttggctttggcggtgatgccgctgtcatccatataaccatcgacttttttcatagaactatcgatttttgaacccgcgctgtcggctgtctgtgacgctttctgcgacattgattcgtcagccagtgcgctgccgctgatcagtgctgagccaatcatggcggccatcagggttttagcaatcttagtcttgttcatcgatatcttccttctatcagttaactcacccaaaaactgtgggcgcaacagaggcacaggtgccgctgcgttacaggacgtaaggacaagagaagtctcttccgccgtccgatagagtaatcatagacggcattttgcaatttgcctggctaactggttgatcacacgtcaaaacagaagaaaaacggggtttttaggaggagtctggaaggaggaaaacagggccactcccagctggaatggcccggaaacaggcgattagtgctcgcgcgttttgcggaaacggacgtcagggtaacgttcctgcgtaatattaagattaaccatggttggcgcgatataagtcaaattattaccgccatcgagtgccaggttaacttcgtttttgcgctggaagtcctcaaactttttcgcgtcgctgcattcaacccagcgcgccgtagagacgttgatcgcttcgtagatcgcttcgacgttatattcgcttttcagacgggcaaccaccacatcgaactgcagcaccccgaccgcgcccacgatcagatcgttgttatgcacgggacggaacacctgtaccgcaccttcttcagacagctgaaccagccctttaagcagctgtttctgcttcagcggatcgcgcagacgaatacggcggaacagctctggcgcgaagttcggaataccggtgaacttcatgttttcaccctgagtaaaggtgtcgccaatctgaatggtgccgtggttatgcaggccgatgatatcgccaggatacgcttcttcaacgtgcgaaacggtcgcccgccataaaggtcagggcgtcggagatcaccacatctttgccggtgcgcacctgacgcagcttcatccctttttcatatttaccggacaccacacgcataaaggccacgcggtcgcggtgtttcgggtccatgttggcctggatcttaaacacgaaaccggtgaacttctcttctttcgcttctaccgtgcgggtgtcggtgtcacgcggcatcggacgcggtgcccatgccaccaggccatccagcatatggtcaacgccaaagttacccagtgcggtgccgaagaagaccggcgaaagtttgccgctcaggaaggcttcctgctcaaactcgtgcgatgcaccctgtaccagctccagctcttcacgcaactgtgccgccagatcgtcaccgactgcggtgtcgaggtccgggttgttcagccccttcacgatgcggacatcctgaatggtgtggcctttaccggtctggtagagataggtctcatctttgtagaggtgataaacccctttgaacagcttgccgcagccgataggccaggtgatcggtgcgcaggcaattttcagctcgctttccacctcatccagcacttccatcgggtcgcggatgtcacggtcaagtttgttcataaaggtcaggatcggcgtatcgcgcagacgggtaacttccatcagcttgcgggtacgatcctcgacgcctttagcggcatcaatcaccatcagacagcagtcaaccgcggtcagcgtacggtaggtatcttccgagaaatcttcgtgacccggggtatccagcaggttcaccaggctatcgcgatagggaaactgcatcaccgaggtggtaatggagataccacgctgtttctccatctccatccagtccgacttagcgtgctggttagagccacggccttttaccgtaccggcggtctggatagcctgtccgaacagcaacactttttcggtaatggtggttttaccggcatccgggtgcgaaatgatcgcgaaggtgcggcggcgtgccacctcttctaaaaagggattagacatggaattcttctcaataggcagcgcaatttactggcgctgctgataaatcacggtggccggcagaaccttaccggcgggtaaacggtgccaaaaacgatctttcatcgttggcgggtcagcgcgaagttacattggcgtgaattccggttacctggtcagctttaaggcggcatagcatacaatattttgcgcgcgcggcctacagggagaggggcaggatttcaggggcggggaatcggggaacggtggatgccacaacaaagcgggacgggtctgcaccctccccgcctccgttatcccagcacctttctgacgcaggctttgaagatctgcacaccaatctccagcgagtcgagatcaaaatgcatgtcgggatgatgcaatccgggcgtcaggttggtgcccagcccccagaagcccgcttttacacccggacgcttcaccggatagtagaaaaagtcctcgctgcctggcgtggtccgggttgacagcgcgccctcttcgcccagcacctcgacgaccgcggcgcggatcaccgccgtcgcctcatcatcaatctcggcggcgggcatctcttttaatacgcggacctcggcgctggcacccagtgccgccacgctgtgagtaatggcgcgcgtgacctgctctttcagcagcgtcatcggcccgtttctcctgcgaacgcagatcccagactacgcgggcttcatccggcaccgagttggtgacaccggcgtcgcacaggaagcgggtcgctttgacgctccaggtcaggccgggcgagaggtggatggcgttgaccgcctgaaccgcctgtacggcagcatccagcgcattcacccccaggtgcggacgcgccgcatgggcgggctggcctttgatggtcgcttccagcgtgctgcaggctgagtagagcaccgcaggcaccgcctggccgaccacgcactcctccagcggacgcagatggaaccccagaatcatctccacatcatccagtgcgccaccttcgatcattgagagcgcaccggcgcccagctcctcggcgggctggaacaggatctttagccggccacgtttcaccgcgccctcctgcagcagagccgtcgccgccgtcagcacgaccgaagagtgaccgtcgtgaccgcaggtgtggcgcgcacacggcacgccatcaatgatgtgccccagcgcatccatatccgcgcgcagtgccagcaccggacccggcacaccgctgtcgatctcggccacaatgcccgtggtgttattgatattgcgcgtcaccttcaggcccgctttctccagctgatcggcgatgtaggccgaggttttcacctcctgaaaacccagctccggaatttcgtgtaaatagtggtaatgctctaatacctcagacacagcgttactcctgaataaacagacgcataacagacattgcgatcagcgcgttgatgatgctcaccagcatcagcagcggccagtatttttttggcacatcggccacgcccagcagccgtcccatatattgcagctgcgatcccatcaggaaaatcgccggggccagaatcgtgatatccgcgccggtcagcagccctttggtcagcagactcaccgctacgccggtacccgccgacgatgagagccaggcggtgagcagcaccgtaattgcctcacccggcaggccgaaacagccccatcactggcgcaaaaacgtgcccgagaaactgcatgatgccgagcagattgagcacttctgccagcacataggccatcaccacatttggcatcaggttgtgaatggcaatgtgaaagcctttacgcgcgccggtcacaaacacatcaaagggattactgctggtcgtgattttattttccatcggcgaaatccttcttataaacactgtttaacacagcgcgcgttatcgccgcaccgacaaatttcagcacgaacattaataacagcggaataataatcggcagcgtcattgaggcgaatagcgcggagccgatggcgaagtaattattgattaagccggcaccggaatattgccaggcactcatcaccaccacctcttttttaccgatctgtttctggtcggccatctctttggttaatgccgcgcccgcgtcggtactttgcaggtcggtgattaacgccagaccgcaatggcccggcagccccatcagcggcttaagcagcggcgtcagcaaccgatgcgccgcgcgaatcgcgccgtagtgggtgaagatttccagcacgcccagcgccagcatcaccgtgggcgtcagcgacagcgcaaacaggaaacccgctttggcactgagtccgcctgcgccaagaaaggtgttgctggcgggatctttcatggtgccaaagctgccgcccagcgtggtgaagtcaaaggcgccaagccatgaaagaccctcgacgttataaaacagccctgagaaaaacaggatggcaaaaattaacgcgacataactgcctttggtcgccgtcatttttaccggactaataacactttcatctgacattattttctcctgataacctggcttgccgcctgttccctgccgtggcaagtttcaatatatggaactgagttctaagcatgatttatgccagagccgatcggcgcgcgatgattaatgaccctgctgtcacctctgggcgtttaatccacgccatgcctgttatggctctgcgaaatatctttttctgacggcaacgtgatatttccggcgcgtcatcagatgaccgctatttctccagcttcagcggcgattgcaccagcaggatagcgaccgggcgcactatcatggtgctgaaattctgattttgttgcccgataaggagtgatgcagaatgagaatcgctcgtattcaatttgtgaaataattctatttaaatcaatcagataaattagctgtttttgcggaaaagccttcgctttactaacatatttgatgcataattcaccgactatacctgtttatttaacatcttcttaaaaggactcggccatgctgactgctgaaatgactgggcgtttaaacgaccagctgaacctggaatttttctctgccaatctttatctgcaaatgagcgcctggtgcagcgacaaaggctttgagggtgccgcttccttcctgaagatgcattcacgcgaagagatgcagcatatgcagcgtctgtttgattacctgagcgataccggcggcatgccggtgctgggtaccatcgctgcgccgccagtttctttcacctcgctgaatgaaattctgcagcaggcgctggagcatgagcagctgatcaccagtaaaatcaatgaactggcccatgccgccatgacctcacaggattactctaccttcaacttcctgcagtggtatgttgccgagcagcatgaagaagagaagctgttcaaaaccgtgctggataaactggcgctggtcagcaacagcggcaacggtctgttcctggtcgataaagatctgggccgcatgagcaccgagaaccacgcagaataatgtttatcggccccttttcggggccgatcttattgccgtcttgctgacaccacggcaccgctattccagccggtaattcgcggctttcccgccattgacccatagttcacggctttcacccgcaggcagtaacagcgcgatctcccgccaggctggctggtaatctccacgtttttccaccgtcaggtcgatacgcgtggcgctgctgcagagcgtccagcgaagccatagcgcattcccctgctgccagccgtggctctcgccatcgtcatcaaacatttcgccttgtgtctgcacgccttcgggggcaggccatagctgccattgccgcaccgtatcacgccgcgcatcggtggtgctttcgcactcgcccagcgggatcaccgcaccggcccgcaccagcagcggcagccgatccagcggcgcatccagcgtgatggtctcaccgcccgcaaacgccttgccgctgtgccagtcataccagccgccgcggttacggggcagatagacttcacgactgcgcgcgccctgctccactacgctggcgaccagcagatcgcgccccagcataaagtcatcacactcctgataggtcagcggatcctgctcgtgatcgaggaaggtcgggcgcagcatcggctcatcttccacactggcctgccacgccaggttatagaggtagggcatcaggcgatagcgcagccggatcgcctcgcggatcatcggcgtgacctccgggtacatccagggctcgtttaccgtgtgatcgtcattccaggagtggatagtaaagcgcgggtgcataacgccattctgaacccagcgcacaaacagctcggcatccggcttatcgcccgagaagccgccgacatcgtgcccgacgttaaacagcccggagaggctcattcccagtcccatgcggatgttgtagcgcagggtttgccagctggtgcggttatcgccgctccaggtctgtacatagcgctgcatcccggcgcagccggaacgggagatcagataagggcgtttgtccggtgcaaattgctgctgggcttccattgaggcgcgcatcatcagcaacggcattaccggccggatatgcttgatggcgatcggctgaccaaaaccgtgacagcgcgcttcgccatcccacacctcatattcgttgttgtcattccaggtggaatcgatgcccttttccagcagctgccgggtgacattttcctgccaccagcgcaccgcctgcggatgagtgaagtcgaggtgcgagccttcatcgtcccagaacaccgaacgctcaggacgatcctgctcagagtcacgaataaacagcccctgcgcagccacttcctgatagcgcggatgatcctgcagcaggcagggtttgatgttggccgccagcttcattccggcagtatgaaacgcgtcgctcagcgcattgggattcgggactttgtcgtagttccagttgaaaacgtagcgcttgttgttaatcgaggtgtaacccgatgagagctggaacgagtcgcagggaatttcatgctcgcgacacagacggataaaggattgcagctgctgttgcgcgtcgggcgcgtcggtatagtgcatggtggacccgctgtagcccaggctccacttcggctgaaacagggtgcgaccggtcagacgcacaaaggctttggtgacgtcgagcagcgtcgggcccagcatcatgtagtaatcgagatcgcccgcctcggcgcggtagcgacgataagggagatggtagttatccagctcattccccagatcgagccagctgctgctcaggttgtcatagaacaggccaaaactgacgccatcgcgctgcgtcagggtaaacggaatatgtttatagagcggatcggtgctggcggcgttgtagcccatggcgtccagattacgcatctcaaaacggcggttaacgcggttcaggtcgccgctcttctcgcccaggccataaacccgatcctgcggctggcgacgctgatagtgctcgaccccatcgccgtgcgcattgagcagataggcaccggtgtgacggtcggcggccagcggctgccagctctcaccatcaaactgctcccagctcaggcagagcggctgatgcaccgtgacacgcagccgttgcgtgctgatgcgcaactgctgcgcatcgtgttcaaccttaaatgccggcagcgtaaagccatccagcgcctcacgatcccgcccctgccagggcacgtcgttgacaggcgcaatgctccaggtgcggttcagcgccagctcaccgtcgcgcttcagcagcacgcgcatcagcttatcctccagcacgtaaagccgcaggaagtgacgatcttcgaccttgagttcaacaaagtgatcggcctgctgatgcatcgtccagttcttcagggttttcatcgcgatatccttatgggttagcagggcgctggcggcgttcggcgaccagcatcaccaggaaaacggcaccaatcaggtcaaagaagcccatcgccacaaacagcggattgaagccgatggtatcggcggtgacaccgataatcagcgagaagataaagctggcgatccaggcgcaggagccgcgcatgccgttgaccgtggccatctggcggcgatcaaaacgctccaccaccagcgcgctcagcatgcaggagatcacctgatggccgaagccaccgacggagatcagggcgatcgccagccagggatcttttaccagcgtcatcagcgccagggagaccatcagcagtgcgccggtcaccgaactggcgacaatcgaattcacacgggtgagaccaaaccagcgcacatagattttggtcagatagccgctggcgacgctgccgaggtcggcggccagaaacggcagccaggcgaacatcacgatctgtttgagatccatgccgcgctcattggccagatagagcggcacccagaagctcagtaccgcccaggccggttcggccagaaaagccggaatggcgatgccgtagaatttcttctctttaccaatcactttcagcgcggtgaagaacggcagtttttccccgatcgcttcgttgtcctgattaataaaggcccgctcctcatcagagagacgaggatggctctcgggcgagtgatagccccaccaccagagtgcaacccacagcaggcccagcccgccggtcagcagaaaggcgccctgccagccaaacgttatgtgtgcgacataaataatcggtggtgccagcatggcaccaatcgaaaagccgacgcccgcccagcccgccgcgaccggacgctcctttttcggaaaccagtcaccgatcgctttggcgtttcgcgggcgttgccgccgcctcagaggcgcccatgacaaagcgcagcaatgccagatgcagccagcttcccgcgccggcgtgcaacagacaggtcaccgaccagatcagcgcacagatcaggaagcccatcttcagtccgatcacatctatcagccagccgcagattggctgaaacagggtataggccagctgaaacgccgccaccacccaggagtactgttcggtcgtcatgtgcagactgtttttaagttccggtgccagaatgccgagcgagttgcgggtgatgtagttgacggttacacccagcaggaacattcccagcatccaccagcgtaaatttttaatcacgcgcaccgtgcgggatgcactgatgggtttggttgttgattcgaggctcattgtgccactcctgattgccattgatgacgcacaccgcctgctggcgtaccgcgtgtcctgtaacgaacttagaaaagtgcgaaacgtgggtacagacacttttttgcaacgcttttcatggcaggctgaatcccggcagaaaatggcactgaaacgcttatctgacgcgattcagcatgttatgaaaaatttttcatcagcagatttgaaggcgatcacagaatgaaacaaaggctgaaagtaagcgaaattgcggcactcagcggcgtctccatcagtacggtgtcgcgggtgctggcgggtaaagccaatacccggcccgccacccgtgacaaagtgctggccgtggcgcagcagcagggcgtgctaaacaacctgcacagtggtcgcctgctgctgaataacctgatggtttttgccccgccgcgcgcctttgatgtacgcagtgacatcttctactacaaagtgattcaggggatcagccaggcggtggagccgcatgaggtgcggctgcgctactgcccgctggaggaggtggaaagtgatgcggcgctgtttatcgataagatgcagcagaccgaagcggcactgctgatcggcattgatgatgagcatattcatcagctggcggcggagatgaacaaaccctgcgtgctgattaacgcccgcgatcgccgaatgcgtctgccttcagtctcgccccatcatcagctgattggtgaattctcagcgcgctatctgtttgagcagggacaccggcagatcctgtcgctgcattgcttacgccgctacaccatggagcagcgattgcagggggtgcgcgacgcctggcatgccatgaacctgcggtttgacagccgccagcatctgctgaccctgaacagcttcagcagcaatgaagcggcggagcggctgagtgaatatctgcgccactgccctgatgcgctgcgcccgaccgcgattctcgccagcggtgattatattgcggcgggcgccgtcactgcgctggagcaggccggtctgcgggtgccgcaggatatttcggtgatgagtatggatggctttaacctggccgctatccacgatattccgctgacctcggtgcaggtgccacgtgatgagctgggcgcagcggcagtgagaatgttgcaggagatgcgactgaatcccggcacacccactggcagcctgctgctgaatggcaggctggtggtgcgcgagtcggtgcggcgcattcgcgataatctcagccatgcgccggtccagcagcatggcctctatgattaacacggtatggattaacacggtatggattaacccggcgcgggttaacccagcgttttcagccgcagttccgacggctgaggccgtccgaaacaggaagccctggaacagggtacagccctcatcgcgcagcttagcgaactgctcatcgctctccaccccttcggcagtaatctggatatccagactgcgactcatgccggtgatggcgcggataatcgccagcgcctcgcggctgtcacccatatcattgataaaggatttgtcgattttgattttgtcgaacgggaaagatcgcagatagctcagcgacgaatagccggtgccgaaatcatccagcgcaatctgcacgcccagtgccttgagattttgcagggtacggatattacccagcgaatcatccagcagcaccgattcggtgatctcaacctccagccgcgccggatcgagacccgactctttcagcgcgccttccaccaccggtaccagcgagctgtttttaaactgcagcggtgagaggttgaccgagaccgactgctccccttcccagctcgccgcttcgcgacaggcttcgtagagtgcaaacgcccccagcatatggatcaggccggtctcttcagcgatcgggatgaagtcgttgggcatgatcagcccgcgaatcggatgatgccagcgcatcagcgcctcatagccaatgatggtgcggttatcgccgttggtgatgggctgatagtagagccgcagatgcccgccgctaatcgcatcgcgcagatcgttttcaatcaggcgtcgactgcgcgccacatcatccatctccagcgtgaaatgctcataacggttgcgaccgttgcgtttggcttcatacagcgccatgtccgcacagcgcagcagctgctccggcgtattggtgatggtggtgctgagcgcaatccccacgctgagcccgaccgacagattatggccttcaacgttgaccggcgggcgaatcgcctcaatcagccgctgcgccacaatgctcgcctcttcattactggccaccgaaggcagcacgatggcgaactcatcgcctccgatacgcgccagagtatcctggtcacgcagcgcgttacgcagacgcttagccacactgcgcagcaactcgtcgccaatctggtggcccagcgcatcgttcacatttttaaagttatcgagatcaaggcagagcgcggcggtctggcgctgtatctgaccggcagtgcgcaaggcttcactcagacgctggcggaacagaatgcggttcggcaggctggtgaggttgtcgtggtgcgccatatggtgaatacgggcatcagcagcgcgctggtcagtgacatcttccaccagcagcatcaggtagttacgtcgcgcatcctgaccgttaatcgcggtggcgcgggtatgcagaatgcgttcgccgctggcggtcatcagcaactgctcacgttcatgcatgccctcactgcgcagcgcaacatccgccagattattaaagtaatcgctgagttcgggcgacatacattcatgcgggcgcttgttgacgatcagcgatttcgacaggccaaacagctgctgagtgcggtcgttaaccagcaggatctcgcgggtgatcgcatcttcaacaatcacgcaggagggaatgttggcgatgatattatccaggaatttagagagcgcggttttctgggtgctctgggcttcagccagatcccgggcgcgcagcacctgctgctcctgctcacggcgttccgtgcggtcgcgggtgatcttagcgaagccgaccagcttgccgtcatcatcgtggatcgcgtcgatgaccacatgcgcccagaaggcgctgccatctttgcggtagcgccagccctcatcttcaaaacggccggtcttaagcgcgataccgaggttcgcttccgggatgcggttcagccgctcctgggaactgtaaaacagcgagaagtgctgacccaccacttcatccgctttgtaccctttggcacgctgcgcaccggcattccagttcaccaccacgccgtcgacatcgagcatatagatggcgtaatcggtgaccccttctaccagcagacggaaacgctgctcctgctcccgttgctggctgcggacgcgctgctgtttcggtgcagtcgcgggtgattttagcgtagcccagcagcttaccctgatcgtcgcggatcgtgtcgatcaccacatgcgcccagaaggcgctgccatctttgcggtagcgccagccctcatcttcaaagcggccggtgcgataagcagtttgcaggttctgctccgggacacggttcaggcgatcctgggcgctgtagaagcgggaaaaattctggccgacaatctcttccgccacatagcctttggcgcgctgtgccccggcattccagttcaccacgttgccgtcatgatcgagcatatagatagcgtaatcggtaacgccctccaccagcaggcggaagcgcatctcctgctcccgctctttgcgctgctgctcctgctgctgagtacaatcgcgggttatacaggcgtatcccaccagcagaccggcgtcattgcgtatcgggtcgatcgtctcgtgtgcccagaaagcactgccatctttgcgatagcgccagccttcgctttcatggtgtccggcagtggcagccatatccagcccacgctgcggcaggccccggcggcgatcttcttcgctatacaacagggcaaagctgcagccaatcatctcgtctggcgtatagcctatcgtgcgctgagcaccctgattccagctgccgatgataccgtcaggttttagcatagtgatggcgtaatcattcacgctttgtaccagcatgcgatagatgacctcagagttattatccattgtgattagcctgctgctctgtagccggatgacggcttaggaatgttcttaatagcgtgcgcagactacagccgaaaagagctgagatgacaagcgcattaagaagattaatcagtgtttataaggggtttatcggcagcggcgagtaaatgttcaatgactccgcggtggcggcgcgtcaggcgacccgctcccagcgcgaggagagcgaataacggtgctgccagcagagcattgccggactttggctcatcagctgctggcactcttgcggcgcgacaaacgccgggatcactttctgggccgccgtctgtctgatcagcgccagctgatcgtcgagtggcggatgcacattccacggcagccagcgtgccatgccggattgcagcatctcaaaggcacgagtgccgctggaaacgtgactgctgaagatcagacgaaagtcgggctgatggctgagctgcgccgccagcccgctgtcagccaccgcatccgccgcgacaattaccgtatccggtcgccagcggtcgggtgttgcgacgcgtaataaccgggccagcgccagcatcgccgcggcgggcaggctgttgagcgccagcaactgcgccacctcttcgcgcacctggggacacatcaccaccggcagcccgcgagcgctgagctgcagggccatctcagggccgcgcccgtgcagcggcgcggtgaccacggcgcccccttgtgccgccagggccagcgcgtcgatctgctgcgccagtcgctgattgcggtcgccataggaaccatcggtaatcaacagccgtgcgcgtggcgggcaatcaaacggcaacagcagcgattcgcgactccagtcgcccatataggtgatgccacccgcaattggcagatgaaaccagatcgatcctggcgaatgcccgctgcgaccggtaaagagattcagcggccccagcgcgcactggccgcgcaatggcaggatgcgtcgcgcctgagccggcacgccagcctcgcccagctgctgccaggtaatctcactggcatagaccggcggtgaaccgatgtcggcccagctatccagcgccgccgcgtgatccacatgggaatgggtcaggcagagcgcatcgacctggccgatggcgtccattgcgggccggacgcccggctccggcccggcacctaaatcccataacagacgatatccctctatctccagcaggaaagcggcaggcagttttccgccgacgccgctgatcaccctcaggcttgccatggcaggactccctgcggcagacggcgcgtcagtcgtgaggccagcagcattaagcccagcacgatcccaatcatcaggcatccgaccgccgccgccagcggcgccgatccgccttcatccaggaaaataatggtcgggccaagcgtctgggtttgcgcggtaaccagcagcactgaaacctgtatttcattcagcgcggtgaggaacaccagcagcgcaccggccagcacagaaggcgccgccagcggcagcaggatgtcagtcatccgccgcatcagacccgcgccgcataagcgcgccgcctcatccagtgacggttcgatttgcgcgaacccggccagcgtcggccttaacaccagcgccaggaaattggccagataggccgcgagaataatccacaccgttccgtaaagggaaaatcccagcagcggcagcggtcgcaggaaaaacagcatcgccgctacgccggtgacaatgccgggcagcgcataggtcagctcactggcgaatcccagcccccgcaccagccgggtacgatgccagctgagaaagaaagccaggaacagtgccatgacgctgagcagcagcgccgtcaggccggtgagccacaggctggtaaagaacgcctgccgtatcgccggatagccccatagcgcctgctgaaaattctccagcgtcagggtttgccagttcagagcctgaccgaaaccgcgggttaaggcggtggtgagcaatgcgctgagcggcagcagcaaggtgatcaccatccacagccaggcgatgatttcgcccggcagtcgcgcgcgccgcagcggctggtgccagggtcgtggcgatccgctgacccggacatcgcgtcgtccgcccagccagccgctaatcagcatcccggcgagggtgatcagcgcaatcagcatcgagtagacggcggtattgggcagcgcaccggggccgagggtattgagctgctgataaaccagcgtaatcagcgtcggcacccgcgccggaatacccagcatcgcctggataccgaaattcccgaccgcagcgacaaacgccagcgccgccccggcgaagatcgcggggcgcgccagcggcaggatcaccgtgaacagaatttgccggggtgatgcgccgctgatgcgggccgcctccaccagttcggcggggagtcgacgcaggccagcccgcaccgtgaggaacaccagcggcgcattgtgcagacccagcagcagcaccatgccggtcgcggaatagagcggttgctgaccgggtgccagccacgtcccgcccagcgcattcaccgctgtggccagcagactgcccggtgccagcgcctgtatccaggccagcgcagtcacctgcggcgggatcatcagcggcaggataaaggcaaatacccaggccgctttggcacgcaaatcggtgagcgccaccagccaggcggccaccgttcccagcagcagcgacagcaacgtcgcgctgatgccgatcgccagggtattcagcgtggcactgagtacccgccggctggtcagcaatctcagcaggcgatcgctatccagtatgccatccggtgccagcgcggttcccatcagccgggcaaagggtgccaccgacagcaggccgatcaccagcaccagtatgcccagcaccagcggttccgcccgccatctgcgatgcctggcggcctggcctcttcgccattcgttgcccagcacgctcacgatcagccgccaaacagttcagtaaaggtttcgcggacctgagcatcctcggccaccgcctgggccacgtccggcgtcagcagcgtgatttgctcaatcggcgcaaagccaccgggtgccgccacgcgggcatcgaccggccggttgccctgcttcgccaccagctgctgtcccgcttccgacagcatgaaatcaacaaaggctttggcggccggcagattatgcgccgacttcatgatcgccaccggctcggtcacataggagacgccctcctgcggatagaccagatcgatgggcgatccctgctttttggcgcggataatatcggcatccgtgatcacgccatacttatccatgccgctggcaaccgctttcagcgccggtccattgccgccctgtggcgcaatgccgatggcggccagttgctgatagaacgcccagccaatcgacggggtatggatatcggtatgcagcttatagagcgccgcaccggaatagaggggactggggaccgcaatctggcctctgttttcttctactgccagcgctttccagctactgactggcttcgcacgctgggtgttataggcgatcaccgtggcgataattttggtgccgaaaaaggttttatccacatcgtaataggcaggcttcaggtggctgaccggggcggccggatatgaatagagctgcccctctttcttgagcgcgcccagattgatcgcgtcggccaccagcagcacatcgggtttgacctggccgctcatcatctccgtgcgcagcacgttcatcagttgagtggtgccgttgcgggtccactccacctccaccgccggatacgcggccttaaacgcatcgatggtctgttgcgcaatttcaggtgcctgcgacgtgtaaaccaccagcttgccgccgggcgcgtcggccgcctgcaacagggttgaggccgccaggctcgatagcaacaacagcgcgtgaagcggagtacgaaaagccgttttcatggtttctgaaaccctttatgcaggaagaatccagccgtcatcgacggcgacgccgacggtgtcatccaccgccagtaatgcagcatcattaagcgtcagcgacaggctgacatccggttgattaagcggtcgaaggttgatctgatggtagccaccgcgaaagatgatgcgctcaacgcgggcggcaaactgccgctctccctcagcggcgaggtgaaaactgacgctgtggaagctggctttgccgtgtggcagcgggcgctggtgaggcgagcagcgcagcaaaacccgcagcccgcagagcgtggcggttgcctgacccggatcgagcggctcaatgtcgctgaccggcagcacccgcccctcatcaataaaggtcgccaccatctcattagccggttcgcgccacagggtctgcgggctggcgaaactgcatcactctgccgtgttcgagcaccacgatgcggtcggccagtgccatcgcttcgcgttgatcgtgggtgatatagagtaaggtggcgccactgtggcgatggaagcggcggaactcctcttccatggtggcgcgcagatggacatcgaggttagccagcggctcatccagcagcaccagcgtcggccgtgccaccaggcagcgagccagcgccacgcgctggcgctgaccaccggagagatcggcgggtcggcggtcggcgaagcgatccagcccgaccagcgtcagggcctgggtggtgcgcagttcgcgttctgcgcgcgccacaccgttcaccttcaggctgtagccgacgttctccgcgaccgtcatatgcggccacaaagcgtagttctggaacaccacgccgagctcgcgggcttccggcggcaggtgcagcccgtctgcggcaacctgccgttcaccgatgtggatttcaccgctgtcgagcgtttcaaagccggccagcaggcgcagcagggtggttttgccgcagccagaaggcccaagaacagcgacaaactcgccctggttaatctgtaacgaaaccgcgtccagtaccgggtgcgcgccgaacgctttgctcagtccggttaacgatattgccgccatcttactctgcctttgccgttaacatgctgggcaaaacgctacgacagtttgatgacagcccggtgacagccaggcttacgggacgcgaaagccgggctggcggagcggcatcggggcgtgctcgccccgtggcttactgctgggcggtgagcgccgcaatcggctgccagatctcggttaatgcgccctctttgccggtaaagggatcctgcgtcggcaacggcactttttttacctgctcctgggccattttcagcttcgcgggttcatcgcgcagcgtctccggcgacatcccgtgcggataggcgccaatcaccataaaatcttcgctggcgctgacctgccgatggccgacacccgccggaatcaggactgcatcgcctgcgcgcagggtcaccatccggccactgtcgccgccaaacagcacttccgcccagccttcagcgacgcccagcagttcatgggtattaggatgataatgggtatatgggaagatcggatagcgccaggcgggtggccagccgttctcctcgaaagttttttcaaaccacgcagcgatctcctcctcttccggcaccacacgcggccagataatcagaggtaacgggttattgggtacaccgcccgacgggctggcaagcatcagatgctgaggattgtcagaggccccggccgagaaggtgccagcggcaaaggacatcattaatagcagactggaggatgaggcacgcatacaggttctccgatgtttttctaagtgtggcaaacccgcggcacaatgcaatgtgcgccagacgacacaattgagataattgactgatattgctgactaaagccaaatgtgtcgttaactatagggtcggagtgtgcctgcgcgacggcggatagcggttcttactgcggcaaagtgttgcaaaatgtcaggcggaaagtcacacaggcgcagcagcccgacgccccggtcactgtcgtataaactgttatataaaaaaagcacagatctgtttctgatatgcttgactgttatctgttgtaatagctaacagatgacagtgaggtaacaaatggacgctattaaacaaatcctgattgacgagatcgccctgcttaaccgcgaagaacgtcgcgacaatttgccgcgtttcagcctctcgtttctgaagaaccaccctggtctctgggcagtaatgtacctctgctacggcctgtgcgtggcgctgattttcaccaccgagatgctcggctggcccgccttctggtttgccaccgtgtttgtgctggtgatgagtgtgctgatgctgctggatatcaacccgaaatatcgctttgaagatatcgatgccctcgatctgcgtgtttgctacaacggcgagtggtattacattcagccggtgcgcgaacaggcaatctcacgcattctgtcgctgcctgagacaccagaaacgcgtgaagagcggtatccagcgtctgctgacgcaaaaaggggaagtcgacttctatgatgtctactacctgacctggggccatcaggaagcggcgcgggtttaatccgtctgcccttccgccatcagctgacccagcttcacgattgccgcctcggcccgactatcccacggccaggcggtatttaacctgaagcagtgcctgaactgctcacctgccgaaaatagctgccccggtgcaatactgatcccctgagccagcgcccgctgatagagccgggtcgtattgatgctttccggcagcgtcacccagagaaaatagccgccacgcgcttcgctgaccgtagcctgcggcggcagcaccttcattaacgcctggcgcaccatctgctgtcgcttcgccagaatctgccgcagccgcttcagatgggtgtcgtaacgccgcgtggcaagaaaatcggccagcgccagctgcatcggcgcactggtagagagcgtgctcatcagttgcagccgctgaatacgctgcgcatgctgtcccgccgcgacccagccgacgcggaatcctgccaccagcgactttgaaaatgagccgcagtgcagcacgttcccctggcgatcccaggctttcgccggcagcggcggcgcatcacccgcccagagttcggcatagacatcatcttcaatcatcggtacctgataacgcgccagcagtgcgaccagctgctgtttgcgttccggcgttaaggttacgctcagcggattctgcagggtggtcatcagccagcaggctttcaccggccagcgctgcagtgcttcctccagctggacgaggtcgatgccatttctggcatcgaccggaatcgccagcgccttgagcttaagccgctctatcgcctgcagcgcgccataaaaactcggctgttcaatcaccacataatcgcccggctcggtcagagattgcagactgaggttcagcgcctccagcgccccgctggtgatgacaatttcatccggcgacagggtgatgccctgacgcgcatagcgctgcgccagcagctgtcgcagtgtggcgttgccgggcggcagattgtgcagcgcatcggttggggtcagatgatgagagacgttagccagcgagcgcatcagctggcgctgcggaaagagtgcgggatcgggaaaggcggagccaaacggcacgatggccggatcgcgcgtggcctgcagcacatcaaacacaaagtcgttgatatcgacctgttcactgatcgccacgctcagcggcgcgggtgctaaggcacgcggtgcaacgtagtaacccgactgtggacgggagacgatccagccctgactctccagcaactcataggcatgcagcaccgtcatcaggctgacgccctgctgcgcgacctgctgacgcaatgacggcagacgggtgcccggcagccagatgccggcctcaatctgctgctgaatctcatccatcaatcgctggtatttcgccacgggtgacctctccttgtttgaccgtgaatagtctgaccgcgagactttaccacgcacggcgaccaatgacaggcggcgcgaatcgctttatccgattgcgctgattcttcacggcttcaggcaggtcagatcacagcgacctgcggcgtcagcggctgcccggcttcggcttcggcattaagactcacttccgcaattgcctcttcaatttctgccaccacataatcagccagctccggcacccgctccgggggaaccggcttgcccagcagatagccctgcagcgtattacagcccaggctggtcaggaaggcctgctgctcagcggtttcaacgccttcggccaccactttcaattgcagcgactgcgccagcgccactatcgccgacacgatggtggcatcttctgtgtgatgctgcagctcgttcacaaaggcccggtcaatcttgagttcactggccggtagccgtttcagatagagcaggctggagtagccagtgccaaagtcatcaattgaagctttcaccccgagctgggtcagctcagtcagaatacgcacgctctcatcgggatcgcgcatcgcggtggtttccgtcacctccagcgtcagcagttcggccggaatctgatgtttttccagcgcatccaccaccgtcttcaccagattcgattgctcaaactgcaacgccgacaggttcaccgccaccgaccagtgcggatggccctgcagatgccactggcgcagctggcgacaggcttcatggattacccagttgccgatattgactatcattcctgtcttttctgccattggcagaaatttatcgggcgacagcaggccgcgctgcggatgctgccagcgcagcagcgcctcaaaaccgagaatcggaccgctcggcgcgcaatattttggctgatagaacaggcgcagttcatcatgatccagcgcctgccagagatcgttattcagctgaagctggctctgggcctgaatgttcatagaaggctgaaagaaggtgtagccgttgcggccattatttttggtgtggtacatcgccgcatcggcgttgaacatcagttcgcgctcatccacgccatcgccgggatagaccgcgatgccaagactcagcgataccaccagctcatagcgtgagatatcaaacggacgatccaccgctttgaccagcttatcggcgatggccgccgcatcattgggatcgtcgatctctaccagcagcacaaactcatcaccgccgagccgcgccagcgtgaagtagccggtcatctgctcgctcatgcgctcggtcacgccgaccagcagactgtcgccaatgtggtgcccgaacgcgtcgttaaccgccttaaacccatcaagatccataaacatcagggcaaactgcctctgctcacggttcgctttgttgatcgcctgctccagccgatcctccagcaggatgcggttgggcagccgcgtcaggttgtcgtgcagcgccagctgtgccagctcgcgattggcttcagccagtgaactggcgagaatcgaggtacgcgcctgcatccgcgcatccagcatcgacaccagcaaggtaatgcccagaatcgaaatagtgaccaccgtgaccagaatcgccagccagttgctgttgacgccctgcccgaccggatgactgtagacgggaaactctgccgccatcatgccggtgtagtgcatgccggcaatagcacagcccatcaccaccgatgcgccaatgcgcagcagggtgacccggctggtctgtccttcccgcaggttaaacgccagccacagcgcggtgccagaggcggccagggcgatcgccaccgacagcgctacccagctccatttccagacgataccgggggagaacatcagcgccgccatgccggtgtagtgcatcgcgactacgccgctgccgaggatcagcgcgccgcctgccaggcgcggcaaaggcagatcgccattgcagaccagccacagcgcaaatatcgacgcacaaaccgcgatggccgcagaaaaggcggtgagcccggcgttgtagctcatgaccatctccatgttcatcgacagcatgccgataaagtgcatcgcccagatgccgatgcccatggaaaaaccgccgccgaacagccagaccagcgcaactttgccggttgaatgcaccacccgtcccgccatatctaaggcggtaaacgaagccagcatcgcgacaagaacggagacgatgacgataaaagagtcgtatgaggtcgctaacatagtgcattcccgcgaaagcagagcttgtggttgggcagagggttttaaaattattctcttagttatcggcacagcccggcggttaatgagccgcgaaccctgcatccttccactcattctgagtgatgaaatctatcgttgctgtcagcgctatcagccggacagtgacgccaccggctgtcgcagtgagggaaaactcagcgcctcaacccggtccgctggcgtcggcttgcccagcagatagccctgcaacgcatcaaagcctaagctggtgagcaaatgctgctgctcttcagtctccaccccttccgccaccatgcgcagattgaggctctgcgccagggtcagcatggcgctgactacggtcgcatcttcactgccgggccgcaggcagttgataaagctgcgatcaattttgagttcactggcatccagatctttgagatgcagcaggttggcatagccgatgccgaagttatcaatcgcgacgctgacacccgcctgctgcaattcacgaatgcgctgctggctgaaagcgggatcgcgcatggcaatcgcttcagtgatctccagcatcagcgcgctgcctggcaactggttacgcgccagggtctgcgtcaggatagtcagcaaatcacgctggtgaaactgcaacgcggagagattcaccgatactgtccagtcactgtggccctggctgtgccatatcctgagctgacggcaggcctccccgatcacccagttacccagcgcaataatctgaccggttttttcggcgcgcggcaaaaacagctcaggcgtcagtaaaccgcgctgcggatgctgccagcgcaacaacgcttcgaatcccattaacctggtgccgccggaacagaatttcggctgatagaatagccgcatctgctcgcgctctatcgcctcccacagatcgttcgccagctccagctgatgctgcgtcgcggcgctcatggccggttcaaacaggcaccagccgtttcgtccgctgtgtttggtgtggtacatcgccgcatcagcattaaacaatagctcctgccggttgcgaccgtgcagcggaaagatcgcaatgcccgcgctgagtgaaacgtgcagcacatagcggtcaagttcaaacggcgaactgataactttaaccagtttttgcgccagctggcgggctgcgctgatatcgcactcagccatcagcacaaattcatcgccccccagacgcaccagcagcatcgtgttgctgagctggctgcacagccgttccgccaccgccaccagcaaccggtcaccgacgtgatgtccccatgtgtcattgaccgctttgaagccatcgagatccatatagatcacggcaaagcgatgctcattaagcatcgcctgtttaatggcgagatcgagctgctgctccagcattacacgattgggcagcgtggtcaggttgtcatgcatcgccagctgacgcaattcctggttagcgcgattgaggcgggtcgccagacgcgcggcgcgtagctgcgcatccagcatcgaactcagcagagtgatacccagaatagtcagggtaatcagcgttacccacaccgccaggcccgcattactgacgccgtgcggctgcatcatactgctgtggctgaactctgctgccgccatacctacatagtgcataccggcgatggcgatgcccatgaccagagaggccagcccgcgcatcagcatcagatgatgatcgccctggcgcagatgaaaggccagccacagcgccaggccagaggccgcaaacgcaatcagcacagagagcgccaccagcagcgcattccactccggttgcggttcaatcagcagggcatacataccaagatagtgcatgaccaccacacccgcgcccaggatcagcgtgccgcgcagcagccgctggcgggtgagatgcaggccacccaccgtctggccaaaagccagcacagacgccaggatcgccaccagcagcgagaggatcgtcagtcgcgtgtcatagcgcatcatcatcggcatcatcatcgccagcatcccgataaagtgcattgcccagacgccaatccccattgcgatgccgcccaccaacagccagaaccgggcgctccagccacgggataccgctacccgtccggcagtatccagggctgtaaaagaggcaatgaacaccacgatcagcgaaacgcagatcaggacgctatcccaggtgacaggcaacatgtgtaactcctcaccacccgcggagaaacgggtgctgtgtacagtctgataagtgatctgaaaacacccgatgggtgaaagtgattaaatttcggtattttctggtcctgaaggtcaggcaaaacgcgcccgccgacgctggcaatttataacctgcatcttattaaccgcccccagagcaagccggtaaaccgttattatgtctgattggtacaggaacatatcaccgaagcagaaagcatgccagataccgaaaaaacaaagaattttgttttatcgcctcgtcttcgcgccttgctgttactgggttatcggccggggtgacgttttgattaatcaaaaataaatagcaaggcttcgcgtaacgctttaactgatctatagtaagtaaaactgatataaatcagcattcttaagtctaagatttttcttaagatagcggcactgcctcccttgttattttatttcctttattttgggttgaatcgttaataaacaccgggtgaaaaagcactgactctggataatccgtaaggaaatattatgaaactcaagctttttctgtttgccgctgcaggattaactgtcgctattccgtcattaacccaggcggcgacgacctcgggaaccatcaatgccacgttaaccctgaccaccggttgtctggtgaacggccagtcggctacggcgggcgttaacttcggtaccctgaactttggtagcagcgcagccacgttcgataccctgaacgccacactggtcggtgcggctggtaacggtatttttgtgcgctgcaccaccggtcaggattacaacgtggtggtcaccagcagcaatgctgcgccagcgaccatctacggcaccgcctctgcatcgccgcgttatctggtgctgggatcggataatgcgcagggcatcgcctataccctctacagtgacgcctcctttaccacggcgatcgccaacaatacgcctatcgccgccagcggtaccaccgatccgacgctggggaccaactacgccatctatggccgggtggtcggcggcggctttaaccccctgatccctgccggaacctataccgacacgattaacgttgccgtgaactattaactgctgtcgcaggtaaatacgggtggttctctggcgatcctgcctgacgatcgcatgcggtctgcccctgctgacagggagtatcagcgcctggagtctgccaaccagcaccttccaggttaccgcgtcgattgtggcaggctgcgtgatatccggtaccaataccggcgtctttggcacgcttaatttcggtacgcagtctggcgtggcggcgaataccgtcaacgccagctatctgcagagcacctcgattaatctcgcctgtacaccgggcaccacgctgagcatgagcattaatcagggcaacaatttcaccacgacccgtaacctgaagctgcccaatttcagcaacaccgttccctacacgctctttagcaacgccagccgcaccacggtgatcccggtgaaccaggcggtgccgctgagttatagcaatgccaataacattacgctgccgatctacggtcagctacaactgcccggcactgcgcgcgccggcgtttataccgacacgctgaccgtcaccctgagctggtgaggtgatagaaaacaaggatatgatcatgaagccactgcgcgccctgttgctgctgctaagttccaccctgctctccccggccttcgccgcgaattcggtcatgatctggcccatcgatcccgccattaatcctgaagagaaagccagcgaactctggctggagaatcgcggtaacagcaccaccatgatgcagatccgcgtcttcagctggcagcagaacaatggccaggagcagtatcagactcagcagcaggtagtcgccagcccgccgatggtgcggatggagccaggccagaaacagctggtcaggctgattaaacagacgccgcctgcggccggtaaagaactggcctatcgggtggtgctggatgagatcccgaccccgcgaaatcccggcgagaatcaggccgggctgaccttccagatgcgctattcggtgccgctgtttgtttacggtaccgggctgaacacagacagcgctcgcccggctctgcgctggcaacagatcagcgagggcggcaggcgctggctccagttaaccaacagcggcagcggtcacgcccggttgagcaatgtggcgattggcggtcgcaaactgggcgaaggcttatacggctatgtgctggctgacagctatcaccgctggccgctcacctcgccggtgagcggcgaactcaccgcagaggttaacaagagccagtggcgcagcgctgcccagaagtaagcgctgaatgagaccgttttccctgcatccctgcgcgctggccgtggccagcgtcatttacgctgttacgccggatcctgtgctggcggagacttactcatccctgcccccgccacccagcctgcagaccagcagcaacggtcagcaatatatgctggagctggtgattaaccagcaggagaacggcaatattgtgccggcagagcagcgcgacggtcatttctggattcgcagtggcgatttgcagcgtgccggcctgccagcggataagctgggccagcagccgcaggtcgatgtcagcagcctgcaacccatcaaagtggagtatgacgctgcgcgacagcgtctgctgctgaccgtaccgcctgagtggctgcccggtcaggtgattggcgaggcgaagaacggaccgcgctatccgggccgtaccagcagcggcgcgctgattaattatgatctttacgccagccgcacggataacagtggctcccgcctgtccgcctggaacgaactgcggctgtttggtgatgccggtcatttctccactaatggcgtctggcaacagcagctggaaggcagtacgacttatcaggatgatggctatatccgctacgacacctggtggagcaatgaagatgagaatgcggcggtaagctggcgggtcggcgatctggtcaccgactcgctggcctggagcagcagcgtgcggctcggtggcatccgcgtcggtcgcgacttcagcgtccgtcccgatctggtgacctatccgctgcccgccttttccggtcaggccgccgtgccttccaccgtcgatctgtttattaatggctatcgctccagccaggcgaacgtgcagcctggcccctggtcgatgaccaatgtgccattcgttaacggcgcaggtgacgccgtgatcaccaccaccgatgcggttggccgccgtgttaccaccaccatgccgttttacgtctccagtaatctgctgaaatcggggctgtcggactacgccttctctgccggggcaatccgcgaaaactacggcataaagaacttcgattatggtgaggcagcggccagcggctcttatcgttacggtatgaccgactggctgacgctggagagccacgccgaaggcagcgaaacgctggcgatgggcgggctgggtggtcagctgcgcgtcggcagctggggcgtggtcaacggcgcggtggcgcaaagtcagctcgatggcgagagcggcaggcaatatagctggggatatcagtacaacaaccgctggttcaacatcggcactcaacagacccagcgcagcagcgacttcggcaatctggcgctggtcggcagccgtgccggtagccaggcggatagccgctacgcactctcacgccgcagtgctcagtacagcgccagcgtctcgctgaaccgctttggcagcgtcggtgctgccttcatcgacatcaccgacggtcagggcgatcgcacccggctgtggaacctctcatggagtaaaaatctgtggggtaacagcagtctgtatgtttcggccagccgcgatcagcaggagaaaagctggaccggtgcaatctcgctggtgatcccgtttggcgaacagggcagcgttgccctcagcaacgaacgcgaccagcgtggccgcgacagtcagcgcgtttatgcctcacgcgccatgcccagcgacggcgggttcgcctgggatgcctcctgggcgaatcagagcggagacagcggcgattatcgtcagggcagtctgcgctatcgcaacaaccagattgacacctcggcgggcttctatggcgatgatgataacctcacccagtgggccgatctctcgggtgcgctggtgttaatggacaacagcgtctttgccgctaacgagatcaacgacgcctttgtgctggtgaagaccaactatcccgacgttaacgtgcgctacgagaatcagtcgatgggacgcaccaatcaacagggctatctgctggtgcccgccatcagcagctactacccggccaaatatgatatcgacaccctcgacctgccggcagatatgaccacgccacgggttgagcagcgctttgcggtgaaacgccagagcggctatctgctcaacttcccggtggagaaactgcgctcagccagcgtaatcctggtcgatgcgcagggccagccgctgccggtatcaagcctggtgcagcgtcccgatcatcccaccgggtatgtcggctgggatggcatcgtctggatggaagatctcaccgccagtaacccgatgcaggtggtgacgcccgatggccgccagtgcgaaaccgaactgcgcatcgccagcggtcagccgcaggcgctgaaaacttacggccccctgacctgtgcgctgcccgcacctgccgcaggcagcgccccctctcccgctgaatcttttacgtccggaaaccgaccatgatgaaatctgtaatactggctggcctgctgctgttactgccgtcgctgggctacgcagcctgcgccctgcccgcatcgaccgccagtttcggttcagtcacaacctttgtggcgaacaccaccgtcagttccaccaccacgaatgccaacgtcaactgtggcgcgggtgccgggctgtcgctgctgggcaataaccagatcacctttcagctgacgggcgcgactaatagcaacggcacgcgcggtacgctgaaacgcagcggtgataccggcagcgataacgtgccggtgcggctctgcaccgacacggcctgcgctactgaactgacgattggcggcacgccgtttgtctatggttcgcagaccctgatcaacctggcgggtttgctcggcagccttaacttcgccattccggtctatctgcgcaccgtttcccggtcaggtggtcgccgccgggacgtaccagctgacgctgaatatggctgtgacttatcgcatctgcaccagcgttgcgattggcaatgtctgtttaagcgagcagaacggcagcggtgtcatcccgattaatatcaccgccattctaactaatgactgcaccaccattaccgcgccgaatatcagctttggcagcgcgccgctggtcggcagcttctccgccgtgtcacagaccatcaatgtgttgtgcagcaaaggcagcacctataccgtcgggctgagcaatggcagttatccggtgggcagcgtcaggaatatggcgagcggcgcgaatcggctgagctatgaaatttataaaagtaccaccagcaatcgctggggatcggcaggcactgaacgctggagcagtaccacctcgacggcggtatccacggatggactgacgcgcggttttaactacaccgcgcgcatcctgaccacgcagaacacgccgccagccggaaactacagcgacagcgtggtggtcgatttgtcgttttagagtgaagcactgaccggcgtgccgctgtgacgggtctgatactgcttcaccatccggccaatcagcaacgtgccgattaacccacagactgcggcaaaggtcagccagacgccaggcatcgctttgtcaccggtggcgtgaatcagatagctggagatggcaggcgtaaagccgccaaacagcgccgtcgccaggctgtaagccatagagaaaccggcggcgcgcacttcagcaggcatgatctccgccagatagaccaccatcgcgccgttatagctggcatagagaaacgacagccacagttccgcttccagcaggtgagcgaagctggccgatcccaccagccagtgcagcaccggccaggtggtgacaatcatcagcagggtaaaaatgatcagcagcggacggcgaccgacgcggtccgacaacgcccccatcagcggcagccagatgaggtttgagacaccgacacagagcgtcaccaggaacgcctgcttgtcactcatcatcaacaccgttttaccaaaggtcggggtaaaggcggtgatcatgtagaacattaccgtggtggtgaccaccatcagcatccccgccagcaccagcgcccagttgctggcgactgaccgcatgatttccgtcatgctgggatgatgtttacgtttgctgaacgcctcggtctcttccagcatccggcggatatagaacaggaacggcacaatcagacagccgaccacaaacgggatacgccagccccactccgtcaccgcctctttcgccagcagatgattcagcatcagacccagcagagcagcaaagatcaccgcaatctgctggctgcccgactgccagctgacgaaaaagcctttgcgtcctttgggcgcgacttcggccagatagaccgacacgccacccagctccacgcccgccgagaagccctgcaacagccgtcccagcaggatcagaatcggcgctgccacgcccagggtggcgtagcccggcaccagcgcgatggtcagggtgcccatcgccattaagcccagcgtcagcaacagccctttacgacgaccatgatggtcgatgtaggcaccgaggatgatcgcccccagcgggcgcatcaggaagccggcaccgaaagtcatcagggtcagcatcagggaggcaaacgggtcatcgccgggaaagaaggtttttgaaatggcagtggcgtagtagccaaacaccataaaatcgtacatctccaggaagttaccactggtgacggtgaagatggttcgggcggcacttttcggcggcttttgtaaagagggggtgtgactcataacggcttcctgttgttttttagccgttttagcctgcctgatgcgggattaatgtgacctggctcaccattgcactttacaaatctatgtacataagtaacaaccaattaacaattcagctcaggcagcataagtgattaccctggccctgatttacctgattttatagggctggagagcagccataaaaaaaggcgacctgaacagtcgccttttttctgaaccggataacccgctatttcttcacggtttccatgcccatcagaccaattttcagatagcccgccgtgcgcagcttatccatcacgctcatcagcgtttcataatcgaccgacttatccgcctggaagaaaatggtggtctctttgttgccctgggtctggttagtcagcacgttaaccagcgactccggcgtgacctgatcgttaccgacataaagctgcttatccgctttaatcgacaggtaaaccggcttttccggacgcggctgcggcgcgctggttgaggcgggcagattgacgcgtacgtcgaccgtggccagcggcgcggccaccataaagatgatcagcagaaccagcatgacgtcgataaacggcgtcacgttgatctcatgcatttcaccatccgtttccagatcgtcgtttaatcgcattgccataagaacttaccctaagcgcagtttctgagccgtcgcaggacgcggaacatcagtggcgacggtgcccagatcgatatcacggctctgcagcagcatcacctgagcggcgacatcacccagcgaggctttgtagttggcgatcatgcgggcaaagacgttgtagatcaccaccgccggaatcgcagcgatcaggccaatcgcggttgccagcagcgcttcggcgatacccggtgcaacaaccgcaaggttcgtcgtctgggttttagcgatgccgataaagctgttcatgatgccccatacggtgccgaaacaggccgataaacggcgcaaccgaaccgatggtcgccaggaagccattgccccggcctgcatggcggctgaacgcagcgacgcggcgctcaaggcggaaactggtgcgatctttaatcccgttggtatcttccacgccagccgacagttcaagctcattctgcgcatcattcagcagcaccacactgtggctgtgaccggtaaacgactgggcaatgcgggcggcgtcattcagattgcgggcttcgcccagcgccagatgctcgcgcttcaggcggcgcttagcggcgctgagttcggcatatttgccgaagaagatcgcccaggtcaccactgaggccaataacaggccaatcatgaccacctttaccacgatatcggcatgttgatacatgccccaaacggagaggtccgtttgcatcaaatcactggctaccacgctgcttctccaacttctgattcagggatgcgagacaagcgcgaataatagcaaaacgacggcgaattgatagtagttctcattagtatttacaaagctgatcgccgccatttacccgcaattgaccaggtttaaacacttttgacaaggatgtttcgaaaatgtgaagttgcatgaaaatttattaaaacatcgtttcaaaatgtgatggcattcattcaatcagcattgccgcattttactggcgcgcgttttcactatgctggctccacacggttctctccggttagcccccgacgccggacgccgtcctacctcagcgggagacaaaataatgagaatgacgaaaacatgcctggccagtgccctggcggtgatgatgatgagcgccaccgccacggcacaggtgatcaaagtggctgaagtccagcctgccggttatccgaccgtggtcgccctgcagcacatgggcgacaaactcaaacaggccaccgatggacggctggagatgaagctcttcgccggtggcgtgctgggggacgaagatcagacgctgcaacaggtgcagctgggcgcaatcgacatgatccgtgtgtcgctggcgccagtcacctcgatcgccccggaaaccagcgtgctgaccctgccctacattttccgcgacattgaccacatgcacaaagtgctggatggcgagataggccgcgagattgccgacaaattcgataaagatcccaacgcccgcatggtgttcctgggctggaccgatgccggtgagcgcaacatgatcaccaagaagccgctggcaaaaccggaagatctgaaaggcatgaagatccgggtgcagaacagcgccatctcattggcgacgctgaaagcgatgggcgcgaatccggtggcgatgggcgtcagtgaagtgttcagtgcgatgcagaccggtgtggtcgatggcaccgagaacaacccaccgacctttgtcgcccataactatatgccggtggcgaagtactacaccctcagcggccactttatccagccagagatgatcctgttttcaaaacgcgcctgggatcgcctgaaacctgaggatcaggcgctgctgaagaagctcggcaaagaggcgcaggatgaggagcgccagctctgggcgacctataccgaagagtcgatcgccaaaatgaaggcaggtggcgtcaccttccagcagaccgaccgtgactacttcgtcaaagcgacccagccggtgcgcgatcagtttggcggcaaatatcaggatctgatgacccggatcgctgaggtgaaataacccttccgcgccacactcccgtgtggcgtgcttaatcaggtatcaattatggctgcttatacacgtctgatggatgggctctatctgctctgcatgctggtggccgccgtggcactgatgattatggtgacggtgatcccgatcgggatcttcgcccgctacgtgatgaacggtgcactctcctggccggaaccggtagccattatctgcatgatcatttttacgtttattggtgcaccggtcggactgcgggccggaacgcatatctgcgtttccatggtcaccgatcgcctgtcacccgcccggcagcgcctgatgctgcgcgtcagcgatctgctgatgatcatcacctgtctggtgatctttcaggccagttacagcctgtgcgaagcgatgtgggtgcagacgctcgcttcattaccggcagtgacttacggcgagatgtatctgccgattccgattggcgcgatcttcaccctgctgtttgttgttgagcgattgctgacaggcgatcagagccagcggccgattgtcacgctgggcggcacccactaacgcggagcagaaaaatggatgcattgatcttgataggcagtttgctggtgttgctgatggtgggttttccggtcgcctttgcggtggggctgagcgcctttattggcgcctggtggatcgatctgccgctggaagcggtggtgattcaggtgaccaacggcattaacaaattttcgctgctgactatcccgttctttattctcgcgggtgcgattatggcggagggcgggattgcccggcggctggtcaacttcgcctatatctttgtcggctttatccgcggtggcctgtcgctggtgaacattgtcgcctcgaccttctttggcgcgatttccggctcatcggtggccgataccgcctcgattggctcggtgatgattccgcagatggaggagaaaggctatccgcgtgatttcgccgccgccgtcaccgccagcggctcagtgcaggcggtgctgacgccacccagccacaactcggtgatttactcgctggcgaccggcggcatggtgaccatctcctcgctgtttgttgccggtatctttcctggcctgctgctgggtggctgcctgatgataatgtgcctgggttttgcccataaacgcggctatcccaaaggagaacgtattccgtttcgtcaggcgctgaaaatcttcttcgacgcgtttctggggcctgtttaccgtggtgatcattatgggtggtattctctccggcatctttaccgcctcggagtccgccgcgatcgcctgtatctgggcctttttcgtcaccatgtttatttatcgcgactttaaatggaaccagctgcatatcctgctgttccgcaccattaagactgtcaccatcgtgatggtgctgatcgccttcgcggccggattcggcgcggtgatgacctttatgcaactgccgacgattatcaccgaggcgttcaccagcctctccgataacaaatatgtgatcctgatgtgtatcaatatcctgctactggtggtgggaacgctgatggatatggcaccgctgatcctgatcctgacgccagtgctgttgccggtcgccaccgcgcttggcgtcgatccggttcacttcggcatgatcatgctgactaacctcgggatcggcctgatcaccccgccggtcggtacggtactgtttgtcgccagtgcggtcagtaagcagaaaatcgagcaggtggtcagagccatgctgccgttttacggcatgctgtttatcgtgctgatgctgattacctatattcccgccatctccctctggttaccgcgcctgatgggcgtgatgtagcgtcggcaaaatcgggtccggtggcggacccgattttcatcctgcgaagcactctgataatcaccattgagtctcaaccctgctggtcgtttcgtggtaacgtgagggcttagtcagaagcggcaaaggcgactcatgaccaccagaaaaattgataccacgctcgtcagtgcaggacgcagcaagcgttatacccagggctcggtgaacagtgtgattcaacgggcctcctcgctggtttttgatacggtcgcggagaagaaacgcgccaccgccggtcgggcaaaaggcgaactcttttatggccgtcgtggcaccctgacgcactttgcactgcaggatgcgatgacggagctggaaggcggcgcaggctgtgtgctctacccctgcggcgcggctgccgtggcgaacgcgattctggcgtttgtcgaggcgggcgaccacgtgctgatgagtggcgcagtctatgaaccgacccaggatttctgtactaagatactgactaagctgcaggtttcaacgggctggttcaatcactgcatcggcagtgaaatcggtgagctggtgcagcccaatacccgggtcgttttcctagaatcaccggcctctattacgatggaagttcaggatattccggcgattgtggcggcggttcgcgccaaagcgcccgaggcgatcatcatgatcgacaacacctgggcggccggtattttatttgatgcgctggcgcacggcatcgatatttcgattcaggcgggcaccaaatatctgattggtcacagcgatgcgatgatcggcacggcggtcgccaatgcgcgctgtatcgatcagctgcgcgagaactcctatctgatgggtcagatggtcgatgccgataccgcctacatggcgagccgggggctgcgcacgctgggcacccgtctgcgtcagcatgaagagagcgcgattcaggtggcagagtggctggcagcgcgtcccgaagtggcgcgggttaatcacccggcgctggcacagagcaaaggtcatcagttctggcagcgtgattttaacggcagcagcggcctgttctcttttatcctgcaggaaaaactcagcgcgccccagctggcggaatatctcgatcacttccatcatttcagcatggcgtactcctggggcggctatgaatcgctgatcctggcgaatcagccggaagagctggccgcgattcgtccggcgggtggagtcgatttcaccggtacgctggtgcggctgcatattggtctggagcacgttgacgatctgctggctgacctggacgccggttttgcgcgcctgacgcgttaataaactcaggcaaaagataaacagacgctaaacagaagatgaaccgggtagcggccacccgcagagtttgccgggctgctgctcatttattgttaaaatttatcccagaccgttcaggtcatcagtgaggtcgctgcatttattgcgcagcgccgcgaccgattgcctgaatgcagacggatagttccttgtgacgtgatggaatagcaaatgggtgttttacacgagattgtccacgcgctctggcatcaggattttgccgcgctggcaaatcctgatgtggtgtgggtggtgtacggcgtgatgttcctgacgctgtttctggaaaatgggctgttacccgcctctttcctgccgggcgacagcctgctgctgctggcgggtgcgatggtggcaaaaggggtgatggattttgtgccgacgatggtgatcctcaccaccgccgccagtctgggctgctggctgagctatctgcagggtcgctggctggggaatacccggctggtgaagagctggctgatgcatctgccagcgcagtatcaccagcgcgcctggaatatgtttaaccgtcatggcctgatggcgctgctggtcggccgttttctggctttcatccggacgatcctgccaaccatggcgggcattgcgggcttacagaatggtcgctttcaactgttcaactggctcagcggcgtgctgtgggtcggcatcgtcgtgacgtttggctatggcatcagccaggtgccgttcatcaagcgtcatgaagatcaggtgatggcgatcctgatgatactgccgatggtgttgctgtttctcgggctgtttcggcagcattctggttatctggaaaaagcgtcggcagaaacaggcctgacgtcagcgcgtagcatcaggatccgccgccactcaggcggacggatccgctaccgtctgccgcacacgattcacctcttcccctggcgtcacgccaaaatagcgcttaaattcccgcgaaaactgtgaaggactttcatagccaacccgcaccgccgccgcactcgctttcagtccatcgtgcagcatcagcaatcgcgcctgatgcaggcgatatcgcttgagatactgcaggggcgaggtctgcgtaaccgctttaaagttatgatgaaaggctgaaacgctcatgtttacttccgccgccagcgcatcgacgctgaggttttccgcatagtgattctcaatccgtcgcaaggcacgcgcgatcaggctgaattgcgtctgtcggctcaccagtgagagcagcgcaccaccaatcgggccagtcagcacgtagtagataatctcccgcacgatgtgcggccccagcacccgcgcatcgcgtggctgggtcatcacatcaagcagccgctcagcggcacacagcatcggttccgtcagccacgccgagtggatccccgaggtctgcggctgcggctggaactgatcgtcatcgccgatttcaatcagcagatcctgcaggctggcggtatcgacattaagacacaacccggcaatcggcacctctggcgaggcccaggtttcgcactccaccggcagcggcaccgtgagcatcaggtacttgctggcgtcatactgaaacaccgtgctgccgagatagccggttttgctgccctgaaacaggatcacaatgccgggctgatacatcatcggcgtacggggacgatattgattagcgtaaatcagcgacacattttcgaccggacaaagacggtcgtgaccatgggtcattaatgtgacgacctgctgcgccagccggtgacacagggcatcgtgcgccatagcgactccttttacgggcaaaaagccagtgtgccgtgcgaatgcctgaatcaccagcagcctggagaatcaggcaagaaatttaccggatcgggcatggcggcagaaccactgttgttgcctcagctaagcaggctgagaattgttggctagacttaagcacagtgaaatctcacggattaaccgcaacggaaaggagcaactatggcagaccaacccattatcaaactgcgcgatggcaatatgatgccgcaactcggactcggtgtgtggcaggccagcattgaagatgcacgtcatgcggtgctgaaagcgctggaggtcggctatcgctcaatcgataccgccgccgcctataagaatgaagaggcgattggccaggcactgcaggaaactgacgtgccgcgagaagagattttcgtgaccaccaaactctggaaacgacgatcagcagaacgttcagcaggcgatggaaaccagcctggagaaactgaaactggagcaggttgatctctatctgatgcactggccgtgcccggaaaaagacaattatgtcgatgcctggaagaagatgattgaactgcagcagcaggggctgaccaaaagtatcggcgtctgtaacttccatgaggcgcatctgaagcgactgctggatgaaaccggtgtcacgccggtggtgaaccagattgagctgcacccgatgctacagcagcgcacgctgcatgcgtggaacgcactgcatcagatccagaccgaatcctggagtccgctggcgcagggcggcaaaggggtcttcgatcaggagatcatcaagtcgctggcgaagaaatatggcaagacgccggcacagatcgtgatccgctggcatctggatagcggcctggtggtgattccgaagtcggtgacaccagcccgcattgaagagaactttaaggtgttcgacttccgtctggacaagcatgaagtgagcgatattgcgaagctggacagcggcaatcgtctggggccggatccggaaacctttaactaaggctgggcgtcaccaggtgagctcaccttatctgccctgcggctggggcagctaacgattaacgcggtcaggcgggctctccctgcctgaccgcgctgttatgcgctgggctgcaccaccagctgaccggcagtaccgcggtcggccagttccagcgtctgactgtagtagacgaacgggaagtgatctgacgaactttgcgggaaagtgaccatcagttccacgctgccatcgacccacaccgtatctttccagccacgatcttcgcccatcggctgtgcaccattcacacttttaatcaggaacatcacgccctggatatgcagcgactgtggccggtcagcatgcaggatccagcgctcaaaggtgccctgctgtgccgtggtgtcaatgcggctcatatcccagatcgcgccgttaatgcccggcatgctgtcaccgatgcggaattcacgggtgcgaaccgccacgccatccagaatctgatcggccagcagccgcatcggcagattatccgtcaccagcggcagcaagccggttggccgcagcgtcaggatcagggttgacgtcagaatggaggatggctcaaagaagccgcgcagccgatccataatgcccgccgccgtacctgcggtaatcgacacttcatcgccctgcgacatatccaccagcacttcgcggcgttctcccggcgccagtgacaggcgctgcaccgcgaccggcgcaggcagatagccctgatcgctggcgatgaccataaacgggcgattgtcgctgagcaccatctcatagcggcgcgcattcgaggcgttcagcagacgcagacgcacccagccgcgtgacacctccacaaacggattgcgtacgccattcaccagcagcgtgtcgcccaggaaaccaccatcctgcggcgggtcatagaccggcgtggcaaagttatcgagccgcttgtcctgaatgataatcgggaagtcatcgacgccgtaatgcttcggcaacggcagctgcctgccaatatcatcttccaccagccacatccccgccagtccgttatagatgtgcggagccatgcggttcggcgtgttggcgtgataccagcaggttgaggccgcctgacgaatcggcagcaccggcgaccagtcgacaccggctgacatcatacgcggcgcgccacccatcagcgcgcccggcaactgcaggccgctgatagtcatggagaccggctcgttcagacggttgctgtagatcagcttaacgtcatcgccgctgtaaacccggacggtcgggccaagatagaggccattaatgccccacaccggcactttgttgttgtcgccattaaaagaccagtggctgcgctgcattgtcaggaacagcggctggccgcgacgggattccagcaacggcggaaccggaagtggcgtgtcgccattagctgaagaagcggcacgcgccgcatgaggtagtacactggcgctaagcgccgctccggcagaaagctggatgaactgacgtctgctgaaagacataaaacttctgaccctttacgcgtggcgctaagcgccgaccctgtttttattgatctgtttttgctgtgctgcgttcacggcgggcggacgtgccccgccgtgcggcatccctgcaggatagttcggcgaatggttcgccggtcagatatttccgtttttttcgcgttctgcgacttcggcgttcagctcttccagctttgccgccatcagtttcgcgacagtgggtcgccagcttacgcaccgacgacgactcgaaagcctttacatcaatcggtggcagcatctcaacgattaccagcccgtttttccagcgattgaggttgatcttgccatgcgtgttagagaccacaatcggaatgatcggcacacccgccgccacagcggcgtgaaaggcaccggttttaaacggcagcaggccacggccacgactgcgcgtcccttccgggaacatccagatggagatgcgcttactgttaaactcatctaccagctgacctatcgtgccgcgtgcttttgcacggtcatcgcgatcaatcagcaggttaccggtcagccagtagagcaggccaaaaaacggcacccacaacaggctcttcttgcccaccgtcaccgtacagggctgcaccattttagccgcggtgaccatgtcgtagttgttctgatggttcgcgatgtagatcgcattaccataattctcagcaccttccggtctgcgcagttctactgtaaggccaaataccgtcgacagtttgccgaacagatggccaaatgtggcgacgtgacgcggattgcgcggtgaaaacagacaccagatacagccagatatacagactaagatcgaatagatgaccacaataatggcacgcagaatcagtaacatagttccctcattgagccacggctgacgcggtgtcagccgggtagtttacgcttcgctatccgggctcgccggacgcgcaggcgcatccagttcaacacgatcaattttttgcaggccgcgcggtaacagcgtaccgcgacgtccgcgatcggcgcggaatttttgtagctcttcactgcgcagcagcattttacgcttgcctacgtgcagcgtgatagcgctgcccggcggtaaaatcatcagccaggccagtttgtcctgaccggcggccgcttccgcggatggaatcgagatgattttgttgcccttgcctttcgacatctgcggcagctccccgaccgggaacatcagcatccgtcccgcctgggttatcgccagcagcatgtcatcttcatgatggacggccatcggcgtcatcacgcgggcgttttccggcagcgtcagcagcgctttaccggcgcggttgcgcgacaccagatcgctgaaggtacagataaagccgtaacccgcatcagaggccatcagcaggcgctgatcatccggctccatcagcacctgttcaactaccgcacccggcggtggcgtcagcttgccggtcagcggctcgccctgcccgcgcgcggaaggcagcgacgttggatccagcgtgtagctgcggccggtggagtcgataaaggccaccggctgattgctcttgccgcgtgccgcagccagatagctgtcgccggctttgtagctgagtccggctggatcgatatcgtggcctttggcgctacgcacccagcccatctgcgacagcacaatcgtcaccggttcagacggcaccagctcggtttcgctcagggctttggcttcttcacgctcacgcagcggcgaacgacgatcgtcgccgtaactggcgctgtcagcctgtaactcttttttcagcagggtattcatcttgcgttcagaggccagcgtggcctgcagctgatcgcgctctttttccagctccgcctgctcgccacggatcttcatctcttccagttttgccaggtggcgcaacttcagttcgaggatcgattcggcctgggtttcgctgatgccaaagcgtgacatcaggaccggcttaggctcatcctcagtacggatgatctcgatcacttcatcgatgttcaggaacgcaaccagcaaaccttccaggatatgcaggcggcgcagcacgcgatccaggcggtgattcagacgacgtttgaccgtatcgcggcggaacaccagccattcggtcaggatctcatgcagatttttcaccgccgggcggttatccagcccgatcatgttgaggttaacgcggtagctcttttccagatcggtggtggcgaacagatggttcatcacctgatcgagatcgacgcggttggagcgcggaacgatcaccaggcgggtcgggttctcgtgatccgattcatcacgcagatcctccaccatcggcagctttttattgcgcatctggttcgcaatctgctccagcacgcgcgcgcccgacacctgatgcggcagcgcggtaatcaccgcctcgccctcttccttcttccagactgcacgctgacgaatcgagccgcgaccggtctgatagattttgcggatctcgtcacgcggcgtgatgatctccgcctctgtaggataatcaggcccctggacaatatccagcagctgttccagcgtggttttcggcgagtcgatcagcgcgatggcggcctgagccacttcgcgcaggttgtgcggcggaatatctgtcgccatacccacggcaatcccggtggtgccgttcagcagaatattgggcaggcgcgccggtaacatcttcggctcctgcagcgtgccatcaaagttcggctgataatcgaccgtcccctgacccagctcacccagcagcagctcggcatatttcgacaggcgggattcggtgtaacgcatcgccgcgaacgacttgggatcatccggtgcaccccagttaccctggccatcgaccagcggataacggtaggagaacggctgcgccatcagcaccatcgcttcataacaggcgctgtcgccgtgcggatggtatttacccagcacgtcacctacggtacgcgccgattttttgaattttgcgctggcgctcagtcccagttcggacatggcgtagacgatacgtcgctgaaccggctttaatccgtcgccaatgtaaggcagggcgcggtccatgatgacgtacatcgaatagtttaagtacgcattctcggtgaatgtgtgcagggcaagacgctctgcaccatcctgagtcagttcactcattaatttctcatcctcacatcgtggcccacaacggcgggacacccggcggtggtttggcgaggatagtaccttattcgctggtgttagtcacaggggaagcgcgggagagcaggcgtcccgccgcgcgattttatgtgccggaggcacgccggattcagaccggcaagtgtctgacctgtctgtggaagtggctcagggctttgcacccatccactggcgggcaatgtcacgatattcgccagtggcggtgctgagatgcagccactgatcgacatagagcttccagctgatgtcgtcacgcggaatcatgtaagccttctcgccatactgcagcggtttgtcgggattgatcgcgcagagcgtcgggtaatgctgctgctgaaaacgcgcttcagaggcatcggtgatcattacatccgccttgttgtccaccagttgccggaagatggtgacgttatcgtggaacagcgtcagtgaggcctttggcaggtggctgtgcacaaaggcttcgttggtgccgcctgccggttcaatcagccgcacgtcaggccggttaagctgttcgatggtctggaagcgatctttatcgctgcagcgcaccagtgggattttgccatccacatccagcggccgggcgaaccaggcggtctgctggcgtttcagcgtgacggagacgccgccgacggcgatatcacactgctttgccagaaaatcgggcatcaggtttttccagctggttggcacccactccactttcgcgccgagcgaggtagccagcgcgttcgccatgctgatatccagcccttcatactgaccatcgggtcgcaggtagctgtaaggcttgtaatccccggtggtgcagaccttaagcgttttagaactgaggatggtgtcgagatgagattgtgcctggacagcaccggtggccagcagcaaagagaggacaatttttttcattttgcgtttttctataattgtttcacagtgagtttgcctgccgatggtgccataaaccggcgcattgttgcttccacagcaaaagtgttgtgatcaacctcccatttttctgcgaccgcagcgcgcgtaagctaagcgccatattcaggaaatgaggcaaacaattcatgagcaagattttaattatcgatggcggcaaaacctttgcccactctaaaggcgaactgaaccacacgctgaccgacgttgcggccagccagttgcgtgacatggggcatgaggtgtctgtgaccctggctgacagcgactacgtggtcgccgatgaagtgcagaaatatgtcgatagtgatgtggtgatttatcagatgcctggctggtggatgggcgagccgtggaccgtgaagcgttacatcgatgaagtctttaccgaaggccacggctcgctctacgccagtgatggccgtacccgtttctgatgcggcgaagaaatatggttccggcggtctgctgcagggcaaaaaatatatgctgtcactgacctggaacgcgccgctgcaggcctttaccgacccggagcagttctttgaaggcgtcggcgtcgacggtctttatctgcacttccacaaagccaaccagttcctgggcatggaagcgctgccgacctttatctgcaacgatgtgattaaagcgccggacgtgccacgcgatattgccgcttatcggacccatcttagtcgcgtttttgcgtaagatggctgggggacaccccctattttcccacgaaagaggaattcgcgaatgttaacagtcgttgctgaaatttgtgtcaaacccggtcgccgtcaggccgtgctggatgcggtgaaaaaactgatcccgctggttttagaagaagaaggctgccatcagtatgacgcgctgctggaccatcaggcgcaggtgccgtggaagcagaactcgccggactccatttttatgctggaacagtgggaaacgctgcgtcatctggagcagcatcagcagatgccgcacatggatgcgcatcgcgccatcattaaagatgatgtggtggatgtgaagattctggtgctggaacccagcgcctgattcgtgctgaaggcttaaccccttttcggtaaacggggtcaggctgctgacaacctcaaacctgagtgcctctggcagcaatgaattagctcaacgcgaagggaacacggtcagaagaggaaagcgtcccgcgccagggatggcgcgggtagagcgaccagggactggcttgagcgcctttccgatctgaccgtgttccctgtgcaagcacaatctcacagcgaatccggccagacttgccagcatctccaaacccctgccctatgacaggggttttttattatggcaggagagatcatagcagctgacgccgatcaatctcggtgcggagaaaatccaggaagcagccgatacgcgaagagagcgtggtgttgcggtaatagaccgcatgcaccggcaaccgcagctcgcgggtttcagcggggagaaccggcaccagccgtcctgccgcgcaatcttcccggctgacaaagtcggagaggcgtgcgatcccctgtcctgccagcgccagttgccggatggtttcgccgctggaggcagagattgtgggcttaatgcgcatgaaatcgccatcaggctgccagatcggccagacgttgtgcgcctcaagatggctgaagccaatgatttgatgctgcgcgagatcggccacgctctgcggggtgcccgctttcgccagataggccggactggccatcagccggatcgcactgctgccaagcatccgggcgcgcagcgtagagtcgcgcagtttcgccgatgcgaatggcaatgtccgtttgctgctccagcagatcgatcaggatatcgtcggtattcagttcaagctggatcagaggatagcgggcgcggaaatcgtccaccagcggcacaatcacatgcagcataaaaggggtggcggcgtttacccgcagccgccctgacggcatctcgcgccgcagggctatctgctcttcggcctgctcaaccgaggccaggatctgtcgcgcatgctccagaaaaacctgtccctcttcggtcagcgccagccgtcgggtggtgcgatgcagcagagtggtctgcagcttgctctccagccgcgacaacgcccggctgatgcccgaactggtctgcgccagctgggatgccgccgcggtaatggaaccgctgtccaccaccgccacccaggcgcgtaattcttccagggtaattttcacaaggattactgtctctgctctgaatctgccgggttctccggggatgtgctggctgaagcacaaagagaacaggacgctttcgcgtcctgtttttttacacttcgatatcggccttgtcgcctttttcctgcaaccagttacgccggtcttcggaacgtttcttcgccagcagcatatccatcatgcgcagcgtctgatcgatatcctcttcactaatggtcagctgtaccagacggcgggtattcggatccagcgtcgtttcgcgcagctgtaaggggttcatctcgcccagccctttaaagcgctgaacgttaggtttgccctttttgcgtttcagctgctccagcacgccctctttctcatcttcatccagcgcgtagtagacctcttttccgagatcgatacggtagagcggcggcatggcaacatagacgtgtccgtttctgaccagtgaacggaaatgtttcacgaacagggcacacagcagcgtggcgatgtgcagaccatccgagtccgcatccgccagaatgcagatcttgccgtagcgcagctgtgaaagatcttcgctgtcgggatcgatgccgatcgctacggaaatatcatgcacttcctgcgacgccagcacctcatcggaagagacttcccaggtgttcaggatcttgcccttaagcggcatgatcgcctgatattcacgatcgcgcgcctgcttggccgagccgcctgccgagtccccttcgaccaggaacagttctgttttattcagatcctgcgcggtgcagtccgccagtttgcccggcagagccggaccgctggtgagctttttacgcaccacttttttggctgcccgcatacgtcgctgggcgctggagatcgccagctcagccagttgctctgcgatctggatattctggttcagccacaggctgaaggcatcttttaccacgccagagacaaaggctgcgcactgacgtgaagagaggcgctctttggtctgcccggcgaaactgcggatcctgcatcttcaccgacagcacataggcgcagcgatcccagatatcttcagcggagagcttcacgccacgcggcagaatgttgcggtattcgcagaactcgcgcatcgcatccagcagcccctgacgcaggccgttgacgtgagtcccgccctgcatggtcgggatcaggttaacgtagctttcagttaacagctcaccgccttccggcagccacaacagcgcccagtcaaccgcttccacatcgccagcaaagctgccgacaaacggtttttccggcagcgtcggtaagccattcaccgcttcgcacaggtagtcagtcaggccatcttcgtagcaccaggtctgttcggtattgttcagcttgtctttaaagacaatctcaacgccagggcagagcaccgctttggctttcagcagatgtgataagcgtgacaccgaaaaacgtgggctgtcgaagaagctttcatcgggccagaaatggacgcgcgtgccggtgttgcgtttagccaccgtgccggtaaccgtgagatcctggactttgtcgccattctcaaacgccatgtcatagatttcgccattacggcgcaccgtgacttcgacgcgttttgacagggcgttaaccaccgagataccaacgccgtgcaggccgcccgagaactgatagtttttattggagaacttgccgcccgcgtgcagacgacacaggatcagctcgacggcaggcacgccctcttccgggtgaatatccaccggcatgccgcgaccatcatcaataacttccagcgactggtcagcgtgcagaatcacttcaacccgcttcgcgtggccgcccagcgcctcatcgacgctgttatcaatcacttcctgacccaaatggttgggtcgcgtcgtatcggtgtacatccccgggcgacggcgaacaggctcaaggccagtcaggacctcaatggcatccgcgttatagttagattgactcatcgtaaatgtctgattagaagggtgaaatggggtgcgatttccgcattactcagggatgattcagaccgagaaagtccagaatctgcgggaaatggcgctcgaatccagtaaatgcatgatttccgccctcttctaccgtgtgacggcacgcgctgtaatagtcgagcgcctgacggtaatcgagaacttcatcgccggtctgttgcagcagccagagtaaatcgggcgcttccagcggttcaatctgcattactttcagatcgtaaatgtggcgtgactctaacacatattgctggccggtgtagggattctgattttcgcccaggaaatccgccagcagctcaaaaggccgcaccgcgggattgacgaccacagcaggcagcataaagcattgcgacagccaggtggcgtaataaccgcccagcgacgagcctaccagccccagcgtttcgccactgcggctcagtaccagatcttccagcattgcggcagcatcggccggaaacgtcggcagctggggcacgatcatttcgatctccggatgctgcgcctctaaccattgccggaaactgcgtcgccttagccgactgcggcgagctgttaaaaccgtgcagatagagtaatgccgccacgcgtcagtatccttctgagtctaaatcgggacgaaaagcgtcggtgtcgagccggttaacctcggtctcaaggccgccatccggatacagcgtgaaccagcgccagcctggtgccacggtatcgatcgtaaagctggtgcagtgcggtttgaactgaacgcaggttgaaggggtggccagcacacgacgaccgtgccactcaacatccagctcctggtgaatatgaccacagaccagcgtccgggctaacgggtaatgctgtaacaccgcatcgagctgatgtgagttgcgcaggctgtgctgatcgagccaggtacagccagaggccagcggatggtggtgcagcaggaccagcgtatgacgttgcggatagcgggccagcgcgttatcgagccactccagctgataatcgctcagcatcccgtgcggcacacccgagacctggctgtccagcaacacaatttgccactgctcacccaccagcacctgtttgtgggcattgatatgagctgctgccagcgtgtcgaacatcgcgggctgaaaatcatgattaccgggcagccagacgcagggccgcggcaaacgtgagatgccctcagcaaaatgctgataggcttcgatagagtgatcctgggcgagatcgccggtggcgataatcaggtcgtagtcgcgatgttgcgcaataatcgcatccagcaccgctttatagctcgaccaggtgttcaccccaagcagcgattcatgttttcccgcgaacaggtgggtatccgtgatttgcaaaatcctgatttcggaaccgttcgctgcaggaagagttagcaggctatccaaagcgtttccttcgtctccacgccatttactgcattatacgcatcagcagaccggaactgccatcgcaccatgtgccaggcagtagcgcagccagtctgcgagaaactggtttatctgatgtttttcatcgcgctgatgcaattttttattgggataatcatagcgcgctttgaaacgatagatctgttgagttgaacacacttcggcgaccatcgcatcgtgatagagccttaccgacatcgagggcagactccagtaactcacggcaggcgcgacctggcggatctccaccagcgtggtgtagcgtgtggactcctggatcgtcagctgataacgggcgccactcacctgatagatcaccgattctcccgcctcatcgttacgcggcagcaggcggcgtaactgggcgaaattggtttcgcagagccgcatcatttcgggaaagtcaggggtatagcgctgtttcatttttgtatccactcttcgcgtagtttctcatggtgcaacgccagccattgcagggcgatgacagacgccgcattgtcaattatcccctcttccacccagcggtaagcctgttcgcggctcaccacatggacaagaatatcctcattctcttcctccagaccatggcatccctctgcctggctggcatccacttccccaatcagcaccgacagacgtttcgctggtgccgccagggctggccagatagttaagcatgggcttaatccggccgacctctaatcctgcttcttcaacggcttcacggcgcacgacctgctcgacagattcaccgggctcaataatgccggcgaccatctccagcagccagggcgaagcactgctgtcataagccgggatgcggatctgttcaatcagcaccacttcatcgcgtaagggatcataaggtagcagcacggcggcatgtccgcgctcaaaaacttcgcgctgtacttccccactcatttcgccgttaaactggcggtggcggaagcgataacgtacgacggaaaaaaaaccatcatagacggtttcgcgtgcaataatttctacatcgttttttgtgaaagtcacaggggattttttttcttccggcatcatcgggttccttatgcagattgaggtggagcgaaaaaagcctgtaaccgtgctccatgtaagtggttctttctgaattatttacgtaaattagggggagaaggcacgttcagccaacttatctcacagttgccctctgctagaatcggcgataattttttggcttacccggcagcgcacccactgcaatttgctgcaacaaaaggaatgcaaatgaaaaaactgctcccattttttattgggctgagcctgggcggtttcagcttcgccagccaggccgaagacctgcttcaggtttatcaacaagcacgtctgagcaacccggatctgcgcagcgccgctgccgatcgcgattctgcctttgagaaaatcaacgaagcgcgtagcccattattaccccagctcggcctgggtgcagactacacctataacaacggctatcgcgacagtagcggtctccattccaacacgaccagcggctcgctgcaattaacccagactattttcgacatgtcgaaatggcgcgcactgaccctgcaggaaaaagctgccggtattcaggatgtggcctatcaggtggcgcagcaggatctgattctgaacaccgcgaccgcctacttcaacgtgctgaaagcgattgataccctttcttacaccgaagcgcagaaacagtcgatctatcgcgagctggatcaaaccacccagcgctttaacgttggcctggttgccattactgacgtacagaacgcccgtgcgcaatatgacagcgtgctggctaacgaagtgaccgcgcgtaataacctcgataacaacgtggaaacgctgcgtcagatcaccggcatggactacatgtcgctggcgtcgctgagcattgatcgcttcagaaccgataagcccgaaccggtcagcgcgctgcttaagcaggcggaaagccgtaatctgtcgctgctctctgcgcgtctgaaccaggatttagcccgtgagcagatccgctccgctgaagctggtcacatgccgacgctgggtctgacggcctctaccggcatgtcgaaacagcaaatatggcggcagccgtgcgaaccagagccaggggtctactgactccattaccggttctaaccaggtgggtctgagcttctcactgccactctatagcggcggcagcgtcacctctcaggtgaaacaggcacagtacagcttcgtcagcgccagtgaatcgctggaaagcgcgcaccgctctgcggttcagacagtacgatcatcgtttaacaacgtgaatgcttctatcagcagcatcaacgcttataaacaggccgtggtctctgcgcaaagctctctggatgcgtcagaagcgggctatcaggttggtacgcgtactatcgttgatgtgctggatgcaaccaccgtgctctacaacgctaagcagcagctctctgatgcgcgctatagctatctgattaaccagctgaatatcagctatgcgctgggtacgctcaatgagcagagcctgcagaaactgaacagccagctgggtaaagagatcccgacctcaccggaaacggtagcaccggaaaatgcacagcagaccgcgcgcgtggatagcggtccggcagcaaccggctcttctgaggcagcacgtcctgcggctcgccacagcagcggtaatcctttcggtaattaatgagcggacgggctgctttgcggcccgtctctctgttgaacgtataactaagtaaagatccctgttgtatcaggcctccagcttcaattttacccccccatcccctattctatgcgctacctttgggcacaggataatcataatgaaacgcacaaaatctattcgctatgccgcttttcgcaaaagctggcaggcacgccatttaacgcccgttgctatcgccgtttcggcggtatttatgctggctggttgtgaacagaacgacgaaacagtttcgatgtaccagaatgccgatgactgttcaaaagccaatccgggccagagtgcgcaatgtactaccgcattcaatgaagcgaaaaaagaggcggaacgcaccgcgccaaaatatgccacgcgtgaagattgtgtcgctgaatttggtgaaaaccagtgtcagcagacaccggctcaggcgggcgtgggcaccactaatgccgaatcgcagcagagtggcggcagcttctggatgccactgatggcaggttacatgatgggtcgcatgatgggcggtggttcgggctttgcacagcaaccgctcttctcaccgaaaaatgcccgcagcccggccaatggtcagtttgttgatgcatcaggccgtaattatggtgcagcaacatccggcaaaagcatgaccgtgccgaaaacggcgctggcaccaaaaccggctaccacctccaccattacccgtggtggctttggtgaaaccgtcgcgaagcagaacagcatgcagcgtagcagcgccagcggcacttccagccgctcaatgggaggctaacgccccgatggaacgcattgccatttcagagcgcccaggctggcgcgaaaaagccaccgagttcggttttcgttttcacaccatgcatggtgaaccctactggtgtgaagatgcttattatcagttcacgctggcgcaaatcgagcatctggaagaggtgaccgctgaattacatcaaatgtgcctgcaggtggtggaaaaagtggttaacagcgaagcgttgctggctaaattccgcattcctaaacacacctgggactttgtgcgcgattcatggcatcagcgtcagccttcgctttactctcgtctggatctcgcctgggatggcaaaggcgatgtaaagctgctggagaacaatgccgatacgccgacctcgctgtatgaagcggcatttttccagtggctgtggctggaggaccagcttaacgccggtcagctccccgcaggcagcgatcagtttaatagcctgcaggaaaagctgattgaacgcttcgccgcgttacatcagcagcacggcttcaactggctgcacttcgcctgctgccgtgacaccgacgaagatcgcggcaccgtgcaatatcttcaggattgcgccaccgaagcgggactgccgagtgagtttctctacatggatgaaattggactgggcgagaaaggggaatttaccgacgcccaggatcaggtgattagcaacctgttcaagctctatccgtgggaattcatgctgcgtgagatgttctccaccaagctgggcgatgctggcgtgcgctggctggaaccggcctggaaaagcatcatctcgaataaagccttgctgccgctgctgtgggagatgtttccgaatcaccctaacctgctgcccgcctggttcgcggaagatgacgtgccgcacatggacaaatatgtggtgaagccgctgttttcacgtgaaggtgccaacatccgcatcgtggaaaatggtcaggagatcgcccgcgtcgatgggccgtatggcgaagagggaatgatcgtccagcagttccatccgctgcctaagtttggcgacagctatacgctgatcggcagctggctgattgacgatcaaccggccggtatcggcctgcgggaagatcgcgacctgatcacgcaggatctttcccgtttctatccgcacgcttttatcggttaatgcaccgcgataataacaggccagcttctggcctgttttcttctggcttccctaacctacctgaaccgacaacatgctgatcgcacccatctccatgccatcaaccggaatgctgatggcgtcatccggctgacgtgcgccaagtacatagagcagcggcagatagtgctcaggtgtcggattagaaagcgccgcaccaggatgatccataaagttaaccagcggatgagaagcagcatcgctctgcaccgccaggttatcgcggacgaactgttcaaaactgctggcccatggataaacttcgttgttgccatcccagcgcactttacgcaggttatgtaccacgttgccgctggcgacaatcatcacgccctgattgcgcagtgcagccagtttctgacccatctcaaagtgccatgccgcaggtttggtgccatcaatgcttagctggaccaccggaatatcggcctccggatacatcttgatcagcacaccccaggaaccatgatccagtccccactcgtgatccagcgtcaccgcaacgggcgctaactgctccaccagctgctgcgccagtttcaggcgatcccggagccggatagcgcgtatcaaacagcgcctgcggaaagcccccaaaatcatgaatggtctcaggctgtgccattgccgtcacggcggttccgcgcgtataccagtgcgccgaaaccgcaataatcgcgcgtggacgtggcagagtatcgcccaggtgacgccacgcggcggtatagcgattctcttcaagggcattcatcgggctgccgtgacccaaaaacagcgctggcattcgtaactggctcattcgtgatccccgggatcgagtatttgatagccattacgatacgcgcatccgctgctttatcacgcggataaccatgatggtgatcatcaggaaatttgaatgaaatttaacgtggcaggtttaacagcgtttcgacatgaaggaaagaggagtagtcagcggtcaggccgcgccattccgggtatcaggaagaaaaacaggcccggggggcctgtttatcgcggcagccagattagctggcgtggcgtgtttcgtgcgcgcgacgccaggcgatcagatcttcgatggtcaccaccggcatgttgtgctgacgggcgaacgcaatcgcttctggcgcatgggccatggtgccatcgtcgttggtcagtttcgcacagcacacctgcgggcttaaagccggccagggtgactaaatcaatagtcgcttcggtatgcccgccacgggttaatacgccgccttcgctggcacgcagcgggaagacatgaccagggcggtgcagatcggtgggtctggcattgtcggcaatggcggcgcggatggtggtgatacgatcctgcgcggagacgcccgtggtgacgccttctgcggcctcaatggtcacggtgaagccagtgccgaaagagctggtgttgttttccaccatcattggcagatcgagctgctggcgacgcgcttcggtcaggcaaaggcagacgatgccgctgccgtgacggatagtcagtgccatctgttcaacggtcatggtttctgcggcgaagatcatgtcgccttcgttttcgcgattttcatcgtcgagtaccatcacaccgcgtccctcacgcagggcggcgatagcacgttctacacgctgttcaggcgtgccaaattcagaaagtagcgtctgattcatggtaataaaaaccttaaaatgtatgggttaccagaatcagggcgtgcttaggagtgacgtcaaaaagacgtggcaataacgtgaagcagacacaattgtccgacagatgtcgttaccctctcccatccggactgtaaccgtcggccccggaattacaccggatctgctgacctttacctctcttttcattaagataaagcgctcgcgggctttcagccgaagctgatttaccgccggtggggaattgcgccccgccctgagaataagcactttaactataacgccgatcgtttgaggcggcaatcatcaatagcgcaattgcttttgcatttcctgcgttaccgatttgaggtttatccttttcatttctggcattacacttaacacttattacgttggtaaacacgctgacacagctccccgtaaccaggaaatcatcatgatcgacacgaaaaaaattgaacaacttgcccgtcaggttcacgaagcgatgcctaaaggtgttcgtgagtttggtgatgatgtcgaaaagaaaattcgtcaggttcttcaggcgcagctgacccggatggatctggtcaaccgtgaggagtttgatgtgcagacgcaggtattactgcgtacacgtgagaagctggcggcgctggagcagcgtctggcgcagctggaaagtcaggggtcatcagccggtacgccgccgacggcaaccgcaccagtaacatctgctgccgcgaccacaccatcagccgccgtagcgacctcacctgcagcctcgccgtcaccggttgcggacgtggtgaaacctgttgtggacaacaagccagaataagcctttaagcgggagcgcggctcccgcttacgccgcgctttagctgccgcggatggttttgataatgttggtagtggagataccatcttcgaagttcagcacctgaacgtcgccgccatttgcccacacttctttgctgcccgcgatatcttccggcttgtaatctccccctttgaccagcaggtcagggagaatgcccgcaatcagccgctgcggcgtatcctcttcaaataccaccacccagtcgaccgcttccagcgcgcccagcacgatcatccggttttcctgtgggttcaccggacggctttcgcctttcagacgtttagtcgacgcatcgctgttcaccgcgacaatcagtcgatcgccgagcttgcgggcatttgccaggtaggagacatgaccggcatgcagaatgtcgaacacgccgttggtcatcaccactttttcgccacggcggcgggccatctcaacggcggcttttaactgcgcttcggtcatgatgccgaaaccctgttccgggcgggcatgaatcgcattttccagctcaacggtgctgacggtggacgtacccagtttacccaccaccacacccgcagccgcgttggccaggaaacaggcttcttccagcgaatcaccggccgctaatgccgccgccagcacgccaatcaccgtatcgcccgcaccggtcacgtcatagacttcctgtgcctgggtgggcagatgcagaggcgctttgcccggctgcagcagcgtcatgccattttctgaacgggtcaccagcagcgcggagaggtcaaaatcggcgatcagctgggtgccgcgcgccacaatttcctcttcgtttttgcatttaccgaccacggcttcaaattcagagaggttcggcgtcagcagcgtcgcgccacggtagcgcgcaaaatcggtgcctttcgggtcgattaataccggtacgcccgcttcgcgcgccagagtaatcatggtctgcacgctggagagcgcgcctttggcgtaatcggacagcaccagcgcacccgcggcggccagtgactcacgcattttctggtgaatcggctccggatcgacctgatcaaagccctcttcaaaatcgaggcggatcagctgctgattacgggaaagcacgcgcagtttggtaatggtcggatggcttttgatcgccacgaagtcacaatgcacgttgacgtctttcagcgtgttactcaacacacgcgccgcatcatcttcgccagtcaggccaatcagtcgcgacgcggcaccgagtgctgcaatgttcatcgccacgtttgccgcgccgccagggcgctcttcaaccgtgtccactttcaccaccggaaccggcgcttcaggggagatacggctggttgggccataccagtaacgatccaacattacatcgccaacaaccagcactgaggcttggccgaaacgcgggcagagtcactttcattccagacactccagactgcattaaaaatagtgcgcggatgatagcacagttgcgatttgtgctatcagcatcacgccaggatagacgcaggcgttatcagccagcgctgccagctgctcagaaccgtctgccgctccgctgcataggcctctggctcaacgtggccgggctgttcctgcagggcgcgatggtgcaatgcgtcgcgcagcgtcacataagcctgcgtcagcgcctgtgcttcatcggcgggcattttatggtacttcgccatcagctcgaaaatgcgcacattgtcagaccagcgcgtcagttcaggctgctcagcggcgtagcgtaagacaagatattgggcgatgaattcaatatcggtgatgccgcccgcgtcggctttaatatcccagcgacctttatgtttgttgctgaggtgagcgcgcatcttttcacgcatctcacgtacttcagtttgcagcgcttcggcggcacgtggcagcgacagaatcgcctgacgaatcacgctgaaacgttcacccagtgccgcctcgccaaagacgacgcgtgcccggaccagcgcctgatgctcccaggtccaggcttcactgcgctgatactcttcaaaggcctcaaaggtactcaccagcatgcccgccgcgcccgaagggcgcaggcgcgcatccacttcatagagaatgccggaggaggtgcgggtactgaagagatgcatgatgcgctgggcgaggcgcagatagaactgacggccatcgatgctgcgctccccttctgtcaccgcatctgccgggcagtcatgcaggaacaccaaatcgaggtcagaactgtaacccagctcccagccccccagtttgccgtagcccagtacggcaaaaccgcggtcatgttcattactcagatgcgaaggacggccgtaacgctgcaccatcatattccacgcctggcgcaccacagattcgataatcgcttctgccagccaggtgagatgatcgctgactttcatcaccggcagtgttccggcgatgtcggcggcagcaatacgcagatgctgtgcctgcttaaactgccgcaccgcttccagctgctgctcttcgtcctcggtagggatgcgcagcagatattgtcgcagctcatcgcgataggcatcggtggcggttggctgatagagcgtggcgggatcgagcagttcatccagcaataagggatgacgcgccagctggctggctaccatcggtgaggcggcgcacaggcgaattaagtggcgcagcgcaccgtgatattcggtcagcagctccagataggtgctgcgggtcaatacgccgatcagcagcggcgtcaggcggccgagcgtcaccgccgcatcttcacgcgggcagacttcgctcagcagacgcggcatcagctggtccagcgcctgacggccacgcgggccgatggtgcgccggttgatatcctgacgaaacgcctccagcgtctggtgcagcgtaagccgctgctcgtcactgagctgcggcaccagcggcgccagttcgctatcctccagctggtcctgccacagcacctgaaactctgccagctcacgctgatcgccaatctcaggggtatcttcgccaatcagctcgtcgaagatagcgcgcaccgccgccatctggccgtcgagccgggtcatcagagcaggccagtcggcacaatccatcgcccacgccagccggacgcgatgcagttcatcctctggcagggtctgggtctgctcgtcgcccaggctttgcagcagattctccagccgccgcaggaacaggtaggcaacacgcaacgcatcgacctgttccgcgggcagcagggccagggttttgatcgcctccagcgtcggcagcagtgaacgcagctgcaacgagcgctcacgtccgccgcgaatcagctggaatacctgcacgataaattcggtttcacggatgccgcccgcgcccagtttgatattgtttttcagcccgcgtcgccgcacttcgcggctgatcatccctttcatgttacgcagcgactggatcacgctgaagtcgatgtagcggcggtaaacgaatggccgcagcatctgctgcagctccaggctccagcgatcgtggtcatcacccatcagccgcgccttgaccatggcgtaacgctcccagtcgcgtccctgctcctggtaataatcttccagcgcggcaaagctcatcaccagcgggccgctgtcgccaaacgggcgcagtcgcatatccacccgatagacaaagccatccatggtgggttgatccagcactttgatcagccgctgccccatgcgggtaaagaactgagcgttgtcgagttcacgccgtccgccacgcgttgtgccgttttccggccaggcaaagatcaggtcaatatcagaagaaaaattgagttcgccgccgcccagcttgcccatgcccagaatcagcatcggctgcgcgtcgccgtccgcattacagggcgtaccaaaatcacgacagcaatcctgataaacccagtcacgcgcccggctgatcagcacttcggctaatgcgctgagctgttgcaggctctgttcggttgtagcgtgctgcagagactgcatccaggcgatgcgtaccagcatacggcgacgaaacagccgcagttcacgcatcaggctcgcttcactgtcgatgccgctaagcgcctgattgagccacgcagagtagtgttgccactcatcaggctgcggcggctggtcgagcatcgcctgccaccagtcgggatgttgttgcaggttttccagcacaaaatcgctgaaagccagtccggcagcctgctccgggcttaacgaagccagcggaaccccaatctgtcgggcggcgtcttcggcctggtcgcgtagcaacgcgggaagtgctgacaacataactccctccttgatggcgtgacggaatgcccgttagcggccagcgccgctggtgagccagaacggaggctgtttcagcgcctgcatcgccagccaggctaacccggacgtctgtttttcatgaattgccgacagcagctgttgccacgggtcgagccagctgacgaccacctcagacggatagaatcccgccagcaggtggacggtaagcaattgacgcgccagacgggtagctttgtcctgatactcgttgggttgttttaccgtgatgaacgtttctctcagatcggcattgacgcggctcagcataatgtcgctgaagcgtttataggacccctgcagcttggcttcccctttggcatcgatccactgacgccactgagattcagccagccagtgtgtcagcgccagctgcgtctcaaccgagagggaagataagcagaaagtggcagcatcctgctcttcattcaccagcgtctcttccagcgtggtcagctgctgacgcagcgcactgctggctttacgcggtaccagcgcaccaaacaggctgaacgcctgacgcagcagatccagcgcttcgcgcaccgcatcctgggccgccgcattgccgcgcagccagacttcttcatgatattgccagtgatgaagtcctgccgacatcgcggccaccatgccctgctctacggtggctttggcgcccgctttcagcagcgggaaaggctgtatctggcgcggcggattaccctgcgccagctgatagccgcgggcagctttgctcaggctgcccatacgcagaccgcccagcgccaccagctgctgtgcgaaggccagcagatccaggcgttcgccacgtttcagctccagctcgatctcgcacagcggttcgctgagatcacctgccgtgacctcgccctgatcaaacgccacttcaatttcactgttgcctgtggtgatcagccagatttcgcgctggaaatgggtagtgaacaggggctgcaagcgcggctgcagcgccgcgacatcggtgccctgcggccagatctctgccggcaggcgtgtaatgtccagaaccggttcgctgagctcaacgttgtattccgggcgctgatgcagtccgccgagcgtctgccccgccgctttcagcgtcatttcataacgctggtcaacgccgcggatacgcaatcccatatcccagcgtcgtagctggttgtcgtcggtttcaaagtagatgttggtcagctcgcgagcagcctgatgctgatgcggcagagtggagagcagttcagccagtttcccggccgcctgtggagttgcaatgaactttagttcgatttcgatggtcataattttttattcactacgccgctggcacttaagagggtgtttcctgcatatttcaggcgattatcagcaggttactcaagctgtcgcctggagggcaaggggttatcaggcgaagattaatgcacagaagccgcgctgtctctgctttctttgctctttcgcagaccttttcgcactctcatgagaccaggatagttctcattcagatttatgcgaggcctctccagactgtgccggtaaatttttagtcagactaagccaaacgaaatcgaatgaaaaaaattactctcgctggactcactttgcttgcccttagcacccttgcacctgcccatgccgacgaaaaacgctatgtttctgatgaactttctacctgggttcgcagcggaccgggcgatcagtttcgcctgctcggtaagctgaaacgccggggaagaggtgcagctgttacagaccaacaatgacacgcattatggccagatccgtgattcggaaggccgcaccacctggatccccctgtcgcagctcagtgctaatccgagcctgcgcacccgggtgcctcagcttgagcagcaggtgaaagatctgactgccaaactggataacatcgacaacagctggaaccagcgcacggctgagatgcagaacaaagtcgccagcagcgacggcgttatcaacgggctgaaaggcgagaatcagaagctgaaaaatgagctgatcgtcgcgcagaagaaagtcagcgccgctaacgttcagctggatgataagcagcgcaccatcatcatgcagtggtttatgtatggcggcggcgtgctgggcgtcggcctgctgctgggcctgttactgccgcacatgctgccgcgccgtaagaaaagcgatcgctggatgaactgacaccatttagccggatttgagcaggggatcgcaggatcccccttttggcatgtctgcaatccggggaatctgtgcaacaataaaatgatatgcaccgctgatttcaggcgcgggacgcgcccggcgtgcaggtcatttctttttctctggagttttgcgtgaagacgtttcttgttggcggtgcggtgcgtgatgcgctgctgaatctgccggttacagacaaagattgggtggtgacaggttccacgcccgaagccatgcttgagcagggctatcaccaggtcggtcgcgattttcccgttttcctgcatcccgtcagtcgcgaagagtatgcgctggcacgtaccgagcggaaaaacgggaaaggctacaccggttttgtcacctggtccgcgcccgacgtgacgctggagcaggacttacagcgccgcgatctgaccatcaatgcgattgcgcaggatgaaaacggtgagctggtcgatccttataatggccagcgtgatattgccctgcgcctgctgcgtcacgtctctgacgccttcagtgaagatccgctgcgggtactgcgcgttgcgcgctttgcggcgcgttttgcccatctcaactttcgtattgcccccgaaacccagctgctgatgcagcagatggccgaaagcggcgagctgtcgaatctcactgctgagcgggtgtggaaagagacggaaaaggcgctgagttcccgtaatccgcaggtctattttcaggtcctgcgcgactgcggtgcattgcaggtgctgtttcctgagctggataatctgtttggtattcctgcgccgattaagtggcacccggagatcgacactggcgtccatacgctgatgacactggcgatggccgccgccctctccagtgagatcgaggtgcgcttcgccacgctgttccatgacgtcggcaaggcgctgacgccgcctgagttgtggcccagccaccacggtcatggtctggcgggcgttccgctggtcgaggcgctgtgccagcgactgcgggtgccaaacgcgattcgcgatctggcgctgatagtgaccgaatttcacgacgtggtgcacaccattgaacggcaatctgccgcgtcgctggtagcactgtttgaccggatcgatgcctggcgtaagccacagcgcgttgagcagatggcgctgaccagtgaagcggatgcgcgcgggcgagccggactggagagcatgccttatccgcagggcgactatctgcgtcgtgcttttgcgctggcgcaggcggtgccgaccaaagcggtggtcgaagcgggatttaaaggtgcagaagtgcgggaagagttgacgcgacgacggattgacgccgtcgcgcagggtctggcgattacgcagcctgactagcaggctgcgtgggctttacatgaagaccatgtaaaccgcggctgccacaataaagcggtagatcgcgaacgagacaaatgagatgcgtttgatcagctgaaggaaggctttaatcgcaatcagcgccacgataaacgccgtgacaaagcccaccgcgaacatcgggaaatccgccatcgtcaggaagccgatgctcttgtacaaatccagtacggttgcacccatcatcattggcactgccaggatgaaggagaactccgacgcggcatagcggctcacgcccatcagcatgccaccggagatggttgcaccggaaacgtgagaagcccggccacagcgctaagcactggaaacagccaatcatcaacgcctgacgataggtaatatcatcgacgcccaccgctttcggctgttttggcttaaggtactcagctgccagcagcagcacaccacctaccaccagggcgtacatcacgttgattggattaaacagcgttttgatctgatcgtgcagcaccagacccacgaccaccgccggtaccatacccagcaggatatggatcagcgacagacggccagtgccgacgccttcatgtttgacttcgccaaagtggatgccgatcaggccaaacagacggcgccagaacatcactactacagccagaatcgatcctaactggatcacaacttcaaaggtctcggctttttcaccctcaaagcccagcaggtgacccactataatcatgtgccctgtggaagagaccggtaaaaattcggtcagtccttccacaacgcccaggattgcagctacccaaagctgatgaatatctgccatcaaatgtttcctctatccgtttcaaaaccattaaaaaggcggtagcgcgtggctatcgcctgaaatcatgccgctatcagcctgaattaaaccttaaggtctacaccatttcgcctgctgtaacgaaacggtacacgctatgacagacagtaatttggtttggtttcattgtgatggcaatcacatcgtatttatttaggaatagtcccgcgctcaattcgcacgccaacctgtgctgcctgggctacagcccccggtttgcttacctttatgcggacgccaggcgaattgaaacggttcatcaacagatccgcgatttcttcagcaacccgttcaaccagcgcaaaacgactgccggtaagatgcgtcagaatcgccgaggagacatccgcatagctgagacaatctttcacatcgtcgctgctggccgccagacggttatcccaggccatttcgacatcgagcaccagcttctgctgtatgccctgttcccagtcgtaaacgccaatagtggtgaagaccgtgagttgttctataaatacgatatccatgatgagagtctctgtttttggctaagccggataccacttccggctgattatgcgtattatccacggttaaagagatcaaaacgaccctaaagggaacggtacggtgttatgagtgctttcgcgcttggtatgattattttcgcgtatctttgcggttcgatttccagtgcgattctggtttgcaaactcgctggcctgcccgatccgcgcacacacggttccggcaatccgggtgccaccaacgtcctgcgtctgggcggtaaaaccgcagcagccagcgtattagtgtttgatgtgctgaaagggatggtgccggtctggctggcctatctgatgcacgtgactccgctctatctcggcctgaccgccattgccgcctgtctgggtcatatctatccggtgttctttcactttcgcggtggcaagggtgtggcgacggcatttggtgcgattgcgccgattggctgggacttaaccgggctggtgactggcacctggctgttaacggtcttactcagcggctattcctcgctgggtgccatcgtcagcgcgctgatcgcgcctttttatgtgtggtggttcaaaccgcagttcaccttcccggtttctatgctctcctgtctgatcctgctgcgtcatcacgataatattcagcggctgtggcggggtcaggaaggcaagatctggaagcgcaaaaagaaatctcagccataaaaaaagccggcaagccggcttttttcacatcagatggcgggcagtttccgccagcggccagcgcggtcgcacgctgacgcttaactctccccgcgttccgccttttaaccgcaccatgcccgcatacgcgatcatcgcaccgttatcggtacagaactccgggcgggcgtagaacacttcaccgccgcgcttttgcatcatgatcgccatctgctcgcgcagtgtgcggttagcgctgacgccaccggcaatcaccagacgcttaaagccggtctgatccagcgcacgcttacatttgatcgacagcgtatccaccaccgcatcttcaaaggcgcgggcgatgtcagcacgggtctgagcatcatcatcattggcgcggatggtattagcggcaaaggttttcaggccggagaagctgaaatccaggcccggacgatcggtcatcggacgcgggaaggtaaaacgtcccgccgtgccctgctgcgccatcttcgacagcattggcccgcccggataattcagcccaagcagcttggccgttttgtcgaacgcttcacccgcggcatcatcgatcgattcacccagcagcgcgtattcaccaatgccggtgacgctaatcagctgcgtatgtccgcccgacaccaggagtgcgacaaacggaaattccggcggattctcttccagcatcggcgccagcaggtggccttccatatggtggaccggcacggcggggactttccaggcaaacgccagggcgcggccaatggtggcaccaaccagcagcgcaccgaccagtccagggcctgctgtgtaagccaccgcgtcgatctgctgcggctccagaccggcctctttcagcgcagcctgaatcaacggcacggttttccgcacgtgatcacgtgaggccagttccggcaccacaccgccataatcggcgtgcagttttacctggctgtagagttggttagccagtaatccggcctcgtcatcatagattgcgatgccggtttcatcgcacgacgtttcaatacccagaattcgcattgcatcacctcattcttgcggcgcgcagtttatcacagcaattggatgtgcagcgcgggcatccaccgtaaaaagtcattttctgtcggctaaagagtgcgctatactcccgcccctggaaaaaccggcagccgcacaggcaaacgctcctgttggtttcaaattatccatggtgctttacaaaccaacttgagttggagtaaaatgctgcaccattttgaaatgtgctggcgccgcagtcagcagcaaaaaccgaattttatcgaggtgagagttacatgccggtaattaaagtacgtgaaaacgagccatttgacgtagcactgcgtcgcttcaagcgttcatgcgagaaagcaggcgttctggctgaagttcgtcgtcgtgagttctatgaaaaaccgactaccgaacgtaagcgcgctaaagcgtcagcagttaagcgtcacgccaagaaactggctcgcgaaaacgcacgccgcactcgtctgtactaagtcgttccggaggcccgcctccaccgcgtgattcacgcagacagagtcaagtaaaaggccgtgctttccgaaaggaagcgcggcttgttgccgtttatgagctgaaaatctggggcgtatggctggacgaattccacgcgtatttatcaacgatttacttgcccgcacggatatcgtggatcttatcgatgcccgcgttaagctgaaaaagcagggtaagaatttccatgcgtgctgtcctttccataatgaaaaaacgccctctttcaccgtaaacggcgaaaagcagttctatcactgtttcggctgtggtgcacacggcaacgctatcgactttttaatgaactttgatcgtctggagtttgtggaaagtattgaagagttagccacttcccacggtttagacgtgccttatgaagcaggcagcgggcccagccagatggaacgccatcagcgccagagcctgtatcagctgatggagaacctgaacggtttttatcagcagggtctgcagcaatccagtgcgcagccagcacgcgactatcttgatcgtcgtggtctgagcgccgaaatcatcaatcacttcgccataggttacgcgccagccggctgggataacgtttctcaagcgttttggtaagcaatcggaagatcgcgagtcattgatggaagcgggcatgctggtcagcaatgacaaaggccgtacttatgaccggtttcgcgaccgcgtcatgtttccgattcgcgataagcgtggacgcgtcataggttttggcggacgcgtgctgggtaacgatacgccaaagtatctgaactcgccggaaacacctattttccataaaggccgccagctctatggcctttatgaagccgttaagaaccatcctgaacccgcccgcctgttagtggttgagggatacatggacgtggttgcgctggcgcagtacgggatagattatgccgtcgcgtcattaggcacctccaccactgctgaacacattcagttgctgtttcgcagtaccgacaccgtgatctgctgttacgacggcgacagggctggtcgtgaagcggcatggcgtgcgcttgaaaccgcattgccttacatgaatgatggtcgtcagctacgctttatgtttttacccgatggtgaagacccggatacgctggtacgcaaagagggtaaagaggccttcgaagcgaggatggagcaggcgatgccgctctcttcgtttttatttgatagcctgctgccgcaggtggatctgagctcacgcgacggaaaggcgcgcctgagcacgctggctttaccgctgattacgcagatccctggtgagaccttacgtatttatatgcgtcaggaactggggaataaactgggtattcttgacgacaatcagcttgaaaagctgatgccgaagctggccgcaagcggaacgacgccggtagcaccaccgctgaagcgtaccactatgcgcgtgctgatcgcgttgctgattcagagtccgcagctggccaccctggtgccttcgcttgatgggctgtctgagtcaaaaatgccgggtttaccgctatttattgaattagtgggccgttgtaatgagaatcctggattgaccaccggtcagctactagagttatatcgcggaacaaattttagtcagacgcttgaaacactggcgatctggaaccacatgatagtagatgaggaagccgaagcggtgtttcaggactcgctggccagcatctacgactctgctcttgaagagcgcctggagtttttaattgcgcgtgaacgcacccagggactgagcgccgatgaacgccgggaaactctggacactcagtcaggcgtttgccagaaagtaactgttttcagcacgctgcccgttctgacagatgaaagggcagattgcctgtttagtgctgccagctgtttcactaccgtgaacagtccgggatcgaaatggcccgcagcaccaggtttaaaggcctctggcgtagagccgggtccttagcacacattttaaaggccgcaggcgccgaagtcagtctggtcaccgccagcgcacagcttccggagcgtactgaagtacgtatggaaagcgagcactgccggggataagaatggcgagtaagccaggcccgcagcacatagttttaaggccgcaggcgtcgaagccagtctggtcaccgccagcgcacagcttccggagcgtactgaagtacgtgaggaaagcgagcactgccggggacaagaatggcaagtaagccaggcccttagcacagagtttatacaagcggcttaagtgccgaatactgatgggcaaagcccacgccgcgacgaaggcagcggcaagaattaaatgcctttactgctattgttggctcgctgccgaccgacaccaatctaatttaacagaagtgtggataccgtcttatggagcaaaacccgcagtcacagctcaagcttcttgtcacccgtggtaaggagcaaggctatctgacctatgctgaggtcaatgaccatctgccggaagatatcgtcgactcagatcagatcgaagacatcatccagatgattaacgacatgggtattcaggtggttgaagaagccccggatgccgacgatctgatgctgaacgaaaacagctccgatactgacgaagatgccgcggaagctgccgctcaggtgttatccagcgttgaatctgaaatcgggcgtaccactgacccggtccgcatgtatatgcgtgaaatgggtaccgttgaactgctgacgcgcgaaggcgaaattgacatcgctaagcgtattgaagacggtatcaaccaggttcagtgttctgtagccgaataccctgaagcgattacgtatcttctggatcagtacgacaaagttgaagcaggcgaatcacgcctctccgatctgatcaccggtttcgtcgatcctaacgcagaagaagatatcgccccaacggcaacgcacgtgggctctgaactttctgaagccgatcgtaaggacgatgaagaagaagatgaggaggatgatgacagctccgacgacgataactcaatcgatccggaactggcgcgtgagaagttttctgacctgcgtaagcagtatgaaactacccgcgcagtgattaaaagcaaaggtcgcagtcatgctgccgccgttgctgaaatccagaacctctctgatgtcttcaagcagttccgcctggtaccgaagcagttcgattacctggtaggcagcatgcgcaccatgatggaacgcgttcgtacgcaggaacgtctgatcatgaagctctgtattgagctttgcaaaatgccgaagaaaaactttatcacgctgtttaccggcaacgaaaccaatgaaacctggttcaaagctgctctggccatgaacaagccgtggtctgaaaaactgctggaagtgcaggacgacgtgacacgttccctgcagaaactggcgcaggttgaagaagagaccggtctgaccattgaacaggtcaaagacattaaccgtcgcatgtcgatcggtgaagccaaagcacgtcgcgccaagaaagagatggtggaagctaacctgcgtctggttatttcgattgccaagaaatataccaaccgcggtctgcagttccttgacctgattcaggaaggtaatatcggcctgatgaaagcggtagataagtttgaatatcgccgtggttacaagttctcaacctatgcgacctggtggatccgtcaggctatcacccgctctatcgccgaccaggcgcgtaccatccgtattccggtgcatatgattgagaccatcaacaagctcaaccgtatttcacgccagatgctgcaggagatgggccgcgaacctacgccggaagagctggctgaacgtatgctgatgccagaagataaaatccgcaaggtgctgaaaatcgctaaagagccgatctctatggagacgccgattggtgatgatgaagattcacatctgggcgattttatcgaagacaccacgctggagctgccgctggattctgctacctcagagagcctgcgttctgctacccatgacgtgctggctggcctgaccgcgcgcgaagcgaaagtgctgcgcatgcgtttcggtatcgatatgaacactgaccatacgctggaagaagtgggcaaacagttcgacgttacgcgtgaacgtattcgtcagattgaagccaaagctctgcgtaaactgcgccatccgagccgttcggaagtgctgcgcagcttcctcgacgattaagtcagacaaaaaccccggttcgccggggttttttatgcctgcctgttactgcctctcccctgccctgcgcagattcattcgttccccgcatgcagttccacatagagctgacgatacgcctctaccatctcgtccagagatgcgcgattaaggccgctgggattcggcaatacccatacctgcgttttccccatacatatgggctgtttgccccattcgactttactctgcttaaaagcacgacgaaacgcatccttacccagaatcgccagcgcagccggctggtaatccagtaccttttccatcagccgtttaccgccatcgcgcagctcatcaggcgctaactcactcgcctgtaccgtaggccgctcaaccagcatggtgatgccgcagccggtctccgttaagcgctgctcctcttccggcttcagctgctgctgggtgaatccggccagatggatcactttccagaaccggttgccgggatgcgcaaagtgaaacccctgatgggcggttgactgacccgggttaatgccacagaacagcacatcaagaccggaggtgatgatgtcgcggatcgcgtgttcactcatgccgccacctccagcgtgcgctgcttcagcgcatcgcggctgcgttgcagcatctggctggcctgctcggcatccggacaggcacgcgccagcgccagcgcaccaaccatctctgcgagcatgctggaggccagcgcttccgcatcgggcagcctcagttcacgcaatatctgcgccagaccggcatgcatcgcgttaaagccctgtgcgaagatctgccgcgttggctgtggaagatgagctacttcactcaccagagcggctaatggacagccctgcgccggtgcattgcgatgcgcctcggaaagatagctatcaataaaatctgccagctgctgcgctggctgggtcacggactccgcgggcttgaaggtatcggcttcagcaaacatatgcttcagtacctcctcaaccagctcctcgcgtgaggtaaaatgcgcataaaaaccgccatgtgtcagaccgacccgcttcatcagcgccgctacaccaattccttcggtgccggtttcacgcatcacgcgcgccgcctcatcaaggatacgccgccgcgtatgcgctttgctgctctgcttctccatctcatctcctgcggtatctgttacgtagcgtctggctattatagtaattattacggtcatcatattccagcttgacgacagatatgatgatcgtcatattgatagctattatgacgaccatcatacgaggaaaaagagatgtcacaatcaggcacagctttaatcaccggcgcatccagcggtatcggtgcgacctatgcaaaacgactggcagcacgcggttatgatttgattctggttgcacgcgatcaggggcggctcaccaccctggctgacgcactggcaaagcagcacgatattcgggtgacggttatggcggctgacttaacgcacgagcaggatctgcaacgcgtggagtcggagctcgcgaacaacgcacagattacgctgctgctgaacaacgcgggcatgaacgttgagggagagtttcttgaggcggacatcacacgcattaacagtatgctggcgttgaatattctggcacccacccgtctggcacaggcggctggccgggctttcaaagcacgcggaaatggcatcattatcaatatcgcgtcggtgctgtcgctggtgcacgagatgttcaacggcgcttataacgccactaagtcttacgtactgactctgacgcgtgcgatgcagcgtgaactcgcagagagcggcgtgcaggtacaggcggtgttgcccggtgcgacccgtacggagattttcgaccgcgcaggccagtctattaatgacattccggctgaaatgctgatggacgttgatgagatggtggacgccgcgcttgccggactcgacagcaaggagacggtaactattccggcgctggaagatctgcagatgtggcacgactacgatcaggctcgtggcacaatggttccccacctttcacggaatcaatcagcatcccgttatcgtcagagctgagccagccatcagccataatgactgaagtccggtttcactaaaggcacggagaagcattatccgtgcctgtttgcgacttcgggatcgcggttcgacagttttgttatagaaatcagcaggtaaatcactgctgcttatttcagcaaccggtggctgagtgctggattgccctgaagagatactttataatccccgctccgctggccccttagctcagtggttagagcaggcgactcataatcgcttggtcgctggttcaaacccagcaggggccaccaaatttcaatataaaaaacatatagataagccgctcattgaagcggtttttttgtatctggcttttcgagtggcggtaaagtggcggtgcattttcctcaacagccttatcatgccgctgctgattgctttaagcaggtggaacaagactactaaacaaagcaaaaaagctcagaagtatgtaaagtaactcgcttatcaatagggagaagctctgatagttttttccagccaaataaaattaccgtctgtatcgtaaatctgccacaatgccggtgtctgaaatggtgaatagtcgatactcatacctgttcaccatcaacgataggctttatgccatttgtataaatcgttggggctttcaaagaattaatcgtatgttcataacggctgaaaagtgtagtagcgatccgattcttcacttgctaccaatcttgtaacaaggagcacgtcactttaattcaagataatgaataatattaccagctaatatagataggatttataaactgtataaaatagagggacaagtaaatgcatcattttcttgaaatgctctcagatttgcttaccaattggcctgtaacagcagggaagcgagagaaaaagccaagaaaagacagaaagaaaatatcaactcttcactacaaacctatatgcaagatcacgactgatcgaaaaagtaacgatataccgaagaaagatgaggccaactaagaaaaatatttatatttacaaaacaagtcttattacttgtaaaaaatttcagtggatataattaagatcataataacagcatctgctgctgacctctgcctgggtatgacgagccgtctttagcattaccaggcaatgtgataatttcgacatcgccttatggaatttaaaagtgtagctataaaaggtttaaaaatgaaagttctgtggaatactccttctcattcaagtacctaatgagacgccggatgaagatatcaagccattaatgagtagtaagcccccagcaatcctgcacaaactcaatgtcatagcgagctattagtagcgctcataccaatatcaacctctgttatactcagtagttttaactactttccttttggctattttaatttcatatccaatcttttaattttaaaaaaatgaacactcttttctactgcatcacattttagtaaagccactcccccgcttcagctgaattaatcagcatctgaacagtcaaaggctcaggttgatgatgatcggtgcgcaaatattttggcaaaatagcgttcggcaaaaaagggattcctgtagccgggaaatagagacgaaaatagaatcgcttcatatcaacattaaatatgttcagcatattcttcaaaaaaatcaaaagcctcttcaggcaaaacgcaatttttacctgtactcagggatgcatcagctggcatttcccaaaagtatttctttatcagacgatgaacatcttcaactttactcataaccagccttatcctttttcacctgtaatcagcttatagcgatgaacaacattgcgggtaataatcgaaagatcatatgcagttaacacagcgccaatccagggcacccaacgtccaacatatgccccgacacttgttgtatattcccattcaccgtgcagcatgcttttccatgtaatagtacgactttttttctgaaaacgctggcgaataagcattcggcttgcgagagaaagcggtctggtttccacgtgtatttttttgaggatccaacttactatagtctcagcttccccgatcaagcttctgcagaggataattttatgtttaacgcctgtacggtttatacatactttctccattacgtaagcgatgcttttaaccgaagcagtaataatctacgtagcccatgcataattcgttaataaaaatctaactaatgatatgcatcactctgactttgttagtcagctttatagttttattgctttttttacaaccataaagaaggccataatctgtgtcacggccttgttgtttgatagcttaattacggataaaaacacataccgatcatgcttctccttttagcttatccagcaggtaagcaactaagtaggccagcatgaagaacccgaagaaaccaataattttccatagccagccatcaagtaaaaacaaagagaaaaatgcggcaaatgagcaaatacccgtagaaatggcttcaacaacatttgtggtttgtataccaatgaacttaacgaattttagaagaaatgattttgcagagttcattttgtatcctttcacaaattaatctatggctgttgatataaatcagatagggttcgagtggcctctctacgaggaaatagaccatatccagattcattcgtgaaacctttgaataggtcattggaaatctattttgcatccgtcttgatgcgactgaagcctcttcaatcaatccttgcaccatgagaatgttcaacgaaagcgatgaaccaactctgacaaaccgcttaaaggcctcaactgtcacgatacgagttagtattcttttagcaataaattgggccaagaaaaattgtgaaccaatccttccccccattctgccagcaccatagcccagcttactatcgatagcttgtttgctttcattatcgagctttgcgtagaaatcgttaatcacaatagtaatcagttgccggatgggttcatgtctgtctgcagtggctttgattaatcgcataaaccgttcagtttccctttgatttcggttcttcagatcgctcccggcaagaccgcttccctcccatgtttcttacaactccctgatacatgcctgaagggatagatgacataccctccacgattccataggcaatttgctttgcatccatacttattccttgtaagcaaataatgttcaaggctgagaatatctaatctgaagtagtaattccattagcactctatttaagttgtttatgcgtcagtcattcttttgatctactgattactagcgttatttattgattcaattaataagtacatcaaatgttcgcgatctatccaaaaaattcatgattaagtttattttcaataataacaataagttagattctttttcagaccattctttaagattaaatcactaaaactctttttaattttttagtttggttttccgataaaagcccaatggcagtgcggactgtcgatgtagtttgtagcaaaatgaaactgaaaatttttatgttcagaattgcactgccgggagcagtgtagccgccgtttttgtcttcaggacgattatttgccggtgttgacccgcagtcagtgccagactatgcggatactctctttgtggttatcgtgctcgtagtggcctcgcattagcgtggtgctgcgtacgtttggtgctctctggtgatggataatcaaaaacccgctgcaatagcgagttatcagtgtggattatttgccaatcacgggcaaatgtctggcattaagcacggcggccttctggccaatctacgcaatgtcgctgctattaactggctggccgcggatcaaagggctcgtcttgctggccagcaaactgctgcacaagctccaggatatcgctcatcaactgagccacgctattctttgctaagccaatccattagcgcacttatcttctgccacgtcccgacaatgctcttactaacctggccgattttttcagtcagcgcatgccagaccgtaatcaccgcgctgccgtcactcatcttaagcacctgcacgccttggtgaaaatcactcagccggttactccgtggttagtccgactcagccagacgtgcgatctcgtcatcagctgcaatgctgatatcaaccgcatccagtagcggcgtggtggtccgctttgcctcatcggtcgcggcggcgagtcaggtgatagccttcagcactgcattttcagcttccggtacctggactaaggtttcacctctcctttccctgattaacctcacactctcatacccactattttccctgtaaaagacaccgctaatcttcactctgataacccgactgatatcctggagtcactttttaaccctgcagagggtgtatcagattattttcataaacccgctatgtttacggatatgaacaaatgcagtccagacgggccaattgaaatctgcacaacgtgtgcgctgaggtcagattcacaattctgcagattaatttattgaacagaagagtatgaatagattagaggtttatcatgaaaagttcatcaagtgctgaactctgctgccgggtaattcgtggaagaaccatcatgccgctgaagaaagttgcgttgtatcaggtcgaatttgaaaatggcagatttgctgtgttacgcattaataaccttctgacgcttcaggaaggcgatattatctcaagagttaatgaagtgtggtctgcaggaccagatattattcaactgtcaccattcgaatttctcgaccagggtgaatcaaagcgttatttcaccgagtacgaaagataatgcagagttatcagcacattgaaattaatgttacgaagatattgcctcaatgagggataaggttaaacagtatgacttgctgctgcctgttgatcgcaacataaaaagacggcggactttatataacatacaatgacttacagtgagggcataagactgcctgtcctttattctttttagctacagactgtctggaaaactttttacacaccggacactgtgtattggtttcgctgctgtgtagcgcgtcgaagagaaagctcaaccaggtcatgtcgttatcctctgaaatgtttccctcagcgtaacacagtggaggtaaattaatttttttatctgtcggctctgatgttaaacagggctaaggtgaggagaaggcagctgtttattttttttaactttattttatcgccataaagaaacgccagccggttaatcaggatagctacgaataacggaaacaggactataatcaataccatctacacctgtttatcacctccagcccttcttttggctacttttttgtcatcctttctttttttccggatccagctgctgcgtaagcgcaaggaaatgagtgtgaaaataaaactgacgacgtggttcagccgggaaagtgaattacccgatgagcattttcctttgttcccgacagaaggtatttatcaggcccaccggccagatattttttcggctgaacaaatggataactacggcgaaaaattagcgaaaacgcataatctgtcgggtggaaaatggtcctaccgactgttgcagcagctggcagataatgaactgtcattgacgcgcagcgcagagatcctgagtgaaggcgataagcgcagccagacaccggcggccgtctggatactggataatttttacatcattgaagagcagatccgcctggtccggcacctgttaccggcaaaattcggtaaaggactgcccatgctggaggagtcggctcattacctgcgcatccaggctatcgccgaggagatgattaagcacagtgatggcagactggaaaccagcgtcctgcatccttttattgctgcctaccagcgcgttacgcccctgctgctcggcgaactgtgggccctgcctgccatgttacgttttgcgcttatcaacaatctgtcccggattgcggctgacgtggccagggtacatcaggaacgtaataaagcggagcagtggatcagcgatatcctctccactgccgccgaagatgcgtcaaaagttattctggtcatcgctgatatggcccgccagaacccgcaggtttccggcgctttcgtcgctgaactcgaacggcgattaagtggccagaacaataccctggcgttaacctgggtcgaacaacagctggaaaataccggccggaaaacctcggaagtcattgagcagttcaaccggcagctggccctgagtcagctctctgtcagcaacagtattaccggcctgcggcaactcggcgaaattgactggcaggcctttgtcgaatccgtcagcctggttgagaaagtcctgcagcaggatcccaccgggacatacccgctgatgcattttgacagtcgcgatgactaccgccacgtgattgaacgtctggcgcggcacagtcggtttgatgaacgtgaagtcgcccaggctgtgctgacgctggccagccagcctgatcttcccctgcgtcagcagcatgtcggctattacctgctggataaaggatttcagcaactggaacagcagcttgacgttaaagtgacgtggctgaacaggagccggcagcatctgagccagactcctttactctcctggttaggcagccttttactgctgacaaccgcgtttaccgccgagatgctctacagcacccatcaggcgggcatggcgtctttactctggttgctggtgctgcccgccatcattgtcagcagccagctagccttgcagttgctgagcgagttaaccacccgtagccgccatccccttcccctgccccgactcgattattctctggcggtaccggagcatgaccgcacactggtggttatcccctgtttactcagcagcaatgagggaacagacgccctgttgcgctctctggaaatctgctatctcggtaacgccttagcgaatatcagttttgcgttactgaccgactttaccgatagcgccgaacaggatcatcatcatgacgccgcgcttatccgttacgccgtgctgaaaacggaagcgatgaatcggcgctacagcgggggtaaatcggacattgcgctcttctccctgttacatcgtgaccgcacccataatatttctcagggcgtctggatggggtatgaacgcaagcgcggtaagatccatgccctgaatcgctggcttcagggtgaagaaaacgccttcagcgtcactgtaggtgccacgcagacacagctgcacagcgttaaatatgtgattactctcgacagcgacacaatactgccgcgtgagactgcgcataagctgattggcgtcatggcccacccgctcaatgcgccggtattcgacgatgtcaaaaatcgggtagttgaaggctatgccatcctgcagcctcgtctggctgaagagataccggttaacggtcagagccgctatgcccggctgtgcagcagcattccggggaatgatgcttactcctcactctcatccgatatttatcaggatctgtttggtgaaggctcatttgtcggcaagggtatttacgatgtcgctgcctttagccgggcgatacgcaatacctgtccggaaaatctggtgctgagccatgacctgcttgaggggtgctatgcccgctccggtgtggtcagtaacgtcgtcctgtatgaacaatatccggatagttatctgagcgatgttgcccgacgatttcgctgggtgcggggcgactggcagctccttaactggctacggttgcaggtgcggcaggaagattgcagtcgtcaaaagaacccgctcagtgcgctttcccgctggaaattaacagacaacctgcgccgcagcctggtggcgcctgccctgctgatgctggtgtttatgctgtgcacgatagtaccgaacccggcattctgggtcggatgcatcatgctctttctgctgcttccgggactgccagcgttggtaatcgacggggtgacgaaaagtaaaaagcgtgcctggcggcagcatttatccatgctggtcaccgatgcctttaaccgcctctcccgcgctggcctggcgctggccatcctgcctcacgagagttactggtcgctgaaggcgattatcgtaaccttatggcgcctgactatcagccaccgctttctgaacgagtggaaaagcgcttcatcacagaaacctgtcgagcctgatgtgcgccatttctaccgccgcatgtggattaatccggtagcaggcgcggctctggtattcctgaccagcctgagcatgccgttgatgacgcatgtcgcactggcgctcgctttattgtgggcggtcgcccccgcgttactgagccgcatgagccagcctaaacgcgctcagccaggcagcctttcagcggaacagcgcatctttttgcgtcgcaccgcgcgtagaaacctgggcctggtttaacgaatttgccagcagtgataacaaccatttgccgccggataatctgcaggagattccggagtcgcgggtggcccaccggacctcaccgaccaacattggcctgtcgctgctggcaaacctgacggcctgggattttggttatatcagccagaatcgggtcatcagccggacgctcgacaccctagatacccttgatcgaatggagcatttcagaggacatctttataactggtatgacacccagacgttaaaaccgctgaacccacgctacgtctcaacggtagacagcggtaatatggcggctcaccttgtgacccttcaggctggcctggcgcagtggaaataccagccggtgatgtctctcccctgtatcctggaaggtctctccgataccttctcactgcttaaagaccaactgagcgacacccgcagcgacattgtggaacaaatcgcagctaagctaagcctgatgcagcgcgcttcacccgccgattttcacgccgggatgcaggctctgctggcattaagcgtggtagcagaacaggcttatcttccgacaacgcgggtaaactggccggcgcttttccagcagcagctggtcgattttactcaggagtggtccctccttttcagctgggttagcccggatgcgccactgcctgccgacattccgtcattgctgtggctcgctgagttgaacctgaaccgccccggactcccggaaaaacaggcagagacggcaatatgggccgcccgcgaacggatggctgccctgctggagctggacagccgcctcagcgatcacgccagtatggacttccgctttctctattatccggccacgtctttactcagcgtgggctataacatggacagcggtctgctggacgccagcaaatatgaccttttcccttcagaagtccgcctgacgcactactttgctatctccaccagtcagcttccggccaagagctggtttgtactgggtcgcctatttactcaactgaataaccagcccgccgtgatgtcatggagcggctcaatgtttgaatacctgatgccgcacctggtcatgccggtttaccccgacacgctgctggaaaagatggcgttatcggcggtcaggcaacaaattgtctcgggtaacagcaccgatacgccctggggcgtttcggaatcgggttacgctgcgtttgacgtcaatcataactaccagtatcgggcatttggtacgccggaactgggtctgaaacgcggcctgaatgacaatcatgttgttgcgccctatgcgacgctgctggcgctgatggtgctgccgcaggaggcgacggctaatctgataagacttaaaaaaatgggtgccagcggtgactacggttattacgaagcgctggatttcaccgcggatcgactggctcccggtcagccatttgcgatcgtcaaatcgtatatggctcatcaccaggcgatgggattgctagcactctctcaccagctgctggatgcgcccatggtcgcgcgctttatgtccagcgcactgtttcagtcgtcgcgtttgctgcttcaggaaaaagtgcctgatgatattgagctctataccccacgccgcagttttgtcgaaaacagtgaccctaaacagcagcgcagcattcccgaccagcgtgaattcagtggttcagatccgcgccagccacaacttcagctgctttccaatgcagattatcatctgatggtgacgcacgcggggacaggctacagccagtggaaggggctggcactcacccgctggcgtgcggatagcaccagcaacaactacggaacgttctgttacgttaccgatcagcaatccgccgaagtgattgctcacagctatcagccgacctgctgcgagcgtccgcattataaaacccgtttcaatgatgccgggattgagtttgacgcttcaggcaccaccttcagcattcacacgcatatcgtggtctccccggaagatgatgtggagatcagacgcatcacggtcactaaccgttcccgtcagacccgcccgttcgatatcaccagctacaccgaagtggtactggcaccagcagccagcgatatggcccaccctgcgttcagtaatctgttcgtccagactgaaatcgttgacaggctggaagcgattctggctcaccgtcggccacgtgaagagaatgaagtgacggcatggatgtttcacgcgatggcgatacatggcaataccggccgccagacctcttttgaaaccgaccgggctcgttttctcgggcgcggcaggacaccagccgatgctcaggcgctgatgccgggcagtgaattaacgggtcagcagggggcagtgttagatcccgtgttatcaattcgccagtcagtgacgttaaaagcgggagaggccgtcaccatcgatatgctttacggtgtgacacttcaacgtgacaccactattgcgttgattgagaagtaccgtaaccacatcagcgccgatcgggtgtttgaactggcgtggtcccacagtcaggtcgccttgcgtcagttgaatattcgcaccgaagataccagcctgttcaatcagctggccagtgccatactgttttccagcgccgaaatgcgtggcgaatcagacgcgctgatgcagaaccggctgggccaggagtcattgtggcgtcatgcgatttcgggtgatctgccgattcttctggttcggatagaaaacattaatcagctcgacctggtcaccaccctcattcaggcgcaccagtactggcgacaaaaagggctgacggtcgatctgctcatcctgaacagtgaccagggcgggtaccagcagaacctgttcaatcagctcacgaccctgatccctgccggagatgaacggcagcaggcggacaaacctggcggcatatttatccgcaaaagcgaaagtttttccgctgacgatctgcaactgttgctgagcgtcgcggcggtcgtgctggaaggccggaacggcagcctcgccgatcagctcagcacgctgttaaaaccggtgcgcaccccgcctgcatttgcgtttccatcgatcagtaagacgccgccgcctgcagccgtcaccttttcgccggagcggttgcagttttttaatggcaccggtggcttcaacgaagacggcagcgaatatcacatcattctttccggccagcagcagacgcctgcgccgtggtgcaatgtgctggccaacagccagttgggcaccgtcatttccgagagtggccagggctatagctggtatgaaaacgcgcatgaatatcgtctgacgccctggcacaacgatcccgtcagtgacagctctggcgaagcgctttatctgcgtgatgaagagacgggtgatgtctggtcgccgacgccgcttccggttcgcggcaagggggattatctgacccgtcatggcttcggttacagcacgtttgaacacacggagtatggcatcagcagcacgttaacggtgttcgtggcagaggaggcgccggtcagactttccctgctgacgctgagtaacctctctggcaaaacgcgtaatctttcgattaccggatacgtcgaatgggttctgggtgagctggcgagccgctccgcaaggcatgtggtgacgtcccctgccgctatcgccacaggcagcgcggttctggccagaaacttttataacagcacgggctctgcgcggaccgctttttttgccgtcacaggtacccggattgcgtacagcggcaaccggcttgagtgtctgggccgtaacggcaccacacggcagcccgcgatgatgaatgttcgtggtctgtcgggtaacaccggggcaggaatggatccctgcgccgcgctgcagacgctgacgacactgattgacggcgacagccgcagctttgtttttgcccttggcgtcggggaagatgagagtgcagtgacagcgctaatgcagcagttcctctccaccggggaggctcagaacgagctgaccagggttaaacagcactggcaccagctactgactaaagtgcaaatccagacaccggcaacggaggtcgatttactggcaaacggctggctgctgtaccagacgctggccagccgtttgctggcgcgcagcggatattaccaatccggtggtgcctttggtttccgcgatcagttgcaggatacgctggcgctgactcacgcggccccgcagcggctgcgcgatcagctgttgttgtgtgcatcccgccagtttatcgagggagatgtacagcactggtggcatccgcctgctggccgtggcgtcagaacccgctgctccgacgactacctgtggttgccctatgcgctgtgccgctatgtgcaggcaaccgatgatattgcgctgctgtcacagcctgtcagctaccttgaaggtcgcctgctggcagaggacgaagagtctgtctatgagcttccgggcgtcagtaagattaatgaaccgctatggcagcactgcgttcgcgcggttaaccacgcccttaatttcggccagcacggcctcccgctgatgggctccggggactggaacgatggcatgagtaccgtcgggattgccggcaagggtgaaagcgtctggctcggcttcttcctctatacggttctggaccgctttgccgcgctggctgtgcggtttcggcgataccgataccgcccgccactgtcaggagcacgcgcagacgctcaaaaccgcgcttaaccatgcggcctgggatggcgaatggtatctgcgcggcttttttgacagtggccagacgctcggttcacatgctgacagtgagtgccggatagacgccattgcccagagctggtcggtactctctggcgcaggcgaggacgccagatgccggtcagcgatggcggcgctttatcagcatctggttgataaggataaccggctgattaaattactcactccgcctttcgatggcgcagggccgaatccgggctacattcgcggttatttaccgggggtccgggaaaatggcggccagtacacccatggcgctctgtgggcgattatggcctttgcggcgatgggtgaaacagagcgcgcctggtccctgctctcgatgattaatccggttaatcatagtggcaatcaacaggatgtgaagatctacaaagcggagccttatgtgatggctgcggatgtgtatgcggccgaaggccatggagggcgaggcggctggacctggtataccggttcgtcaggctggacctatcagcttatcagtgagagtctgcttgggataacccggcgcggcaatgctctgtctgtccggccacagcttcccgcggcctggacagagataaaaatcgtctaccgtgagggggaagggatctacaacatccgggttactcgcggtgacagcacttatcagctgtggctggatggcaaacggtgtgacggtgacgaaatagcgctggaaagccatagccaggaacatcaggttgaagtcaggctgggctctgcgtcagattaagttaaacctgacaacccgcctgcatcagcttaaagaggatattcagtggcctttgcgagcgggccgttgagctgccagccgcgtcaccacgggcagctcaacgacagcgatctggtgaatggcgagggttaatcgcctgctcacaattatctgtcgccctgccctgttttccctcgcgaagcccatgctatcttgtggttttgattttttcagtgggcaaaattgatgacaaagttgcgggtagggatcgtgtttggcggaaaatcggctgagcatgaggtgtcgttacagtcggccaaaaatatccttgaggcgatcgacaaaaccaggtttgacgtggtgttgctgggcatcgataagcagggacactggcgtcttaacgatgcttcaaacttcttgcttaacgctgaaaatccggctttgatcgcgctgaatcacgccgctgaagatgtggcgctggtgcccggcacgactcagcagcagatcatcacccgtcataacgcccatccactgtcgcagatcgacgttatcttccctatcgtgcacggtacgctgggtgaagatggctccctgcagggcctgttgcgtatggcctcgttaccttttgtcggttccgacgtgctgggctctgcggtcagcatggataaagattttaccaaacgcctcctgcgcgacgcaggcctcaacgtcgcgccgtgggtgagcgtcacccaggcccagcgtgcacagctggacgccagcgcagtcattgcccgctttggcctgccgctgtttatcaaacccgccaaccagggttcatcggtgggcgtcagcaaagtggatagcattgaagaatttgatgccgcgctggcgctggccttctcctttgaccgcaaggtgctgattgagcagggtatcaaaggtcgcgagatcgagtgtgcggtgctgggcaacgatgcccctgaagccagcccctgcggtgaagtagtggtgcatgacgccttctattcatatgacaccaaatatatctccgagagcggtgcgcagacggtggtcccggcagccatttcaccggaaaccagcgatacgattcgtgaggttgccatcaaggcctttaccgcgctggagtgctttggcatggcgcgcgtcgatgtgtttttaactgacgacggcgaaattatcgtcaacgaagtgaataccctgcccggattcaccaatatcagcatgtatccgaaactgtggcaggcggccggactcagctatcaggatctgatcagtcgcctgatcgacctggcgattgaacgccaccagcaggccagtaccctgaaaagcagcgtcagctgacagaacccggcggcgtggcgttatgccacgtcgctggtgatggcacggtagttaaccggtgaggtctgattgcggccattacgtttcgacagatagagatttttatcggctgcggagatcagccggttgatgacgcggtgccactccgtcgcctcaccggcattgccatgcgccagccccagactgacggtgaccgtggccgtactgccctgcagccagaacttctctttcgccatcttctgccggatgctctcagcaagaaagtagagcttttccggattctggtcgaacagcaccaccgcaaactcttcgccgccaaaacggcagatgcgcccctctttacccacgacgcgctgcatacggcgggcgatctcttccagcacgctgtcacccgcatcatgaccaaaattgtcattaatcgctttaaagtagtcgacatccagcaggatcacgcccgcccggcggtccgggaagattggctcagcacgcagactttcatagaggccggaccgcgacagcagccgggtcaggaagtcatagttggctcgcagcgccagacgctggttgagctggcgaatcgcatccatgctcaccgccacaatcagcgggctgatcgcaatggtcgccacgcccagccgtgccgaggtcagatgggtgatcggcagcatattatcatcgccctggatattcatcacgccgtgcgaaaccagaatgatttcgctaatgccggtgagcaaaatcaccagactggtgagcggcatcggcagcacgatggcgcaccagaccagcgccggaaccgggaacgtcaggctgcctgcgccgcccatcatcgcgccaatcatcagcgaaaaaatcacggcgacaaccggtgccagcttgcgcatctgcataaactgccggggcgacagcgacgcccagtcgcgcgtcagcaaaaagggcagcagcatcagcccggttgagaactgttcgctgaaccattcgccccaggccgtcaccagcccgctgttaaaatcggcctgctgcgccagcgccccccagctggcgcaggccagtccggccagcagacaggccggaaaaatgcgcagcacgctggttatacgctcgctgccggagtcgtgctgaagatgttttaccagcagcgtcaccgccaccagcacaaacagaagattcgccatgttgagggtaaaagcagagagcgcccagcctgaaaaaacgatgtcgttaaacaccatcgcagcaaaggtggccaggtaatagcgggtctgatgcagaaaaggattccggacgatcacgccagtgacgatcgcgttgaccggccagaacagcgacagctcctgtggaaagcgcaggtgtccgccgataaagcaaaacagcaacgtgattaaaaacagtgaaaatgcgttcttcttaacgttgtgctcttcaaacagctgtatgcgcatacatccggaccttgtcacagagaggctggctgtccacgccagcctggacaggcgcgtggtgtcagaatgattaaatcctgaatatcctcaatgtcatccggcgataaaacctcgtttcataggctaactcagaaaagttaccgttttgaggctaaacccatcagatgacagcaaaaactggggctctattatgcatcgcaaataaaaaaatcggatatccgagatatccgatttttgctgttctgacgactttaccgttgcgctaaacgctattttacggcaaccggccactgactcaggcgaatgccgcgtttgtcggcattatcgccaaaatctttcagcaccgctttgacgtcgggatcgatatattccgcattgtcgttatcgacgatgacgacgctgttctccgggatctcatccagcaatccctgcagctttggattgtgcataaaggtcaggttctgctgaaagcgcagcacgtagtggtcgtcatagcgggtgagctgcagcgcgttgcgatggcttttatagatgctatagaggatctgcgtggcgatgccgataccaatcccgaccagcatgcccagcgtgataataccgacgatggtggccagaaacggcacgtactgctgcgcgcccatccggaactgctcaacaaacaatttgggtgtcgccagcttgtagccggtatagagcagcacggcagcgaggctggccagcggaatggcgttcagcatctcactgaaccacataccgcaaatcagcagcagcacaccgtgaatgaagatcgacagtttggtctgcgcgcccgcactgacgttaaccgaactgcgcacgatcaccgccgttatcggcatcgcgccaaggaaaccggccgccaggttaccgatgccctgcgcgaacatctctttgttaggcgatggcgcgggcgtctgaggacgcagttttttcagcgcttcctgactcagcagcgtttccagactggcgaccagggctaaggtcaccgcaacgacccagacctgcggattttgccaggccatccagtcgggcgtttccagctctgccatcagcgcggaaatgctgtcaaaagcgggcaatgaaatgcgcgccagaccgctggtcatctccgggaacagccgtccacccacgacggtagcaaggcagcctatcagcacggcaatcagcggcccagggatccaggccagcgctttgatccgcttcaccggtgcggtagtccagagacataaaatggccaggccgacacccgctaccgctaccgcaggcagcgagaaggtcatctcaccggtcaccagtgaaaccagctccgcatcgcccgcggctcccagcgccaccgggatctgctgcatgatcagcagcaaaccgatcgctgccagcatccctttgatgacgctgcccggcaccagcgaaataaaccgtccggcacgcagcaggccaaacagacattgcagtgctccggcgataatcagcgcggtgagaaaggcggaaaaactgcccagagacgccattgaggcaacgacgatggtgaccaggcctgccgccgggccgctgacggcaaaccgggacggactcagtgatgtgaccaccaggccgccaatcacaccagtcagcagaccggcaaacggcggtaatccgctggcctgtgcgatgccaagacagagcggtaaggcgaccagaaacaccaccagacccgcaggaatgtcgcgacgcagggtatcgaggttcataatgaaggttcctctgcagattgatgaatcagctctttaagatggccggagcgcaggtcatacacacaaccaaacacctccagtttcctggcccgattgccagatttgccggaccggttcagatttcaccagtctggcgaattgcgccttaacgttggcctcaaccagccgatcgagctgttcacccggctccgcgtctgaaggggggctttccgccaggccatgctgaatgtcatgacgcagcgtctgaatgcgtctcgccagcgcgctctcctgcccgtccagcacgctacccggcagattctgcgcggcttccaccccaccgcagccatagtggccgcttaatacaatgcgttttacaccgagaaagaagagcgcgtattgcagcacgctcagtaaattgtcatcgtcctcaatcaccatgttggcgatattacgatgcacaaagagttcgccaggatgggagccggttaagacttctgccggaacgcgactatcagaacaacctatccagagtgagtgcggcttttgctgatgaaggaattttttaaagtagtctggattacgctggcggcgctgtaatgcccaactgcgatttttcgctaataagggtttaagtgtcgtcacaatcatcttctctctactaccgggatgtcgcatcctggctaaccacaaagtgtatcggctcacaaataaagcgtgagccgccaggtaaataagaactgagtcacagaaaaaggttatagccgctaaccattaccaatgcacgagcaatatttcacagcactttaacatcatgctatttgtcaatctggcgtcagtaagagtcaggggtaagtaaatttaattaagcagcagagaagtgaaataattagcggaaaccattttaagatcaataatatcaatagattaaaatataaaagataataaactaaagttattgctgacaaaaaaatacaatcattaaccaaggggatattcactgccataccaaccggcctgctttttaccaggaatactcttaattaaaaaattaaccattagcacgatcaaccggcttaattgctgatagccagtcagatatgcctgattttagataagaatgaagcaagagataattaatttaatttgcagcaaaatagtgacgggagaaagtaaatcaggaccatgttttaacagagcctgacacggtcaggctctttttcttgacgaattatttaccgttccagctttgcaggcgcgattcccgcacagacagctgctgttcgggcgtcagtttattgtagttttccgccattccgctctcccagtcgccgtagagcggattcggcagcacgatgaactgcgttccaaactgctgatggttaagattcacaaaatcacgacgcgtctgattaccctgatgccaggtcgcgccaccaaaatcgttgaggttatcgccaacgtagagcaccacgttatagccggcatttttaatggcatcgaaacgcgcctgcttattggagctgtcagtattcagacgtaccgttttatcgctgacgttggggaagccgagctgctgcatgttagcgaccgtggccgcgtaatctttctgatcgcggttcgacacatagaacagcgtgccgccattctgtgtgacatgacgcgcaaactctatcgcgcccggcaccgctttcgcctgccgcgcctgtgtccaggctgaccaggttttgctgctgaacggctggccgtttcttcgcctgccacgcgctgtaggcactgttatccagcatcgtctcatccagatcgacaatcaccgctttgggtttgccagtcagcgagggggcctgatcaaacgccatacgcgcggtattaaatgcctgccaggtcagcgcctgatattcaccagactgctggaaccagtttaccgccagcaccgattgctggccgagttgctgttgcgcggtctgatgtgacgacgaggcgcagccggtaagcagcagcgcgaccagtccggatgcagccagttttgcggaggttttcatcatttcatccttaaggtgagaaaggtctgaggagaagcttcaaaaatgtagcagttaacgtaagctgtgggcagcccaacgcacgctgttataacaggagattcctatggccgtgatcccgcgctcgccattgctcgattcgctggagtggctcgaatatgcgtttcagccagccggagagccaccacccgctgaggccgcctatggacatcagcgccacagcgcgaccgtggtcaccgatattgagaacatcccacccaaaagctgcgagtctgatggcgtgattggcagcgggacgcgcccggtggcggtctacaccgccgactgcctgccagtgctgttcgccgatcgccagcagcggatcgtggccgcggttcatgccggactcaaaggtacgctggtgggtgtgctgacccgcgcggttgaaaaactgtgcgagcagggctgcgagccgcagaacctgatggtggcgatcggtccggcgatgggcccctgctgttatgaactggccgaaccgcagctggcggagattgcgcagaacccggcattggccagcgggctgcgctggcaccagaaccagccggttaatcctctggcgcaacgcccacaggccgctgcccgccagcagggtgtctggttcgatctgcctgcgctggcgacgcagttgctggtgcaggcgggtgtgccggctgcgcagatcgataacgtcaatgtctgcacctactgcatggccgaaagcggttcaagctaccgcttcaatactcaccacggcagcggctatcactcccgctattcgtggatccgtcgacgttaatgggttttctggcaccgcgctgacagcagataacggaacctgaactgcgacgggcgctgacgcctgtcgcaaagctacgcgggccacggatggcggtcttaacctctttgcgcaaggcacgggctagctccgcccactctttgttactcacctcactcccctgccgttgtttatgatttcactcacaccctgacattctttcacttttttttaacgcagaagtggctagagtgaactcatccgaccactttaccgtgagtgactatcatgtccgtcaatcctgactatcctgcgctgtttacgccgctggaccttggctttacccgactgaaaaaccgctttctgatggggtcgatgcacaccggactggaagaacatccggatggtgcagcccggctggcggctttttacggcgagcgggcgcgtgaaggcgtcgcgctgatcgtcaccggcggcatcgcccccaatgcccagggtgtcaccaccgcgcatggcgcgatgctcaccgacgagacgcaatgtgactggcaccggcagatcacggaggcggtgcatcagcatcagggcaaaatcgccctgcagatcctgcataccggtcgttacagctatcagcccgatctggttgcgccctcggcacgccaggcgccaattaacccgtttacgccacaggcgatgagcgaggcggcgattgaacagaccattgatgactttgcccgctgcgcccgactggcacagcaggcgggctacgatggcgtggagatcatgggttccgaaggctacctgattaatcagtttctggtgaagcacaccaatcagcgcaccgatcgctggggtggcgacttccggcagcggatgcagttcgcactggcgattacccgcgccgtttcgcgccgcgaccggtgacgcctttatcatcatcttccggttgtcgatgctcgacctgatcgaagagggcagtacgctggaggagacgctgttgctggcgggcgagctggagcagtgcggcgtcacgctgtttaataccggtattggctggcatgaggcgcgcatcccgaccatcgccacctgcgtgccgcgcgcggcctttgcgtgggtgacgcagcgcctgcgtgaacaggtgaaggtgccggtcatcgcaaccaatcgcatcaaccatcccgccgtcgccgagcagctgttgcagtccggctgcgccgatatggtgtcgatggcgcgcccttttctcgccgatcccgcctttgtcactaaagcccagcgcggtgaaccggacagcatcaacacctgcattgcctgtaatcaggcctgcctcgatcaggtgttcgccggtaaaatcacctcctgcctggtcaatccgcgcgcctgccatgagtcgctgatgccggtcatcgccagcaccgccccgcgcaggctggccgtagtgggcgccggtccggccggcatggcgtttgcgctacaggcggcgcagcgcggccatcaggtaaccctctatgaggccgcgccggagataggcggccagttcaatcttgcacggctgatccctggcaaatcagagttcagcgaaacgctgcgctatttccggcatgagctggcggccgcaggcgtgacggttcagacaggcagtcgggtgacggcggatcagttgagtgacgccgatgaagtggtgctggcgaccggcattcagccgcgtacgcccgatattccgggcatcgaccaccccagcgtgctgagctatctggaggtgctgcgcgataagcgcccggtaggtaaacgggtagcgattatcggcgcaggcggtattggctttgatgtggcggagtatctgtcacagccatcccatgacgaagatctggcggcgttttatgccgaatggggcatcgaccacagcctgacgcagcgtggcggcgtgatgaaacccgagccgcctgctgcgttacggcaaatctggctgctgcaacgccgatcgggaaaaccgggtgccgggctggcaaagaccaccggctggatccatcgcgccagtctgcaggcgcagggcgttgagatgtggggcagcgttgagtatctggcgattgatgacagcggcctgcatctgcggcgcaacggcgaaacgctgttgctggaggtcgataatgtgattatctgtgccggacaggagccgcagcgcgaactggaagccgcgctgcgtgcaaaaggacagagggtgacagtcatcggcggtgcagatgtggcgcaggagctggatgcgcgccgtgcgattgcgcaggcgacgcagctggcattaaccgtctgactagcgcattttcaccgcgcgcagcaccacgaacttctggttagaggcgatcagcgtacagttaccaaacagcttcttcagcttgtggtgataatcgaggtggcggttgccgacaatacgcaactcgccgccatactgaaggcagcgtttggcatcacggaacatctgccatgccaggtgatcggtcaccgcgtgctgctgatggaacggcgggttgcacagcaccgcgtgcagccgatctgacggatagccgctcagcacgttgttcaccaggaactgacagcgtgacagatcctcaggacggttcacttccacgttaagcttgctggaagcgaccgccatgtaagactcatcaaggaaatgcacctcggcctgcgggtttctgctccagcgccaccagtcccaccacgccgttaccacagccgagatcgacaatctcgccctcaatgttttccggcagatgctgcacaaagagccgtgcgccgatatccagcgaagcgcgcgagaagacgttggcgtagttgtgaatctgataaggggtgccatccagcggccagaccagcgtcggcgtggcctcacgcagttcaggcttgctgaactggctgtagatcagacgcgcttttttccacgccagtgaggttttggtttcaccaatgatctgttcgaacagctgcagcgtagagttatggatctctttggcgcgcgccgccgccagaatcaccgtatcaggcgtgacgacttcgcggatggcgcgcagctggtgctccagcagcgccagggttttaggcaccttgatcagcacagccgcaggtgaagcaggcagttcagccaggctatcaacaaagtgaacgtcgctgtcatccagcccattaaaggtcaggttctgacgggcggcctgctggctcagccaggagtcgctgacgtgccagacggtacgcggattcagggcgcaggttaatgccccgaaactgtcgttgaagaccagcaccggcccctctggcagcgcctgctgtaacagatattcatcagccgcatcccaggcttgcaatggactttcgtcacgcatctgcgggaagcgatgcaggatcagtgtgcgatcgttcagttcaagttggctcatgaattctccggcgtggtacactttggttgatttttcgccccaaaatcgggggcgcagtatactgtctttcgcctggaatccctaatgtcctcactgatctaccttcagggttatcctgccccccttcttgagcaggttcagtcgctgatcgtccatcagcgcttaggtgcgtttctgcaggaacgttatcccgacacccacgacgtgatgagtgataaagcgctgtatgactacacgcaggcgctgaaaaatcgctatatgcgcaatgcgccgccgatcagcaaagtgatgtgggataacaagattaaggtgatgaagcatgcactcggactgcacacagccatctcacggattcagggcggtaagcttaaggcgaaagcggaaattcgtatctcgacctttttccgcctcgcgccagagccgtttctgcggatgatcgtggtgcatgagctggcacaccttaaagagaaagatcacgataaggcgttctaccagctctgctgccatatggagccggattatcaccagctcgaatttgatgcgcgactgtggatgacggaccaggcgatgcgcggcaacgcggcttaaagaaactcctgcgctttctgaatcaggctggttttggtcagcgcgcccagaaagcgccgttcctgcggattgttgagcaccggcaaccgctccagcgtcaccgccgcaaaggcttcccatccctcacgcatactctgattctgatacaccaccgggaaatcctgatccatcacgcactgcaccggtgagtcgagggtgatctcctgggccagcacccggcgcgaaatttcatgaatcgagaccacaccgaggaaagcgcccgcggcgttgatcacataaacatagcgttcacgcttcagggagctgaccgccagcgcctgccccaccgactcctccggctgcaacgccgcacccgcaataatcagctcggcaatgcgcatgttatcgaaatcatatttcgcttctgaacggctgaagtgatgactcacgaccggataagtactggcggattgcaggcgatagaccaccatcgacgccagcaccgtggcgatcatcagcggaaacagcaggctgctgttgagtgtcatctccagcaccatcagcatcgccatcaacggcgcctgactgaccgccgccagcaccgccgccataccaatcgcggcataaagcagcacattgccgagcggcagatgcagcgccgcccccaccgtcgcgatgatcacccccagcagcgcgccaatcagcagcgaaggggtaaagagtccgccgacggcgttcgaccctaccgacaggctggtagcgagggttttcagcaccagcaacagcagcagacccggcagcaggtagtgccctgccatcactttgacgatcacctcgtagccgttgccgaggatatcagtggagatcagcgccagtaagccgaccgcaaagccgcccgctccgaggcgcagcggcagggaggcgacccggctgaacagcactttgctgcgggcgatgcatttaatcacgatccagcccgccagaccggcgcacagaccaatcaccaccgtcatcagcaggctgctgagatccatggcgaagttcgcgtctgccagcggatagagcgcgctgcgaaaacccagcgtccacatggtcatcaccgccgtggcggcagcgatgatcagggggatcagccgctgcaacgcagaaatgccgaaggcgatttccgccacaaaaatcgccgacgccagcggcgcatggtaaaccgacgcgaggcccgccgccgccgccatcgccaccacgtcactgtttttcaggttaagtgaggccggtaacaggcgaccaatcgcactgccgcatagtgccgagagctgcaccatcggcccctctttacctatcgacgcgccgctgccgatactggcaatcgacgataaggcgcggaacagtgaggtccgggtcggcaccgcatcgagccgggcgttgatcacttcaaggtaatccgttttcaccgtctgctgctgctcaatggcaacggcataacgcagaaaatagcccgccagtacgccgcccgcccccaccagcagcggccagaagatccacggccagagatgcagggattcggttatttcgccactgcgggcaaacagcagatggttgatcagttcaatcacgccgcggaaagccagcgtcaccagcgacgccgcacacccgaccggaatggcgatcagaagtgtggtccagtttaatgcgtgcttacttgctttcacctgcgctccctggttggtacataaacatcatcgctttcgcatattattggaatgcggatcgcaggatcaatccctgcccgcccggcaccattgcacagcgtgggtgagatgttactctgccgctttacagctgccggagagatgacgtgattcgttttgccattgtgggaacaaactggattacacgccagtttattgatgccgctcatgaaaccggagcgatgaagctctgtgcggtctattcacgcagtcagcagcaggctgaggcctttatcgccgattatccctgcaaacagacctttacctcactggaagcgctggccgccagtccggagatcgatgcggtctatctggccagccccaacgcactgcactgccagcaggcgctgctgtttatgtcgcacggcaagcatgtgatttgcgaaaaaccgctggcctctaatctggcagaagtggaacaaatgatcgcctgcgcccgtgagcatcaggtggtgctgtttgaggcgtttaaaactgccagcctgcctaatttcctgcggctgcagcaggcactgcctgacgtgggtaaactgcgaaaagcgctgctgaattactgccagtactcctcacgctacccgcgctatctcaacggtgagaaccccaatacctttgatccgcgctggtcgaatggctcaattatggatatcggttattactgcctggcctcggcagtgacgctgtggggcgagccagatcgcgtgcaggccagggcgactttgcttgcgagcggcgtggacgcgcacggcgtggtggtgctgagttacggtgatttcgacgtgacgattctgcattcgaaggtgagtgattccagcctccccagcgagattcagggtgaagcgggcgcgctggtgatagagaagttatcggagtgccagcagctgacttttgtgccgcggggcgcggaaaagcagacgctgagccagccgcagcatatcaacaccatgctgtatgaggccgccgcttttgcccggctggttgagcagcgccaggtggaccacccttcgcttgaggtttcgcggattactgcatcgctgctgactgagatacgccgccagaccggcgtgatcttcccggccgaccaggctgctgtgtaaatatttctaaatatgtctgagaggtgttgcttcctgtgcggctaaaccgtaacttaccctcctgcaaaggggagtaacttgtaagctgattgatcgtcattacgatgcgaaagcatccggtcatcaggcaacccggaatcaatttctgtgttgtaagtgagaccttgccggaaggcgaggtttgcttacacaaaaataagcggctgacgtcttctgacttcagccgttttttttatttttcggacaggatacgaatatgcaaactgtgggtacgcctttactgtggggcagctttgcggttgttgtgcttatcatgctggctatcgacctgctgttgcagggacgccgtggcgcgcagaccatgtctttcaaacaggcggccgtctggtcgctgatctgggtttcagtctcactgctgttcagcgccgccttctggtggtatctggagggcagcgcgggacgtgaagttgctaacacgcagacgctcgccttcctgaccggttacgtgctggaaaaagcgctggcggtggataacgtcttcgtctggctgatgctgttcagttacttctctattccggccaatctgcagcgccgggtgctgatctatggggtattaggcgctatcgtgctgcgtaccatcatgatcttcgccggtagctggctggtcacgcagttcagctggatcctctatgtgttcggtgccttcctgctgttcaccggtgtgaaaatggcgctggcgaaagaggatgacagcgcggtgggcgaaaaacctgtggtgcgctggctgcgtaagcatctgcgcatgactgacgatctcgacggcgagaagttcttcacccgcaaaaacggcgtgctgtttgcgacgccactactgctggtgctgatcatggtggaaatcagcgacgtgatctttgcggtcgacagtatcccggcaatcttcgccgtgaccactgacccgtttatcgtactgacctcaaacctgttcgctatcctgggtttgcgtgccatgtacttcctgctggcaaacgtggcggaacggttctcgatgctgaaatatggcctggcgattgtgctggtgttcatcggctttaagatgctgattgtcgacctctaccatatcccggtcggtatctcgctgggtgtggtcggtgccattctggcatcaaccctgctgattaatgcctgggttaaccgcaaaagagaccagaaaaagctcgcaccataattacctgcaggggcatccgatgcccctgttttattttgtggcagcctgtcacgccatttcatccctctgtcacacttccactatccagcataataaaaatctgacctgctccacagtgacagaactttctcttttctcgtccgatcttttccttatactccgccgggcaaaccgttttagccgatgcaaaacatcgcgtctgaaactacatccgcgacaaaatatagaaaatattatgcagaaaactctctccgcacgtctgggcacgctgctcgccggaagcctggtgaagcaaatcatgattgggctgatcgccggtgtggcgctcgcctggatttcacacgatgccgctatcgcggtcggtctgctgggtgaactgtttgtcagtgcgctgaaagcagtcgcgccattgctggtactcatgctggtgatcgcctcgattgccaaccaccagcagggccagaagagcaatatccggccgattattatgctttatctgctgagcacctttttcgcggcggtggtcgcggtagtcttcagccatctgatcccgcagacgctgacgctggcggtgggcaccacggaaatcacaccaccatccggcatcaccgaagtgttacgcggactgctgatgagcatggtgtcgaatccaatcacggccctgatgaacgccaactacatcggcattctggtgtgggcaattggtctcgggctggcgttccgtcacagcagtgacactacccgcgcctttctcaatgatgcctctcatgcggtgacgtggctggtacgctgcgtgattcgctgcgcgccgattggtattttcggtctggtggcctcgatcctcgcgtctaccggctttggcgcactgtggcaatatgcgcatctgctggcgctactgatcggctgtatgctgctgatggcgctggtggtgaacccgctgctggtgttctataaaatccgtcgcaacccctatccactggtcttcacctgcctgcgcgaaagcggcgtgaccgccttctttacccgcagtttctgccgccaacattccggtaaatatggcgctggcgaaacgtctggatctggatgaggatacctattcggtgtcgattccgctgggcgcaaccatcagtatggcgggggcatcgattaccattaccgtgctgacgctggcggcggtgcatacgctggggatcagcattgatgtgccgacggcgattctgctgagtctggtggcatcactctgtgcctgtggtgcatctggcgtggcgggcggttcgctgctgctgatcccggtggcctgtaacatgttcggcattccgaatgatctggcaatgcaggtggtggcggtcggctttattatcggcgtcctgcaggattcggcggaaaccgcgctgaactcctcaaccgatattctgtttaccgcagccgtctgtcaggcagaagcggagcgcgaaaccagccgggcttaacctttcagatagctcaaaagctcaaagagtgggtggcagagtccgaagagcaaagcgtcccgcgccagggaaggcgcgggccgagcgagcagggatgctttaagcgactttgcgatcggactctgccacccacgaagggcacaggattaaccgacggtaataacaacatcaggatcgccattgtttgcctgacaaactatagcgttacaccgcttttgaaaatcgccagctcgcggaaatcgttcttctcgttgttggtcggctgaccgctggcaatcgccacaatgctgtcgacaaagtcttccagcatcgcatccatactcattccctcgatcaaccgtccggcattaaagtcgatccagtgcggtttcttctccgccagcggcgtattggtggccagcttcaccgtcggcacaaaaccgccataaggtgtgccgcgtccggtactgaacagcaccatgtggcaaccggctcccgccagcgcactggtggcgaccgcatcattgcccggcgcactcagcagattcagccccggcgtttttaaccgttcgccatacttcagcacatcgaccacctggctctgccccgctttctgggtacagcccagcgacttctcctccagcgtggtgataccgcccgctttgttgcctggtgacgggttttcgtagatcggctgctggtgatcgataaaatactgtttgaaatcgttgatcatcgccaccgttttgctgaaggtctcctcgtcgcgacagcgactcatcagaatccgttctgcgccaaacatttccggtacttcggtcagtacggtcgtgccgccattggcgatcatctggtccgagaaacgtcccagcaacggattggcggtgatgccagacaaaccatccgaaccgccgcactccagaccaaacttcagctcgctgagtttgcccggctcgcgctggtcgtgacgcattttttcatacaatgcgtgcagccgctccagcccggcttccacctcatcgtcatgctgctggcacaccataaactcgacccggtcgctttcaaacgcgccgagggtatcacggaaggcatcaacctgattgttttcgcagccgagaccaatcaccagcaccgcgccagcattaggatggcgcaccatattctgcagcatggtgcgggtgttttcgtgatcctgccccagctgcgaacaaccgaatgtatggctgaacaggaacgcgccatcgatgtcttctgcctcctgcgtctctttcaggaaacgctgcaggatctgacgcgcaatgccgttgacgcagccaacggtcggcaggatccacagctcattgcggatgccgacctcgccgttagcacgacggtagatctgcacctcacggtcacccggctgcggcggtagcgtcacaaactcgggctgatacgcatactgatccagatcgctgagattggtgcgggcgtttctgcgaatggattaactcaccggcggccacaggctgcgtggcatgggcaatcggcagcccatatttgatcaccagctcatcctgcgcgataggctgcagggcaaatttatgcccgcgtccgaccgcctgttgcaccgccacacgcagtggcggcagctctatcatggcgcccgcgtctaaatcacgtaacgccacggcgacattgtcgcggggatcaattttaattgcgtcttgcatagcgttatctcagttggctcagcgcctcacgcattccgtgggcgatgatattttgcaggtgttgggtgacagccgcagccagtccgggctgacgggttaaatcttcaccccagtgttgcgcgtcgctgagtacgccgttcaccagctgttgcggtgacagctgatccgcatcaagtgctttccaggcgtcggcgtagcgctgtaaccactgcggctcgtcctgcaatggccagctcttgccggctgactcgccgcgataaaaagcgatcagcgcagccagcgcaaaggtgatgtgtgccggccactcgccggtttgctgatgcgcggcaaggagtggcgtcagcagacgggtgcggaatttggtcatgccattaagggcaatcgacagcagcgcgtggcgaataaacggattgcggaaacgacgctgtaccgcatcggcaaacgcgtgcagttcatcggcaggcagatccagcgtcgggatcacttcgtgacgcagcaggttatccacaaatccggcgatagccggatcggccatcgcctctcccacactctcaataccggccagaaacgcgaccggtaccattgcagtgtgcgcgccattgagaatggccactttttgcgctttatagggcgcaatgtcatccacatgccgaacctgcggcgacagcgccgccagcttcagttcattaaacagcgccgacggcccctgaatcacaaactgatagtagacttcgcccgccaccagatagcgatcttcataacccagctcgcgttgtagctgctcgctttccgccgggaagccggtgacgatgcggtcgaccagggtgttatagaacgcgcagtgctgatgaacccaggttttaaattcggagggcagatgccactgatcggcgtagcgcagtaccagatcgcgcagcgtatcgccgttatggtcaatcagctcgcacggcaccaccagccagccccggtcgctggcgccgttgaagaaggaatagcgcgcccacagcagctgcgtcagtttgccggggaaactgctggcgggctgatcggtgagctgatccgtgccgacaaaggcgatgcccgcttcggtagtattggagaagaccatgcgcagatccggattacgggccagcgccataaactcgccgaactgctgccagggctggatttcacggttgaggctgcggatcagccgggtttcgctgacctgctcgccctgatcgttcagcccgcggatcagtgtggtgtagagtccatcctgctgattcaggctgtcgctgacttcacggttgcgcggccgcaccaccacgatcccggcatcggtgccctgatgttcattgagccagtcgatctgccagtcaataaaggcgcgcaggaagttgccttcgccgaactggatcacccggtcgcgataaaccgcgcccggaaagtcgtgacggtttagccttttcattatcaggctcccagctcgatgccgaagtaatcgcgggcattgttgaagcagatgttctgtaccatctgacctaacagtgcttcatcggctggcgcttcaccctgctccacccagcggcctatcatctggcacagtagccggcggaaatattcgtggcgggtgtaggagaggaagctgcggctatcggtcagcatgccgacgaaacggctcagcagaccaatctgcgccagctgcgtcatctgacgctgcataccatccagctgatcgttaaaccaccaggctgaaccaaactgcatcttgcccgcctgaccttcgccctggaagttgcccgccatggtggccaggacttcgttgtcgcgcgggttcaggcagtagagaatggttttaggcagcgcattattgagattctgcgcgcccagcaggcgtgccagcggttcggccagcggctggtcgttgatcgaatcgaagccgacatcaggccccagcagctggtactggcgcggattggtgttgcgcagtgcgccaatgtgatactgctgcacccagccacggcgggcatattcgctgcccagccagaccagcaccgccgttttaaactgtgccgtttcctgcgggttgggtacggcaccgctgcgacgacgcgccagaatcgcatccagcgtggcgtcatccgcctcggcgtagcagaccacatccagcgcgtgatcggagactttacagccgtgcgccgcgaagtgatccagccgctgatgcagtgcgctgcgcagatcgtcaaaacgctgcacgctgatatccgtcagctgctccagcgtctcgatccacggcaggaaggtttccgcttcgatattaaacgctttgtccggacgccagctcggcagcactttaacgctgaagctggcatcgtctgccagcgcgcggtgatggcgcaggtcatccagcggatcgtcagtggtgcccaccatcttcaccttcatctgctgcatgatgccgcgcgtggtaaagctatcctgcgccagcagttcattgcagcgatgccagatgctgtcagccgttttctcagaaagcagcgtatcggtaataccgaaaggccggcgtaactccaggtgggtccagtgatagagcgggttgccgatagtgtgcggcacggtacgcgcccaggcgtcaaatttttcacgatcgctggcgttaccggtacagaaacgcctcagccacaccgttggcgcgcatggcccgccacttatagtgatcgcccttcagccagatgtcataaaggttggcgaagcgataattttcggcaatctgctgcggcggtaagtggcagtgatagtcgaaaatcggctgatcctttgcatagtcgtgatagagacgacgggcgaattcggtatccagcaaaaaatcttcggtcatgaaacgtgacatacatgcttcctcatcgactgaaccacggatggcccaaagttatcataccaattttagtccgttacggatttatttgcgatcctgctcacataaacggcggtagctggctgccgttatggacgtttttgtcgtccgcatcgcgctaaatggctgtcattacgcaggtttccagtatcccacagtgcagaaagggtttttgtgatggctctcaacttttaaagttgtataacaagttaggctctcgccccatcgtgaggtcgttagcgactcacaaatggcaaggtcataacagggttgctcatacagaacctgcgggcgtgagcagagctacatcacgtgctgtcccgctccagataacaacagcggcaagaccgcatacagaactggaagaggtagaggatgcgtaagatcaaagggttacgctggtacatgattggactggtgacgctcggtacggtgttggggtatctgacccgtaacaccattgccgtggcggccccgacattaatgtcagagctgcatatcaccacgcagcagtactcctacataattgcggcctattcagcctgctacacgctgatgcaaccggtggcaggttatgtactggatctgctcggcaccaaagtcggctacgcggtgtttgctattatgtgggcgattttctgtgccgctacggcgatggcgggcagctggggcggactggcgctggcacgtggcgcagtcggtgcggctgaagcggcgatgatcccggccggactgaaagcgagcagcgaatggttcccggctaaagagcgttcggtcgccgtgggctactttaacgtgggttcgtctatcggtgcgatgctggctccgccgctggtggtctgggcgattgtggcgcacagctggcagatggcatttatcatgaccggtgtgctgagcatggcctgggcactcagctggctggtgttttacaaacacccgaaacagcagaagaagctgagcgatgaagagcgcgactacattatctccggccaggaagcgcagcatcagaccggcaacacccgcaaaatgtcagcactggagattatccgtaaccgccagttctggggtattgccctgccgcgctttctggcagaaaccggcatggggaacgttcaacgcctggattccgctgtttatgtttaaggtttacggcttcaatctgaaagagattgcgatgttcgcctggatgccgatgctgttcgcggacttcggctgcatcctcggtggctatctgccgccgctgtttcagcgctggttcggcgttaacctgatcgtctcccgcaagatggtcgtgacgatgggtgcggtgttaatgattgcgccgggcaccatcggcctgttcaccagcccctacgtcgccattggtctgctgtgcatcggcgggtttgcgcatcaggccctctctggcgcgctaatcaccctctcctcagacgttttcggccgcaatgaagttgccacggctaacggcctgaccggcatggcagcctggaccgccagcaccatgtttgcgctggtggtcggtgcactggccgatacgctgggcttcagcccgctgtttgccgcgctggcggtgtttgatctgctgggcgccgtcgttatctggacggttctgaaaaataaacccatttcagagctgaatgccgaagccgttattccgcaggccagcgccgttcgcagttaatctgccgggctggcgcaagccagcccatttcctcgcacctcctgaagtggtataacaacttatctgtctgctaccaggattgtgctatggacttcactgaatcccgtcgactttatcaacagctggccagcgagctgaaaagccgcattgaaaccgggatctatccggtgggtgacaaactgcctgctgagcgcctgattgccgaagagatggaagtgagccgcaccgtcgtacgtgaagcgatcatcatgctggaagttgaaggctatgttgaggtccgcaaaggctcgggcatccacgtcattgccagccagcagcagaaccgcatcgcttccaccagcagtcagctggagtttgccacgtttggccccttcgaactgctccaggctcgtcagctgattgagagtaatgtggccgagttcgctgcaacgcaggtaacgcgtcaggacattatcgacctgatggcgattcaggaaaaagcccgccaggaggatcacttccgcgactccgagtgggatatgcagtttcatgtacgtatcgcgcaatccacccagaacagtgccttagccgccatcgttgaaaaaatgtggctgcatcgcctgcacaatccctactggctcaaacttcacgaaacacatcgaccagcgcagcattctcagctggtgcgacgaccacgatcagattcttaaagctctgatgcgcaaagatcccgccgccagcaaactggcgatgtggcaacatctggaaaatactaaacagatgttgtttaacgcgacggcggatgattttgaatttaacgtggatcgatacatgtttggtgagaatccggtcatcctgcctgatgggtccaataacgcccgctaaaagtgcctgaaaatgccctgagatggtcagttaatctgcaatagtgtcaggtcatgtaaagctcctttttacacgccgtttcacaaggtaaaactcctgttcgccagagagttttcctgtctcagacaggcgatttttgttacagttatcgcccttttattaccctttgcgactgggggttataaagtcgctgatttaacaatcaattctggaaggatccggaaaatcccgcccaggctgcgctcctaaaatttataacgaaatgccggtctgcgtttaagtccctgtgggacatgtttaacaatgatgtttaggaatgaattgatggatattttgcaatcgttgctgcatgccctctggcagcaggactacgaaaccctctccgatcccacgctggtatgggccatttacggcgtgctgtttatgattttgtttttagaaaatggccttcttcccgctgcatttctgccgggtgacagtctgctgattctggtcggcgtactgattgctaaaggcaccatgagcttccccctgacgattctggtgttaacgaccggtgccagtcttggctgctgggtgagctacttacagggccgctggctgggtaacacgcctacggtgcagaaatggctctcccatcttcccgcccagtatcatctgcgcgcgcacagcatgttccatcgtcacggcttatctgccctgctgattggtcgctttatcgcgtttgtgcggactctgctgcctaccatcgccggattgtcaggcctcagtaatgcccgctttcagttcttcaactgggtaagtgcgtttctgtgggtggtgattctgaccgttatcggcttcgcgctgggtaaaaccccgattttccgtcgttatgaagatgagatgatgttcttcctgatgatgctgccgctggcgctgctggtgtttggtctggtgggatcgctggtggtgatatggcgtaaacgtcaggcgaatcagaatgggaaagccgagtaatgaaactgctgcaggctattcctaaacggtggttaccgtggttgatcgctggcgtctttgcgctggtcgcgctttgtgtggtccccggtctgatgaagcacgagacggtggtgcagattcgggtttcccatgctggcgccaccctgcccgatggtttttatctctaccagcaattaagtgcgcagggtattcgtatcaaaagcattacgcctgcgggtgatgcactgatcatccattttgatagcgaagagcagagcctggcggcccagaaggtgttacgccgtctgctgccacagggctttattgtggcgcagcacgatcactctcagcacctctcactggcgtaatctcccgactcccctctccttttcagaccgtcgcgccatcgctcggcggtctgaaaggcgctctatctcccggtcttctttgaactttttactatgggtgtctatgcttaagcgagagtcgattcttagcacccgcagccatatgattacgcgggtgatgatggatcaggtcgcaatggaagggtccaggaccaatgaaatatcaagtattactgggagtcgcgctgttttcgctgtcgggttcgctgctggcggcagaatcgctgtgtgagcagaaagagcaggatattcagcgtgaaatcgggatggcgcagaagcataacaaccagcgccgggttaacggtctggagcgcgcgctgacagaagtccgggccgattgcagcgacaaaaagctcgaggccgcccatctggaaagaattaacgctcagaagcagaaagttgctgagcgtgagcacgcactcagggaagagcgtgaagagggccatgacaaggagaagattgctaagcgacaacaaaaactggatgaagcgcgccgggagctgaaaaagttacaggcggagccctattaatcggaactaaccaactgatgttaaaggagtattttatgtctaaagacacatcatcggaacatttgcgtgctgaactgaaaaacctggccgataccctggaagaggtgctgagcagcagcactgaaaaatccaaaggcgagctggataaacttcgcaataaagcgcgtgtggcgctggatagctcacgtgaacgtctgggcgaatcaagcgagcgcattgctgcgaccacccgcgaagcggcgcaaaaagccgaaggctacgtgcgtgaaaatccatggcatggtgtgggtatcggtgcagcgattggcgtcgcactgggcatgctcatttcgcgtcgataattatggctgactcacagcataaccacggcccggctaaaggggtcattaacatcggccagcgcattgttaccacgctggttggcatggtcgagacacgcgtttcgtctggcagtggtggaactggagcacgagaaagctaacctgattcagctgctgttgatggttggcctgacaatgctgttcactgcatttggtctgatgagcctgatggttctgattatctgggcagtggatgcgcagtaccgtctgatggccattggcatcacgaccggcacgctgctattgctggcggttattctggggctctggacgcttcacaaatcacgtcagtccacgctgttgcgccacacgcgcaaggagctggaaacagaccgggatttacttgaggaccagcgctgatgagccgccgcgagcgtgaagaacgcatccatgaactgcttaagcatgtgcagcagcagcggctggatttaagcgctgcgcggcgtgactggctggaaggcaccgcccattacgatcgcggctggttcaccttcctcagcttgcgccgctacctggccattggcagcagtgcgctggctatctactccgttcgcagtcccaacatgctgttacgctgggtaaaacggggattcggcgcctggagtacctggcgcatgatcaagtccgctctgccaccgcgttaattttgctaaaagccggtcctgaaaaggccggcttttcttcatcagaatttctgaaaaacactgacagtatatctcgcttacaacctttccactccgcgactatcatctccagctatcaacccaatgaacgcaatactgctttcagcgggcataaaccttgcgggcagcttgccctgcatccctgatagcgctggagtaaatgatgaaaaaattcgaagacgttggtttgttactggctcgcatcctgatgccaatcctgttcattacggctggctggggcaaaatcaccggttatgcaggtactcagcaatatatggaagcaatgggcgtcccgggctttatgctgccgctggttatcctgctggagtttggcggcggtctggctatcctgtttggtttcctgacccgtttcactgccctgtttactgcaggcttcaccatcctgaccgcgtttctgttccacagtaactttgccgaaggcgtgaaccagctgatgttcatgaagaacctctctatcgccggtggtttcctggtgttaggtctggtgggtcctggtgcgtacagcattgatcgcctgatcagcaaaagaaaaacacagccagcgattgcgcgctaatctcacatagagcgtaatgccacatatacttagcagggcggggacatttccccgccctgtttgcattggagccattatgggacagttaattgacggtgtctggcatgacacctggtacgacaccaaatctaccggcggacgtttcaagcgttcagagtcggctttccgcaactgggttaccgcggatggcagtgctggcccggtgggtaaagcgggatttgtcgccgaaacgcgaccgctatcatctttatgtctcgctggcctgcccctgggcgcaccgcacgctgctgatgcgtcagctgaagggtctggatagcattatcgatgtctccgtagtgcatccgctgatgctggagaatggctggacgttcgatgatagttttcaggatgcgaccggcgataagctctaccagaatgagttcctctatcagctctatctgcacgccgatccgcaatacagtggccgcgtaaccgtgccggtattgtgggacaagcagcagaacaccatcgtcagcaatgagtctgccgatatcatccgcatgttcaacagtgcgtttgatgctgtcggtgcccgtgccggggattattatcctgttgctctgcacgaaaagattgatgaactgaatagctggatctacgacaccgtgaacaacggcgtttacaaagcaggctttgccacttctcagtctgcttacgacgaggcagtcactgtgctgttccattcgctgtcgcggctggagcagattttaggccagcatcgctatctcaccggcgatcaattgaccgaagcggatctgcggttatggaccacgctggtgcgatttgatccggtctatgtgacccactttaaatgcgatcgccatcgcattagtgactacagaaacctgagtggtttcctgcgtgatatctatcagatgcctggtatcgcagagacggttaatctgccgcatattcgtcatcactactattgcagccataagaccatcaacccgaacggcgtcatttcgctgggcccggcgtttgactgggacgagccgcacggccgcggttaagctgcctgcatatcgcgcagggagcagatacaatctgaccgcaatgacaatctaaaagcgaagggaacagggtcagaagaggaaagcgtcccgcgccagggatggcgcgggccgagcatgtcagggatgacggattttgcgactttccgatctgaccctgtttcctttgcaggcgcgatctcaccgctgaccttcaaaccaccgcgcgtcacaaagcaaaaaccccgccgaagcggggtttttgataaaaagtcgaagctgaccgttaagccgggttctgtcgtggacagtcattcatctaggccagcaatcgctcactggctcaagcagcctacccgggttcagtacgggccgtaccttgtgaacccctatttggccttgctccgggtggagtttaccgtgccacgaactgttgccagtcgcgcggtgcgctcttaccgcaccctttcacccttacctgatcccatttctgggccatcggcggtttgctctctgttgcactggtcgtaggcttgcgcctcccaggcgttacctggcaccctgccctatggagcccggactttcctcccctctgcccgtctccccacaagtgaggacgacgacaaagcggcgactgtctggtcagcttcggcgcgggataataggacattcgccggcgtttgtcacgcctcttgctgctccagcgcatacttataaagcgcatttttcttcacgctgtggatctcagcggtcagcgcagccgcgcgtttcaacggcagctctttttgcagcagcgccagcgtacgcagcgcatcggctggtaacgcatcttcatcatcggtcttgtacccttcgacaatcagcaccatctcgcctttgcgacgattctcatcttcttttacccacgccagcagctcgccgaccggtgcaccgtaaatcgactcccaggttttagtcagctcgcgcgccagcaccacgtagcgttcggcacccagctcactcaccatatcctgcaggctgtcgatcagacggtgggtcgactcatagaaaatcagcgtgcgcggctcctgcaccagggcccgcagggcgtcgcaacggcctttggttttggcgggcagaaacccttcgtaacagaaacgatcggatggcagtcctgcagcacttaacgcagcaatggcagcacaggcgcccggcagcggcaccacacgaatgcccgcttcacggcagcgacgcaccagatggtagcccggatcgttgatcagcggcgtgccagcatcagaaactaaggctatgctttgaccctcctgcagcttcgtcagcagcagttcagccttgtgctgctcgttgtggtcatgaagtgagaagagtcgcgcattgatggcgaaatgttgtagcaacagtccggtatgacgtgtatcttccgcagcgaccagatcgacgctcgaaagcaccgtcagcgcccgctgggtgatatcacccaaattaccaatcggggttggaacgatgtagagcgtgctggcagaaatctctgcccgatcgagttgtttcattgtttcatccgaattgccgatttaatattgagcatcttgaaaaaaacatcactggatacagtatgcttccttcaaaagtcgttcgtcataaagcaggacgctttctgcctgtcattcttgctgggctgattttagccgcatgtagcggtcaggggccgcaaacctcaaccgtcaatattcaggggcccgtcacagccagctccgcttactatctgcagcaagcgcagcaaagcagcgatgatagcaagaccgactggcaattacttgcaatccgcgccctgctgaaggaaggaaagtatcctgaggcgactcagcaactgagccagttgccgcagcagctctctgagacgcagcaacaggaatccctgctgctgaaagcgcaattgctgattgcacagcagaagatcaaagatgccgaaccgctgttagcggcagtgaaaaccggcgcactgtcgcaggatcagctggcgcgttactacagcctgcagatcgccagcgcacagggtcgcccttcactctcgctgctgcgcaactatattgcccaggagccgctgctgaaaggcaccgatcatcagggcaatatcgacgccacctggcagacactgacccagatgccgccgcaggaagtcagcaacctggtcatcaatgccgatgaaaatgtgctgcagggctggctggatctgctcgcagtctggcgcgccaacacgcaggatgctgagatgctcaagtcaggcatcaaagactggcagacccgctatccgcagaaacccggcggccaaaacgctgccgacgcagctgagccagatgcagaactacaccaaagcttcaaccagcattattgcgctgctgctgccgctgaatggccaggctcaggtgttcgccaacgcgattcagaaaggctttaatgatgcgaagaatggcatctccgcgccggtcgctcagcctgcggcagctcagcccgccgctgctgatgcaactgccagcacccaacccgctgccgctgctggttcttccaccgatccaatcagcgcgccgcagcagcaacagcctgccgacgcgacgccacagcctcaatcacagcctgctgccgcggaaccggccagcaacgcacagatcaaggtctatgacaccagcagccagccgattgaacaggtgatgcagcaggcacagcaggatggcgccaccatcgtggtcggtccgctgctgaagagcaacgttgagaaggtcgccaacagccagacgccactgaatgtgctggcgctcaacgagccggaaaagatccagaaccatccgaatatttgctactttgcgctttctcctgaagacgaagcgcgcgatgcggcgcaccatatctgggatcagggcaaacgccagccgctgttgctggttccgcgcagcggactgggcgatcgcgtcaccaacgcctttgctcaggagtggcagacgctgggtggcagcaccgtgatgcagcagcgctttggttcgacctcagagctgaaacagggcattaacagcggcgcgggcatcagcttatccggtacgccagtgaacgctgcacctgccgagccgcagggtgttacgattgcgggcctgactatcccggcaccgcagcagaacacgccagatgtggtcagcaccagcagcggcggcggtgtcgatgcggtctacattgtctcaacgcaggacgaaactgcagctgatcaaaccgatgattaccatgcgcaccggcagtcgtagcaatatctcgctctacgccagttcgcgcagcgcgcaagccggtgccggcccggacttccgtctggaaatggatggcctgcagttcagcgatattccgctgctctccggcagcaatcctggcctgatgcagcagacatcaaagtcattcaataatgactattcgctggtgcgtctctatgccatgggaatggatgcctggacgctggcgaatcactttaaccagatgcgtcagtcacctggctttacgctggacggcaataccggcaagctcagcgccgacacggattgtgtgatcaacaggaagttgacatggaaccagtatcgtcggggcgaaatcgcaccggccaactaaatcggcgtcagactggcgccaggtatgaagaagatgcccggcgctatctggagcaggctggcctgatatgggtcgccagtaatgttcactttcgcaatggtgaacttgacctgataatgcgtgacgggcactgttgggtgtttgttgaagttcgctaccgacgcgatgcgcgttatggtggcgcgctcgccagcgtaacccggaataaacaacaaaagctgctgcgcgctgccgctctctggctggcgcaacgcggcggcagttttgaaacagtgaattgccgtttcgacatcatcgccattaccggcacggcgctcgagtggctgccgaatgcctttaatgcagacgtttagaaccaggtggtcgtgtgcaggacagaattaaagcgtgttttaccgaaagtattcaaactcagattgccgcagccgaagcgttgcccgatgccatctcccgcgccgctatgacgctggtgcagtcgttactgaatggcaataaaatcctgagctgtggcaacggtgcctcatccgccaatgcacagcacttcgccgccagcatgatcaaccgtttcgagaccgaacgcccaagcttaccggcgctggcgttgagcgccgacaacgtgatgctgaccgcgattggtaatgaccgcctgcacgatgaaatctatgccaagcaggtgcgcgctctgggacacgcaggcgatgtgttactggctatctcaacccgtggcaacacccgtgacatcgttaaggccgtggaagcggcggtaacacgcgatatgactatcgttgcgcttaccgggtatgatggcggagagctcgccggactgctgggtccgcaggatgtggagatccgcattccgtcgcaccgcagcgcccgtattcaggagatgcatatgctcaccgttaattgcttatgcgatctgatcgataacactctctttccccatcaggaatgaccgaaggagcacgaatgaaagcattgaatgctatagctattctgttaaccgccatgctgctgcagggctgcgttgcggttgtggcgggtggcgcagcggttgccactaaaacggccaccgatccacgctcggtgggtacgcaggttgatgacagcacgctggagctacgcgtgactaacgcgctggctaaagatcagcagattaaaaccgatgcccgcattatcgccacggcctatcagggcaaagtgttgctgaccggtcaggcgccttcgcaggagatcgccggtcgtgccaaacagatcaccatgggcgttgatggcgcaaccgaggtctataacgagatccgtatcggccagaaagtgacgctgggcaccacgtcgtcagacacctggattaccaccaaaatccgctcgcagctgctgggcagcgatcaggtgaaatcctccaacgtgaaggtgacgacggagaatggcgaagtgttcctgctgggtctggtgacaccgcaggaagcgcaggcagcagctgatgtcgccagccgcgtcagtggcgtgaagcacgtcaccacggccttcaccatgctgaagtaatacgcaaaacgcaaaaaaggcggccatggccgccttttttattgcccgatgttcagaccggaatgtcgatgaccagtgcgcgggtcgccgttttcgccgtcagttgcaacagcttctcttcctgcaaaaaggcaccatcgccacagcccagcttctcctgatgatccgtgccggacatcgcttccagcgaaaccgtgaatcgactgcagataggctcgcggcccctgtaactgcagcgaatgcttttcgcctggtgccagctcgacctgatgaatccacacctgctgacgcagttgcagactgtcgtccatgccatccggcgaggcgatcagctgggacaaccggccatccgtcagggcaattttctgcatccgcggattttcgcgctccggacaggcggccagccagagctgcatgcgtgtcagcggtcgatctttgctcaggttcatttcggtgtaactcacacccggctgggcagagagcagcagcgcctccccttcccgcacgctgatggtgttgccttcgctgtcgcggtattcagcttcaccctgcagcacgatgttcagcacatcaacctgtggataggtgcgcggctgaaaagcggcacccggcgccagcacttcctggttcagtacgcgcagtgacgcgtaccccatcagtttgggatcaaaatagtggccaaaagagaaactgtagcgcgcctgtaaccagccgaaatcggcctgaccacatgcggacgcactgcgtgtcgttatcattgtttacctccagcatccggtgacgaggatcggccacggactatatgctcccatggtaaaagtctggacgccggattgttagccagttaatctgccgggcatgttcaaatttcctgacagagaaccgggatggctaaagagcgtgcgttaacccttgaatctttacgcgttatggatgcgattgatcggcgtggcagttttgccgcggcggcggatgaactggggcgcgttccttccgccctcagctacaccatgcaaaagctggaagaggagctggatgtggtgctgtttgaccgttccggtcaccgtaccaaatttactaacgtgggacgcatgctgctggagcgtggccgggtgctgctggaagcagccgataagctcaccaccgatgctgaagcgctggcacgtggctgggaaacccatctgaccatcgtcaccgaagcactggtacctgttgatgcgctgtttccgctggtgacgcgactggccgacaaggccaatacgcaattttcactggtgacggaagtgctggcgggcgcatgggaacggctggaacagggccgggccgatatcgtgatcgcccccgatatgcacttccgcgcctccaccgagatcaatacccgcaagctctacaccatgatgagcgtctatgtcgccagtgctgaccacccgattcataacgagcctgaaccccagtctgaagtgacgcgggtgaaataccgtggcattgcggtcgcagataccgcgcgtgagcgtccggtgctgaccgtgcagttactggataagcagcagcgcctgaccgtgagcagcatggacgataagcgccgtgcgctgctggctggcctgggcgtggcgaccatgccctattcgctggtggagcaggatattgcggaaggccgtctgcgggtggtgagtccggaatatacccgcgaggtcgatattattatggcgtggcggcgtgacagcatgggcgaagccaaatcctggtgcctgcgtgagatcccgcgcctgctggcgaagaaaaactaaagcgccgattcagggcgagggccaggagcggctcaggcaatccatcgccactgccctgaagagggtgaaatcggtgctgtcccgcaggcgggtcatcgccctttcacgcaggaacgtcacaaacagatcgtatatcgccatcgcctcttcatattcacttttgctgatcgccagcaggaaaatgacataggcggtatcgtctccccaggcgatgccgtgcggcgccagcaccgtgtaaaccacggttttctttgccagcagccccagcgagtgcggcagcgcaatgccttcgccgagcatggtgctgacaatcgcttcgcgctcttcaaccgacggatagaacgccgcatccacaaatccctcctcctccagttgatcgcacagctggcgaaacagttcagactgggtcatcggcctgtcgacgatatgaaagtgttgggcatcaaaaaatttcgccagcatatagggccgggtacggtccaccagcaccagcttgccaatctgttcaagctgaaaaccggtgggaaacggcgacatcaccaccaccggtttctctttttcgctgagccggatggtagagataacaaaatcttcgtcgatgcggctgcgcgcctcatactcgcgctgggacaggcgggccgtgacctgcaactgcggatatttgcgcagcagcatcgcctcaatcattcgcagcgtagagttaccgctgtcgcagaccagcagcacctgcggatgacgctgataaccgacgtcatagtggcgctccagcccgacaccgatatgcagcaccagaaagccaatctcattctcggtgatcacgtaaggggtatattttccccagctggtcaccgccgctaaggtgacatcataggccatgggatagtgctgtttgatgttactgagcagcgggttgggaatatgaatctgatagcgcacccgcgtaatcatggttttgatgtgggtgagcaggtcagcacgcagctgctgatcgttttgcagattgaagttgtaatgcgtgttgataaagctgagcagataatccaccagcgcgtcggcgtcatcagcattgatggcgctgggagcaatcgcctgaatgcgtcgcgcggcgatattgacccgcagccagttctcttccgccggtgaaatcggtttgctgaccagcggacgcatcagattaatcaggtgatgggccgcttcacgcacctcatcaccaatctcctctgcacccggatcgttaagcggatagccttcactgatgcgccgcaccgccacggcgcagtaaagccgcagatagcgttcaccctcatcgctgagccgaatgttgtgctgagcaaaacagctttgcagcagcgggcgcagcgtctccagcatgccgctgttcagcgcttcgattgtgagcagcgggctctcgggctgcgcctgatcaatttgccataacaggtcggtcaggcaggtacgaattgccacttcgctgccaaacagcttcatgccgtagtggggcttgctctcaatggtgaggtgatagcgccccagccattcgcgcacctccgccatatcattctgcagggtggcgcggctgacaaaccactcttctgccagctcttcaagtttcagggaataggcggcggtaagaaagcgggtcagcaggtagcgaacccgatccggcgaggtgcgcggcacccgcagcggcgacgcggtatgctgttgcagatgctgaaagcgctgagcatcctcaatcttcagctgatagcccgcgccgcgattgaggacaaactgcgcgccatgttctgccagcagcgcattcagcgccgtgatatcggtacgcacggtgcgtgtcgagacggcgaaacgccgcgccagctcatcctgaggcagcgtttcgttttgcatggcatcgaacagttgcgcaaggcgctgattgggaaatctcacaagcgttacctgtttgcagacagaaatagggaacatcagcctacggagatcgtctcgcaacgtccatgttgcgcgatctgcctgttgcaggcagatcgtgttgatctctaagccagcagcgttttacagatggccagcaactgcttcacatcttcaacgcgggtctctccgctggctttgtcgatgatcgaactgtagacgtgcgggatcactttgctgacgcccgactccagcgctatgcgcacgatctcaccgaaattttccagatcgatgccgccggttggctccagccagaaatctagctttgcacaggcttccgccacagcgcgatactcatccaccgcctgcagaccgcccatcgggaaatattttaccgagctgccgcccatatcctgcagcatcgcgatcgccgtttcgacgggcacgatcccgtcacgctgttttgagctgcgcggtccggtggagattttcacctggcctggcgtaccggtgggcgagatcagaccgttcactatcgtctgcgactgccccagcagcgcacggcttgtggcgacgccggtaaagacctgattcacatgctgcggttgcagcactgccgcaatctcactcaccatctgtgactggttgggatcgcccgcaccaagaccaatcgagagcgcattatcgatcagcgcggcatactcgtgcatatcggcgatagcggcttcattgctggcgtagtttttcgacagcacgccgaccagcacatgcccttctgccgcctgccagatggcgcgcgcattctctttcgatcccgccagtacgttaaggcagagacgatcctgatagaaattgggggtcagcgtcatgcgtttttctctccgtttaacagtgcctgaatgcgggtgaaaatagtgtgcagttgatcggcgctgacgctgcgcacgtccgcctcaatgatcccttcgttggctttgtagccacggaagtagatcgcctcctcgccgtttttcagcgcctgcaccagatcgccggtgcgctgctgaatcgcggcttcgtcgaacttgatctcagcacgggcgatgtcgcgtccggctgcgtcccacactacccgggccgtcacgccattcagactgttgagctgttcaataaacggcgtcattttttctgccatctgcgcgccgctgatttttggctgcgtcagatagttttcaatcgcctgggtcagccccaggatcccctctttgcccactttcatcgcgcggccaatgccgttggtctggcgtttgacccactcaacgtagtggtttcggccaatcaccagtccgctggtcggcccttcaatcgcttttgctccgctgtagatcaccagatcggcacccgcctggtagtagcattgcagatcctcttccgctgccgcatcgacgatcagcgggacgccatgctggcgcgcaacggctgcggcctgcgccacatcgagatggctcttctgcacacagtggtgcgattttacatagaggatcgccgcggtctgtggggtgatcgccgccgccagttgggcgggtgagcactcgttgctgtaacccgcttccaccagttgtccgccacccagtgccaccatgctgccgaccggtgcgccatagttcacgttgtgccctttcggcaccacaatctggtgcgggacagtcagcggcgcggcatgcaggttatccaccagccagtcgttgtctttcacaatcaccgccgccacgctctgggcgataccggccgaggcgcaggagaccaccagcgcgttctccaccttcagcagaccggcgatataagcaccggtcttatccaccagatctttcatttcgaagtagtgatcgaggccatatttcaccgtatcgatcacctcactcgatggcgtagagacgccgaggatcgtcatacggccagaggcgttaatcaccggcttcaggccatacttttcatacaccgaggtcatgcgctattccttcttcagtcgcgatccacgtaccagcaacgacggccgccagcgggaccagatgcttctcacctgcgacctgttcaccttctgaatcgatgaatggccgggtttcctctttgacgctaaacacagtcagatcggcgtcgtagccgactttcagctggcctttgcgctgcaggcgcagtcctgccgccgcattgagcgttacgcagtcaatcacctgcggcagcgtcataccgacactgaaaaatttcgacatcacatgcgccaggttgtgaaccggtccggccagacgattgcggcagtagatgtcagagctgatggtgtcgggcagaatgccctgcgcaatcgccgcgcgggcgacttcaaagctgaagctggcactgccgtggccgacatcaagtttgacgccacgcgcgatagcctgttttaccgccgctttgagttcgccctgcggcgtcaggatacggttgggtttgccgttaaagcagtgcgtgatgatatcgcccgtggtgagcagatccgcaatctggtcgagattgggcggattattgccaatgtgaaccatcagcggcagcccgccggtttcctgctggatcgccttcgctttaatcagcggctgcacaccattctcgcccaccacgctgctgctgatgcgcgccttgaggccgacaataaaatcgggcagccgcgccaccgcctgctgcaccgcctcgccatctatctgcgtcatgtcagccagctcattctgggtgacgatgccggtgcgggcgatattgatcagcgcataaacctgggtctgtgccgcgcgtgtcagccggtaaaagtcatcaatgtgctctgcgccggtgctgcccgcatcgacaaccgtggtgacgccatgcgctacgccaatcgcatccgcttcatcatgataaattggtgatttgggatagcagtgaacgtgggagtcgatccagcctgcgctgaggtagtaacggccagccagatcgcgctcgtgctgcgcgttaccctgcaccttgcctatggcggcgatacggccatcctgcagcgcaatgtcgaccacctgctcatcgctgagacgcgcaccgcgaataatcaagtcgtacatggtttctccttaacggcagcccgctgccgggctgccggtgagatcagagagcaatcggaaacagtgccccaaggatcatcgcgccgaggatggcgccgccggtaatgggcttgttccagagatagaagagcagcgcgcccagcagcgaacccaggccaatcggaatggatgccgccatggctgacaggatgatcagcggccccagaaagcgccccgaggcattacccgcacccatcatcacgtctgcgccgtaggttgagtcgctctgattgatggtgaatttacgcgccagaataatcaggtagccaatcgccacaccaatcaccaggcccgtcgccagcgaggcagcgaagttcgccaccgggaagacaatgcccgcacccagcagcagtgccggaacgcccagcccgacgccggtctgaatcgccccgccgatatccagaatgcccaccagcgagccttcgatgatacgggcgaaacaggaagctggcaccaaaggcggcgaccgcgccgtagacgccggtctccatgcctgcgcgcagcatcgacacaaacgccacttcgttgaacgcgccgatgccatagaggtaatacatgtgtgtcccggcaaagacgccagaagagagcaggccaacaaagatcgggaaagaccagtcggcgtaccagaagcctttattttcgttcatcgcatcgcctcttatttgccgctgactgagttgtggatcatgtcgagccagccgggaatgccgagctggaaggactgcagcagcttcatgtcgaaaccacggaagaagccgctcagcacaaacagcagcacgatggcggtcatcatgactttggtgacccggttccagccgctctcttccacgcctttaccgatcaggatacccagcaccagccccggcacggcgttgcccatgatcagctgcgccagaccgccaaaaatggtggcccagaagcctgactttctgcccgcgtcgatcgccgccagccagaagatcaccggcatgacggtgttcaccagcaggttagcggcgggcaccagcactttgaccgccgtgacctgcagcgcagccggaacagccgaggcggtggagttgaggaaggcgaccacgatcatgccgatgatgccgcaggcgatggccatttttttcggatcgtgcagcgtctctgccacattacgattcttcaccattaaggcggccgcaccccagtttggaatgatgcgatgatccacatcctgagtgaatgaaccggctgcaaccgacgatgcccaggcattgaaaaagaagccaagaccaaaggagaagtgggatgccggatcgccctcgcacgagttcagctcgcccagcgtacggaaagcgcccatgccctgagtggttggcgcgtggaacatgcgcgcagcacccgcaccgacgccgacccctaccagcccgccaatgatcaacgacttaaacaaaatgattaaaaacatgttgttgtaccttgttgtcgtttttacctgccctatccacgccgccgcatcgcccacgcctgatcatcgcgatgtcgcgacagcagagcatcgggcaaacggctggctggcgttaacaggctctgttttacgatgccgccgtgaacaccacctgttcggtgtcgaaaacggtgacgctgacggtgatctccagcgtgacgctgaagctccgccgttggcgcgccagaaagaagaagagaaacttctcggttttgacgctctcctgcgcgcgcagcacccggacatcctgaggttcaatgcgcagcagaattttttgcgtcgcgcgcagaacctggttctgcacacgactcagggcatcggcaaaggctttcgctttggtgtcgcctttgccctcgaccgtcacctgggtaacgtattgttctttcataatcagctgccgtgcttcttgttccaggcctgcaccagccgctcgcctaactcttctttatccataaagccgaagcccagcaccgtggcaccttcattaatggcggtgacgccttcgtcgacagaaacgcatgccatgctttgctttgtagccatatttgttctgagcggtgatagcaccggcgccgccgctgccgcagaatgagatgccgaaatcggcgttttccgccttcatcacgtcacccagtttcatgtcagcggcgacacctggcaccacgacggcacggccacccgctttttcgatgcccgccgccactttctgtcctttacctaaacgatcaccaatcactactgttaccatcttatgttcctctctggttgtttgatcgcgcgacttcaatatgcactgacagcagccaggcctcttcgcggggcagattgccaaacagatcgacgacctgctgcgccagcgctaacgtttccggcggaatatcctcaaacagctccgcttccacttccggcagcggctcaccgctcagcgagcgtgacgccatggcaccgacatgcgattgcagcatctgctgctgaaccgcattgggctgaataccctgctgctgatagatcgcagcaatctgcgtcatcacgctgtcagccagctgttgcactttctcaggtgccgcttcatacaccgggacgccgttattactcaccttgctactcctgttaaaccggataattcgcgttaaaaacaaattagcggtcatcgccccggctgtggagaggcaacatttccagcagcaagtggaaattgaagtgaaggttgtgcgtcagatcgcaggctgcatgcttagtgcgacacgcgtcgcagaatgcataatttgatggatttaaccgagaaaagcggtgatgttgtgcggcgacaagccggaagcgctggggttcagggtacggtgataagcagaagtgatggtaaaaaaccgccggcctggctggccggcgatctgattaacggaatttcttatggttggtattgcggatgtcgtcgaacttcgctgcttcgcgtttcgccccgtccacattgttggctttcgccagcgcgctgaccacatcgatctgcgcgatcagtgagtcgataccggcatggaaatctttcacctgtgggctgtcagccggctggccttccagcttatccggcgtgccctgtcgcgcatcctgtgccgcggcacgcattttggttagcgcctgctgcatctcctgggcattgtcactttttttgacgattttcaggttcgcattcagtgtatccatatcctgctccagatccgccgcatagagactgacgctggagaacaacagagaagccgacaacattgcaatcacatgcttacgcattattacttcctttttattgtgatgaaaaaaaagcagccaaccggctgcttcaggaatccatctttattgtcccgctatcttcatctcaggcagtaacactgaaccgcactggatattgctgcgggtttcaatatcgtcaccgatggtcaccatattgcgccacatctctttgagatttccggcgatagtcacttcgctgaccgggtactgaataacgccattctcgacccagaaacccggccgcaccgcgtgagtaatcaccggtaatggcgctgaccccctgtcccatcagttcggtcaccactaacccggtgcccatctgcttcagcaggtcgtcaaagctgtggccctggcccgcaatgcgccagttatgaatgccgccagcgtgaccggtgctggtcaggcccagtttgcgggctgagtagctggttaacagccaggtctgcagcacgccatctttgatgatgtcgcgcgcctgggtacgcaccccttcgctgtcgaatggcgtggaggcgagccctttcagcagatgcggctgttcattgatggtgagccactccggcaggatctgctgacccatagaatccagcaggaaggtcgatttacggtaaacgttgccgccgctgatcgcgccaaccagatgaccaaataagccggttgccacttctgaggcgaaaatcaccggggctttcatggtcggaagtttacgcggtgccagacgggagagcgtgcggcgcgcgcactctgcaccgacccactccgggctcttcaaatcttcaaacgcgcgcccaatggtgtaggcgtagtcgcgctccatgttgccatcctgctcggcaatcacgctgctggagagcgagtgacggcttgagcagtagctctgtaacataccgtggctgttgccaaagactttgatgccgacgtggctgttgaagctgccaccttcagtgttggtaatacgcttgtcggcgcgcagtgatgcctgttccgcctgcgcagccagttcaatggcgcggtcagcatcaatctcccaaggatggtagagatccaggtctggcgcatcataggccagcagctctgcgtcggccggaccggcaaagggatcgggcgaggtatagcgcgcaatatcaatcgccgcctgcacggtgcgtttgatcgcgtccgggctgaggtcggtcgatgaggcgctgcctttacgattctgatgatagacggtgatgcccagcgcaccgtcgctgttgaattcgacgttttccacttcgccatagcgggtgctgaccccgatgccggtggttttactgactgccacttccgcgctgtcagtgcttgctttagccagttcaagtgcctgcgcaatggcctgctccagtacttttcgctgttctgcaacctgagtagatacgttcatcgacctgccgtctaatcttatgtgtgaatgatttgagtctatcagagtcagagaacaatttcgcagtcacccgataaactggtaggattagcctcttttttttgggagcccggaaatgaccaaacagcccgatgagtggctcgacgatgtgccagataatgacgaagaagaagatgaagagattatctgggtcagtaagagtgaaattaaacgcgatgcagaagagttaaagcgcctgggtgccgaactggttgatctgggtaaaaactcgctggataaaatcccgctggatgagcgcctgcgtaccgaagttgaactggcacagcgcatcaagaaagagggtcgccgccgtcagctgcagctgatcggtaaactgctgcgcagtattgatgtggagccgatccgcgttgcgctggataagctcaataatcgccataaccagcaggttgcactgttccataaactggaaatgctgcgcgatcgtctgattgaacagggtgatgaagcgatgggcgacgtgattgcgctttatcccgatgccgatcgtcagcagttacgcagcatgatccgtaacgcgcagaaagagaaagcgggcagcaagccgccgaagtctgcccgtcagattttccagtatctgcgcgaactggccgaagcgaagtaacgccatggcgggcagcctcgcccgcctcccggaagcgcatttatcgatagatatagagaataccggtgcgcaaccgcagctggcgtttcgctcgatgtcgcagaacgtccgatatcgccaaaggtgacgtaaggcacccagacgcgatcgttgccaagcgcataatcgaactgtaactcctgttcgtaatcatcatgtttattggcaaagagtttcgcatccgcgtgtttatacaccagcttataggtggtggtcagccgatcgcttttatttcgcagatagagatcaaaacggttggcagtgcgatgccggtcagtatcgcaataatcaataccgccggtacggcattgatcgtcatgcgcataatcggtcagctcaagacgataaaggccaccgagagaccagcgatcattaaatttataccagggtgccacaccaaatttccattcagtgcgcgaggagttaaactctggctgaataaaaggcgacagtgtccagttcccccagtaatacgacttcagaaaggtcacctccactacgtttaacacggtgtcgttataatatttgtcttttggatcggcgccgccggttttgaatttggtttcgacgccgagaaacatattgtccggcagcgtggtgctcagacccagcttgtcgtagtgcgtgcggtcgcgaaggcggtactcatgccggtaatcaacggtggccgtggccagcgccgcagcagaaactgcataacaacgcggcgcccagcaaaaacgacaatgaattattatttcccatatgaacatccttattagtggtaatcagagcaatgaattatccgaactcattcgtttaacccatagttaacttatatttaaaatcctcatcaatataagatcgcgcataaagagagactgttatttatccctttaactttaacgcgttaattattattcctcagtcactacagggatgatgctagaaataaccggcgagagcggcctttctgtttcagacactaataagaaaaatatggcaacggcaggaagagtgagcagatcgaattcaaaaatatgcgggatttattgagggaataatatttccggggataatgcttttaaaaaagcgcccgaaacgggcgcctgtgacattatgccagcctgtccagcagcttctggtggatgccaccaaacccgccgttgctcatgaccagaatcgtgtcgcctggctgagcggctttggccaccatttccaccagggtatcgatatccgcgctccagtgtgcaggcggaatgcacgcttctgcgacatcagatacctgccacggaatatggtgcggctggaacagaaagacctcatcagcacgcgccagcgacggtgccagatcgttcttgctgacgcccatcttcatggtattagagcgtggctccagcacagccaggatacgcgctctgccgccaactttgctacgcagggcagccagcgtcgccagaatcgcggtcggatggtgggcgaagtcatcatagactttgatgctgttcacttcgccgcgcagctccagccgtcgacgcgcattgataaagctgttcagcgcctggcctgcatcttccggcttcacacccacatggcgcgcggcagcgatcgccatcagcccgttgtgcatattgtgttcacccaccagagcccagttcacttccccgactttttcgccgtcgagccagatttcccagtgagacgcatcgttggtgagcttcttcgcctgccagcgcccgtgctcgccgacgtttctcctgttcgctccagcagcccatcgccatcacctgtttgaggttaggatcatgttccggcagcaggatcttgccctggcccggtacgatccgcaccagatggtggaactgcttctggatcgcgcgcagatcgtcaaagatatcggcgtgatcaaactcaagattattgaggatcagcgtacgtgggcagtaatggacaaacttggaacgcttatcgaaaaacgcgcagtcgtactcatccgcctcaatcacgaagaatggactttttcctaattttgccgagacatcgaagtttccgggcacaccaccaataataaagcctggctcaaggccgcaggcctcaagaatccacgctgccatgccggctgtggtggttttgccgtgggttcccgcgaccgccagcacccagcgatcgcgcagcacgaaatcgtgcagccactgcgggccagagaggtaaggaatgttgcgttccagcaccgcttccacgcaaggattaccccgcgtcatcgcgttgccgattatcaccaggtcaggcaccgggtcaagctgactggcgtcgtaaccttctgttaattcaataccttgctgttcaagcagagtactcataggtgggtaaacgttggcgtctgacccggtcacctgatgaccaagtgaacgggccagcatcgccagaccgcccataaaagtgccacaaatcccgaggatgtgaatgcgcattacgtgatccattactcaaaagttcggcgcacagtgtaacgccgctcgcagatggaagaaacggattaggactatggtttttgaagttcaatcggctaaactgcgtacgcatccgttggcagactgttacgcgtgctgccactccatcgaagattcagggaatgtgttatgaaaacgttgggcgaatttatcgtcgagaagcagcatgactttccgcacgctacaggtgaactgacagcgctgatttccgctattaagctgggtgccaaaatcatccaccgcgatatcaacaaagccggtttagtggatattctgggtgccagcggcgtcgagaatattcagggtgagcagcagatgaaacttgatctgtttgccaacgagaaactgaaggcagcactgaaagcacgcggcatcgtcgccggtatcgcttctgaggaagaagacgagtttgtgatctttgaaggtgaagaaaacggtaagtacgtggtgttaatggatccactggatggttcttctaacatcgacgttaacgtttccgtcggcaccattttctctatctaccgccgcgtcagcgagccgggtacgccggttgttgaagcggacttcatgcagccaggcaacaagcaggtcgctgccggttacgtggtttacggctcctccaccatgatggtttataccaccggtgcaggcgtgcatgcgtttacttacgatccgtctctgggtgtgttctgcctcagccacgaacgtatgacctatccaccaacgggttacacctactccattaacgaaggtaactacattcgtttcccgcagggtgtgaagaaatatctgaagttctgtcaggaagaggatctgccaacgcaccgtccttatacctcacgttacatcggatcgctggtcgcggatttccatcgtaacctgctgaaaggcggcatctacctctacccaagcactgccagccatcctcagggtaagctgcgcctgctgtatgagtgcaacccgatggcgttcctggcagagcaggcgggcggtaaagccagcgacggtcagaagcgtattctggatattccaccggtcacgctgcaccagcgctgcccgttctactgcggtaacgaggcgatggtgaacgacgttgagcgtttcctggccgagttcccggattgccgtcagggttaatccggcagtggtataaaaagtcatataaaaagcaagggcgcgattttcgcgcccttgctgtttttacgccgtctgcaacctgaactgcgccatggttgcctgaagctgatcggactgcgcttccagcgactgggtcgcggcggttgcctgctccaccagcgccgcgttctgctgcgccgccgcatccatctgtgtgaccgccagattaacctgctcaatgccacggctctgttcgtcggaggccatcgagatctctttcatcagtgccgttacgcgcatgacctcaccagaaatctcatccatggtttccccggcccgcgtcgccatctcgctgccctctttcaccctcgactgtgaatcactaatcagcgtacggatctctttggccgcgttagcgctgcgctgtgccagcgtgcgcacttcatttgccactaccgcaaagccacggccctgttcgcctgcgcgcgccgcttcaacggcggcgttgagcgccagaatgttggtctggaaggcgataccatcaatcacgccaagaatgtcgccgatacgattggcactgtcggtaatctcatgcattttttccatcacatagcagaccacctccgcgccgcgatcggcagtatcagagaccgcgttagccagctggtgcgcctgctgggcattgctggcgttaagccgcacggttgccgtgagctgctccatgctggcggcagtctgctccagcgaggcggcggactcttcggtacgctgcgacagattgacgttgcccgcggccagttcacggctgccgatgtcgatctgcatactcgcttcgcgcacctgactcaccgaggtacgcaacgactgctgcatcccggcgagcgcatgattaagccgccccagctcattgttgcccgacggtggcagcgcctgcgagaggtcgcccgccgcgacctgctcaagatggagaatggccaggttcagcggctgcagcagcatccggcgcagcagttgccaggcgagcaccagcagcagcagtgttaataccaccgccacggcgatcaggattttcattttggtttcgttgtaggccgcctgcgccagctgggcctgggtgatctgatcggccagctggctgaagtccgtgacggccttgttgtagctggctgccagcgtcgccaggttgccttccagcaactggtaatactcgtcggtatattgcttatccagggcgttcatcatcggtttgatgccctggtcgagataggctttgtaactggccgaaactgcatcagccagctttttgccgtgcgccgtcaccgttccggcgtctacaaagcgcttcaggctttgctgtgatgagaccacatccgcctgcgacagttttgttactgccgccccctcttccagtaaaccaatttcaattttacgcaccgccagcgcggcgttagcgcgggcccgcatcagatcggcattgctctggtaaagactgttcagctcgatcccctgaatgcggttgatcacatccagcgagcgattccctttgttaattgccacgatacccataaaactcaccgccaacagcagcagtgtcataaatgccagcaatgccagcaaccccgtgcgaagtgataactgtttcatccagatagtttccgtgtatgtgaaaaggcaaattttccagcggccctaaaacggatgaagtatcggcagtaacggcgcgaaactttaaccctgattagtgttaacaacttgatcatcacgggaacatccatcaagctaatcgccgcttatccgttatccggagaaaagaatgaaaccaggattacttctgatgctgctgtgcctcagcacggcggcgctggcagaggatctgccgacagacgcctcgcccgatcgctgcctcaatgacgcctctactacccttgccatgaaccagtgctacgctgcggctaatcgggcctgggatcaggagatgaataagcagtacaacaaactgatgaaaaccctctccggcgaacctaaaaacaaactgcgtgccgcgcagcgcgcctggctgagctaccgcgacagctggcttgaggcgagccgcagccagctcagtacacaaggctcgctgggcagcgtggcgctgagcgctcagagcctgagcctggtgcgcaatcaggcactgatgctgcagtcacttggtaaaggcagctgtgctaaccccgatgactgctgatcgataaccggcttttgcgctgactgaagtcagcgcactcattaaccttcagggagaaaccatggctgcttacgcctcgaccatcattctgatttgcctcgccgtgctgagttatttcgttcacaacaacgcggtcacgatttcgattctggtgctgctggcgattaaaattaccccgctggctcagttcttcccctacgtagaaaaacagggcattaccttaggcatcattattcttaccgtggcggtgatggccccgctggcaagcggctcactgcccgcctctgcgctgatcaagtcgtttgctaactggaagtcgattgtggcgattctggtagggatctttgtcgcctggctgggcggccgtggcgtgaactttatgagcgtccagccttcggtgattggtggtctgctgattggtacagtgattggcgtggcgttcttccgtggggtgccggtaggaccactgattgccgcaggcattgtttcgctgtttgtggcggctaagtagcgtttgggcgcattccgaaacgccaaaaagggggcatactttcagagtcagttggctataatagccgacactcaacatacgactactgaaggaatgccagatgagtttgaaccaggtgccagcaggtaaagacctgccagaagatatctacgttgtcattgagatcccagcgaatgctgatccgatcaaatatgaagttgataaagagtctggtgccctgtttgtagaccgtttcatgtctaccgccatgttctatccgtgcaactacggctacatcaaccataccctttctctggatggtgatccggttgacgtactggttccgaccccgtatccactggttccaggctcagtgatccgctgccgtccggttggcgtgctgaaaatgaccgacgagtctggcgaagatgccaaactggttgccgttccgcacaccaaactctctaaagagtacgatcacatcaaagatgtgaacgacctgccagaactgctgcgtgcacagatcacccacttctttgagcactacaaagatctggaaaaaggcaaatgggtgaaagtggatggctgggataatgccgaagccgctaaagctgaaatcatctcctcttacgagcgcgcacagaagaagtaattctgctgccggtttgtgagtcgaaaaaaaaacaccgtccggatggacggtgtttttgttcaggcctctggctcctcatcgcgcttcagccagtcaccactcatgatgcgctggcgtcctgccactgagcgttgatagacataaagccatgcactgccaaacggcgtctgagtcagataacgtttgtactctccccctttggtgcgaagcgcatccagctccgcaagggttgaggcatcaatgcggtacacctcacaatgtaccgctccattgccctcaatcacgccgggataatggcccagactgtaaagctcaaagccttcaatctggtgatcacccagccactgcgcattcgtcatccagtgactgtttccctgtttgcgccgtaaactgccgtagacaattattcgcattgctaaaactcaaactgatagagcaaatcgagagcctgatccacaccggacacggcttccagatagagtttaggcatcaggcggtaacgcaaggttaacgtcgccagtgaatcaaatatgccaacaccgtattttacctgcagacccggtagcacatagccgctgacctgcacctgctggctgtcgccaacaccggcagtatcaacagcgagattgctgacaccgaatgtctccccgattttacccacaacctgcccactttgtgcaacccctaagccaacaagtgctgaagtgagggcgttactgtcgccgtcgctgcccaatccctgaccgcgcagcagataggaaagcgcttcctgttgcgacatcgccggatcggagaagacttccgcttttggctcatccgccaggccagtgacgcgcagacccgcggtgacgccatcttcggtggcatccgggttacggatggcttccaggttgacgtaaggctgatccggcggaccggcaaactgcagctcgcctttacgcacgatcagatcctgaccataagcgtggaagcgaccggacggaatgttgatctgaccgttcaggccgagtcctgacttatcctgcaccattttcagatcgccattcagcttcgctttcaggccaaacgcagagagtcgcacatcgttgccgacgtggatcaccagattgctgttaatcggaatcgcggcggtttgcggtgcaatcggcttcagctgtttatccagcaacacctcatccgacgaaacgccagtggcgctttccggcacttcctgcaccgtgatgcgcgcccatggaatatcgacccggccatcaaggttaaaggccgctggcgtcgcttcaaacaccagatccggcgagacatccatgcgcaccatcggcggcacggtgacgcgaacccggctgccctgtgccgcaatgcgcgcacgccagttgtcgagctggctccagtctgcgttaccgctgaggttgatattgccctgcccggtctgcaccagcccgttcagggtagagctcatgccgttaaacaccagattcaggttggcactggtcaggtcaaccggcataaagttgccatccacatccacacccgtcaggccaagctgaccaaatacctgcggctgctgcacgctgccgcccaggcgcaggctgctgttcaggctgcctttgatcttctcgccctgcatcagcgccggattgagcatcgccagcgagacattgcggatgttgacgttaccgcccagcgtgcggcggttttgcggatcgtcgatctgcacgttaccatccagctgaccgttattggcgatgcggatcagccagtcgagctgggcgcgtccgtttcgcagcgcggcattgaggttcagcgtgtcaaaggcgatcggcagattgttgccctgcacatcctgcaccactttcacgccgttgcccttcagcgccacggtaccggtcggcaggctgccatcggcagtccagttgacgcgcacgtcaccgctgaacaggccgctaagctgagtcgcatccggcataaacggcttcaccatcgccaggtcaaagcgattcagcaccacatgcgccttgcctgccgggcccgcttcaaccggctccggcacacaaatttgcgcattggggttctgccagcagtgtgggccgatggtggccgtctggcggctgttcagatagtcgatggccatggcgcgggtcagacgccactcaccgactggcgtatcaaagtgggtgtcgttcagcgaccctttccagcgctccgtctggcgatcaaagctgccgttcagcgccagctggccagagaccggtttgccctgcacattgagcttcagctgatgctgatgctcattgccgtccgcgttcagcgttagcaggctgatgttcagcgcatcctgcttcagctgctcgacgcgcagttgcagtttacccgccacctgctcgccggaacggacgtcgccattcagggtgacgcgattgatctgcatctgctgccagcgcagaccacgggcattaagatcggccagcagctgcggtgccttcagggtaccccgcgcttttattgtgccgttgatgacgccgcccagacccggcagcgcattgtcgagctggggtgcgtcgatactggcatcgagatccagactgtcgcccagcgcgcctttaacatccagatggttgcgtcccagcgccagcttaatgcccggcaccgtccactggttgtagctgttaccggtcagggagccatcagcggtcacggcgttctgtttcacattgcctttcagctgtagctgcggcacgctcagttgccagctgccaccatacagactgccgcgggtggtgattttgccatccagccgtgctggccagtcgggatactgtttagcggtattaattcccgccagcgtcagctcactgcgccagcttatcgccttgctccagtccaccagcgcggtgagatcgatattgccctgcagcgcagccacgcgcaggcggtcgaggctgaactgctcaacgttgcctttacccgtcagcgagatcgtcgccggtggtacagattcacccttcacggcagtctgcagcgacatcacatagtcggtggctttgcctttgaactgatagtccaggttatccgcctgatacgctaccggaccggtcagcggccagcgtaactgcggactggtcagcttcagtgacagcggcagtcccgccaccgccagctgggtcgtggcgtccagctgcgcattcaccggaccggagaggttcagccccatcttcagctcgtcgcgcatcgcgccattaagtttcagcgcgagcttttcgcctttaatcggatcggtattcactgtgccgttaagggagaaatcgaccggccagttatccgacagcgtcgcctgaccgctacccttcaggttgccgaggttcgagtccacctccagcgtgctgagctgcatctgacgatcggcggttctggctttcagcagcaaccggctgacggaaatatcggtgtcgccggtaatgcgcagctgttcacccagaatctgctgcacctcaatatccagcggcagacggaaatcaggcatctcaggcagcaggggttgcgcaaacatcgcctgcagcgtttcacccagcggtttttcagcgggatgtggctgctggactttcggctctaccacctcgtcattgaccactttcgccgctttcggcagcgcaatcagcaggctttgaatatgggtcgggttcagcgtcagcgcacgatcctgccactgcaggccggtggtgaagtcgagcagcgatattgcggtgtcatcaactttgacattgatattgtgcaggccaaagtgacgcagcgtgatggggtatggcgtgctgaggttagagttgccactctcctcttccggcgctggtgccgctggtgtcattttcttgctgtcgaccaccacgctgatatcgcgcagggagacatcgttaacgcacacggaggagtgcagcaggcagttgagatccaccgccagatgaatttgcccggcatcgacgctgaccccaggcatttcgtaacgcagaccgttaagggtcaggttacgccagccaccatcgacctgtttgattgacaggcccggcacccagcgcgacgcacctttcagcactaaatgcagcccaggcgtggtaccgattaaaaatgccaccccacccaacagcacgaccagaaagatcagaatgccgatcaggacctttttccacagcttcatagttctggccccagccctacgtaaaattgtaatccatgctcttcgtcatccccgatgggtctggcgatatcaaatttgattgggccaaccggtgaagaccagcgcacgccgacgcccgcaccggttttgacgttactttgcttgatgtcgttaaccgcttcgcccgagtcgacaaacaccgcgccccaccatttcccggtgacgttgtactgatattccagcgatccggtggcgagttttgatgcaccggtgagtttgccgtcatcatcgcgcggtgaaatatttttgtatttgtagccacgaatactgcggtcaccaccggcaaagaagcgcagatccggcggcactttttcgaagtcgttggtttcgatccagcccagattgccgcgcgccacaaagcgatgactgtcgccaagggtacggatccagacgttttgcgcctgcaggatcaggaagtcgacgtctgaaccccaggtggtatcagagacgtctgccgaatagcgctgtgaatcgccccaggtcggcatcaggccgccacgggaacgggtgcggtttacgctgacgccaggatagagcagcatagtggtgttggtcacgctgccctgagtaaagtgatccaggctccagcgcaggttgaccgtcttctgccagccgctgctgctgtcccagttgcgcgacatcgcaagcgtcgtggtatccgctttggtgtcgttgaggtcggtgcgcttcaggccgccggagaaggtgtagtactgctcaagcgggcttttcagcagcggtactttatagctgagatcgacctgctgttccggcgcggaaacgtaggcgctggccgccaggctgtggccgctgtcgttgatccacggttttttccaggtccctttcaggcgcggaccgacgtctgtggaatagccgacgccggtttcaatggtgttttcggtgcggggtgacattactgcgctcagcggcagcactttggtctgtcgtcccttgctgaattccggcgcgaccaccaccgaattaaaccagccggtagcggagaggcggcgattcagctcggctaaatcgcgggagctgtagtagtccccctctttaaacggcaccaggttttgcaggtactcttcgcgaatttgcgatccctggaaagtaacgtcgccgaagcgatagcgttcgccactgtcgtagtcgatatcccagaaacgcttcacgccgctcaaccgagacaccaagctggctttttttaaacgtgccgtcgaaatagccgttacgcagtgcgagattagagaagccgcttttgaatttgtcatattgcccgtggttaagctggctgcccacttcagggcgtccctgcttcacccaggctttgtaatccgcgtcattgcgcgcatcgccttcgaccacaatcgtgctgccgccgatttttaccggttcaccaggcgttacgtgtgccactaataccggtcgtccaccctgcgcaggcgcggggcgggattcgaaatcgatggtgggctcgtaataaccgagcgcgcgcagcccctcttttatcgcaacagaaacgcgcgcgcgaaagcggccatcattagagacctcatcgctgccgatggtggacagacgcgctctgacattcttttgcagatccccggataagccgtctacctgtaatcgcactgtcgccgcctcaagggcgggcgcggcaagcagcaggccagccatgcaataaacataaaatcgtggcacctgtactcctgttaatcatgccggccccttttccgcggggcgcttattaatcttctttgcccgcactaccgcaacggcaacatcctcatcatagccgcactttatggcaaacggcggagcaacactgacatctaagtcaaataacggggctattgtcggtaaatggggtgagcgatacaactcctgcgggtcggaatgatcagtccgatatgactcactcagataaatccgagtctgtaaccggccgctctggctgctaatgcgcccttaagcagcggtttgccctctggcggcgcaatgagcgctcctgctataatcggccaccacaggcattccgcctgttttcatttctgccccgacatgtcgtttgttgtcgaactggcgcagacatttttggcacggatagctttgtttcacggataaaccaactctgtttgcgcttacccacgctgcccaggccaaaaatgacaagtggataaccctttggatctcatatgttagatagcttacttgtcattctgttactgatcgtaatcagtgcctttttctccctgtcggagatctcgctggcggccgcccgtaagatcaaactgaaactgctggccgatgaaggcaacgtaaatgcgcagcgcgtgctgaaaatgcaggaaacgccgggcatgttcttcaccgtggtgcagattggcctcaacgccgtcgccatcctggggggtattgtcggcgatgcggcgttttcgccggttttcagcggcctgtttaaccggtttgtctcgccggaaactggcggagcagctcagctttatctgctccttcaccatcgtcaccagcctgtttatcctgtttgctgacttaaccccaaagcgggtcggcatggtcgcaccggaaaccatcgcgctgcgcatcatcaacccgatgcgtttctgcctgctgataatgcgtccgttggtgtttctgtttaatggcctggctaacgtattcttccgtattttcaagctgccgatggtgcgtaaagatgacatcacctccgacgacatctacgcggtggtggaagcgggtgcgctggctggcgtgctgcgtaagcaggagcatgagctgattgaaaacgtgtttgagctggagtcacgtaccgttccctcctccatgacctcacgtgagaatatcgtctggtttgatctgcacgaagatgagaccagcctcaaaaccaaaatcgcccagcatcctcactcgaagtttctggtctgcagcggcgatatcgaccatatcgttggctatgtcgactccaaagagctgctgctgcgcgtgctgggtaatcagagcatggcgctgaacagcggcctgcagattcgctcggcgctgatcgtgccggacacgctgaccctctctgaagcactggaaagttttaaaaccgccggagaagatttcgcggtgatcatgaacgaatatgcgctggttgtgggcattattaccctgaatgatgtgatgaccacgctgatgggcgatctggttggtcagggtatggaagagcagattgtggcgcgtgatgagaattcatggctggttgaaggcggtacgccgattgatgacgtgatgcgcgtgctggacattgatgatttcccgcagtcaggcaactacgaaaccatcggcggctttatgatgtatatgttgcgtaagattccgaagcgtaccgattttgtgaagtttgctggctacaagttcgaggtggtggatattgatagctatcgcatcgatcagctgctggttacccgcatcgatgaacgaccgccggtgctgagcatgacaaaaagcgaagaagagtagaatgaccagcagcctggacatggacagcgcggaacaaccggaatgtgacgtagtctgtgagaattgttggcactgctcaggttcagagtgacaaataaaatggcctgactggccagacactaagggcgccatcggcgcccttatgattagttgaactcaagtttgagacgaacgacctggcggttaatttctgacatcacgctcaggtgctgtttgtctttgacgcgcgggattaatactttccctttgtcgaactcgaacgcgccgacgtccttgatatacaaccttcctttgaacagcgtttttacatatttcgctatttgtagcggattatagcgctggaagatcttcatactgactaactcctgtacatttttaagcacgcttcgccgtttccaaatttggttccagcccatgaagcgcgaattcgcgataactatagaacactcaaacctactaatgttcctaaaagtgattttttttactgaattgacacatcattacagaacactctgttatcaggctcacacaacacagtataaaccttcgttggttaaggaattgtggcggccataacaaacctgacacctttccaggacaggcgcatcatccctgcttactattgcagtaaaatgactaactggtctgatcactcaaggaaatagcaatgcgaataattctggcagctgtagcgttgtctttactgatactggcaagcgtgatggctcatgacctcaggcaggatatgcgggtaccggccgttggcgtgaacgacaaaggcgagctgttattgcagcaggataagtttagctacaaaaactggaatagcgcgcagctcggcggaaaagttcgcgtggttcagcacatcgcgggtcgctcatccgctaaagagatgaatgccgcattgatcgaggcgattaaggccgcgaagctgccgcatgatcgctatcagaccaccaccatcgtgaatacagatgatgccattcccggtacgggcatgtttgtgcgcagcagcgtcgagactaacaagcagcaatatccgtggtcgcagtttgttgtcgacagcaagggcaatgtgcagcatgcctggcagttacagccgggcggttccgccattgtggtgctggataagcagggtaaggtgaaatttgtgaaggatggatcgctgacgcaggatgaagtgacaaaagtgattacgctggtcacctccctgctgaaggattaatcgctgaagccccggtggggagagcatcgcccgccggggtttcagccttcagcaggctgagcgctcagacagcgttaaaacagtgatacgcggaagccaggattaaggaaggattcgcgcggcgcgtagtccagagttttaccctgccagtcgtgcacatgcgcgcccgccgccatcgccacggcatggcccgcgccggtatcccagatgttggtgggtccgaaacggggatagagctgggcttttccttctgccaccaggcagaatttcagtgaggatccggtcgcgacggtctgatgttcacctaactgcttcaggtactctttcatctcatcgtcgtcgccatgtgaacggctcaccaccaccagcggaggacgcgcatcacggacatgaatctgttcacgctgaccgccctcctctttccacgctttgccgtctgcagcggagtacatcacgcccagcactggcgcatagaccacgcccattaccggcttgcctgcttcgattagcgcaatattaacggtgaattcgccgttacgcttgatgaactctttggtgccatccagcggatcgaccagccagtagcgctgccagtgctgacgcacctcccaggctggcggatcttcttctgacagcacggggagatcaggcgtcaactttttgaggccagcgaggatcacctcgtgtgcagcgatatccgcggcggtcaccggcgaatcatccgatttgtgagaaacgtcaagcggcgcggcaccgttatagacctgcataatcgcgtcgcctgcttcgcgtgccagttggcagatttgctctaacatttttcacctcattgtgtctgtctgctgcaggatcagctcatcgtcagatagtgacattttagcagttccgcctgaagtacccatttacaggcactttggcgattcaatttatagatatatcaatatcatagttacccatttatcgccacgcctgtgccgctacgcctccatcgtttaagaatccgtcgctgaccgatgcgccaaaacgttatacccatcacgatttaaaatgactatctgtcatgcttttacattattttgagatccttatttattttgcagcaggagcaagcatgttaaagcccggaatgatgttactggcactgagcgtttccgtcgccacccaggcggcgacggtggatttgcggatactggaaaccaccgatctgcacagcaatatgatggatttcgactattacaaagacacgccaaccgagaagtttggtctggtgcgaaccgccacgctgatccacgccgcacgccaggaggtgaaaaacagcctgctggtcgataacggcgacatcattcagggcagcccgctgggtgactacatggcggccaaaggattacatgagggcgagatccatccggtctacaaggcgctcaacacgctggattacagcgtcggtaacctcggcaatcatgaattcaattatggcctgccctacctgaaaaaagcgctggcgggcgcacgctttccctatgtgaacgccaacgtgattgatgtgaagagcggcaaaccgctgtttaccccatacctcatcaaatccaccacggtggttgatcgcgagggcaaaacgcagaccctgaagataggttatatcggctttgtgccgccgcagatcatggtgtgggataaagccaacctgcagggcaaggtacgcgtcgatgacatcaccgaaacggctcgccgctacgtgcctgagatgcgcgcgcagggcgccgatctgattatcgctattccccactccggcctgagcagcgagccgtatcacacgatggcggagaactcggtttactatctcagccaggtggaaggcattaacgccatcctgtttggtcatgcgcatgcggtcttccccggcaaggagtttgctgacatcaagggtgcagatatcgccaacggcaccctgaacggtattccggcggtgatgccaggcatgtggggcgatcaccttggcgtggttgacctggtgctgaacaatgagggcggacgctggcaggtgagcagcggcaaagcacaggcgcggccaatttacgataccgcagcgaagaaatcgctggcggcagaggatccggcgctggtgaaggtactggctgacgatcaccgcgccacgcgagagtttgtggcgaagcccatcggcaagtccgccgatgtgatgtacagctacctgtcgctggtacaggacgatccgacggtacagatcgtcaataatgcccagcgcgcctacgtggagcatttcattcagggcgatccggatctgggccgcctgccggtgctctctgctgctgcgccgtttaaagcgggcggacgtaaaaacgatccggccagctatgtcgaagtggagaaaggcgcgctgaccttccgtaacgcggccgatctctatctttatcccaataccctggtggtcatgaaagtcaccggtgcgcaggtaaaagagtggctggagtgctcagcgggccagtttaatcagatcgatccccacagcacgaaaacgcagtcgctgatcaactgggatttccgcacctataactttgatgtgattgacggggttaattatcagattgatgtgacccagcccgcgcgctacgacgcagagtgtcagttgatccatcctgaggcctcacgtatccgtcagcttagctggcagggtaaacccgtcgatccacaggcgaccttcctggtggcgaccaataactatcgcgcttacggcggcaagtttgccggcaccggagataaatacatcgcctttgcctcaccggatgagaaccgttccgtggttgcagcctacatcagcgcggaaaccaaagcgcacggtgaagttcagccgaaggcggacaataactggcggctggcaccgattacctcatccaccccgctcgacattcagtttgaaacggcaccgggtgataaagcgaccggatttattaagcagcatgcgcaatatccgcttcagcccaaagggacagatgcgatcggctttgctctgtggcaggtgaatttacagcagaaataaggcggaagaaaacgctgcaaccgggggggttgcagcgtccggaattacagaatttccagcagttcgacttcgaagatcagggtgctgaatggtgggatagaggcacccgcaccgcgctcgccatacgcgaggttctgtgggatcaccagttcccattttgagccaaccggcatcagggtcagcgcttcaatccagcctggaattacgccgcttaccgggaattccgccggttcgccacgggcaacagagctgtcgaatacgctgccgtcgatcagtttaccggtgtagtgaacgcgtacgcgatcctgacgtgatgggattggaccctcgccctgcgtaatcacgctgaactgcaggcctgattcggtgctgctcacgccttcacgctgcgcatgttcctgcaggaacgcctgaccttctgcggccatggcttcggtgcgctcacgacgcacgccttcagcgcgttcatgcacttcacgcagtgcgcgatgaaccacatcaaccggtacggccggcgagtttcccttccagcgcgtcgcgcagacccgcgagcagtgcttctggttgcagaccctgcagaccagattccagcaactgctggccaacctgtaaaccaataccgtaacttgcttgtgcttcgacgctgtcgaaagaaggggtagtcatcttcgttcctttcactctcggataaattcgaacgggcagcatagcagcgcaggccgctggcgtaaaatgccctgcgtcgcagatgacttttgccggggaaagagaaacaatagagccgtcaattttatcaatgctggcaggcacttcgcgccggtattgcccatactataactatcgggggggatcaccccctctgtagcacacgaataagagagcaaacatgggccagatagccccacgacgccgcaggatgcgtgcaaaatatcttgtatcccggctgcagacctggctggccgcacgcaggctaaatcagcctgccggagaggaggaaccccgaatggcttcagacacgtcatcccgcctgccgacatggcttcagcgtatctggcattttaccgaccacattcgctggatggacccgctgcctgcgccgcaccgccgtggcattgtggccgcactgctggtgatgctggtggcgtttctctggcccgccagcacgctgcgctatccggttgagcagccggtcgcaccccagacggagaaagaggtgccgatgcaggcggatatttatgagaacaacagtagccgccagccgtcatccccaccgtctcagcagacgccaaaagccgattctcagggtgagtggcgcaatctgaccatcgcttccggtcagacgctggcgcagctgtttcgtgataatagtctgccggtcaatgatgtgtttgcgatggcgcgggtggaaggcagcgatcagccactcagctcactgaaaagtggtcagcaggtgaaaatccgtcaggatgcgcagggggctgtaacaggtctgacggtggagggcgcaaacggtccggtgctgtttacacgtcagccagacggcagctttattcgcgcgcagtaacgcgaacagcggcgattgaaaggcacaaaaacaaaaacgccggcacagggccggcgtttgtgtcgtgctcagttaataaagattaaccagcaactactttcacgttcagtttcgcgaatacttcgctgtgaacctggaagcttacttcatgctcaccggtagtgcgcagaacgccgttcggcagacgaaacttcgctcttagccacttcaacgccagctgcagtcactgcatcagcgatgtcgcgggcaccgattgaaccgaacagtttaccttcatcgcccgctttagacgtgatggttacagtgcccagttcattgattttctcagcgcgtgcagttgctgcagactgaacgtcagccagtttggcttccagttcagcacggcgtgcttcgaagaactcaacgtttttcttggtagcaggaacagctttgccctgtggtaccaggaagttacgagcgtagcccgctttaacgttaacctgatcacccagggtgccaaggtttgctactttatcaagcagaataacttgcattaccttatcctcttaaagtcgttaatggacagttgccgattactgatgacgatcagtgtacggcagcagagacaggtaacgcgcacgcttgatgcagcgagccaactgacgctggtattttgcacgagtaccggtgatacggctcgggacaattttaccgctttcggtaatgtagtttttcaacgttgcgatgtctttgtaatcgatctcaacaacgccttccgcggtgaaacggcagaacttgcgacgacggaaataacgtgccattaggctagtctccagaatctatcaattcaatctgctcggcatggaacaccactttgctctggccatttcgtgcctgatggcaactaatgaaaccgtcgagtgtgagttgcgtgccgaccgttatatgttgagtaatcacctgatgggcgctgccgctgataataaccggcatacgacaccaggcttgccggtgaaacccggcctcctcctgcactgagcggtgctcaagcacgaactgacagtgaggaattcctgacgggctaactcttcgaaccggcgtcttgcacacagtgccagacaggcgaagtcgattaaccgtcacgatggattactcttcagaatccccagcatctgactcatcagcggattcgttagcaaaatcttcgcgacgatcacgacgctcatctttcgctttaaccatcggcgatgcttcagttaccgcgtttttaacgcgcataaccatgctacggataacggcgtcgttgaagcggaagttcgtttccagctcatcgatcgcttcctgcggcgcttcaacgttcatcagaacgtaatgcgctttgtgcagtttattgatcgggtaagccagctgacggcggccccagtcttccagacggtgaatcgtgccttctgcaccagtgatagcaccagtgtaacgctcgatcatgccaggaacctgttcgctctggtcaggatgaaccataaatacgatttcgtaatgacgcatcgaaattgctccttacggattattcagcctcctgtcggggtcaaccgcggcccatggaagcaaggaacgttataggctgtgtcccacaaaggttcgttatgacgagcgtttgtgggacacagcctgagaatgcggctgaaaaattgacgcgtaatcatactggcggcgacggctaaactcaagcgcacatttcaacaaatgccatccggcgtgccatatacggtagcttttcgtgctaatcatgtgaatacagcgcgttaagcgggaaaggttcaaaaaagctgataaagagcttcaggcggacgatctggcgataatgtgcacagtcgctaaacttaatacagacgctacggtttggcttatcggcgtctaacagagtgtgttccctgaagtgaggagtcgggcatgaaaacgttcgtcatcgccactttactgggtctcttcctgtctccacccgctcttgccagcaatgctgactgtgcgcagcagataagaagtcacagcagcgaagcggcatcgggttatatctacattaatcggctggatgcgccacaaaagaacccggtcaacgcgcctgccagagcagcagaaaaatcgtctgcgcactggtaagtgctggtaaatttacgggcggcagatccactctccgcccgctcatttttatagctgctgtttaaaaaagctgaccagcgccgtcaatgctgatggcgtgatcttatgtccaatctgtttttcagacagcgaagtcagatgcttcgccagcccgttgtcacgcagcgccctctccagccgtacgctctccgcccagggcaccacctcatccgcctcaccatgccacaacagcagcggacggtttgccagggcctccagccggttgcagggatcgtagtccgccagcggtgccatgcgggcagcaaactgcgcttgctgctcaggcgtgtcggctaccagcggcggaaacagcgactgactgagctgcataaaatagcccgatcccatcaggcaggcgacgctctgaatctgcggataacgcgccatcgcgcccagcgccgtcatgccgcccatcgacgcgcccgccaccgcaaggcgctcgccggcgatcagatcgtcagcgcgcagcgccgattccagctgcggcagctcatcaatgttctgtttcagaatctcccagaagcgaccaaggcgtgcatcggcatcaccgtgatagcgcgcgccgtgcagtttctgcatccggcatcaccgcccggaaccccgcctgtgccagcgcgacagcgaagtaggcgtagacctcttttgaagaggtaaagccgtgataaaacagcacggtgggcagtggctgatgccgttgtccggcaggcgtggcgtgcaggcattcgataccggccagcgtttctgtggtgagttcaatcatggtctctcctgagaaggggcaaggcgtgccgattgagtgtacgtctgcgggttaatttacgaaatcccctgctgcgtttagtcgccagatttcggcctaaacttttcccgcgctttgccgttgatgttgtgtccccctaacttgatcaaaggtaatttatgaagcgtctctctctcagcggcctgagtcttggagttaagctgtctgtactgacgtctctcagcgtagcgttattgttgctggttctgacgctaacccagagccacaccgcttcgcggcagctggaaaatctcgccatcgatgacatgcaaaaccaggtgcagggcatcagtgaaatggccaccatgttcaacgccactctcaccgaagaggtggctcactacaccggtctgtttaccagtttcctgcctaagcgttttagcctggatgaaggctcacgggtgcaggtcggtgccttttcgacgccggtgctgcgcgccgggttaaaaacgctgaacctcgaccagaccgcggtagacgatttcaccgaacgcaccgccgccgtggcgaccatttttgtgcgcgacggcgatgattttatccgtatttccacctcgctgaaaaagcaggatggcagtcgcgcaatcggtacgcagcttgaccgcaacggcgccgcctggaaaagcgtcagtcagggcgacgtctatcaggggctggcgacgctgttcggccatcgctacatcacacaatatcagccggtaaaagatgagagtggcaaggttgtcgccatcctgtttgtcggcgttggcattgataagcagtatgcgctgatgcgtgaaaaaatcctggcacgcaagctgggtgatagtggtcatttctttgtgctcaacggcacccccggtaagacgcagggagagtatctgttcgatcagcacaacgaaggaaaacgacccgcctgggatgacgcgacactccagccgctgctgactcagccgctgggcatgatgcaggcagagatcaacggcgagcaccagattctggcctggcagcagctgccgggctggaactgggtgatcgccggcgaagttaaccgtgaaagcctgctcgccccgattacgcatagccgcaacctgttcctgataaccggactgattctggtggtggtctttgcgctggggtttgtctggtacagccgtcgggcgattacccgtccgctgcagcaggtgatccatctggcggagcagtatgccgccgggaatctgcaggtccatatggatacccagcgtcgcgatgaagtgggccagttgatcgttgcgatcaacggcattggcgatggtctggagaaaatcgtcagccaggtgcgcggcgcggcgcaggagatcagcgacggcacggacaccatcgcggccagcagtcataacatcagcgagcagatcgggcgtcaggccagcagcgtggagcagacctctgccagcatggagcagtttggcgcgacggttgaacacaccgcagacagcctgcgtcaggcgatgtcactggtggccgaagccagcgatatcgtcagtcacggcagccagacggtggtgcgctcggtcaacaccatgtcggcgattaaggtttcatcacaaagcattgcggatatcacccacgtgattgagtcgatcgccttccagaccaatatcctggcgctgaatgccgccgttgaagcggcacgtgccggggaacagggccgtggctttgccgtggtggccgcagaagtgcgtgcgctggcacagcgttctgcgcaggccgctaaagagattgatggactgattgcgacctccatcagcaacgtggcggaaggccatcaattatctgagcagacgcgcgatgcgatgagcgacattgtgacccacatcgagcaggtgcaggcgctgatgggcgagatcaacgtggcggcgcagcagcaggcggcaggaatcggccaggttaatctggcgatgaaccagatcagccaggcgactcaccagaacagcgaactggtgacacaggcggaaaacagcgcgcagaaacctgagtgataaagggcatcacctgacccaactggtcagcgtattcagccttaaatcctgacgccattcagggcgatggcatacacttaatgcttcgtcctgaaagagggttttgctatgcgtttcgcttatttactgatgataagcctgctgctggcaggctgttccgcgcttgagaccacgccaaaagcaccgcccgcgccgacgcaacaggcgcaggagatttcacgggcgcagagtggcggtttgccaaagctgggcaatattaccgttaacgtgcgcggctcaccggatgatgccgggcgggccgtcgccgcccgggctaaccaggccggtgcggcttactatcagatcgtggcgctgagtgaaacagtgatgcccggtctctggtacgccagcgcgattctttacggcgcatcacctgccacaggcgcgggccagtaaacggtctgtgattgctgtctcaagcgggcgggagccacgccgatcgagccactgctggcaccatgcatccgccagcggcggttcgccatatttcagtagctgagcgccggtcgcaagcagcagcagtgtgcgggtcacctcgcgcgcctgctcttcggggactttgctcattcgcagccgtaactgacgccagcgcgcatcgaaatgacgattactccctttcaccgcttcaaattcctggcccagcatctccgaaacctctgcctgacgggtgagcacgcgcagtacgtcaagacacatcacgttgcccgacccttcccagatgctgttgaccggtatgtcacgatagaggcgcggcagctcgctcgcttcgcagtagccgatgccccccagcacttccatcgactccgcgacgaacggggctcccgctttgcagatctgatattttgcagccggagtgaataagcgggcaaacgtgacctcatgcggttttgccggttgtgaccaggcgcgcgccagccgcatcagcagtgcggtttgcccctccagctgcagcgcctgctgtgccagaaacctgacgcatcagcggctgatccaccaggtttttccccatcacctggcgctgatgtgcatgccagagtgccaccgagaatgcacgccgcatctgaccatgactgccgagtgcgcagtcgaagcgcgtcataccgcccattttaaggatcagccgcacgccttcgccctcttctcccagcagccagccggtcgcatcgcgaaactccacctcacaactagcatttgagcgattacccagcttatctttaagctgctcaagctggatggcgttgcgtgacccgtcaggcaacaggcgcggcaggaagaaacagcttaatccggcgggcgtctgcgccagcaccagatgcgcatcgctctgcggcaccgagaagaaccatttgtggccggtcagccggtaggcttcacccgggccgcgcgcgcccagcggctcggcccgggtggtgctggtgagcagatcgctgccgccctgtttttccgtcatgcccataccgatcagcagaccccgtttctggtcgccgggctgcgcatgggtatcgtaacgatcgctgagcagcggatcgagccagccttcgaacgcggcaggcagataagtctgcagcagtggaatggccgcgtgcgtcatggtcacggggcaaagcgtgcccgcttcaacctgcgcatgcagaataaagcgcgcagcgcgcgccacgctggcctgttcacgtactgtgggatgccagctgagattatgcaggcggctggcgcagacaccctgcatcagcaggtgccaggcggggtgaaaacggacttcatccatccgtacgccacgggcgtcgtagcgcagcagttcaggtggctccgcgttggcgagccggcccagttccagcgactcggcgctgcccagctgtcggcctaccgaagccagccactcccgatcccatccggcgccttcgcgtgacagtgcctcgccgagcggcgtatcagacaggaacaggttgctgttgctcagaggatggggctgattaaaaacggtgtgtgttgtccaggtcataaccactcctcgcggatgtcactcagtaagtatacccgtcgtctttcaagctgcatttttgttggctgcgttcactcacccgaatcacttactcatgtaagctcatcgggattcgttctcttgccgcctcaatgcaacccgaaatcctttgggtatatacgaatgacgcgcagttatgcctggtacagaaactaatttgtggcgaggatcacatcggggatcaggcgttgcgctgacgcaccgcttcaaacaggcagacacccgtagcaaccgagacattcagcgaagagacgctgcccgccatcggaatgctgatcagctcatcgcaatgctcacgggtcagacgacgcatgccttccccttccgcgcccatcaccagcgccatcggaccggtcattttgctctggaagacggtatggtcagcttcacctgcggtaccgacaacccagatgttgtactcctgcagcagacgcagggtacgtgccaggttggtgacgcggatcaacggcacattttctgccgcgccgctggccacttttttggccgttgcattcaggggagcagagcgatctttcggcacgataatcgcgtgaacaccggccgcatcggcactgcgcaggcaggcacccagattgtgcggatcggtgaccccgtccagcaccagcaggaagggtttctccaggctctgcagcagatccggcaggtcgccttcctgatactgacgacccggttttacccgcgccacaataccctgatgcacaccgccttcaacctggctgtcgagccacttgcgctcggccagctgaatcacgaccccctgagcttccagcgcggcgaccacgggttgcaggcgacgatcgtcgcggcctttgaggataaagacttcctggaatcgttgtggatcacgttccagcagcgcctgcacggcatggataccaaaaataatttcgctcatcgatctgctcagtgtttggaaatgaatgaatgaccgccctttctcagtgagaaagggcgggtgcgcgcatcagtcaggctgcgccttttttctggcgcgcttcgcccgggtggcggcggcgattttacgggttttttccgagacgtttttacttttattctcggtatttgcagcggcgggcttgcccttgtcgccccggaaagcggcgtccggctcgaagttggacttcttgctcgcatcacgacggcgtttcgctggcgctttgtcgtcacgcttcgcccggtcgcgtgcggttttgccttcaccacgtacctgacgctggctggagatcagggcaaagtcgattttacgctcatccatatggacggcttcaacacgcacttcaaccgtgtcacccagacgataggtgcgaccgcccgattcaccgatcagacgctgacctaccgggtcaaaacggtagtaatcgttgtcgagcgtcgaaacgtggaccagaccatcaatgaacagatcgcttaagcgtacaaagaagccaaatccggtcacgctggagatgacgccgttgaagacgttgccaacctggtcctgcatgaagtcacacttgagccagtccgcgacatcacgggtcgcttcatcggcgcggcgttcggtcagggaacagtgcaggcccagttgcagcatctgcggcatctcgtagtgatagccgccggttgctgtcgtcatatctttggctacgctgcgatctctcggcatcaggtatttaatggcgcgctgtaccaggcctttaccttcatcctgctcttttgccagcagatatttgatggcgcgatgcagcgtcagatccggataacgacggattggcgaggtaaagtgcgcatacgacgagagtgccagaccaaagtgaccgcggttttccggatcgtaaacggcctgcttcatcgaaacgcagcagcatggtttgcagcatttccgcatcaggacgatcggcaacctgcttcagcagcgccgcatagtcgattggctgcggtttattgccgccaggcagactcagtcccagctcgttgagcacggtacggaagctcttgatgctttcgtcggtcgggcgatcgtgatcgcggaacagcgccggttcctgatttttctcaacgaagcgtgccgaggcgatgttcgccaggatcatgcactcttcgatcaacttatgggcgtcattacgtgacacgcgctcaacacgctcaatacggcgctcggcgttgaagataaacttcgcctcttccgtttcaaacgagataccgccgcgctcttcacgagcggcttccagcgcatgatagaggttgttcagctcttccaggtctttaaccagtggcgcatactgctggcgcagctctttgtcgccctgcagaatgttccagactttgttgtaggtcagacgcgcatgggagttcatcaccgcttcgtagtgcttgaagccggtcagtttacctttggtcgagatggtcatctcgcacaccatacagaggcgatcgacctgcgggttaagcgaacataagccattcgacagcacttccggcagcatcggcacaacctgcgacgggaagtagaccgaggttccgcgctgatgcgcttcgtcatccagtggggtgcccggacggacgtaatagctgacatccgcgatagctacccacagacgccatccgccaccgcgcttcttctcacagtaaacagcatcatcaaagtcacgggcatcttcaccatcgatggtgaccagcggcagcttacgcagatcgacgcggccttttttggcctcttccgggacttcttctttcagtttgctgacctgagcttccacttccggcggccaggtgtgcgggatttcatgcgtacgcagcgccatatccacggccaggctggtacccatatcatcgcccagaatctcggcgattttaccgatcgctttgctgcgacggttcggacgctggaccagctcaaccaccaccacggaacccatgcgggcattcatcgtctcttcaggggggatgaggatgtcaaaactcaggcgactgtcgtccggtaccacgaagccggcaccggcatcggtaaagtaacggccaacgatctgattgttgcggggttcctgcacccggaccacgcgcgcttcgcggcggcctttgcgatcggcacccagcggctgcgccaggatcacgtcaccgtgcatacagaatttcatctgttctgcggaaaggtagaggtcatctttctgaccttctgcccgcaggaagccgtagccatcacggtggccaatgactttaccgcgcaggagatcaagacgtttctggcagggcataacactgacggcgggtgaacaccagctgaccatcacgctccatggcgcgaaggcggcgacgcagcgcctcaaggtgttcttcttcctgcagattcatctcttcagccagctcttcgcggctggccggtttttcacgtttttctaacagagccagaataaattcacggctcggaatagggttttcgtatttttcagcttctctatcctgaaaaggatcttttgacatagcggttcctccgatgtcatttaatatttatttccaccggcgatctggacaagatgatctcataaagtggtgtatttccttcgaccagatctgccaacgtatagctatccagctcctgcaaaaatcgctgcaccgcatcatgtaacgcctgcttcagacgacaggctggcgtgatggaacaggacgcacaatccactaattgtagtggttccatcttacgtaccacatcgccaatgacaatctgacgagctggcatacccagacgaatgcccccgtttttaccacgcgttgcggcgacatagcccgcccggctcagctgattgataattttgaccatatgattacgggacaaaccataagtgttcgtcacttccgtaatattggtctgctgaccttccggcaacgatgccagataaatcagtgcccgtaagccataatcagtaaaactcgtgagctgcacagtaacctcagtgaaccttcaggcgcggcatgaccttattcgccctgtgattgatgccaggattaaatcggatcgccattcgattagctacgatgataaaccagagtctgtctggccgtgcgcttttttaagccagcagaaggtttgacaagcgaagggaggttaagtggcatcaaagaatggaaaaacaagggccggacagcgtccggcctgaatgattacgcgtcgaacgggtcgcgcagaatcattgtttcactacgatcagggccggttgagatgatatcaatcggcacacccgttacctcttccacacgcttgatgtagtcacgcgcggcctgaggcaaaccttccagcgtcttgacgccaaacgttgtctcgctccagcctggcagggtttcgtagatcggctcaatgccttcccagttctctgccgccagtggcgtggtggtcacttcgcggccatcaggcatacgataagccacacagatcttcacctctttcaggccatccagcacgtccagcttggtcatgcagaaacctgacagggagttgatctggaccgcgcggcgaaccgctaccgcatccagccagccggtacgacgacgacgaccggtggtcgcaccaaactcattaccctgcgcacagaggaattcgccggtttcatcgaacagctcggtcgggaacgggcctgcgccaacgcgggttgagtaagctttcacaatacccagcacgtagtcgacatagcgcgggccaatgcctgaaccggtcgctacgccacctgcggtggtgttggatgaggtcacgtacggataggtaccgtgatcgatatccagcagcgtaccctgcgcaccttcaaacataatcagatcgccacgcttacgcgcgacgtccagcagttcagagacgtcaacgaccatgccagtgatgatgtcagcgacttccatcacatcactcagcactttatcgaagtcaactgccggctctttgtagtactccaccagctggaagttgtagaaatcgaccacttctttcagcttggcagcaaaggtttctttgttaaacaggtcgctgacgcgcagggcacggcgagcgactttatcttcgtaagccggtccgatgccacgccccgtggtaccaatcgctttggcgccacgagcacgttcacgcgccatatccatcgcaacatgatattgcaggatcagcggacaggcttcagaaatcagcagacgttcacgtaccggaatcccgcgcgcttccaggcctttcatctctttcattaaggcttcaggagagagcactacgccgttaccaatgatgctggtgacgttatcgcgcagaatgccagaagggatcaggtggaggacggttttttcaccgttgatgacaagcgtgtggcccgcattgtggccgccttgataacgcacaacgtaattcgcgcgctcagtcagaaggtctacaatcttacctttaccttcgtcaccccattgggtgcccagtacgacgacgtttcttacccatttctcaaaatcaccgattgcttaaaaaaggattctaccatctgatcccgtggttttcagcacttttagcatacgattgcgcgcttttttgcctgagttttgatcactacaacatgttggggataatagcgttgaaaggcacaatttagccggtctgaacgtcagcctcagaggttgccgtgcaggctgagcatgcagtaaatcaccatgccagcaacgaccagtcctccaccaaagcggtgtagcagacgatcgggcaaccgcgtcatcgtcaggatcatgcgtcgccaggcgcgcggcataaacatcggtcccaacccttccagcactaacaccagcgccagcgccatccagatgcttgttttcattctgatacccaaaaaaaagggccgacaacattgtcggcccacaggttatatcagttcttagcgtgtcgcgttagagggcgccttcatatatcggaagaagtcgctatccgggcttaacaccatcacatcctgatcgctattgaagctgttttcataggcacgcaggctacgaataaaggcatagaagtcaggatctttgctgaacgaatcggcaaacaaccgcgccgtttccgcatcaccgtcaccgcgtgtaatcagcgcttcacgctgggcttcagccagagtacgggtgacctggtaatcggcctgggcgcgcagtttttccgcctcttcctgaccctgtgaacgctggctacgcgctaccgcttcacgctcagcacgcatacggttgaagatcgcatcagacacttcagtcggcaggttgatctgcttgatgcgaacatccaccacctgaatacctaacgccgccatactgttcgggtttggtgctggctcgctgctgttggtttcacgctcgacacgggccgctgcactggcaatcgcatcatcagccgcaggggttgcgatttcatcatcgttgcctgcagagccggtattcagcgcgtcacgcacatcggtagtcagacgaccacgagagtccgttacgatatctttcacatccagacgacccatctcagaacgcaagcggtcactgaacttacgtttcagcagcacttccgcctgagagacatcaccgccaccggtggccaggtagtagcgactgaagtcgctgatacgccacttgatgtaggagtccacgatcagatctttcttctctttggtgacgaagcgatcggcctggttatccatggtctggatacgcgcatccagcgttttaaccgtttccaggaatggaatcttgaaatgcagacccggctcaaacacctgcggcttgttttcgccgtcgcgcaggactttaccgaagcgcagaacaatgcctcgctgcccttcctgcaccacaaacagggacgcatagagcgccaccagcacgacaatgattaaaaatactattggcttacgcatcgattactctctcccttcgcgctggctgtcgctgcgctgagcatttgcccgacgctgatccatgatgttgtccggactgtatgacgacgtgtcattgcggctggcactgctatcggagcgcgcaggcagcgaagaaccattcgcgcctttctgaccattctggcccgatgaagtctgtccgccacgcatcagttgatccagcggcagcaccatcaggttattactccgatcgttaaccagtactttgcgggtatggctcagcacacgttccatggtctcgatatagagacgctctttggtgatttccggtgcagctttatactcaggcaggatcttggcgaaacgcgccacctcaccctgcgcttccagaaacggtacgctctttgtaagcgcgtgcctcttccagaatacgttgcgcctggccgttagcacgaggctgaacttcgttggcgtaagcttcggcttcgcgaacgtactgctcgcggttttcgcgtgcggcaatcgcgtcatcaaatgcagacttcacctcttccggcggacgtgcagcctggaagttgacgtccagcaccgcgatccccatgttataagggcgaatcgtctcgtcgatttcacgctgggtatcgctacgcaccacggtacgaccttcggtcaggatgcggtccatggtagagcgaccaatcacgccgcgcagtgcgctgtcagtagcctgacgcaggctgtcgtccgcgctggtcacagcataaagataacgttccggatcggtcacgcggtactgcacgttcatctccacgcgtaccacgttctcatccgaagtcagcatgacgccagaagcagccagttcgcgcaccgattcaacgttaaccgcacgcacctgatcaacgaatgtcggcttccagttcaggccgggttcgaccagatgactgaatttaccgaagcgcgtcaccacgccacgttccgcttctttgatggtgtagaaaccgcttgcagcccagatgactacagcagcaacagccacgataccaacaattttgccaccgctgccggagccgcgctgaccgttgtcgttctgtttgccaccgcccagtccaccaagcttcttgctcagcttacggaagatatcatccagatcaggaggcccggattcccgtcctcccttattccccccagagttgccgccttgattattgctgcttccccacgggtcgcggtcctgtccgttatttccgggctgattccacgccatgtttctactccatttattgtaattacgatttttacccttcagctttcggattgcagcggtgttggctgccttcgctcaccccggtcacttacctgcgtaagctcccggggattcactcagttgccgccttgcttaaatccaaaatactcgggtaacgccagcgtattcgggtctgcaaagaaagtgcgacaatcttcaatttttaaggtaaatgcgtttgggcaatatcaaacaatgtaactggtcagcgacggttcctgcttacataaacgcatccactcaataatgggcatacgaatctgcaatcctacactgccgtcttcttcattccactctttctcaatcgcctgcagctgatagaaacggctgcgaagtcgccccgcttccggtggcagacgtaatgcgtgctgggctatttcacccgccagacgctcagacagcgcctgccatagcaacggaatgcctgcgcctgtctgggcggaaagccagacgcggattggcaggtttctcttcgttacgatcaatacgcggttcgaatccgtcgagcatatcgattttattcatcaccagtaacgtcgggatttcgtccgcttcaatctcttccagtacggcatcgacagcagcgatattttccgtgacgcgaaggtcagccccatcaatcacgtgcattaacagcgtcgcctgacgtgtctcctgcagcgtggctttaaaagcggcaaccaggtcgtgaggaagatggcgaataaagcctaccgtatccgccagtaccacgtccccgacatcagcaacattcagacgacgcagtgtggggtcgagcgtcgcaaacagctggtctgcggcaaagacgttggcggaggtcatggcgttaaagagggtcgacttgccggcgttggtgtaacccaccagcgaaaccgttggcacatccgctttggcgcgtgactgacgtccctgctcacgctgtttttcaactcgctcaagacgagacaaaatctgactgatacggccgcgcaacagccggcggtccgtttctaactgcgtttcacccgggccacgtaaaccaatcccgcctttctggcgttcaaggtgggtccagccgcgcaccagacgtgtcgcaagatggcgcagctgtgccagctcaacctgcaatttaccttcgtgggtacgtgcgcgttgggcaaagatatccagaattaaaccggtgcgatcaatgacccggcattcgcacaggcgctcgaggtttctttcctgagcgggcgtaagggcatgatcgaataatacgaccgatgctcctgttgtttttaccgcatcggcaatttcaacggcctttccttcaccgacaaaatacttggggtgtggcgctttgcggctgccagtaaccacttgcagcgcctcaacgccagcagaagagaccagggtttcaaactcctgcaaatcttctacttctttgtcttgggagaaccagatgtgtaccagtacggcctgctcaccggcttcataacggtcaaacaagctataacctcgctaaataaaagaccaggacggaaaaccgctgttctccgttcctggctgtacggtgacgcgttattctgcgttatcaccgtcttgttgtggctgtggctgcgcagttgtgttgctgccgccatgatggtaattgttgctgccgccaccggtattattgctatggtgagaaaccgggcgtgaaggaacaacggtagaaatggcgtgcttatacaccatctgactcaccgtgtttttcaacaaaatgacgaactgatcaaatgactcaatctgaccctgcaacttaataccgttaaccagataaatcgaaaccggaacacgttcacgacgcagtgcgttcaaaaacgggtcttgtaatgattgccccttagccattctatcttttccttatatgcttgttgtttgttgcaagtagaacctatggttctgaaaaaaactgcgtaaaaatttgcgcacgataacccatcaattgtacacaatcacccatgcttcgcactaagaacctgtaacactgtatcacgcgccagccggggctcgtcactgtcaagccagtgaacattttcccaaccgcgtaaccaggtcatctgtcgcttagcaagctgccgggttgcgcaaattccccgataaaccatctcgctgtaatcgatttcgcccgataaataagaccacatctgacgatagccaacacaacgaatggaaggcatgtccgtatgcaaatcacctcgtgcaaaaagggcccgagactccgcttcaaatcctgacgccaacatctgctcaaaacgcaacgcgatgcgctggtgcagcaattcacggctcgcgggggcgatggcaaactgttgcacgtcgtagggtaacgcttcaccggatgtttttgtcagttccgttaaagttttacccgaaataaaaaaaacttccagtgctcgcgaaagtctctgcggatcattcggatgaatacgactgccggcaaccgggtcgatttcacacagctggcggtgtaaagcttcccagcctttttcacgcgccgtttgctctatccgctgacgaaacgtcgggatcggccgagggcaacggcgacaatccttcaagtaacgccttgaagtagagcatggttccaccaacaagcaacggtattcgtccggcttcaacgatatccgccatttctgctaaagcatcccgccggaactccgctgccgaataggcttcagcgggatcgcgaatgtcgagcagacgatggggtgccactgctaactcctcagccgacggtttcgccgtaccaatatccatctgacgatagattaaggcagagtctacgctgattagttccactggtaaccgcttacgcaattcaattgctaaagcggtcttgccagaagccgtgggtcccatcaaaaaaatagcctttggccggccagcctggtttaattcactcatgcttcaacgcgttgatcgcgctctcaatctctatgggctgtaataagcctgaaggcggcgatttcagtagctgtgggcaaagccgttcaagctctgccagcaggttgatcgcctgtgagtgattccagtcggaggactctgtatcctgacgccgcgccagccactgggccagttgcgtcgcagagatctcctgctgccgggcgagatagcctaacagctcaggaatcaagatttgtaaattttgtgttcgtaacggtaaaggcaccgcgcgtaaggtcacgtggtcaccttcgggctgaagatcaatacccatctgattgagcaggctgctcttttcttttgcggcctgccgttcatcgagggcgattttgagccgcaccggaatcagcagaggttgcggtttaagtccctcttcacccggttcaagctgcgcctgtttcagccagcgcgccgcgaccggcagcgctatcagcattaacttctgatcctgctccagcagcgcatagtggttttgcaacacggtcagtacccggccaaagctctgggcatgcgcggccagcggcgagggtttttcggctggacgcggtgccggttcacgggtttttggcggcggcgtggcgctgacaggcgttttcagcaactgctgataaaccgcgccttcacgctgacgatacacgttctctttgttttgccaggccggcgccgctgcgggcggtgtttgccgcgtggaggctgaagattgattctcgctggcgggcgctgaaggctgcgcaaaatgattaccccccgccgcctgacggttttccggctgccagcgcggtgcggcttcttctgcctgcagcgcaggcaaaatgggtgacgctatcgcctgtaacgcgctgaccacgccctgataaataaaatcatgcaccaggcgtgactgatgaaaacgcacttcatgcttggccgggtgaacgttgacatccacctgatgcggatcgatctccagatagagcacgtaagcgggctgctggtcatcctggagctgggtctggaaagcctggcgaatagcgtgattaatcagcttgtcgcgcatcatccggccattgacgtagcaatattgtaactcggtgacctggcgcgaaccggcgggatcggcgacccagccgcgcagcgagagatcatcatgctgccagtcaattcgcagcgcatgctgaataaacgtggtgccgcagatagctgccagtcgccgtttcgcgctggctctcctcgctgaccgcccgatactgacgcatcattttgccgttgtggctcagtgaaagcgcgacatcaaaacgcgccagtgcaatacgacggatcacttcgtcgatatgaccgaactcggttttctctgtgcgcataaatttgcggcgcgccggggtgttataaaacagatccagcacttcgagcgtggtcccacacggatgcgcagccggtttaaccgttaccgtcatatcacgcccttccgcataggcctgccaggcttcggtttgatcggcggtacgtgaggttaaggtcaggcgggagacagaactgatactggcgagcgcttcaccgcgaaaacccaggctcatgatcgcttccaggtcatccagtgaggcgattttactggtggcgtgtcgggccagcgccatcgacagctcgcttttcacgatgccgcagccgttgtcacgaatgcggataagctttgcgccccccttttcaatatcaacgtcaatgcgcgttgcaccagcatccaggctgttctccaccagctcttttacaaccgatgcaggacgttcaaccacttcacccgccgcaatctggtttgccagttggggcggtaaaatttgtatcggcatggttttccttttagctggtcgcccggcgcagcggccgggcaaacaatcaggatgcagggattttcaggttctgccccaacatgacgttggtcgatttcagattattggtctgcattatcgctttcgggctgacgccataatgtgcggcaatgccggtcagtgaatcccccacaaccactttatgacgcacaatgccgcgtggcgtggcgcgcgtggtgcggctggcggccgcactggccggcactttcaaccgctgtccgacccataccacatcccgcttcagggtgttcatctcacgcagggtcgccatgctgacgccatacttcgcggcaatcccggagagtgtctcaccgcgcgttaccgtatggcgctgagttacgccggtatattgcgtcaccccggtcgccgggttgctggcgacgttaaccgctggcgacgagcccagcggccggttttcctcctttgggatggattgcagcgggtgcgccaggaaataagtgcgcagacctttatagatcgactgcgcaatcttatcctggtgtgcgctactgccaagcagtcgctcctccgaggaattactgataaagccggtttccaccagcaaagaaggaatatcgggtgaacgcagcacgccaagactggcatgctcaggcagacgtttatgcagcgacgtcacgctgcgcatctgctgcaacactttctgggcgatgtcataaccgacacgctgcgagtgaccgaattgcaggtcaagtaccgcctggctgaggtaggggtcggcctgactgttagccagcaggtcacctgcgccgcccagcagctcagactgtttctctttctgctccagccagttagccatctcgttattggcccggcggtttgataatacccagaccgatgcaccggtcgccgcatggctcggcgcagcgtcagcatgaattgaaaccagcacgttggcgttggctttacgcgccacgtcggagcggcccataaccgagataaaatagtcgccatcacgcgtcaggacgcctttaaacatcggatcgttattcagcaacacccgcagtttacgtgcaatcgcgattgtgacgttcttctctttcagtccgcgctgcccgatagcgccgggatcctgaccgccatgtccggcatcaatcgccacaatcacggtatcgttctggctgacggcccggccaggactcacggtgctggctgtgctggtcacggacgtcaccggattcgaattaaaggggttagccgctgcggcactctgggtgggcacgcgtgtcggggccgttaccggcgcaggcacactgcgcgtaacagcaggtggcttaccggtaatggtgaagacgacgctgtagctgttgccattgcgctgggtgaccgcccgggttttacccgcctgcgtcagctcaaacaccagccgcacgctctgtttatctttcggggtgctggtgcgaattcgctttacgatgttttcgccgctgaaatttaacggcagcccctgaaccacgccgctctggcgcacatcaagcaccacacggtcaggattgcgcagcgggaagaagccatagacaggttgtccggcaaagttcagggtgatggttgcctggctgtcgccattagcgactttgatatccgacagggtggcggcaaacaggggtgtacagaccagcagcaacagtgtcaccagcgctattttcatccgtgacatcatgcctgatccctgccctgaccaaattgttcaagccattgctggcccgacgaggattgtgccgtcagttccgcttcacgcgcctcacccacgtaacgcagcgttagcgtgagatcgggcggcggcagaaaaccggcgccctgctgcggccattcaaccaggcagatagcatcgccgctgaaatagtcgcggatgcccatgaattcaagctcttcaggatcggcaagacgatagaggtcgaagtgataaagtgtgcggtcgtccagcgtgtaaggctcaaccagagtgtaagtagggcttttgacgttgccctgatggcccagcgcctgcagaaagccgcggctgaaggtggttttacccgcccccagatcgccatagagataaatcactgccgcgctgccacaggcgcgcgccagctgagcgcccaaactgagcgtagccgcctcatcgggcaaagagataacacaggtcttcatgcttctttattcatctcaggattaacaaactgccacagcagatccagtaaatcagttgccagcataccgcgcgtaccacgttccgcagcgaccgcatcggccgcggcaccgtgtgcaacgcagccggcgcaggccgcatcaaacagcgtcagtttctggcccaccagcgaggcgatgattccactcaggagatcgcccataccgccggaggccataccggcattgcccacgtcagcaaaggccatttcaccctgctcgctggcaatcagcgtaccggcacctttcagtaccactacgccgccataacgctgcgccaatgtctgcgctgcatgtaagcggtcactctcaatttcactggtctcggtattcagcaaacgcgccgcttcaccaggatgcggcgtaataatgcgattctgacgtttctccgcactgattgccagcaggttaagtgcatccgcgtcccaaagcatcggcttttcactgctcgctacccgcttcagcgcccgctttccccagtcgcgctgacccagaccgggccctatcgcaatgacatcggcccactccagcgcctccgtcaggcgctcatcggtcagttcatcgaccataatttcgggccgggcggtcaggatcggaataatattatctttgtgagtaagtactcgcaccaacccactaccgctgcgcaacgccgcttcggccgtcatccgtaccgcgccagcggtaccggcatcgccccccactaccagcagccggccatgactgcccttgtgcgaggttggtttgcgcggcttgagccagcgggttaatgcgctggcatcataacgcgcgatgggagccccttcgcccgccagaaaagcggccaggccgagatcggcatagtaaagctctccaatgtaatctcgcgctttgccagtgatctggcccggtttaagagcaaccacactcagcgtatggctggcattaattacctcaccgggcgcggtgccattgcgggctgataagccggaaggcatatcaatggcaagtttcggcgccgcatgagcgttcgcctgctggatcagcgtggcatagggttcttcgggcgcacgatgactgccggttcccagcagcgcatccacaatcacatcgatctgctctggccagaccgcatcggccgcatgaatttcaccgcccgcatccagccacgcgtcccgtgcacgctgtgcctcttccggcaacgctttttcactttcgcacgccagcagcgtaacggttttgcccgccgcctgtcccagtcgcgccagcacataaccatcgccaccgttattgccgtgaccacacagaatcagccagtggctggcctctggccagtgcgcagtcagatgctcgtaagcggcctgtccggcacgcagcatcagctcatacagcgtaatgccgagcgcatcggccccctgttgctcaagctgggccacagcctgcgcaggccagacagaatatggtaaactgcggctgtttttcttcgaatcctggttactcatgtcataccctctcgatcttcatcaattcgcacaacagattaaacagtggggattggatctcggctttcagcaggtcggcatcaccgataccgatctcagtgcggaagagccgcgcctgcaggcgtggctggataagcagtatcatggcgagatggagtggatggcgcgacacggcatgatgcgggcgcgtcctcatgaactgctgcccggcacgctgcgcgttatcagcgttcgcatgaactaccttccggccaaagccgcctttgccagcacgttgaaaaatccccagctgggctatgtcagccgttatgcattaggtcgtgattaccacaaagtattgcgcaatcgactgaaaaagctcggagaaatgatccagcagcattgtggcgagcttaattttcgcccgtttgtggattcggccccgctgcttgagcggccgctggcagccaaagcgggactcggctggaccggcaaacattcgctgatactgaatcgggaagcaggctcatggtttttcctcggcgaaactgctgatcgatattccgctgccgatagatacaccgcagcaggagcagtgtggccgctgtgtcgcctgcatgaccatctgccctaccagcgcgatcgttgagccctacgtcgtggatgccaggcgctgtatttcctatctcaccattgagctggaaggcgcgatcccggaagagtttcgcccgctgatgggcaaccggatatatggctgtgatgactgccagctgatctgtccgtggaatcgctatggacaactcagtgacgaaagcgatttttcaccgcgagcggcgctacacgcccctgagctgatcgatctgtttcaatgggatgaagcgaagtttttacgcatcactgaaggctcagcgattcgccgcattggtcatttacgctggctgcgtaatattgcagtggcgctgggtaacgcgccctggtcgcccgaaatcgttcaggtactggaacaacgactcggtgaaagtgacctgctggatgaacatattctgtgggcaatcacgcagcagcagcagaaacgcgagcaactcgtggttgaagtgcaacctgcccagcagaagcgcctggttcgtgcagtagagaagggtttaccgcgtgatgcgtgattgaacagcttgatcgcgaattatcgttttccacatgctgtgaataaaaataaaaagctgttgtcattcaactgcaacaacgctgattttgctgttaaataacaaattgaaatattttcataatgataaatatcaacaacttatataaaagttgtgtttatttaataatgaggctatcgcttcggttaacctgcaaagttgtggataactctgttcaaaagccatttacagatcgccgtaacaggcgcagatgatggggtgcagtgctgtggataaccttcatgaaacaatcaaaatcacgcgacgtaaaacagtcggctaacggactgaaatgagggtgatgttaaatctggagcgggaaacgagactcgaactcgcgaccccgaccttggcaaggtcgtgctctaccaactgagctattcccgcatagaagggcactactaaaaaaactggagcgggaaacgagactcgaactcgcgaccccgaccttggcaaggtcgtgctctaccaactgagctattcccgcaaagagggtactgcttacattttaaaactggagcgggaaacgagactcgaactcgcgaccccgaccttggcaaggtcgtgctctaccaactgagctattcccgcgccttgtaccgttaataaattcttcaccggtacggggtgcgcattatacgagaaatcgttgctgctgcaagcgtctgaaagcaaaaattttcgctttcagcgcgtttgctgattaaatcagcaacctggtgatttcatgcgcacccgtcgccgattaaagctgcaaaaagtgttcgcggtagtacgccagctccgccacggactcacggatatcatccagagcctggtgcgtccccccttttttgaagccaggaaggatatcgggtttccagcgacgagccagctctttcagggtactgacatccagataacgatagtggaagtacgcttccagctcaggcatatacttaaacaggaaacgacgatcctgcccgatgctgttgccgcagataggcgaggtgttcgccggaaacccactgtttcaggaactcaatggtcgccagctctgcggcacgatcgtcaatctgactctccttcacccgcgcaaccagaccgctgttggtatgagtgcggacattccactcatccatcagcgccagttgcgcatcagactgatgaacggccatgaccggcccttccgccagaatgttcaggttggcgtcagtcaccagggtcgcaatttcaataatgcgatcgtgcgtcggatcaagtccggtcatctcaagatcaatccagatcagattctgttcatttccagtagccatgctgtttcctgcggttgctgtagtcgtcatttacgatgaataaggtgtatcatagacgttttgcccagccgggcgaaatctggctaacgctgtgagggtgagtgagtaaaaataaactgtcgaagggccaacaacgccgcgtaagcgctaaccacgatcgccgtctcaaccaacgcagagagcgtccggaagcggatgacaacctgtttggtgaagctgcagatggggtcgttgtcagccgttttggcatgcacgctgatgttgaggatagcgcaggcgtcgcccaccgctgcaatatccgccgtaccattcgttcgctggtcaccggcgaccgggtgctgtggcgtccggcaaccagcggcaacaaaggtattgttgaagcggtgcatgagcgcaccagcgtattaacccgccccgatttttacgacggcgtgaagccgatggcggcgaatatcgaccagatcatcgtcgtctccgcaatcctgcctgaactgtcgttaaacatcatcgaccgctatctggttgccagcgaaacgctggatattgaaccgttgctggtactgaacaaaaccgatctgctggatgacaaggcgcgcgcctttgtcgataagcagatggatatctatcgcaatattggctatcgcgtggtgatggtctccagccgggcgaaaaacggcatggacgacctgaaagcggcgctgaccgaccgcatcagtatctttgccggtcagtctggcgtcggcaaatcgagtctgctgaatgccctgctcggcttcgacaaagaagagcaggtcgctattctgactaacgaggtttcggatggctcaggcttaggccagcacaccaccaccgcatcgcgcctttatcacttcccggacggcggcgatgtgatcgattcacctggcgtgcgtgagttcggtttatggcatcttgagccggaacaaattacccgcggatttgtcgaattccgcacattccttggcgattgcaaattccgcgattgtaaacacggcagcgatcccggctgtgccattcgcgaagcggtcgaacagggcaaaatcaacaggtcccgttttgataactaccaccgtatcctggagagcatggcgcaggtaaaaacgcgtaaaaatttccctgatggtgaaagttaatcggtataaccgcgtctgaaacgggtaagccagggcattttgcgaggtacattccagtcgcgcgtccagaccgtgcagcgtgccggaattcgggtatagtcgccatctgaacggggcgctgctacaatccgcccccttttttacaacgtcataaaatagccaggaggctaaggtgtttgatcgtttaaaactcggcttgaatcatattctcccgaagaaatggctgactgaacttgccggttggggcgccagtcgccgcggtggttggttgaccaaactggtcattgacatctttgtctggttttacaaagtcgacatggcggaagcgcgaaagcccgataccgccagctatcgcacctttaatgactttttcgttcgtccgctgaaagacgatgcgcgtccggtggatgccgatgccaatctcatcgccctgcccgcggatggcgctatcagccagctcggccacattgatggcgatcagattttccaggctaaaggtcatcactacaccattgacgccctgctggcgggtgatgagcggatggcggcacaatttgttgatggcgagttcgtcaccacctatctggcgccccgtgattatcaccgcgtccatatgccgtgcaacggcatcctgcgtgagatgatttatgtacctggcgacctctactcggtcaacccgctgaccgcgcgtaatattcccaacctgttcgcccgtaacgagcgcgtcatctgctacttcgaaaccgatatcgggccgatggtgcagatcctggtgggtgccaccattgtcggcagcatcgaaaccgtctgggctggcaccatcacgccaccgcgtgaaggcgtgatcaagcgctggcactatccggcagcggatgatgaaagcgccgtggtgctgctgaaaggccaggaaatgggccgcttcaagcttggctctaccgtcatcaatctgttcgcacctggccgcgtcaaactggctgaaagcctggaagcagaaagcaaaacccgtctgggtcaaccgctggcgattgcgctgccggtcgcgacagacatttccgacgtcatcgtcgattaaattgagtgtcctctgtgcgttcgattctcctcctgctgctgagcctgtggctcagcagcccggccttcgcggccagccttcctgatgccagccagctcaaacagcagctggaagagataaaatcggccaaaagttcaccctctcaggctgaacagatccagacgattgaagccgccttaaactttctctctgaacgcgatgaatcgctggagcgcgcggcgcaatatcagcaggttattgatgattttccgcgtctggcgcgcgaactgcgtcagcagatcgccgcgctgagtgacagcgggaaaaccgtgcgcaacaacatgagcagcgccgagctggatcaggagatcctgcaggtcagcagccagctgctggaagaggggcgtcaggcacggcaggagcaggatcgggcgcgggaaatcagtgattcgctgtcgcaactgccgcagcagcagacggaagcacgccgggcgatgacggagagtgaacgccgtttgcagagcgtcagcagcagtttcgccacaggggcagctgcaactggcggctcgccaggcggaaagcgccgcgaataaagcgctggtcgatgaacttgagctggcacagctctctgccaacaaccgtcaggaactggcgcggatgcgggctgaagcccaccagcgcaaagcaactcagctcgataactatcttcaggcgctgcgcaaccagctcaacgatcagcggcaacgtgaagccgaagtcgcgctggcccgcaccgagcaactggcagaaaacagtggcgatcttccgccagagatcagcgatcagtttcgggttaaccgcgaactctcggttgccctgaatcagcaggcgcagcgcatggatctggtggcgtcgcagcagcgactggccactaaccagattattcaggtccgtcaggcgctctctaccctgcgtgaacagtcgcagtggctgggtgcctctaatctgctgggcgaagcgctacgggcgcaggtcgcgcgtctgccggagatgcccaagtcgcagcagattgataatgagatggcacagcttcgcgtgcagcgtctcaattatgaagatctgctggagcgccaggaggcgctgcgcaagggacggcaggccgatggtcagcccttcaccgcagaccagaagcgtattcttgatgcgcagctacgcactcagagggaactgctcaattcgctgatctccggctgtgacacgctgattctggagatcactaagctcaaggttggcaacacgcagttgcaggatgcgctgacggaagtcaaagaggcgacgcatcgctatctgttctggaccgccgacgttaacccgattggtttgagttatccgctggatctggccaaagatctttcccgtctgctgtcgctggatacgctgggtcagctcggcaaagcgatggcgatgatgtttaccagccgcaactcggtgctgccgattattggtgcgttgctgctggtcggcttcagcatcagttcgcgccgccacttcaatgctttccttgaccgttccgccagcaaagtcggcaaggtcacgcaggatcgtttccgcctgactatccgtactctgttctggtctatcctggtggcgctgccgctgccggtgttatggggtgcgttgggttatggcctgcagaaacgcctggccctaccctatcgccgtagcgattggtgatggcattaccgccacgctgccgctgctgtgggcgtttatgatcagcgctgcctttgcccgtcctaacggcctgttcattgtgcatttccgctggccgcaaaaccgggtggcgcgcgccatgcgctactactcgctgagcatcggattaattgtgccgctgattatgttgctgatcgcctttggtaatctggaagatcggcagttctcctcgtcgctgggtcgtctctgtttcatcctgatctgcggggcaatcagcattgtcaccgtcagcctgaagcgttccgggattccgctctatctcgataaagagggaaatggcgagaacatggtgaaccggatgctgtggaacctgatgatcgccatgccgctgatggctgccctcgcctccgctgtgggttatctggctaccgcgcaggcgctgctggcgcgactggaaacctctgtcgccatctggttcctgctgctggttatctatcacattatccggcgctggatgctgattcagcgtcgccgtcttggctttgatcgcgcccgtcagcgtcgtgccgatatgctggctaaccgtgcgcgcagtgaagaagagaaggagcaaggctctctgaacactgatgcgattgaaattgaagagccggtaattgacctggatgcgatcagtgcgcagtcgctgcggctggttcgctctatcctgatgcttatcgccctggtctccgtgattgtgctgtggtcagaaatccattcggcctttggcttcctggagaatattcagctgtgggacgtcagtacctcagtgcagggcgtagagtcgattcagcccatcaccctggggtcagtgctgatcgccattctggtgtttattatcaccacccagctggtgcgcaatatgcccgcgctgcttgagctggcgctgttgcagcatcttaatctgacgccaggtacgggttacgccatcaccacactgaccaaatatctgctgctgttgattggcgcgctgattggtttctcaatgattggtattgagtggtcgaagctgcagtggctggttgccgcgctgggtgtgggactggggtttggtttgcaggagatttttgccaactttatctcaggtctgattatcctgttcgaaaagccgattcgtatcggcgataccgtgactatccgcgacctgaccggcagtatcacgcgaattaatacccgcgcgaccaccattaccgactgggaccgcaaagagatcatcgtgccgaacaaggcctttatcaccgagcagtttattaactggtcgctgtccgattccgtgacgcgcgtggtgctcaccattccggctccggcgaaagtcagcagtgaacaggtgaccaccattctgatccaggcggctgagcgctgcagctatgtcctggacacgccgcaaccggaagccttcctggtcgatctgcagcaggggattcagttatttgaacttcgtgtgcatgctgctgagatgggacaccgtatgccgctgcgtcacgaactgcatcagttgattctgagcggatttgatcagcacggtattgagatgccgttcccgccgttccagatgcgtatggaaaccctgggtaagaagctgcctgccagcaacggcacacccgctgcccgcgcctataagtctggcggactgtaatgcaaaacgcccggctgagccgggcgttattgcaagtctgagccgtcagttactgtttaacgaactcttcgccctgggcgatatctttcttcagcgtatccagcatgcctgacagcgcctgctgttcgtaagcgctgagggtaccaatcggcctgcgttcagccacaccgtttttacccagcagcagcggctgggagaagaagcgcgcatgttcaccctcgccttctacgtaagcacactccaccacattagcttcacccttcagcgcgcgtaccagtgacaaaccgaaacgtgcggctgcctggcccatcgacagcgtggccgagccgccacccgctttggcttccaccacttcggtgccggcgttctggatgcgtttggtcagatcggccacttcctgatcgctgaagctgacgcctttaacctgcgacagcagcggcagaatggttacgccagagtggccaccaatgaccgggacttccacctggtcaggctgcttgcctttcaatgcagccacaaaagtattggcgcgaatgatatccagcgtggtcacgccgaacagccgatttttgtcgtaaacaccgtgctttttcagcacttctgccgcaatggccacggtggtattgaccggattggtgatgacaccaatcaacgctttaggtgccgttgtggcaacctgttcgatcagattacggacgatacctgcgttaacgttaaacaggtcggcgcgatccataccgggcttacgtgcaacaccagcggaaatcagtaccacatcggcaccctgtaaggcaggcgtggcgtcttctccactgaatccctgaatagccactgcggtaggaatatggctgagatcaacggcaacacccggcgtaaccggcgcgatgtcatacagcgagagttctgaacctgcgggaagctgggttttgagcagaagtgcgagcgcctggcctatgccgccagcggcaccgagaacggcaactttcattcttaactccttattaaggtggggcagagatgggccgaaattctatctgtgtcagaccttaatcaactgctcaggcgatgataaatatccgttgttaattctacgtgttttcacacttaatctccggattcaaaagttacttatcattgtacctgaatgaccgacaactttgccgtcgtcagacagagaacggctacgtgcgttttctgttactacaccaccaataatataacaactttgcaaccttcgccttccggggctgtgacgcgtgttttggtctgagcggatttatttgctattatcgccgcccgctagccgcccggacgctgctcatcaatcgaacgattgcataaaaatgcatataaatgcataatcaccactctgccgcgggcggatgcgcggttattctctctatttattggtaacctatgcgaaacccatcgaaacaagacgatctggttaaggctttcaaagccttattaaaagaagaaaaattcagttcccagggcgaaattgttcaggcgcttcaggacgagggctttgaaaatatcaatcagtccaaagtctcgcgaatgctgaccaagtttggcgcagtgcgcacccggaatgccaggatggagatggtctattgcctgcccgctgagctgggtgtgccgaccaccaccagcccgttaaaaaacctggtactggatatcgactacaacgatgccctggtagtgattcataccagtcccggcgcagcacagctgattgcacgtatgctggattcactgggtaagtcgcacgggattctgggtaccatcgcgggtgatgacacaatctttattacccgcgcgcgtgacttcaccgttaagcagctgcacggtgccatcctcaccctgtttgaacaggaaactctgatcgcggactgacgaccggctatcatgtgccagatcgtcagttcgttctctctgctcacccctttccacaatagtcacccgctctggataagtattaagcctgcttttacacgcccggctgttggtcagatcgataactctgcttcaccttctgcgctattttacactgctttacatcactgaaccggcaccattgcccggatccagatcaaactccagcccgatacacctccgactttcgcactaaaagttaaagtgatctatctcactgtttttgcgattaaaagtggcttaaaggttactttttatcctttttttataacgttaagttattaaaagtagccataaggataaagaatcacaaaaaaacattattagcggagtattaatttctgacgttattagttctatacttcttttcgtgatgcaaatcacactaaataaaaagataaaaatagacgacgaggaaaaatctatgaacgtaaaaactaccattgctaccctgagcattctctccgccctctcatttggtgctgttgcagcagaatctattgatgcgtcacaggcacagaatctgcaggctgtcggcaccatcagtgtcagcggcgtggcgggttcgccgatggatatcaaacagaaactcagcgacaaagccgatcagcagggcgcaaaagcctatcgcgtgattgaggcatacaacaacggcaactatcacgctaccgccgcactgtataactaaggcgtaaccgataatgccatctgctctctgtctgacgcgcccttttgcgctccggagagctgaagcagaaatttcaggagagttgaccatgaaaatgaaattagctatcgctgcactgagtctggcatccctgtttctcagtaggtgccaacgccgccagcctggtgtccaatgaacaggcacagggtctgcagccaatgaatcagaccatcagcattggtggacgaaatggcgaccagacacatatccgtcaggtgctgtcagagaaagcggatgcccagggcgcaagccactatcgcatcatcgaaaacaaccaggataacacctggcatgtcaccgctgagctttataaataattaaccgtgatgacgcctgaagggcgtcagaagatatcgacgacccgcctttacgagtaaccgcaggttgttgaatgtattgaggagataatcatgaatatcaaaacaaccatcgctacagtcagtctgctttccgttatggcgttcggcgcatcagccgcacagctggtcaccggcgatcagacgcagaacctgcagcctgcgggcaccgtgaccatcagtggaaccgcgggatcgccaatggattaccgcgctgagctttctcagaaagcggatgaacagggtgccagcgcctataaagttattgaggcgcgcaccggtgataactatcacatcaccgcacagctttataagtaattcctcgtcagatgtatgacgaaccctttggccccgctcgccggggcctttttttatctgacgttttatctgacgttaaaatgaagctgaccttccagctcctcttctgcttcatcaaataacagaatcagcgcgccataacgccgtcgctgtcccctgcccagattaacaaattcaatctccagcggcagcggtaacagatcgcccgtcaccacatcccataatccatccagatcgcagatgcggcgctcctccagcgcaaatcgctcgctgaactgccggaagaaatgggcctgatcgacaatttcattaaaatcaaaacgctcgattttcatgctgacggctcccatgctccgtctgcgggcgacctgcgccgcccgttactgtccgctagctcaaaccgcccaggtgcagcgctttgacctccagatactcttccatgccgagtaccgaaccttcgcggcccagccccgactctttcacaccaccaaacggcgccagctcggttgatacggcacattcattaatgccgatcatgccgctttccagcgcggctgaaacacggaatacccgctgcagattctgcgtgtaaaagtatgcggcaaggccgaacggcgtatcgttagcgcgacggatgacctcatcttcatcatcaaagcggaaacaggcagccaccggaccaaaggtctcctcctgcgcgagctgcatcccttcgtgcgcctcagtaatcacagtgggctgccagaagttgccacccagcgcatgtcgctcgccacccgccagtaatttgccaccttttgctaccgcatcattgacgtgctgctcaaccttttccaccgccgatgcctcaatcaatggcccgacaatcacgccctcttccatgccgttgcccaccttcagcttgttcacttcggcagccagctgctgagtaaaacgatcatagatagcattgtgaatgtagaagcggtttacgctgacgcacacctggcccgcattacggaatttgttggcaatggcgccctgcacggcggcatcaatatcggcatcgtcaaacacgatatagggagcattaccccccagctccatcgacacttttttcatggtttcggcagcattacgcatcagcagcttgcccacctgggtggagccggtgaacgagattttacgcaccgctttgctggccatgatggcatcgctgatggcatgggtatcaccggctaccgcattcagtacaccatcaggcacgcctgcctccttcgccagcgccagcagggcaaaggcggagagtggcgtgttattggcaggtttaataatgccggtgcagccggcagccagagctggccccagtttgcgggtcagcatcgccatcgggaaattccacggcgtaatggcggccacaacgccaatcggttcgcgggttgccagaatacgggagccgggtttagctggcggaataatctcaccattggtccgtttcgcctgctcggcgaaccactgaataaaactggcggcgtattctacttccccttccgcctctttcaggggcttgccctgttcggtcgtcatcagctgtcccagccagcgcttgttctcaatgatcagctggtaccagcgagtgagaatttcagcgcgcgcttttgcagtctgcgcccgccaggcgggaaatgcgcgctccgctgcggcgatagcctgttccgtttcagctttacccgctttcgccacctgtgcaatcacctcaccggtcgccggattggtcacgtcaaaggtagaagccgcctgatgccactgaccgtccgctaaataaccggtccggaacagttcgctctcttgcagtgatttcattgattcgctcctgtcagttttgctcttccgtctggagagtatagttggcaaaagcgacagattttgtgatgggtggggattgcgcaggccgctgcaggtcacagcggccagattcagatttggatgagcgtgttctggtacttatccagcatcatagccagtcgttttaccggttccgttacgctggcgggagcctcgtaatgggccagtttttcctgatagacatccagctctttcagcagacgttcaaagtagtaacgccgcttgtcatcgctgctggcggagatcacccggtcagcggtgtaacgcaactgccggtgataagcagagagatcggcattcaccggcacttctgcgtcgcgtaaccgctgatgaccgatgatcagcgtcagggcgatgcgatatttgttgatatcgcccggaaacaggttgagcagcagaaacagttgctgatagagcgctggcagatggttttcacgccggcgcgcctgattggtcgtcatggcagagacagccgcatacataaagcggttcagcagcttgcggccggtgcgcgcttttgatttatcacgaatcagcaggatcaccatcatcgccacgaagcagccgatgacctggcccagaacgttatcgagaaagacgttaatgtggaattccatcggattatccagcaccagaacgttaagggtgccaatcaatgcccccagcgtgccgagctgacgccgctgaatgaagataccaccgataaacccgagcaggccgattgcgatgcagagcagcagtgcgctctgctgcgtcgccgggagaacatacataaagtagagcgcgcccagcggaaccgcgaccgtcatgccgtagagaaagtcctttgccatcatcagcgggttgggcatacgcatcgccagtgcggtgatgacagccagcatgaccatgcagccactgccagaggtccagccggtatagagccagaacagcgaacccagtgcggtcgccacaaaggtacggataccgttgatcatcgcatgatgcgtttcagcggaacgcgcctggatcaccacttcgcgctgcagaatctcctcttccagcgaggtgatccggctattacttttgatccctttcagtagcagcagatattcggtagcagtgcctacccagctggccagcgtgaccggcgttgatttgccgctggcaccaatcacccgccgcatcactttcatccgcttatgcacctcttcaacggtcgaggctggtttttcaaccatcagacgatactggggcggaatgtaatcaggacgggaattctggatcagaaaggtttcggctgcctgtgtaatcagcgtcagtgacagcgtattgagcatctgcaaacggcgattgctgttcttccagcgtgaggattccatcatcagctggctgcgcatgctgttcagcgccgtggtgcgccgtaccagcgcgctccaggctttatcgacctcttctttatcaccgtgagcgacgcagagttgcagcaggttatagtgtgccaccagcagcgaatcgacctcagcgtcgatcacttttttaatcgaacggggtgagaaaatcatgtcggccagaatggcgcacaggatgccgagtacgatttcactgcagcgctctaccgcatattgtggcaccagcgtcagaccgccgctggcgttagccgtcaccacaataatcagcgcggtgtagcccgccagtccgagcgcgtaagagttttctaccttgatcagcgaagagagccagacgcagagtcctgcccagatgcagcacagcagcagcatcacgaccggtgcacgcacggtggcaatcatgatggtcagcgcggcgatacagccaataaatgtcccgataatacgcaaaacgccgcgatagcgcagcgccccggaataggggtcccccccggccgcaaacgcggtaccgccagccacgataccggcggtcatcaccgcccagcgcggcgtttcaaggttaaagtgaaaacccaccatcagcgctaacaccagcgcaaaggtgagctttaccgggaaccgcaggaactcgatcatatcgccctcttaaccaaactcacgcaggcgattaaacagtcggaccatcggtgaaacctgttcaggctgacgatcggcctgaccggtgatcaccactgtcgctgtcgtgcccgccgggaagcgattgccgggctgctgatcaagccggatgcgaaccggcacacgctgcgccagacggacccactccagattggaatctactgtggccatgcctttgctgtcgaccgagctgctgctgttggtgacgccagccgccacactgtctacggtgccacgcaacacgatgttgctgccaagtggggtcacttctgcgcggaagcccttctccacgccgtgcagtttggtctcttccaggtaagccagtacatagaaggagtgctgctgaaccagcgccacggcaaccgaaccacgggtaataaactcaccctggtagacattcaggttggtgacccagccatcggatggcgctttgaccgtggtgcgctcaaggtcaatcttcgccagatcgcgtgtcgccaccgatttcgccagctgatgttcgctggtttgcagatcgttattggattgctcgatagcctcgcgcgacatggcggaggtgcccagctggttacggcgcccggcttcgcgacgtttctcactgaccagtgcctggtaatattcaacatccgcctgcgcctgatcgagcgctttttgatagcgcggccggtcaaccacaaacagcgtatcgcccttcttcaccagctggttgtcgtgtaccggaacctcggtaatcaggccggtgacgtcaggggagatcgccaccacgtcagcggcgaaacgcgcatcacgggtccagggcgattcggtatagaagacccaggcacggaaaataatgaccactgcgatgatgaccagcaggatagtaatcgcgtagcgcgcgatttttcttatgagtgctttcacttaaacctcagactaataaacgggagacaaggtaaaacacacagcagtaaagcgctgtattaaaaagtgccggatgccagacaagatcgtagataccgctcggcgtaagcacgcgtttcactaaccagaacagcatcagtgaaataataagttcgatgaaaatgggcggaaaagagagcccaaacatgacaaataccggaagcacactcatcacaaatccttagttcgaccttgccgggatactcatgcctcttcagatgtcgcaggaaaaccctctggaagcgttatccgaaccgcagctggcttaataatagcgtatcatcgaagggtatcaggcaatgaagaatcaccgggaaataccccggcgcgcttataataacgcgcctgactataagttttctacagaatgtgatctaaatcacttttaagccagagtaaataatggaacgacttaaaggcatgtctgtcttcgctaaagtggtcgaactaggttcgtttaccgctgcggcgcgtcagcttcatctgagcgtctcatcaatcagccagatcgtcgcgaaactggaagatgcattgcaggtgaaactgctgaatcgcagtacccgcagtatcgggctgaccgaagcgggcaaaatctattatcagggctgtcgccgtatgctggccgaagcgacgcaagtgcatgaacagctttacgcttttaacaatacgcccattggcgtactgcgaattggcagctcctctaccatggcgcagaacgtgttagccggcatgaccagcgatatgctgcgggaatatccggggctgagtgtgaatctggtcaccggcgttcccgccccggacctgatcgcggatggtctggatctggtgattcgcgtgggagcgttaaaagattccagcttgttttcgcgtcgcctgggtgcgatgccgatggtggtgtgcgccgcaaaaagctatctggcgcagcatggtacgccggagaagccgggtgatatcgataatttttcctggctggaatatagcgtacggcccgacaacaatttcgaactgattgcgccggaaggattagtgacacgcctggcaccgcagggacgttttgtgaccaatgattccctgacgctgattcgctggctgaagtcgggcaatggcatcgcctatgtgccgatgatgtgggtgattgatgagatcaccgcaggcgagatcgatattctgtttccgcagtatcagtccgatccgcgcccggtctacgcgctctataccgagaaggataagttaccgcttaaggtgcaggtctgtatcgattatctgaccggctattttgaacaggtggctgaacagtatcagcagcatcgtaaaagttaacaataaattgttgacaacatctgtcccaaccagctgtaagacccagccagcgaaggaaacacggtcagataggaaagacgcaaaatccgtcatccctgacacgctcggcccgcgcgatccgtggcgcgggacgctttcctcctctgcccgtgttccctgcgctttcagctattgcattgctgccaggttcatccggctatggatttgtcagcattctgacaacccgccgggcggcgggttgttagggtcacatcaggcggtgccgccgatggtcagtttatccagcttcagggtgggctgaccgacaccgaccggcaggctctgcccctctttaccacaaacgccgacgcctttatccagcgccaggtcattacccaccatcgagatctgctgcatcgcttcgatgccggaaccaatcagcgttgcgcctttaaccggtttggtgattttgccgttctcaatcagataagcctctgaggttgagaagacaaatttgccggaggtgatatccacctgaccgccaccaaagttcggcgcatagaggccatactcaacgctttcaataatatcctgcggcgatgacttgccagccagcatataggtgttggtcatgcgcggcatcggcagatgcgcgtaggactcacgacgtccgttaccggtagggctaacccccatcagtcgcgcattcagcttgtcctgcatgtagcctttcagtacaccattctcaatcagcatgttgtactgaccgggaacgccctcatcatctactgccagtgaaccgcgcagcccttcaagggtgccgtcatccaccacggtacagaggtcagacgcaacctgctgaccaattttaccgctgaacaccgaggtgccacggcgattgaagtcgccttccagaccgtgaccgaccgcttcatgcagcagcacgcccggccagcccgcacccagtaccaccggcaacgcaccagcgggtgcggccacggcggagagattcaccagcgccatacgcaccgcttcacgcgcccaggcgtcagcgcggacttcgccatcttcatctgcgaggaaaaacgcataaccggtacgcgcaccgccgccgctggcgccgcgttcacgtttgccctgatcttccacctggacactaatagagaggcgaaccagcggacggacatctgccgccagcgtgccgtcagtcgcggctaccaatacctgctcgtaaacgccggtcaggctggcattgacttcctgcacgcgcggatcagccgcacgagccactttatcaacgcgatgcagcagggcaattttgtcttcacgtgtcaggctgctcagcggatcgatagcctgatagagcgaacggttcatcacggcagaaagcgtgtgtgccttgccatttccctgttcgcgtacgatgctgcgtgcggcttcagaggagagacgcagtgcattcagcgtgatctggtctgcataggcgaagccggttttctccccgctgaccgcacgcacgcccacaccctgatcgatatggtaggagccatctttaatgattttgtcttccagcacccaggattcgtgaaagctggactgaaaatagagatcggcataatccagacgacgttctgaaagctgccctaacagggaaaataggtcctgctgattaatgccgttagcagtcagtaactgctcacttaccaggttcagagtcatcgtttctcactcattatgtgctcagataatcatagcctgcggtaattccggtacggcgtcaaattcacttgttgtcagtttcacgcggtttacgcagcacttcattgatttccggtttatctagcgggccactgatgtgataacgcagcagcgatatcttgttccacaggggtcccagaaactttactggcggcaaacaccgccgcgccaattaccggattgatggcaaaagctgtcgccacaccgaccgaggcggatatttccggcgcaaccaccgcttccatgtcgatctgacgcttcaccaggtcgagattaccctgcatcgcaatgtccgcttccaggccatccaccagcagattatcggtgcgcatcatgccgttttcgatccaggcggtgccgttaatcgagtcgaagtagaaagaattggtgaaggtgtcgctgaagtcgaagcgcagcttgcgcagtagcgcatcaaagctcaccagccgcagaattttcccggcggcaccggtattcacatcggcgatctggcctttgccaaagtgggtcttcagggtgccgctcagcgtctctgccgagggctgccagggggcagagcgccagtgcaggtcatacgcaatatcaaatggcgcatcgcgcagcggcgtgttgaccccaaaccagttggtcgcgttattaatattcgggcctttcagcgtgcccttcagcgaagtgcgctggtcgtccgggcggttaacccattccccgttgattttcagttgtgaactgccagtatccacttttccgttagtaagcgctaacgtatctccgcggggttgcagcatcgcggagacctgaccatatttctgacccagcacccagcactctttacagcgcaactgtaaagcgggccactggctgaagttaatattcgtggctttttgaggtggcgctttgccgcctttgccttcaccgttatcccactgcggattgtagtaaaggtaatccaggttcacctgccacggtgctttcggtgccattgccagcgcaccatgcagctctttagccctgacgccgacctgacccttgccgcccgcactctgagccagtgtcgcttcaacctcatgccattgctgcccggccagggtgacggccgggctgcgaagcgtgatattgccgggcagcgtgacgccacctgttttgaggccgccgcctgactcgctgcccccggatgctccccctgcggccatcatcgccacccaggcctcgccatccagcgcgggcaggttcagtaccatgccgggatgatcgggcagagcaggtgttttctgcgcatcattcagccagatgccacgatcgacgcgcagcgtcggctccagcaaccagcggctgttaaagcgatggtttgcatcgacgctgccactgagatcgaaatggtgcaggtcgccactggccttgattgcgactggcatcgcctcaccggctttcttatcgagcggtgcaggtaagtgactacttacttcttttgcattaccgttcagcgtcacgtcataacgcgccccgccatgatggggcagcgtaatattgacgtcgccctgccacggcagatttccgcccaactgcttgctgacggctgcaggaagctggctgattttagcaggctgccagtcgccctgaagtttgacgttcacgccaaaatcgtccggattctctttggtgctgaaacgcacgcccatcggctgaccaaaccagttcgcacgcagatcctcactggccagattgccgttgtcgtaacggaagcgcccggagagattgttaatggtggtttttaacggtttgataaacagcgaattattgttcaggtccacattgccacgggcgtgaacctgctcaccatccagcgggatatccagattcaggtggccgccgacgcggcctttgatttccagctgctccagcgcggcacccagtgaaggtttcagcggagtctgcccgaaatagtccgcgatttgctggccttcaccactgatatcaccctcaatgatcagtttttctttcaggtagtcggggatgaccgcagtgacgttgcgcgcgtccacctcgcccagtttcgccaccggcgctttcatccagagaccgtcattcaggaagttaaggtcgatatcgagattgcttaacgctggccatttgggctgaaacgcataggttgcctggcgaagcggcacccagacctggaacatgccatcattatgcttgaacgggaacagcgccggattaccggcaaacagcagtgtggcgttgtccaccttgccacccttcactgccccactcagatagtgcgtcaggctgttacccaacagcggcaccgggaagtagcgccaggcatcgcccgcatcggtaagccggataccggccagaatatccagacgaggctcaccgccgctattctgctggtagctgaagtcgccgcgcgcccagagcgagcgcgcctccaggtcaagattttcgcccgccagcgtgaggccatgatcatcattcagccagcgcagcgcaccggtcacccgcttaatctctaacggagcctggaacatgtcgccatagggaacggtcgccgcccccatatccacactgacctgaccattgctcaggctgccgcgcgcttcaccgcttaaatggctgatgcccggcaacagtttccagtgctgccagctgaaatcacgccacttcacctgtacgcgggttttttcaggctgctgtaacggaatatccagcgccaggccatcgatggtgccctgtggctgcagcgtctgccagttttcaaacagtgccggagagagcggcgcaaacagcggaacgatcggcgcaatatgactcagcaccagctgtgtggcgcgaaacgcgcacttccggctgaccatccggtcccagcatctgcttatcttcaggacgccataacagagagaagtgaccggcgggccaggcgtggccatcggtgctgagccgggtttgtggcacattgaccacccagccattctggaaacgtgacagatgcgcggtcagcccatcgacctcaatgcggtgtcgtccggtctcgccctgccagctggctccgcccttgcgcagcagcagatcaccggcgtagatgtcgccatcgcgcaggttaacccaggccgccaggctaaatcgggcgctatccagccgggtattgtcacgcacccaacgacccagccacgggcgcatgtcgacgtcgtcggcctgcatccagatacggccatcattgagtaaaccgttgctgtcgttaagatcaagccgcacctggaccacgccgtgctggccggtgaagctcgacaggctgacttcgccttcggcccggtggcggttatcttcattgacccaggtgagtcgcgggatcgccagctcagcatgctgaccggaaggggtgcggaaacggatggtgctgtcacgcaggtcaaagtggtcaaactgacgcaggaagagttcgtttatctgcgccggacggaagctgtttttctctttgtcgttatccagcagcgggcgattagtatcgaggtgcaactgccagaaggtcagatctcgaaactgccaccgccagtgcagcagggactgccagacgtcgagagccagattgatgcgtttgatagtgagtttgccgttctcatgcagatcgacgctaagatcgcgaacctgcagggttgggccaaaattctcccatttaccctgtaactggctggcgttgaccggcacgccgctgctgtcggagatgtattgcagaaggttgctgcgatagctgtcgagatgcggcatcaccagacgcaatccgctgaccagcagcgcgacaatcacgatgattgccgcgaccagcagtaacaaaatcctcggcaactgcctcactcacgcctctccttgtgttccgtaaacgacggatagttggttctcatacccgaccgtctcccgataaaagcgttaaaacgcgcattttatctcaaacaagggcgatttttcagcccgatatccgaagaaaccggtgaccgggctggcgttacatcatcaccacgtcgaactgctcctgagtgtagagcgcttcaacatgaactttaacctgcttgccgacaaagatttcgacttcagccagtgcatgagactcgtcggtttttaacgcctcacccaccgtcggtgaaacatagaccagaaagcgatcagaatcataagcgtgatgaacccggacaatctcacgcatgatttcatagcagaccgtttcaacggttttcagcgtgccgcgccctttgcagaccgggcagtcctggcacaaaacgtgctcaatactttcgcgggtacgcttacgcgtcatctccaccagacccagcgccgagaaaccattaataccggttttaacccgatctttactgagcgcgctttccagcgaatgcaatacccggcgacgatggtcttcgttgctcatatcgatgaagtcgataatgatgatgccaccaagattacgcagtcgcagctgacgtgcgatcgcctgagtggcttcaacattggtattaaagatcgtctcatcaaggttacgatggccgacaaacgcaccggtgttgatatcgatggtggtcatcgcttcggtctgatcgataatcagatatccgcctgactttagttcaactttgcgatccagcgagcgctgaatctcattttcgacgtcaaacaggtcgaaaataggctgtttaccgttgtagagctccagcttaccggccatttccgggatatattcaccggtaaattccaccagcatatcgcaggtcaggcgggagtcgacccggatgcgatccagcgccgcgcccgcaaaatcacgcagaatacgctgggccagagccagctcaccgtagagcaggcagcgggtctgattgcgctttttacgctcgctgactttggtccagagtcgtttgagaaaagccgcgtcctgcgccagctcctcttccccgatgccttctgcggcggtacggataataaagccgcccagatcgtcgcagtagtcagccacgaccgctttaagccgatcgcgctctttctcgctctcaatacgctgagagacacccacatgcgatgcgcctggcataaagaccaggtaacgcgaaggcagagtgatgtcagtggtcagccgggcacctttggtgccaagcggatctttgacgacctgaaccaccagatcctgtccctgccgcaccagctcggcgatatcccgcacgataaagtttttcttttcgtcgcccgccacacattcagtatgcggcatgatatctgaggcgtgcagaaaggccgctttctccagaccgatatcaacaaaggcggcctgcatgccgggcagaaacacggcttacacggcctttataaatattgccaacgatgccgcgccgcgcctcacgctcaatgtgaatttcctgcagtatgccgccgtcaatataggcaacacgtgtttcagaaggcgtgacgtttaccagtaattcagccgtcatgttgaccccttacggcacgcagtgactcgaaatggctgatcaactcccctgtctcaaccaagggtaatccgaccactgcatggtagcttccattaattttgcggacaaagtttcctcccctgccctgaataccgtatgcacccgctttatccattggctcgccggtcgcgatatagtcgtcgatgtcggtggcggttaaggtgcggaatgtcacatcagtggttacgacgcaatccagcgcctgctgactgtcggccagcgctaccgccgtcatcacctgatgcgtatgaccagagagtttgcacagcatcgcgcgggcatcagcggcatcgcgcggcttttccagcacttcgccattcagcaccacaatcgtatccgcgcccagcaccggcagatcctgcgcggccagtttgacacccgcctgcgctttatcattggccagacggcggacatagatttccgccgcttcgttcggctgacgctgctcttcaacgtcagtcacgatgcgctcgaatgtcagcccaagttgagttaacagctcacgacgacgcggtgaaccggaagcaagatagagggttaccataaatttccttattgaacagcgaactgacgacgaatttttctcattaataagaatagccagggccagagaataccgtcgacgacactgctccagaaaatttcaggtcggaatgaaacgttgattaccaggaattcagcccagaagacaatcacatccatcgccagcgacagcaccataaccattaacgcttgctgccacaacgctaagttgcggaataactggaacttaaaggcaatcaggtaggcgatgatactgagcgccagcgcacgcacgccgagtgtggaacccgcaatcagatccatgatggcacccagcacaaatccgctgccgacattgacccgatgcggcagtgcgagcacccaatagataaggatcaacagtagccatgagggccggaacatataaatttcatccggccagggcatgatctgcaggacaagcgcaaccaggaaggagagccagatgacccaacgtccctggctgcgatatcgactcaaggctgccccccgcgtgaacgcgaggagttgctttgtccactgctgctggtagctgacggtgcaggcggtcccatctgtacggcaggcgcaggcgggcccatttctcccgcaggcggtaagacctgcggcatcatctgcatcagacgctcgttcgcaacgcgatgaacttcatcctgcggcagcggcatatcaccattgcgatcggcgccccacagcagcagcaggtaacgcagacgctgcagacccgcggtcggatgcgcctgaatcaccgtataggcgcgttgggtatccacttttaccgaggaaaccacacccaccggatagccttcagggaatcggccaccgatacctgaagtcaccagtacatcgccgacccgaatgtccgtattacccggcagatgctcaagctgaagatcttcagtacagccgttacctgcggcaatgacacggatgtcattacgcagcacctgaatcggcagggcatgtgacgcatcgcagatcagcagaacacggctggtgagttgtccgacagcgatgacctgaccgactacccctttatcactgatgaccggctggccttcatagacgccgttgacgctgcctttgtcgattaccacctggtcggtgtaaggatcggtgccggtggagatgacctgtgtcaccatcttttgctcatcctgacgcagcggtgaacccagcagttcacgcaggcgtgcgttttcctgcttatattgccccagcattagcaggttactgtttttcaggaagagctcacgacgtaacgctttgttttcctgctcgagttgctgacgcgacgccagcgactctgacacgccatccagcaactgacgtggcccattggccaggaagtaaaacggactgaccgacgtatccagatagttgcgtatttgggtgaaagaacccacacggctgtcggcaatgataatggcaatcgccacgataaccgccaggaatagacgcaactgcagggaaggtcccctgctaaaaatcggcttcatataatctgcgtgatcctcgacaacaggagaggaagcgacggcgtaacaccgtgcttccctgggctgaacgcactgcaccggcacagattgcgccggttcacatgccactccctcgcatgatcattgcgttcttagccggttgaggcaattattcttcgctgaacaaatcgccgccatgcatgtcgatcatttccagcgctttgccgccaccgcgagccacacaggtcagtggatcctcagcaaccacaaccggaatgcccgtctcttccatcagcagacgatccaggttgcgcagtaacgcaccaccgccggtcagcaccatgccgcgctccgaaatatctgaagccagctcaggcggacactgctcaagggcaaccatcaccgcgctaacgatgccggttaacggctcctgcagcgcttccagaatttcattagagttcagtgtaaagccgcgcggtacaccttctgccaggttacgaccacgcacttcgatctcacggacttcatcacccggataggctgaaccgatctcatgcttaatacgttctgcggtcgcttcgccgatcagtgaaccgtagttacgacgcacataattaataatagcttcatcgaaacgatcgccaccaatacgcactgacgaggagtagaccacaccgtttcagcgagatcaccgccacttctgtggtaccgccaccaatatccaccaccattgagccagtcgcttctgaaacgggcagacccgcaccaattgctgcagccatcggctcttcaatcagaaacacttcacgcgcgcctgcgccctgagcggattcacgaatcgcgcggcgttcaacctgtgttgccccgacgggtacgcagaccagcacacgcgggctgggacgcataaaactgttgctgtgaacctgcttgatgaagtgttgcagcatcttttcggtcacgaagaagtcagcgataacgccatctttcatcggacgaatcgctgcgatattgcctggcgtacggccaagcatctgtttggcctcatgacccacggccgcaacacttttcggtgaaccggcacgatcctgtcgaatagcgacgacggagggctcgttcagtacgatgccctgtcctttcacgtaaatcagggtattcgcggtacccaggtcaatggacaagtcgttggaaaacatgccacgaaattttttaaacatactaaggggtaatcctgcaagctgggggcggaaaataaaatccgcttactttaccaaccacacgaagctgccacaaggcgcaaaaacgttctgcttcggtgaaaaaagacgcctgattgcgtttaagtcatctgaactggcgatccacaacagcagaatggcgaccagacgccatcagcactgcatttcacgctatttcccctcgccctgtccgacataaaatctaacatttccggcagtaagttcagaggttcagacgcgaataaacattaaaaaaaaccgtaaatttccgtcagtacgaccgcaattcattaaatacggtaacgttgtgaatacttcttcacgttactgttaaccggaagcgagggagcaaaaaagtcgccctgcccacctgctacgcccaacgcgactaaagtttgccactccgctttagtgcggacaccggtagcaaacacctgaatgcccgtacatttacagacttccagcagactctgcacaaacagctgattttcagtccgtcgctcaatattgcgtaccagaccggcatcaagcttgatcagttccagcggcagctgtcgtatgtaggcgctgcttaccacggttaaacccgcctgatttaccgcaacccgacagccaaaagccttaagtgcgcggaaaactggcgttaaacggttgatgtgttgacaaacatctgcctcggcaagttcaaataaaaatcgttttctttgcgctttcgggcactgcagcagcatgttctgcagccagaggacaaaagagcgctgcagaagcgaggtaatcgtcaccgggatcaccagcgtctcttctggccagagttcagagagtgccgcaatgcgagtcattaactggcgatcccagccatcagccatgccgagctgctgtaccaggggcatatattctgcggccagcacttctttatcgccgtcgaagatgcgggtcagcatcacccggtgctgtaccttaccctcaatattgacggtgggtttatgatagagccgcgggccgccacggctaagcgtgttctccagcagggtttcgccagcgcacactaccccgcccggcgtcctgcggatttccggcaccattggtccagttgttgccgcccagcagtgccgcacgtcgggtagccatttcggcattttccatcacctgcggcacagtctgcccgctgtgccaggcgctgataccgatatggatgagatcatcacgattaaccagccgcatcggcggcagggaatcaacggcattgatcagctgatccgcaatactgtttgcctctttgagactgcgatgcggcagtagcacggcaaaatcactgcggaaatagcgtgccagcagggcgccaggatagcgcagcacaaaggtggaaagcatgttgacgaaattgaagaggtactcctcaaccagccccggctccagcgaatccttcagcgtgtccagatcgggcaggcgcaccatcatcaccacaccatgggtgccgacagcttcctgatcctccagcagggtggcaagctggttatcaaagaacagccggttgttgagaccggtgcgtccatcctgcgcagcaaaggtgcggatcagcgtgtcgatacgcagacgctgttcgcccgcctcctgcagatccgccagcaacacatccagtgcgcggctcgctctcggtggccactcatccgcaccgcgtttcggcattacaccgcgctcaccgctgataatcgcctctgcccgcacttcaagatgctccataccgcgccactgacgactgagccagcgatgcatcagcagcagcaccagactcatcaccagcatgacggtaaacaggatgcccagcgtagaggtgccggtaatggagcgcagccaggttttggcaggatcaagggtgacgacccgcagctctaaccccgtctggtgcattaaaggcacatcgacctggataaaacgattaggctcgtcttccagcatctggttttcgtgtcgggagagggtaaggaaagtctgcctgccgttgtgaagagaaatctgctcggcattcattatcggcatcatacgcgtgagccagacatgcagctctgccggcgtctgggtgaacatcgcctgatccacttcggtcgccagtatctgcgcccgatgttcaacccgctgatgactgaaccagaaaacactgaatgcacagcctgccagcatcaacgacatggccagcaggcttaaaaaggtaataaacgcagataattttgtggttaatcgcatccctgtgcctgtattactgcggtgataaccggatcacccaaccttgtaccgtcagcctgacgaaaacgcgagcaaaaatagcataatttgccgttgccgacagcgccgggacgtatgaagccgaagtatatcgtcgggatatcatcgctgacgttgatcctggcacttttcggtgcattctcatcgtaccggccagccaggaaatttcacattttcagtgcgaaactggctgatatcagtaatagtcatcatgctggttaatgacatcctgtctggagaaggcaccatgaaacgcacaccccgtctgaccgaagccgacgtaacgccggaaagcatttttaacatgaagcgccgccaggtgctgaaaacgctgggactgagcgcagcggcgatgggtatgccgggcgtggcgcaagccgatattctcagctggttcaaaggcaacgatcgcccacccgcgccagcaggccggccgctggactttaccaaaccagcgcaatatcaggccgatctgaccttaacgcctgcggataaagtttccggctataacaacttctatgagttcgggctggataaggccgatccggccgccaatgccggtacgctgaaaacagaaccctggaaactgaccattgatggcgaagtggctaaacccgtgaccctggatatggatgacatctttaaacggtttgccatggagcagcgaatctatcgcatgcgctgcgtggaggcctggtcgatggtggtgccctggataggctttgagctgaataagcttatctctctggcggaaacccaccagcaaagcgcgttttgtcgccttccagacgctgtacgatcctgagcaaatgccaggtcagaaagatcgctttattggcggcggactcaattatccctatgtcgaaggtttacgtctggatgaagccatgcatccgctgacgattctgaccaccggcgtctatggcaaagcgctgccgccgcagaatggcgcgccgattcgcctgacggtgccgtggaaatatggttttaagggcattaagtcgattgtcaaaatcaccctgaccgcaaatcagccaccaacgacctggaaccagatcgccgcagatgaatatggtttttatgccaatgtgaatccgcatgttaatcatccacgctggtcgcaggccactgagcgatttattggcccgggcggcagtctgaaggtcgaacgtcagccaacgctgctgtttaacggctatgccgaacaggttgcgtcgctctatcgtggcctggatttacgggagaattactaggtggtacgcctgtcgataaaacagatcacctggcttaaggtgattctgcatctggcggccctgttgccgctggtttatctggttcttgccgcgatgcagggcggcctgagtgcggatccggcaaaagatattcagcattttaccggccgcatggcgctgaaactgctgctgggtacgctgctggtctcaccgctggcacgttatggcaggcaaccgctgttaatccgcacccggcgtctgcttggcgtctggacgtttgtctgggcttctctccatctgctgagttattacctgctggagctgggcgctgacaatctgcgtctgctgggcagcgagctgatttcccgtccctatctgacactggggattatcagctggctgatattactggccctggcgctgacgtcgtttcagcgcgctcagcgcaagctcggtaagcgctggcaaaccctgcacaacgcggtctatctggtggccattctggtgccgattcactatatctggtcagtgaaaaccgtgtcaccccagccacttatctacgcactacttgctgcaatactgttagcctggcgttacaaaaaatttctcaaatggtggcctcgctagcgcttcacccgttgttttcctctgcacttttctgataaaagatgtggcccgcaggccacatccgatcatcttcgcagataagaccagtattttgctgcgaaatgacacgaaacggatataatgcccggctttattgctcgtcgggtcttctttttcattctcaaaggtgacaaatgaagattcgcaaggtattttacgcgatgcctcaatgattgcgggagatggcagcacgatggcgcataaattacatattctgcttttaaacgggcccaacctgaacctgttgggaacgcgtgaacctgagaagtatggtcataccacgctgcgtcagatcgttgacgatttgacacgtcaggcagaccagttgaatgtggaattgagccacctgcaaaccaatgctgaatttcagctgattgatcgcattcatgaggccaaaggcaatgtggattacatcattattaatcctgccgcgtttacccataccagtgtcgcactacgtgatgccctgctggcggtagaaataccgtttatcgaggttcatctctccaacgtgcatgcccgcgagcccttccgccatcactcctatctttctgatgtctctgctggcgtgatctgtgggcttggcgctgacggctacacatgggctttacaaacggcagtaaaacgcctgtctcaaactaattaatcaaactgagtacggaaccccactcatggatattcgtaaaattaaaaaactgatcgaactggttgaagagtctggcatttcagagctggaaatttctgaaggtgaagagtccgttcgcatcagccgtgcacctgcaaacgtgggttacccgatgatgcagcagacttacgctgcgccggttcaacagcctgctctggcaacagctgttgctcctgttgcagcggttgccgaagcggcaccggctgaaatcagcggtcacatcgtgcgttcaccaatggtagggaccttctaccgtacgccgagcccggatgcgaaagcctttgtggaagtcggccagaaagtgaatgccggcgataccttgtgcatcgtcgaagccatgaaaatgatgaaccagatcgaagctgacaaatcaggtgtagtgaaagctatcctggttgaaagcggtcagccggtcgaatttgacgagccactggttatcatcgagtaacggggcagatcatgctggataaaattgttattgctaaccgtggtgagattgcgctgcgcattctgcgtgcctgtaaagaactgggcatcaagactgttgcggtacactcaagcgcggatcgtgacctgaagcacgtgctgctggcagacgaaaccgtctgcatcggcccggcgcagtcagttaaaagttacctcaacatcccggcgctgatctctgctgcagagatcaccggcgcggtggcgattcaccctggctacggcttcctctctgagaatgccgattttgctgagcaggttgagcgctccggctttatctttatcggtccgaaagcagacaccattcgcctgatgggcgacaaagtctctgcgattaatgcgatgaagaaagcaggcgtcccaaccgtacccggttctgacggttcgctgaccgatgatatggaaaaaaaccgtgcctttgcgaagcgcatcggttatccggtcatcatcaaagcctctggcggcggcggcggtcgtggtatgcgcgttgtgcgcagcgacaaagatctggaacaatccatcaacatgacgaaagcggaagccaaagcggctttcagcaacgacatggtttacatggagaagtatctggagaatccgcgccacatcgagattcaggtttctggctgacggccagggcaacgcgatctatctgggcgaacgtgactgctctatgcagcgtcgtcaccagaaagtggttgaagaagcgccaggcccaggtattactgaagaacagcgcagctttatcggcaatcgttgtgccaaagcctgtattgagattggctatcgtggcgcaggtaccttcgagtttctttacgaaaacggtgagttctacttcattgagatgaacacccgtattcaggtggaacatccggtgaccgagatgatcaccggtgtggatctgatcaaagagcagctgcgcattgctgcgggtcagccactgtcgatcaaacaggacgaagtggttattcgcggacatgcggtcgagtgccgtattaacgctgaagatccggtcaccttcctgccaagtccgggtaaaatcacccgcttccatgcgccaggcggttttggcgtgcgctgggagtcgcatatttactcaggctacaccgtaccgccgtattacgactccatgatcggtaagctgatcacctatggcgaaacgcgcgacgtggctatcgcccgcatgaagaatgcgctggcggaactgatcatcgacggtatcaaaaccaacgttgaactgcagatgaaaatcatgtccgacgaaaacttccagcacggtggaaccaatatccactatctggagaaaaaactcggcttgcacgagaagtaaacgcaacgctgagtcagtcagaggccggttaatccggcctttttcttttgccgctggcgttaaggttgaatcatggatgctcgttttatacaggcacataaagaggcgcgctggtcgctctacctcaccctgctctggctcgctgcctgggggctttctgcctggctgggtggcagtgaaattggtatcaccggcctgccgcgctggtttgaactctcctgcctgtttgctcccctgttgttcatattcctgtgctggatgatggtgcggttaattttccgcgacatgccgctggaggacacaaatgaacagtgaaattatcctgccgttactgatttatctggtgctgattgccgcgctgtcggtgtttgccgtgcgcaaaaggcgcgagggtagcttcctcactgaatatttccttggcagccgctccatgggcggatttgtgctggcgatgacgctcaccaccacctatatcagcgccagctcgtttattggtggtcccggtgccgcctacaaatatgggctgggatgggtattgctggcgatggtgcaggtgcccgccgtctggctctcgcttggtgtgctggggaaaaagtttgccatcctggcgcgtaagcataatgcggtgacgctgaatgacatgctctacgcccgctatcagagcccgctgctgatctggctggcaagtctgagcctgctggttgcctttatcggtgccatgacggtgcagtttattggcggcgcgcggctgctcgaaaccgccgcaggcatcccgtatgacacgggtctgctgatttttggcggcactattgcgctctacaccgcttttggcgggttccgtgccagcgttctcaatgacgccatgcagggcatcgtgatgctgattggcacatttctgctgctgttcgcggtgattcatcaggctggcggcctgagcacggccgtgcagaaactgcatgacattgatcctgctttgctgtcgccgcagggaccgggtgagattataacgccgaccttcctcagttcatttgtcgtgctggtctgctttggggtgattggcttgccgcatactgcggtgcgctgcatctcttataaagacagcaaggcagtccatcgggccattattctgggtaccattgtagtggtgatcctgatgctgggaatgcatctggccggtgcgctgggccgggcgatactgccgaatctgaccgtgccggatagtgttatacccaccctgatgatcactgtgctgccaccgttagctgccggactgtttctggcagcccccatggccgccattatgtcgaccattaatgcccagctgttacaggcttcggctacgctgatcaaagatctctatctgcgtgttgccccacagcagatggaaaatgagacgcggctgcggctgttatctggcaccattacgttcgcactgggtctcctgctgctgattgcggcctggaatccacccgatatgattatctggctcaacctgctggcctttggcggccttgaggcggttttcctctggccgctggtactgggtctctactgggaacgcgctaatgccgcaggcgccatcaccggcatggtggtgggtggaggctgctacgcttttctggcgagcctgaacctgcagattctgggttttcatcccattgtgccctcactgcttttaagcctgctggcatttttagtgggcaacctgtttggacgcgcgccgcaaacggtcgacgcgccgcaacattgacggaaagagagacgttatgccgtggattcaaatcaaaattaatagctcaggtgaacacgcggaaacgctgagcgatgcgctgatggacatcggtgcggtttcagtgacctttcaggataccaacgacacgccggtgtatgagccgctgccaggtgaaactcgcctgtggggcgataccgatgttatcggcctgttcgatgcagaaactgatatggccgcgattaccgccgaactggcgcagcatccgttgctgggcgccggttttcgtcaccggatcgagcagatcgaagataaagactgggagcgcgaatggatggaaaacttccatccgatgcgcttcggtgagcggctctggatctgtccgagctggcgtgatgtgccggatcccgatgccgtcaacgtgatgctcgatcccggcctggcgtttgggaccggcacgcatccgaccacctcactctgccttacctggcttgacgggctggatctggtgggcaaaacggtgatcgatttcggctgtggttcggggatcctggcgatcgccgcactgaagctgggcgcggctcaggcgatcgggattgatatcgatccgcaggctattcaggccagccgggataatgctgagcgcaacggcgtctctgatcgcctgtcgctctatctgccccaccagcaacccgaaaatctgcaggctgatgtggtggtggccaatatcctggccggcccgctacgtgaactggccccgctgatcagcgtactgccgaagtctggcggtcatctgggcctctcgggcgtgttagagagccaggcagagagcgtctgcgaagcgtatgttagcgagttcacgctcgacccggttgcggttaaagaggagtggtgccggattaccgggattaaatcctgaatatggcgcctgtctgccgcctctgatatcgctctgcccggaacaaagtgccttaacagaacattcagccagcccgtagcgtaagttgcgggctttcccgatttgaaatggatgcttgtatcgttaatcacggcatgtgacgttttttatctggcgaattgacgtacttttctggaaaaacttttgctcacaatttcagcataagttgttaaatcattgatatttaagcttaataaatatgcacatcgatcatgacccggatttcattgatctttcttgctgattgttcaaagtttggcctttcatcttcctgcaaaaatgcgtaatatacgccgccttgcagacacagtatggccattctgacttcatgcgtattggaaacctccagctgagaaatcgactgattgcagcaccgatggccggtattaccgacaggccgttcagggcgctgtgtcacgaaatgggtgcaggcatggcagtttctgagatgttgtcttcaaacccggaagtctgggctagcgacaaatctcgattacgtatggttcacagcgatgagccaggcattcgcgccgtgcaaattgccggttgcgatcccagtgaaatggcgcaagctgcacgcattaatgttgaggctggtgcacaggtcatcgacattaatatgggatgccctgccaagaaggttaaccgcaaaatggcgggttcagccttgctgcaatatcccaccgtggtggagtcaattctctccgcagtggttaatgcagtgaatgtgccggttacgctgaaaattcgtactggctgggatcctgaaaacaggaactgtgtcgcgattgcccaattggctgaacgctgcggtatacaggctctgacgatacatggtcgcactcgtgcctgcctgttcaacggagaagctgaatatgacagcattcggacagttaagcagagtgtctccattccgattatcgcgaatggagacataactgacccgcataaagccagagcggtgctcgactatacaggggccgatgctctgatgataggacgtgctgctcagggaagaccgtggatcttccgggaaatccagcattatctggacactggggagttgcttgccccgctgccgatggcagaggtcaagcgcttgcttgtttcgcatatacgtgagctgcacgacttttacggttcaggcaagggataccgtatagcgcgaaagcacgtctcctggtacctgcaggagcacgccccgaatgaccagtttcggcgcacattcaacgccattgaggatgccagcgaacagctggaggcgttggaggcatacttcgaaaatcttgcgtaacgaaataaagagctgaaagaactatgttcgaacaacgcgtaaattctgacgtactgaccgtttcaaccgttaactcacaggatcaggtaactcaaaaacctttgcgtgattcggttaaacaggcactgaagaactattttgctcaactgaatggtcaggatgtgagcgacctgtatgagctggttttggctgaagtcgagcagcctctgttggacatggtgatgcagtatacccgtggcaatcagacccgtgctgccctgatgatgggtatcaaccgcggtacgctgcgtaagaaattgaaaaaatacggcatgaactgatttttagttctgtctgtaaatcacgccagccttcgggctggcgtttttatttgtgcgtcgacgcacaaagccacggtaatgatagtgaaacagtttccggtaatatggtaactgtagttgcaatcgctggcgtgatatttcaccctctcgctttcgcccgctgtgatttgacttagtgcctgcctgaccctcacctcgcttcacatccccgccactgctgggtatgtgactttctgcgcattaaaaagcaacgcaatctcttcatacatttctgcctgagtgaatgctcacactgctcccacatagtgaaactatttgcactaaatgtgatcgggtcgactcgcattgcttccttttggtgcgccatattagcggaactttctaagtgcttccgattattaaccgttctttcatacgaattcaggaacctgcaaacctggcatcagctttgcagagtcgtggatggctgaccgccacagacaggaaaaacgcacactaaagtgcgcaaacataacaacatgatcccgccacacaggatgctttatgaaaaagatgatgctctctacgctgatcgctgctgcctcgctggttgccgttgctcagcaagcacacgcaggcaccacactggatgcgataaagaaaaaaggttttgttcaatgtggtatcagtgacggcttgccgggcttctcctatgcagatgctggcggcaagtttaccggtatcgatgtggatgtgtgtcgtgcgacggctgccgctgtgtttggtgatgcgaccaaagtgaaatataccccgctgaccgcgaaagagcgttttaccgctctgcagtccggcgaggtggatgtgctttcacgtaataccacctggacctcatcgcgcgatggcggcatgggcttcctgtttgcgggcgtgaactattacgacggtatcggcttcctgactcaccagaaggccggcctgaaaagtgcgaaagagctggatggtgccactgtctgtattcaggcgggaaccgacaccgagctgaacgtagcggacttctttaaagccaacaaaatgcaatatacgcctgtgacctttgaccgctctgatgaatcggctaaagcgctggatagcggacgttgcgatacgctggcatctgaccagtctcagctttacgcattacgcattaagctgggcaaaccggacgaatttattgttctgcccgaagtgatctccaaagagccgctggggccgttggtgcgtcgtggtgatgatgactggttcaccatcgtgaagtggtcgctctacgccatgctgaatgcggaggagatgggcatctcctcgaagaacgttgatcagatgacggccaagccaaccacaccagacatggcacacttcctgggcgccgaaggtgattttggtaaggatctgaagctggataacaagtgggcctacaacatcgtcaagcaggtgggtaactatcaggaaagctttgaccgtaacgtcggtaaagacagcgcactgaagattgcacgtggtcagaatgcgttgtggaaccagggcggtattcagtacgcaccaccggtacgttaacagacctcactaatcgggcaccctattctgtggtgccctaccccagctttcgttactgaggtttcaacatgtcacaacgcccaaccgtgaaaagggatttttcatttggtaatcccacggttcgcgcctggatttatcagctcatcgccgtcgtcgcggtgcttggtgtggtgggttatctggtgcataacaccattattaaccttgctaatcgcggtattacatcggggtttggatttcttgagcgcactgccggtttcggcatcgttcagcatctgattgagtacactgagggagatacctacgcgcgcgtatttctggtcggattaaccaacacgctgctggtctctgcactctgtattgttttcgcttcgattctcggattcgcggtcggtcttgcccgcctttctgacaactggctgctgcggaaactctcgaatatctatatcgaaaccttccgtaatatcccacccctgctgcaaatcttcttctggtactttgcagtcttacgcaatctaccgggcccacgtcaggcgctgaatgcttttgacctggcatatgtcagtaatcgcggactctacgttccatggccgacctatgcagcaggcagctggccgtttgttattgcactgcttctggccgcggctgtgagctatggcctgtaccgctttaaccgtaaacatcagctgaaaaccggtcagttacgtcgcacatggcccgctgccgttgcgatgctgattctctttcctttgcttgcacacattgggtttggcccagccacgcactgggatgtgccacaactgcgcggtttcaatttccgtggcggctcggtgatgataccggagctggcagccctgacgctggcactgtcgatttatacgtcgtcgtttattgctgaagtgatccgctccgggatccagtcggtcccctatggtcagcatgaagcagcgcggtcgctggggctgcctaatccggttacgctgcgccaggtgattattccgcaggccatgcgcgtcattattccgccactgaccagccagtatctgaacatcgtgaagaactcctcactcgccgccgctatcggttatcccgatatggtgtcgctgtttcgccggatcggtactgaatcagaccggtcaggccattgagacgattgctatcacgatgggcgtttacctgattatcagcctgctgatatcaatgcttatgaacttctacaaccgcaaaattgcgctggttgagcgttaagagaacgggataactatgtctgtgactacgcatgaaacgccccccgtcccgacgactctggtcagtcgcgcctggttttgggctcgtaaaaacctgttttccagctggtttaatacgctactgacgcttttttgcatctgggttatctggcacgtcattccgcccgcgctgaactggctggtctttcaggcaaactggatcggcaccacgcgcgccgattgcaccaaagagggtgcctgttgggtctttatccatgctcgtttcggccagttcatgtatgggctttacccgcatgagttgcgctggcgtattaacctggcgctggtgatcggcctgctgtcgattgtgccgatgttcctgaagagcctgccgtatcgtggacgctacattgctgcctgggctgtcatctatccggtgattgtctggtttctgctgtatggcggctatctggggctggaacgtgtcgaaacacgtcaatggggcggattaacgctgacgctgattattgcgtcagtgggtattgccggtgcgctgccgctgggtattttgctggcgctgggccgtcgctcacgcatgccggtcgtgcgcacgctgtcgattatctttattgagttctggcgcggcgtgccgctgattaccgtgctatttatgtcatccgtgatgctgccgctgtttatgtctgaaggcactaacatcgacaagctggtgcgcgcgctggtcggcgtcattctgttccagtccgcctatgtggcagaggtggttcgcggtggcctgcaggcactgccgaaaggtcagtacgaagcagccgaatctctggcgcttggctactggaagacgcagatgctggttattctgccccaggcgctgaagctcactattcccggcctggtcaataccatcatcgcactgtttaaagataccagcctggtcatcatcattggtctattcgatctgttcagcagcgtccagcaggcaacggtcgatccgacctggctggggatgtcgaccgaaggttatgtctttgctgcactggtctattggatcttctgttttagcatgtcgcgctacagccagtatctggaaaagcgctttcacaccgggcgtacatcgcactgaggttttacatgactgactctatgacacactcttccgacgcgttgatgatctcgcttgagaaacgtgaataaatggtacgggcaattccatgtactgaaagacatcaacctgcaggttaaaccccgtgaacgcatcgtactgtgcggaccttccggctccggcaaatcgacgacgatccgctgtatcaaccatctggaagagcatcagcagggccgcattgttgttgacggtatccatcttaatgatgacgttcgtaacattgagcgcgtgcgcaccgaagtcggtatggtcttccagcacttcaatctctttccgcatctgaccgtactgcaaaactgcacgctggcaccttcctgggtaagaaagattccaaagaaggaagctgatgagctggccatgcactatctgcaacgcgtgcgtattgccgagcatgcacataagtttccgggccagctctctggcggacagcagcagcgtgtcgccatcgcccgctcactctgtatgaagcccaaaattatgctgtttgatgagcccacgtcagcgctggatcctgagatggttaaagaggtgctggatacgatgattggtctggcggaggatgggatgactatgctgtgcgtcacccatgagatgggctttgcccgaacggtggctgaccgggtgatctttatggatcggggagagatcgtcgaagtcgcgccaccgcaggagttttttgcgaatccaaaatcggagcgtacccgggcgtttctatcgcaggttattcactgatcagacgttcagttatctcactacccggcctggtgccgggtttttttatggcctgaacagccgctttaatatgcttactgacctgttgctgttatgaatagacagacagatacgctgtgaagagggagttttatcgcggtttgccacaacgaaaaaagcccttcgcatacgcaaagggctctctcttatttaatgcctggcagttccctactctcgcatggggagaccccacactaccatcggcgctacggcgtttcacttctgagttcggcatggggtcaggtgggaccaccgcgctacagccgccaggcaaattcttttatttaccgaactcgtgtcttaactggtgctgatacccagagtcgaactggggacctcacccttaccaagggtgcgctctaccaactgagccatatcagcacactaaatttgatgcctggcagttccctactctcgcatggggagaccccacactaccatcggcgctacggcgtttcacttctgagttcggcatggggtcaggtgggaccaccgcgctaaagccgccaggcaaatcttggtgcacgaaacgaatcttttacgccatgaccgcgttgccatcgctcagccacaccggtcacatacttcagtatgctcccgctgacgtcctcgctctgcgccttgtcacgccgcaaaatctttcgtttccgctaatttttatccggtacaggctgaaaattgtgtctctcaaaaacgcctctggcgttgtaaggttaagcctcacgggtcattagtaccggttagctcaacgcatcgctgcgcttacacacccggcctatcaacgtcgtagtcttcaacgtcccttcaggactctcaaggagtcagggagaactcatctcggggcaagtttcgtgcttagatgctttcagcacttatcttttccgcacttagctaccgggcaatgccattggcatgacaacccgaacaccagtggtgcgttcactccggtcctctcgtactaggagcaacccccctcaattctccagcgcccacggcagatagggaccgaactgtctcacgacgttctaaacccagctcgcgtaccactttaaacggcgaacagccgtacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctgctttcgcacctgctcgagccgtcactctcgcagtcaagccagcttatgccattgcactaacctcacgatgtccgaccgtgattagctgaccttcgtgctcctccgttactctttaggaggagaccgccccagtcaaactacccaccagacactgtccgcagcccgggtaacgggcctacgttagaacatcaaacattaaagggtggtatttcaaggttggctccacgcagactggcgtccgcgcttcaaagcctcccacctatcctacacatcaaggctcaatgttcagtgtcaagctgtagtaaaggttcacggggtctttccgtcttgccgcgggtacactgcatcttcacagcgagttcaatttcactgagtctcgggtggagacagcctggccatcattacgccattcgtgcaggtcggaacttacccgacaaggaatttcgctaccttaggaccgttatagttacggccgccgtttaccggggcttcgatcaagagcttctccttacggataaccccatcaattaaccttccggcaccgggcaggcgtcacaccgtatacgtccactttcgtgtttgcacagtgctgtgtttttaataaacagttgcagccagctggtatcttcgactggcttcggctcggggagcaggtccctccacctacgcgccagcgtgccttctcccgaagttacggcaccattttgcctagttccttcacccgagttctctcaagcgccttggtattctctacctgaccacctgtgtcggtttggggtacgattctgtgttacctgatgcttagaggcttttcctggaagctgggcatttatcacttcagcaccgtagtgcctcgtcgtcacgcctcagcgttaataagggaccggatttacctggaccctccgcctacacgcttaaaccgggacaaccgtcgcccggccgatatagccttctccgtccccccttcgcagtaacaccgagtacaggaatattaacctgtttcccatcgactacgcctttcggcctcgccttaggggtcgactcaccctgctccgattaacgttgaacaggaacccttggtcttccggcgagcgggcttttcacccgctttatcgttacttatgtcagcattcgcacttctgatacctccagcatgcctcacagcacaccttcgacggcttacagaacgctcccctacccaacaacacatagtgtcgctgccgcagcttcggtgcatggtttagccccgttacatcttccgcgcaggccgactcgaccagtgagctattacgctttctttaaatgatggctgcttctaagccaacatcctggctgtctgtgccttcccacatcgtttcccacttaaccatgactttgggaccttagctggcggtctgggttgtttccctcttcacgacggacgttagcacccgccgtgtgtctcccgtgataacattcttcggtattcgcagtttgcatcgggttggtaagccgggatggccccctagccgaaacagtgctctacccccgaagatgagttcacgaggcgctacctaaatagctttcggggagaaccagctatctcccggtttgattggcctttcacccccagccacaggtcatccgctaatttttcaacattagtcggttcggtcctccagttagtgttacccaaccttcaacctgcccatggctagatcaccgggtttcgggtctataccctgcaacttaacgcccagttaagactcggtttccctgcggctcccctatacggttaaccttgctacagaatataagtcgctgacccattatacaaaaggtacgcagtcacccccataaagaaggctcccactgcttgtacgtacacggtttcaggttctgtttcactcccctcgccggggttcttttcgcctttccctcacggtactggttcactatcggtcagtcaggagtatttagccttggaggatggtccccccatattcagacaggataccacgtgtcccgccttactcatcgagctcacagcttgtgtgcttttgtgtacgggagtatcaccctgtaccctgcgactttccagacgcttccactaacacacaagctgattcaggctctgggctgctccccgttcgctcgccgctactgggggaatctcggttgatttcttttcctcggggtacttagatgtttcagttcccccggttcgccttgcagcactatgtattcatgctgcaatgatgcacagagtgcaccgggtttccccattcggacatcgacggctgtagcggttcatatcaccttaccgtcgctttacgcagattagcacgtccttcatcgcctctgactgcctgggcatccaccgtgtacgcttagtcgcttaacctcacaacccacaggcgtttttcaacgctgcgtgttgcaagcatttgagagactcgaacgcatcgccaaatcattccttattacggaggaatgacgcgctgcgtcgtttcaattttcagcttgttccggattgttaaagagcaaatatctcaaacgcggcccggctgcttacgcaaccaaatcggttttgagatactgtatggagacacctttcacctgtcaccaagcaggtggcgtcccctaggggattcgaacccctgttgccgccgtgaaagggcggagtcctaaccgctagacgaaggggacacaaaagtgtcacgacttcgcagccgtcctgctcattactttttatcagacaatctgtgtggacactgcgcgggaaggtatcttcaggtaaggaggtgatccaaccgcaggttcccctacggttaccttgttacgacttcaccccagtcatgaatcacaaagtggtaagcgccctcccgaaggttaagctacctacttcttttgcaacccactcccatggtgtgacgggcggtgtgtacaaggcccgggaacgtattcaccgtggcattctgatccacgattactagcgattccgacttcacggagtcgagttgcagactccgatccggactacgacgcactttgtgaggtccgcttgctctcgcgaggtcgcttctctttgtatgcgccattgtagcacgtgtgtagccctactcgtaagggccatgatgacttgacgtcatccccaccttcctccggtttatcaccggcagtctcctttgagttcccgaccgaatcgctggcaacaaaggataagggttgcgctcgttgcgggacttaacccaacatttcacaacacgagctgacgacagccatgcagcacctgtctcacggttcccgaaggcactaaggcatctctgccaaattccgtggatgtcaagagtaggtaaggttcttcgcgttgcatcgaattaaaccacatgctccaccgcttgtgcgggcccccgtcaattcatttgagttttaaccttgcggccgtactccccaggcggtcgacttaacgcgttagctccggaagccactcctcaagggaacaacctccaagtcgacatcgtttacggcgtggactaccagggtatctaatcctgtttgctccccacgctttcgcacctgagcgtcagtctttgtccagggggccgccttcgccaccggtattcctccagatctctacgcatttcaccgctacacctggaattctacccccctctacaagactcaagcctgccagtttcaaatgcagttcccaggttaagcccggggatttcacatctgacttaacagaccgcctgcgtgcgctttacgcccagtaattccgattaacgcttgcaccctccgtattaccgcggctgctggcacggagttagccggtgcttcttctgcgggtaacgtcaatcgacagggttattaaccccgtcgccttcctccccgctgaaagtactttacaacccgaaggccttcttcatacacgcggcatggctgcatcaggcttgcgcccattgtgcaatattccccactgctgcctcccgtaggagtctggaccgtgtctcagttccagtgtggctggtcatcctctcagaccagctagggatcgtcgcctaggtgggccattaccccgcctactagctaatcccatctgggttcatccgatagtgagaggcccgaaggtccccctctttggtcttgcgacgttatgcggtattagccaccgtttccagtggttatccccctctatcgggcagatccccagacattactcacccgtccgccactcgtcacccaaggagcaagctcctctgtgctaccgtccgacttgcatgtgttaggcctgccgccagcgttcaatctgagccatgatcaaactcttcaatttaagtttgatttgcttaaacaagttaagcggtgctcatctgtaaaacgtcataatgaatttcattatgtgttcactcgtgaggcttgatatttttttacgtccggagacgctgatatcaatcctgcgagtgcccacacagattgtctgataaattgttaaagagcagtgcgaacagtgcgttagcgtcctgtcgcgaggtggcgtatattacgctttcctcctgcagagtcaacctctttctcagaagtttttctccggcggtgcagtctcctgtgcctctcaacccgcttcccgttgccggtgttccgtgtcgatggaggcgcattatagggatcccgtttaagagcacaaccctttttttggatcttttatctgaacggttataaatgatccagattgatgagatcgccagcgatccaggccagaattggcttgtcagctgcctgaaatcgcatcaggctgcattgaaaacagaacaaaggagaacatgatggcttccgccctacgtccatataaagaccttttcccgcaaaccggccagcgcgttatggtcgatccaagcagtgttgtggtcggtgatgtcataatggaggacgacgtgagcatctggccgctggttgcgattaggggggatgtgaatcaggtccgcattggtgcccgtactaatgtacaggacggcagcgtttctgcacgttacgcataaatcagcgtctaacccgcaaggcttccctcttattattggcgaggatgtcacggtcgggcataaagcgatgttacacggctgtaccattggcgatcgcgtgctggtcggaatgggatcgattctgcttgatggcgtaatagtagaagaagaagtgatgattggtgccggaagtctggtgccgccaggtaaaagactggagagcggctatctctatctgggtagtccggtcaggcagatcaggccgctgaatgacaatgagaaggaaggtttacgctattccgctaataattatgtcgcctggaaagatgattacctggcgggagataaccagatccagccctgagcatcaatattatcctgacggatagccgcttcggcctcatcttccagatcccagcgatggtgctgaaacagcgccatcgtctccccttcaccaaaacgtgaagtcagcgacttcccgctgattgcacaggtcagccgcatgccgttgaccagcaccgggaaacagaccgcgttcagttcagcattataggtttcatcatcaggaaactgtatcgcctgattcatggctgcatggcctgtttaagctgggtaatcaccggtgcgatttccggcatcacaccgtgccacagatagaaggcatgagcagcctgccccaccagcatgcccaaaccatctgccagatgagccgtgccctgcgcctgacaccagcgcaggaaaggcgtcagcccgctttgataaaacatgtcataacagcgcacatcagcatgaatgactgctgcaggtaaaggaggggtttcgccattcacgccgcttgaggtcgcattaatgatcagatcaaagtgctgatctgcaagctgctcaaaaccacatgcgcggatagtgccgctccctgcaaacaggctagccagctcttccgcccgcgcggcggtacggttaacaacagtgagtgtcacgcctgctgagagaagcggcagaatgaccccacgtgcagcaccgcccgcccccaccagcaataccttgtcaccagagttgatcatcttcagccgttcaagatcgcttaacagcccgataccatccgtgttgtcacccaggatctgcccatcgctgagttttttcaccgtgtttaccgcgccggacagggctgcacgttcgctgagctgatcggcaaattcccatgcctgctgtttaaaaggtaacgtcacgttggcaccacgacctccctgttcgaaaaaggcagagagcgcctgaggaaaaccatcaatcggggcacaaatccgaccatagcgatgttcaacgcccgtctgttcagcaaaagcctgatggatcagcggagatttactgtggttgatcggattaccgaaaacggcgaattgatccatgaattagccctgacgtataagttcgccgctgatgacatcgcggatttcagagggattgagccgcccacctgtttttcccgacagaaccgggaactgctcaccaaactgctgcttcacttcttcagccgttcggcagggaggcaggcctgacagatttgcactggttgagaccagcggtttaccaaatgcgcggcaaagggcctgcacatcaggatggtcactgacgcgaatggccagtgaatcaaactgtccggtaagccagcgaggcgtttgtggcggaacgggtgcgacaaaggtcaccgggccgggccagcatgcaaacatccgctcacgctgtatcacagacagttcccgagcggagatgtaaggttccagctgggtgtaatcagccgcaatcaggataagccccttttctaccggacgctgtttcagcgccagtaaagccatgacggcagattcactgtcagggtcacagcccagaccaaatacggcttcagtaggataggcgatgaccgcctgtcgattcagctgctctaagcaggtttcaagtgaatcggcgaggtgttgattttccatggtctatgaattctcttcagcaatggctttgccacaacttttactggcgcaaaagcgtttgatcccttgggccgtctttttttcaactaatagcggatactggcaataaggacagattccggcaacgggtgtcagattcacaacaaactggcaggctggatagcggtcgcaggagtgaaacgttttgccgtaacgggagcgccgctgaactaaccggccttcatggcactgtggacaggccagcgaggtttcatccggtttgtcgatggtttcggtgtatccgcattccggatagaggctacagccaatgaacatgccaaatcgcccctgccgcaacactttatccgcaccgcattcgggacaggcgtggccttccagcactttgaccacatgaccatcggcctgaccctttaagggtcgaatgtagtcgcatgccgggtagttcgcgcagcccagaaaaggaccgtgtttaccggagcggataaccagttctgccccgcaagcggggcagggatcctgtttacgcacggtgaagagtgcagctttactcatagcgatcaatgcatgaaaggaaatttaatgcagcataccttcattggcgtcgaatagcagttcttccatctgctgataggcattttcacatccgggaatgttgaacaacaccatcagtaccacccatttgagatcctccaggtcaaactcagaggtatccagcgccataatgcgttcgatgaccatttcacgcgtttccaggttcagcacctgaatctgctccaggaacagcaggaaaccacggctgtcagcatctaaacgtttgctctcttcatcggtataaatacgcatggagagcggatcatttgtcagtaaaattggcgcaaccagtccttcctgatagtcagccaatctttctaaccagttcagcgcactgtaaatatcttcacgatggaacccggcatccgtcaggtcgtctgtcaatctgtcctgatcaacacccatttctgcttcgttgtggatatatgtctcaaacaaatacatcagtacgtcgaacatggcatgccctcctcaatcggacatagccgccgggtacagctgcgatccatcctgctaactccagtttccagcaactgagctgagataactggcacagattggccggcacgttcagcgacaacgtcaacaggtgtaacatcatcacctacgttagccaacacatcagcaaatggcaatggagcatcgtcactcacctcagaataaatttcaccggccggtgtcatcggcagccagttaagtgcacttgccagatcttccacgatgttatggggatgggccaccagcagcgccccctgctgaatcagccagtttacgccttcgcttaacgggttaccgagcgcgccaggtaaggcatagacattacgattttgctccagcccataccgcgccgttaccagggaaccactcttcagcgaggcttctaccaccagcaccccatggctcaggccgctgataatacgattacggcgcggaaaattaagcggatgcggcagggtcgtcagcggaaactcagaaaccaccgccccaccctgttcaacgatctctgcggcaagatgggcatgattgctgggatagagccgctgcaatccactacctaacacggccaccgttttaccgcccacgttgagtgctgcctgatgcgcaacaccatcaataccccttgccagtccgctggtaatggtcagaccgctgaggcttaagtgctgggtaaaccagtcgcaccagtagcggccatagtgtgaacagtttcggctgcccaccaccgctaactgtggtgtgctgataagcgcaggatcgccatcaatatagagcagcggcggaaagcggttggtttctttaagacgggcaggataggccgcgtccagagcagtcaccagatgatgagccggactctgatccagccaggaatagacttctgtgagattattttcattaaaatcatcatattgctggcactggctctcatctaagccaagccggataagctgctccctgtctgcctgtccggcacctatttgctgcgccacatcaacccagcgttttcctgtcattccagtgacggcggccagccgtacagactgcgctattttgtccatcttcagctccctgatcgcccttgcttcctgccgcagaatgctgtcaatcaggcctcgaaaagtctacaatataaggtagtaatcttttcttaaccgaatacagatctggatatttatgtcagttttgcaggtattacatttccctgacgagcgtcttcgcaaagttgctgcgcccgttaaagaagttaacgcagacattcagcgtatcgttgatgatatgttcgagacgatgtatgccgaagaaggtatcggtcttgcggctacgcaggtcgatattcatcagcgcattatcgtgattgacgtctctgaaagtcgtgaagagcgtttagtgctgattaaccctgagctgctggaaaaaagtggtgaaaccggcattgaagagggttgcctctctattccggaacagcgcgcatttgttccgcgtgccgagcgggtaaaggtccgtgcactggatcgcgagggtaaaagtttcgaactggaagccagcgagttactggccatctgtatccagcatgagatcgatcatctggaaggcaaactgtttatcgattatctgtcgcctttaaagcggcaacggatcaaaaataaattagagaaactggcgcgtcagaaacgcgcaggcttcctgagatcttaataagggataaacgtgtctgccccgctaaaaatcatctttgctggcacacctgactttgcagcgcgtcatcttgacgcgctgcttgcttctgaacatcaggttatcgccgtattcacccaacccgaccgtcctgctggtcgcggtaacaaattaacgccaggcccggtcaaaacgctggcgatggcacatgacattccggtttatcagcctaagtcactgcgacctgaagaaaatcagcaactggttgctgacctcaaggccgatgtgatggtggttgtagcctacggattaattctgcccaaggccgtgcttgatatgccacgtctgggatgcatcaatgtccatggctcactgctgccacgctggcgcggagctgcgcctattcaacgtgcgctctgggctggcgacagcgaaaccggcgtgaccatcatgcagatggacgtgggactggataccggcgatatgctgcataagctggcctgtccgattactgcccaggataccagtgccacgctgtatgacaagctggcacagcttggcccacaggggctgctggatacgctgacattactgaccactcagcaggcttcacctgaaaaacaggatgaaacgctggccaactatgctgagaaactcagtaaagaggaggcacgtcttgactggacactctctgcagaacagcttgagcgttgtattcgcgcttttaacccgtggccgatgagctttttcaccattgaagatcagccggttaaagtctggcaggcaagcgttctgccccacagcgatcgtgcgcctggtgaaattatccatgctgacaagcatggcatccaggtggcgacggctcagggcgtactgaacctgctccagttgcagcccgccggtaaaaaaccgatgtcggctcaggatcttctcaactcgcgccgggaatggtttgaacctggaacccttctggactgactctcaggcccggtccctcaccgggccttttgtttgatgacaaaaccctatgactaaatctatcaacctgcgtagcctctcggctcaacttattgagcgtgtggtcgacaagggcgaatccctgaatacggcactgccagccgcccagaaaaagctctctgacaaagatagcgcgttagtgcaggagatctgttttggcgtattgcgcacattaccgcagctggaagcgctcattggcaaactgatggagcgtccacttaccggcaaacagcgggttctgcactatctgatcatggtcgggctttatcagctggaatatacccgagtgcccgcccatgccgcactggcagaaaccgtcgcgggcgccgaagtactgaagcgcaccagtatgaaaggcttattaaatggcgtattacgccagtttcagcggcagcgggaagagctgctcgccactgttcaggatggcccgcagcgctatctgcatccgggatggctgctaaagcgtttgcagcatgcctggccggaacaatggcaacagattgtcgaagcaaataatctgcgtccgccgatgtggctgcgggttaatcgccagcaccacgatcgtgacacgtggctggcaatgctggccgaaagcggcaggaatgcacagcctgctgtcgatgtgccggatgcgctgcggcttgacgcccctgccccggtcagccagctaccaggctttgatcagggttgggttaccgtgcaggatttatctgctcagcgctgtgccttgctgcttgagccccaaaacggcgaacagattctggatttatgcgctgcgcccggcggtaaaacgacccatatccttgaaatcgcgcctcaggccgaagttatggccgtcgacgtggatgcgcagcgtcttaaacgcgtaaatgagaatctgcaacgactgggtatgaaagcagacgtgaaacagggtgatggacgaaacgccgcaacagtggtgcggcgatcgtcagtttgaccgtattctgctggatgcaccctgctctgctaccggtgtgatccgacgccatcccgatattaagtggctgcgtcgcgatcgggatatcgccgagctggcaaaacttcagggtgaaattcttgatgctatctggccgcacctgaaacctggcggtacactgatttatgccacctgttccatcctgcctgaagagaatcatcagcagatagatgctttcctgcagcgccagcatgatgcgcaggcagagcccctcagagatgcgcccgcgaacggcttacaggtattcccggaagccgagggcggagatggtttcttctacgctaagctgataaaaaaatcgggtacaaactgaaatgagtattgataagcgatgaaaataatcattctgggcgcaggacaggttggcggaaccctggcagaaaatctggtgggtgaaaacaacgatatcacggtggttgataccgactcttcacgcctgcgtcacctgcaggataagttcgatcttcgcgtcgtgcagggtcatggttctcatccacgcattttacgtgaggcgggtgcagaagatgccgacatgctggttgccgtaaccaactccgatgaaaccaacatgattgcctgtcagattgcttattcgcttttcaatacgccgaatcgcatcgcccgtattcgcgcagccgactatctgcgtgatgcggacaagttatttattcctgaagcggtgcctatcgatcacctgatctcgcctgaacagctggtgatcgacaatatctatcgtttaatccagtaccctggcgcattgcaggtcgtcaactttgctgaaggcaaagtcagcctcgccgtggtgaaagcttattatggcgggccactggtaggaaatccgctgtcgatcatgcgtgagcatatgccacacattgatacccgcgtagccgctatatttcgtcaggatcgccccattcgcccgcagggttcaaccatcgtagaagcgggtgatgaagtctttttcattgcagccagtcagaacattcgtgcggtaatgagtgaaatgcagcggctggagaaaccttataaacggattatgctggtaggtggtggtaatatcggtttcggcctggcacaaaaacttgagaaaaattacagcgtgaagctgattgaacgtaaccctcagcgcgcagcagaaactggcagagcatcttcacgacacagtcgtcttttatggcgatgcgtcagatcaggaacttctcgctgaagaacatgttgatcaggttgatctctttatcgccgtcaccaacgatgatgaagccaatattatgtcagccatgctggcaaaaaagatgggggcgaagaaggttatggtgctgattcagcgccgcgcctacgtcgatctggtacaaggcagcgttatcgatatcgctatttcacctcagcaggccacgatctctgccctgcttggtcatgtgcgcaaagcggatatcgtgggcgtttcatcgctacgacgcggtattgcagaagcgatcgaagcgatagcgcacggagacgaatcaacttcacgcgtggtcggccgctccattgatgatatcaaactaccgccaggcaccattattggcgcagtggttcgtggagacgatgtgatgattgccaatgataacctgcgaattgaacaaggtgatcatgtcatcatgttcctgaccgacaagaagtttgtatcagatgtggaacgtctcttccagccgagtccatttttcctgtaaatgccgcgtttacaggcgaacagaacacaaggaacgcaaaactgccgcttaattcgctgtgttgatggcaaaaccagtagggtttgttagactttatggcattggcttgggcaaggagataagtatgagtttaatcaaagagtttcgcgatttcgcaatgcgcggcaatgtgatggatttagccgttggtgtcatcatcggtgctgcattcggtaaaattgtttcatcgttagtcgccaacatcattatgccgcctttaggcttactgattggtggtgtcgattttaaatcattcgcctgggtacttaagcctgcagttggtgatgctccagccgttgttatgcagtacggtatcttccttcagaccatcttcgatttcgtcatcatcgctttcgcaatctttatggcgatcaagttaatgaatcgtctgtacaagaaaaaagaagtagagaagccagtggctaaaccgtcaaacgaagaagttctgctgactgaaatccgcgatctgctgaaacagcagaatacccgggtctagttaataagccgccgcacaggcggtttttttaaccgtaaaagcagaagggcagtgataagacgctttcttatcactgccctcccatccagtccccttgccatgtttctctttccgcttaaaactacctttacccttttgcttctgctcgatgcgttgccgaaatagcgggtcgtgtaacagagcctgaatcgcgttatcgcggatttgccctttggtgtgctgatatttactcatgacgcctcctgttgagatggtctgatactctattcctttgcagcaaaataacaatatgcttatttgctcgaagcctctccccgctccagcgcctcaagaattgagcacgaaatgctactgtgactgtcaccacaacaggcatcggaaaggtgtcgcagagaaacgctgcatcgtttctaattctgcgatcatctgagcaacttcgctcagccgtttttcaacgatcgcttttgattcctgacaggtgtggtgcgcaggatcaacccggatcgaaagtagctctctgatcgcttccagactgaaacccagtttacgaccataacgaataaatttcagacgctgaagatcgccctcgctgtaaaggcgaaaaccaccttccgtccgaccatcatgatccatcatctgctgcttttcataaaaacggatagtgtctggcgtcacctccgcaagcttagctaactgaccgatgcgaaacatttactcctcctcgcggaaacgatgctgaatagcagtggaataactgccatggagaaagtcggtactgatacccgcctggcgtaatcttagctccagcacctgaagccgatggcaatgatcctgataattttgatccgcaggatcgaggttacgaagaagatcgttaacttccatggcttcacgtctgagctcaagctccggcggcagaaagcccgcatttttcagtaaacggtagcccgctcttaactcaggcggaacatgactgtcatcatccagctgcagcggcttaccagagccgggaagattactcagctcgcctttttccagcgccgctttgatgtactgttcagcaagttcatcaaccagccacatagttagctcctttgaacatgaaaagagtaagttctaaggtagtaaatttcaggcaataaaaaacccgccgaagcgggttttttacgttgctacagattactctgcggctgcttctgcttgagcttctggacgatcaaccaactcgatgtaagccatcggagcgttgtcaccagcacggaagccacacttcagaatacgagtgtaaccaccggcacggctcgcgaaacgcgggcccagctcattaaacagttttgccacgatctcgttatcacgagtacgggcgaatgccagacgacgattagctacgctgtcggtcttggcaagagtaatcagcggctcaactacgcgacgcagtttctttggctttcggcagagtcgttttgatgatctcatgacgaaccagagaaccggccatgttgcggaacatagcctgacgatggctgctgttgcggttcagttgacgaccactcttacgatggcgcatgaccttatccttctcagtgaaaccttaacctgtgatctgattattcatcagcaatgcttgctggcggccagttctcgaggcgcatgcccagagaaagaccacgcgaagccagcacatctttaatctcggtaagagattttttaccaaggttaggcgttttaagcagctcaacctcggtacgctgtaccagatcaccgatgtagtggatagcttctgccttaaggcagttagcagagcggacagtcaattccagatcgtcaacagggcgcagcaggatcggatcgaattctggtttctcttctttaacttccggctgacgtacatcacgtaagtcaacgaaagcttcaagttgttctgccagaatggttgccgcacgacgaatcgcctcttcaggatcgattgtgccgttggtttccatttcgatgaccagcttgtccaggtcggtgcgctgctctacacgcgctgcttcaacattgtaggcgatacggtctacagggctgtagcaagcgtcaactaacaggcggccgattgggcgctcatcttcttccgaatgaattcgggcagaagccggcacatagccacgaccacgctgaactttgatacgcatgctgatagcagcgtttctcatcggtcagatggcaaatgacatgctgaggcttgacgatttcgacatcaccatcatgggtaatgtcggctgcagtcacagggccaatgccagatttattcaaggtcagaataacttcatctttcccctgaactcttaccgccagccctttcaggttgagcaggatttccaggatatcttcctgtactccctctttggtgctgtactcatgaagtacaccatcaatttcaacctcggtcaccgcgcaacccggcatggatgaaagcagaatacggcgcagtgcgttaccaagagtatggccaaagccacgctctaaaggctcaagggtcaccttggcgtgcgtcgaactcacttgctcgatatctaccaggcgcggttttagaaactctgtcacagaaccctgcattgtgtcctctctttggtactaagccttacttggagtaaagctcgacgatcaggtgttcgttaatgtccgcagacagatcagtacgttcaggaatacgcttgaacacaccttccatcttagtcgcatcaacttccagccaggttggcttttcacgctgctcagccagctccagagcggccttcacgcgagattgctttttggctttctcacggatgctaacgacatcattcggagatacctgataagaagcgatgttaacaacgcggccatttaccagaacagacttatggctaaccagctgacgtgcttctgcacgagtggcaccaaagcccatacgataaactacgttgtccagacgaccttccagcagagccaacaggttttcaccggtgttgcctttcagacgagctgcttctttataatagttacggaactgacgctccagcacgccgtagatacgacgaactttttgcttttcacgtaactgaccgccgtaatcagacagacgcggtttacgcgcaccatgctgaccaggggcttgttcaatcttacacttggaatcaatcgcgcgaaacgccagacttaaggaataagtcagtgccctcacgacggctcagcttgagcttaggacccaaatatcttgccattttctttctccaactatcctaaaaaaacgggcgttatacgcgacgttttttcggcggacgacaaccgttatgagggatcggagtcacatcagtaatattagtgatgcggaaaccagcggcgttcaaagcacgaatcgtagattcgcgacctggacccggaccctttaccataacttccaggttcttaattccgtaatcttttaccgcttctgcacagcgctctgcagcgacctgagcagcaaacggagtggatttacgtgaaccgcggaaaccggaaccaccggcggttgcccaacccagtgcgttaccctgacgatcagtaatggtaacgatggtgttgttaaaagaagcatggacatgagccacgccatctgagacttgttttcttacacgcttacgtgcacgaactggtgcctttgccattatttactcaccccgattatttcttgatcggtttacgcggacccttacgggtacgtgcgttggtcttagtacgctgaccgcgaaccggaagaccacgacgatggcgcaaaccacggtagcaaccaaggtccataagacgcttgatgctcagggtgatttcacggcgcagatcaccttctacaacgaatttcgcaactgcatcacgcagctgatcaatttgttcttcagacagctcactgatcttaacattttcagcaatacccgttgaagcgcagatggctttagaacgagttttaccgataccgaagatcgaagttaatgcgataacggtatgtttttgatcaggaatgttaatgcctgctatacgggccactatgcactcctataattaaacaagcacgtcccatgctgaaaagcccgttttcaggatactcaaatggaaacgcactgacatacaaaagattggctggctaatctagccagctcaacccgactttgcaagaaaaatatgtgacaaaatcagccttggcgctgtttatgctttggctcggcgctgcagatcacacggacgacaccgtcgcgacgaatgattttgcagttacgacataatctcttgacggaagcacgaactttcatttttactctccgtaacttctcaaccaactgaattaacggccgtagcctttcaggttagctttcttcagtgccgactcgtactgacttgacatcatcagagtttgcacttgagccataaagtccatgatgacgacaactacgataagcagtgaagtaccgccaaagtagaagggaaccttcatcgcatcacgcatgaactccgggataaggcagataaacgtaatgtagagagcgccgattaaggtcaatcgcgtcattactttatcaatatacttcgccgtttgctctcccggacgaattcccggtacgaatgcaccagacttcttcaggttatctgctgtttcacgtgggttgaaaaccaacgccgtatagaagaaacagaagaagatgattgcagtcgcatagagtagcacataaagcggctgtcctggctgcaaatacagcgaaattgttgtcagccagttccaaccggtaccgcccccaaaccacgatgcaatcgttgccgggaacagaataatgctggaagcaaaaatggctggaatgacgcctgccatgttcactttcaacggtaaatgtgtgctctgtgcagcgtaaacgcgacgaccttgctgacgttttgcgtagttcaccacaatgcggcgttgaccacgttcaacaaagataacaaagaaggtcactgcgaatacgagtactgcaaccaacagcaacagaaggaagtgcaggtcgccttgccgcgcttgctcgatggtatggccaatggccggcgggagacccgcaacgatacctgcgaagataatgatcgaaataccgttaccgataccacgttcagtaatctgttcgcccagccacatcaggaacatcgttcctgagaccagactcacaacagcggtaaagtagaaagcaaagcctggattcattaccaggccttgcatccctggcatattcggcagaccggtagcaataccgatcgactgaaatatggccaataccaacgtaccgtatcgggtgtactggctaatcttacgacggccagcctccccttctttcttaatttccgctaacgctggatgaaccaccgttaataactggatgataatcgatgccgaaatatacggcatgatgcccagtgcgaaaatagaagcacggctcagagcaccaccagagaacatgttaaacatttcaatgatggtgccacgctgttgctcaagcagtttggcaagtacagtggcatcaataccagggattggaataaaagagccaatacggaagacaatgagtgcgccgattacaaacagcagtctgcgtttcagctcaccaaagccacccttggcactttgaaaatctaatcccggttgtttagccatctgctacttattcctcgattttaccgccagcagcttcgattgcagcacgtgcacctttggtgacacgcagaccgcgaaccgttaccggtgtagaaacttcaccagacagaattactttaacgaattcaatctgaacaccgacaatgttggctgctttcagcgcgttcaggtcgacgataccgccttcaactttcgccagatcagacagacgaatctctgtggtgatcattgctttgcgagaggtgaaaccgaacttcggcagacgacggtacagaggcatctgaccaccttcgaaaccgcgacgtacgccaccgccagaacgtgagttctgacctttgtgaccacgaccaccggtttttccgaggccagaaccgataccacgacccagacgcttggtagcgtgcttagacccttcggccggagacagagtatttaaacgcatctcttactcctccactttaaccatataggaaaccgcgttaaccataccgcgtactgcaggcgtgtcttcacgctcaacggtgtggccaatacgacgcagacccaggccaaccagagtggctttatgcttaggcaagcggccgattgaactacgggtttgagtgattttaatagtcttagccatcgtgattaccccagaatttcttcaacggatttaccacgcttagcagcgaccatttccggagatttcatattgcccaggccgtcgatagttgcacgaaccacgttaatcgggttagtagaaccataggcttttgccagtacgttatgaactccagcgacttccagaacggcgcgcattgcaccaccggcaataataccggtaccttctgaagccggctgcatgaacacgcgggaacccgtgtgtgcacctttaactgggtgctgcagggtgccgttggtcagcgcgacgttaaccatgttgcgacgggctttctccatcgctttctggatcgctgctggaacttcacgcgctttaccgtaaccaaaacctacgcgaccattaccatcgcctaccacagtcagtgctgtgaaggagaagatacgaccacctttaacagttttagaaacacggtttaccgcgatcagtttttcctgcagtttcgccagcttgtttctcgatgtgtgccatcttagacctctaccttagaactgaaggccagcttcacgggcagcatctgccagtgcctggacgcgaccatgatattggaaaccggaacggtcgaaagaaacaccagtgatgcctttttcgattgcgcgttctgcgatagctttacctactgcagctgcggcttctttattaccggtatacttcagttgttcagtgatagctttttctacagtagaagcagcgaccagaacttcggaaccgttcggggcgattacctgtgcgtaaatatgacgcggggtacgatgtaccaccaggcgagtagcacccagctctttgagcttgcgacgtgcacgggtcgcacgacggatacgagcagatttcttatccatagtgttaccttacttcttcttagcctctttggtacgcacgacttcgtcggcgtaacggacacccttgcctttataaggctcaggacgacggtaggcgcgcaagtccgctgcaacctgaccaatcagctgtttatcagcgcctttcagcacgatctcagtctgagttggacattctgcagtgatacccgcgggcagctggtgatcgactggatgagaaaagcccagagacaggttaaccacgtcgcctttaacggctgcacgataacctacaccaaccagctgcagcttcttagtgaagccttcggtaacaccgattaccattgcgttcagcagcgcgcgagaagtacccgcctgcgcccagccgtcaacgaaaccttcgcgcggagcgaaagtcagagcgttgtcagcatgcttaacttcaacagcatcattgatagtacgagtcagctcgccgtttttacctttaatcgaaattacctgaccgttgagttttacctctacgccggcaggaacaacgacaggtgctttagcaacacgagacatatgtatcctccgattacgctacgtagcagataatttcgccaccaagacctgcctggcgcgctgcacgatcagtcatgacacctttagatgtagaaactacagcgatgcccataccagccattacctttggcagctcatcttttttcttatagatgcgcagaccaggacggcttactcgctgaatgctttctacaacagctttgccctggaaatacttgagagtaagttccagttccagcttgatgtcgccttcgattttgaaatcttcaatatatccttcttccttcagaaacgttggcaattgccaatttcagcttggaggaaggcatggtgaccgcaactttgtttgcggcctgaccgttacggatacgggtcagcatatccgcgatcggatcttgcatgctcatctgtgttactcccgtgattcaattggtgacaattaccagctagcctttttcaggcccgggatttcaccgcgcatggcggcttcgcggaccttgatacggctcaacccaaacttccgcaggaaaccgtgcggacgacctgtttgacggcagcggttacgctgacgcgaagggctggaatcacgcggcagactctgcagcttcagaacagcatcccaacgatcttcgtcggaagcgttcacatcagagatgatcgctttcagttcagcgcgtttagcgaagaatttgtctgctaattttgcacgcttaacttcgcgtgctttcatagattgcttagccattaagtaaccctaccttacttacggaacgggaagtcaaaggcagccagcagagcacggccttcatcatcagatttcgcagtagtggtaatggtgatatccaaaccacgaacgcgatcgactttgtcgtagtcgatttctgggaagatgatctgctcacgtacacccatgctgtagttgccacgaccatcgaatgacttagcggacaagccacggaagtcacggatacgtggaacagcaatggtgaccagacgctcaaagaactcccacatgcgctcgccacgcagagttactttacagccgatcggatagccctgacggattttgaagcctgcaactgatttgcgtgctttggtgaccagcggtttttgaccggagattgctgccaggtcagctgctgcgttatccagcagtttcttgtcagcgatcgcttcaccaacacccatgttcagggtgatcttctcgacccgagggacttgcatgacagaattgtagccaaactctgtcatgagtttctggactacttcgtctttgtagtaatcatgcagtttcgccatcgtactactccaaattacttgatagtttcgctgttagacttgaagaaacggacttttttgccgtcttcgaatctaaagcctacacggtcagccttaccagttgccgcgttgaacagtgcaacgttagaaacctgaatagcagcttctttttcaacgatgccacctggttggttcagagccggaaccggcttctgatgtttcttcaccaggttgataccttcaacgatgaccttaccagaagacaggacattcttaactttaccgcgcttacctttatctttaccggttaacacgataacttcgtcgttacgacggattttagctgccattgttcgctccttagagtacttctggtgccagagagataattttcatgaacttttcagtacgaagttcacgagttaccggcccaaaaatacgcgtaccgataggctgctcactgttattgttcagaataacgcatgcattaccatcgaagcgaatgacagaaccgtccgggcgacgaacacccttcctggtgcgcaccactaccgccttcaggacatcaccttttttgactttaccacgcggaattgcttccttgatggtaactttgatgatgtcaccgacgcctgcgtagcgacggtgcgagccacccagaaccttgatacacattacgcgacgtgcaccggagttgtcggcgacgttcagcatagtctgttcttggatcattttagtgctccgctaatgtcaactactacttcgggacctaaacctcaggtcgttagaaagccccataattgagggcgcggcattgtaacaccggttctcacagatgggtagaaaaaataaacggctctcaatcgagccgctgatttcccctgatgacagggagggcgtattctagggaatagtgcgaacagtagcaaatgtaatctgccttatttttcgtcgcctcccaaataaagtgcccttctgactcaaccagccagtttcctggccagttggttatgctgacgcaacacggctggcagttcaattccggccacttgtccgtcccgtacccggacttttccgttaatgatgctataggcaacctgtcccggattacagaacaccagggcggctacaggatcgtgccctgccccggcaagtccaattcgattcaggtcaaaaatggccagatcggccatcatgcccggcgcaatggtgcccacatcatcgcggtttagcacctttgctccacccagcgtcgccagttccagtgcctgacgtgccgtcatcgcatccgggccgaagccaacgcgttgcagcagcatcgcctgacgaacttcggccatcatgtctgagctgtcattggaggctgagccatccacacccatacccacgtgtacgccggcatcacacatatggcgtatcggcgcaataccggaaccgagacgcatgttcgagcagggacagtgcgcgacgccggtaccggtacgtgcaaagagttctatgccatgctgatccagtttgacgcagtgtgcatgccagacatccggtcctacccagccgaggtcttcaacatactgtgctggcgtcatattgaatttttcacggctataacgaatatcgctgtcgtttctccgccagatgggtatgcatagagacattgaagctgcgtgccatcgctgcggattgcttcatcagctcacggctgactgaaaacggcgaacatggcgcaaccacgatgcgtaacatcgaaccgtggctgtcatcatggtagcgctcaatcacacgctgcgtatctttaagaatggcggcttcatcctctaccagcgcatcgggtggtaagccacccagggacttaccgacgctcatgctgccccggctcgcatggaaacgcatgcccattaaggctgcagcctcaatactgtcgtcaagcttacagccattcgggtagacgtagagatggtcactggtagtggtgcagccggagagcattaactcggccatggagatctgtgttgagatatgaatcatctcaggcgtcagattctgccacagtggatagaggtgggtcagccagttaaagagctcgccgttttgcactgcaggaatagcgcgggtcaggctctgatacatgtggtgatgcgtattgatcaggccagggatgacaatatgtcctcgcagatcgatgatctcatccgcgctatcaggtaacgagcgtgcttccccgactgcaaggatcttatttccttttatcagaatagaggcgttacctatttccctacggtcagcatccatgcagaccacacattcagcattcttcagtaacagagttcgttccatgctattgcctgtgggtagtggttgtgtgttacccgataatagcggcaagcttttggcagagctaatcgcaggtaacgcagctaacagtggcaattttaacagtgaccggcgtaagcggtcatgactctccattttcacggcacatttccttgtacagttatgataaccccggcgtttatagcctggcgttttcaggccacctcgcctgaagagaggcagcttaatccctgcaagcccctgaatttgtgagcaccatcaaatccgtattgccacgggcacaaatggatcaagcccgaatcgcaggcaaaaaaaaaccccctgccgaagcagagggtttcctcagaaaaaacgattcttattacagaacagctttctcgattacgcgaaccagggtccaggatttagtcttggacagtggacggcattcgcggatttctaccacgtcaccaattccacattcattgttctcgtcatggatgtgcagcttggtcgtacgtttaatgaatttgccgtagatcgggtgtttcacgaaacgttcgatagcaacaactgcagatttctgcattttgtcacttactacacgaccctgcagagtacggattttatcggtcattacgaacccgccttctcagtcagtaaagtcttaacgcgtgcaacatcacggcgaacctgtttcagcagatgagtctgctgcagttggccagatgctgcctgcatgcgcaggttaaattgctcacgcagcagattaagcagctcagtgttcagctcttcaacgcttttttcacgcagctcagttgctttcattacatcaccgtcttagttacaaaggtggttttgataggcagttttgctgctgccagcttgaatgcttcacgggccagctcttctggtacgccgtccatttcatacaggactttaccaggctggatcagggcaacccaatactctacgttacccttacctttacccatacgcacttccagcggcttctcggtgatcggtttatccgggaatactcggatccagatcttaccttgacgcttaactgcacgggtcatagcacgacgtgctgcttcgatctgacgagcagtcagacgaccacggccaacagctttcagaccgaaagtaccgaagctgacatccgtacccgcagccagaccgcggttacggcctttgtgcactttacggaatttcgtacgctttggttgtaacatcagcgactctccttacttacggcctttacgctgctgctttttaggttgagcagccggttccggttgttcaacagcagccataccacccaggatctcacctttgaagatccataccttaacgccgattacaccataagtggtgtgcgcttcagaggtgttgtagtcaatgtcagcacgcagtgtgtgcaatggcacgcgaccttcacgataccattcggtacgtgcgatctcggcgccacccagacggccgctaacttcgactttaatacccttcgcgccaagacgcatggcgttctgaactgcacgcttcatagcacgacggaacatcacacgacgctccagctgtgaagtgatgctgtcagctaccagtttcgcgtccagttccggcttgcggacttcggcgatattaatctgtgcaggaacgccagcgatattcgcgacgaccgtgcgcagtttttctacatcttcgcctttcttaccgataacgatgcccggacgagcggtgtgaatagtcacacggatgctcttcgctggacgctcgataacgatacgagagacagatgctttagccagttctttagtcaaaaactgacgtactttaaaatcgctgtccaggttgtcagcgaattctttggtgttcgcaaaccaggtagagttccatggttttacaatacccaggcgaataccattaggatgtactttctgacccattgctagtctccagagtctcagcgatcggacacaaccacagtaatgtggctggtgcgcttcaggatgcgatctgcacgacctttggcacgcggcataatgcgtttcatggtcggaccttcatcaacgaaaattttcgtgattttcagatcgtcgatatcagcgccatcgttgtgttcggcgttagcaatggcagattccagaacttttttgaccagtacagccgctttcttattggtgtaggtcaaaatgtccagtgcctgcgacactttcttaccgcgaatcaggtcagcaacaaggcgaaccttctgagcagaagaacgagcgtggcgatgttgagctaaagtttccatctcttcctcctacttatttcttcttggcttttttatcagccgcgtgaccgcgataagtacgtgtcggcgcgaattcacccagtttgtgaccaaccatttcgtcggaaacaaagacaggaacgtgctgacgaccattatggacagcgatggtcaaaccgatcatgttaggaaagatcgttgaacgacgggaccaagtgcgcaaaggcttcttgtcaccgctttccaccgctttctctaccttcttcagcaagtgcaggtcaataaaaggacctttcttgagagaacgtggcatggcttatcctctaatattatttgctacggcgacgtacgataaacttatcggtacgcttgttgctacgggtcttcttacctttggtctgaacgccccacggagttaccgggtgcttaccaaagttacgaccttcaccaccaccgtgcgggtgatcaactgggttcatcgcggtaccacgaacggtaggacgaacaccacgccaacgggctgcaccagctttacccagaacgcgcagcatatgctcagcgttgccgacttcgcccagtgttgcgcggcagtcagactcgactttacgcatttcacctgaacgcagacgcagggtaacgtaagaaccttcacgcgcaacgatctgcacgtaagcaccggctgagcgagcaatctgaccgcctttgcctggtttcatttctacgttatgcacggttgaacccaccgggatgttacgcatcggcagagtgttacctgctttaatcgcagcatcaacgccagattggatctggtcgccggctttcaggcctttaggggccaggatgtaacggcgctcgccgtctttgtacagaaccagtgcgatgttcgcagagcggttcggatcgtattcaagacgttcaacaactgccgggataccgtctttgttgcgtttgaagtcaacaatacgataagcctgcttgtgaccaccaccgatatgacgggtagtgatacgaccattgttgttacggccaccggatttgctgtttttttctaccagcggggcaaatggtttgcccttgtgcagctccgcgtttaccactttaactacatggcgacgacccggagatgtcggtttacatttaacaactgccattgtctttctcctccgacttactcagcgccgccagcgaagtccagattctggccttctttcagggtgacgtaagcttttttccagtcgctacgacgaccgatacgctgtccttgacgcttaactttgcccttaactaccagggtgtttacgtctttaacttctacttcgaacagtttctcaacagcagcaacgatctctgctttggtcgcgtcattagcaactttgagaacgatggtattggttttttccatcgcgctagatgctttttcagatacgtgcggcgcgcgcagtactttcagcagacgttcttcacggatcatgccagcatctcctcaacttgcttaactgcatcagcagtcataacgactttgtcgaaggcgatcaggctaactgggtcgataccggatgcatcacgtacgtcaaccttgtacaggttgcgcgcagccaggaacagattctcatccagttcaccggtgatgatcagcacgtcttccagagccatgtctttcagtttctgtaccagcagcttggttttcggtgcttctacagcaaatgattcgacaacgatcagacgatcttgacgtaccagttcggacaggatgcttttcagcgcgccgcggtacatctttttgttaactttttgactgtggtcctgcggcttcgcagcaaaggtcacaccacctgaacgccagattgggctctttacagaacctgcacgcgcacggccggtgcctttttgacgccatggctttttgcctgaaccggttacttcggcgcgagttttctgcgcgcgagtaccctggcgggcgccagatgcgtaagcaacaacaacctggtgaaccagcgcttcgttgaaatcacgaccgaaggtagtttcggaaacagtcagcgcgctctgcgcgtctttcaatactaattccattgctatccccttacgccttcacagctggtttaacgatcaggtcgctaccggtagcaccgggaactgcacctttaaccagcagcaggttgcgctcagcgtcaacacgtactacgtccagactctgaacggttacgcgctcattacccagctgacctgccattttcttgcctttaaacactttgcccggagtctggttctgaccgatagaacccggaaacgcggtgagacaaggagttaccgtgagtagcgtcctgggtacggaagttccagcgcttaacggtaccggcgaaacctttacctttagaggtaccggttacgtcaactttcttaacttcagcgaaaatctcaacgctgatgctctgacctacagagtattcttcaccttcagcggtgcggaattcccacaggccacggccagcttcaacgccagctttagcaaaatgaccagcttcaggtttggtcacacggtttgcttttttagcaccggtggtaacctgaattgcctggtaaccatcgttttccaggcctttgacctgagtaacgcggttcgcttcaacttcgattacggtgacggggatagaaacgccatcttcagtgaagatgcgggtcatgcccacttttttaccgactaaaccaatcattgtttcaacctctcaatcgctcgatgacctgattaacccaggctgatctgcacgtcaacaccggcagccagatccagacgcatcagagcatcaacggttttttcagttggctcaacgatgtctaccagacgcttgtgagtgcggatttcgtactgatcacgcgcatctttgttaacgtgcggagagatcagaacagtaaaacgctctttgcgggttggcagcgggattggaccacgaacctgcgcaccagtgcgcttggcggtctcaacgatttccgcggttgattgatcgatcagacgatgatcaaacgctttaagacggatacggattctttggttctgcatgagaccagagctccaaactttttatagacgaaaaaaattactactcgagcccattacgattgatgggagagtgtaatcgttcagcatataactccacaattgggagtattgtcaggcggcctaaatttcagccgtctgcgattctgctcgaatcgcgcctgcaatatctgcaggcccgcgcattatacgtaaatctgttcaggaagcaacccgtgttgaggttttacccattaaattgtggccggttcgtgaagcgtgcgtcgcattgcactgccgtatcgctgataaatcagttattcagttgtgactctgtttccgcccttcttcattcataggtgacacagaacccgttgcccacgagagtgcatctaacctttcgtccggagcataatcatgtcgcccactctgataactcacattgctgcactcgcaggcggaggtgcattgggaagctttctttctctgaccagccagcgcttcacccccgccctctcacccgctcaatggtttgccctactctgctttccgggttcgcactgtaatcattgccagcagcgcctgctgtggcgagatgcactgccgttaataagctggcctggcttaaaagggcggtgtcgcttctgtcatcgcgcgttcggcgcagaaaacgttgtcattgaatggctgtttgcccttctgtgcctgctggtgctgcagagttttgaccactctgcggaggctatttttattattacggcctcaggcctcttgctgctcgtggctgccatcgatcgtcgccacttctgtatacctgacccgctcaattatctgctgctctggtctggattattccatgccacgctgtccggaaccgaaacaacggcgatatggggtgctgtggcgggctactgtgcgttgtggctgctcgcctggagctatcggcagatgcgagggtacgagggattaggttatggcgatatcaagctcttcgcagcgttaggtgcctgctgtggctggcaggcattaccctggattgcgttgggtgccaccgttatggcgctgacgtcgatcgtgatgctgcaactgcggggttttattcagggggacagcccgctgccgtttggccctttcctggccattgcgggctgggtagcgatagtactgcagacccgattcactcttgtttgatttgagcctgcagatagtttctggatgcccatcttctggattaactcaagttccgtctcaatccagtcgatgtgatgttcctcatcagccaggatttcaatcatcatgtcacggctgacatagtcatgcactttgtcagcataggagatagcttcacgaaggtctttcgcgccctccagctccagattcaggtctgaactcagcatctcttcaacatcttcaccgatacggagccgtcccagatcctgaagatttgggatcccttcaaggaaaagaatacgctcaatatatttatcggcatgtttcatctcatcgattgattcatggtattccacatcattgaggcgcgtcagaccccagtttttgaacatgcgcgcatgaagaaagtactgattgatagcaaccagttcatttccaagcagtttgttgagatgactgataactttgatatcgcccttcattgttaaccctccgcgtctggtttattagagcgtagatgcggttaaaaagaagtcaaaaaaactcgacagatattgtgggtattcacgcaccgatcgtcggtcaggctatctctttgtagagtggtgcatgctgcatctcttcatccataatttcacgcgcagcacgaatacatttgccgcattgcttgccgaccggcacaagctggcgcagttgctgaatagatttgggctgatagcgacgcacgacttcacgaagggttttatcactgatggcattacacaggcagacgtacattgattcatcactcgggtacattttctgtacacagtgtaaatgcgaatcgtttttatttcaaacccaccttttgcagggttatggcgttttcagagcaaaaaaaaagagcaccgaagtgctctttttactgtgttgcagtggccatttacacagccacagcagatatcacaattaagcgataactttagcaacaacacccgcgccaacggtacggccgccttcgcggattgcgaagcgcagaccttcgtccattgcgattgggtggatcagggtaacaaccattttgatgttgtcgcctggcattaccatttcaacgccttctggcagctctactgagccggttacgtcagttgtacggaagtagaactgtggacgatagcctttgaagaacggagtatggcgaccaccttcgtctttagacagaacgtaaacttctgactcgaactgggtgtgcggcttgattgagcctggcttagccagaacctggccacgctggatgtcttcacgcttgataccgcgcagcagaacaccacagttttcgcctgcctgaccctggtccagcagcttacggaacatctcaacaccggtacaggttgatttcacagtatctttgataccaacgatttcaacttcgtcgccgactttaacgatgccgcgctcaacacgaccggtaacaacggtaccacggccagagattgagaatacgtcttcgattggcagcaggaacggcatgtcgatcgcacgctgtggctctgggatgtagttgtccagatgctcagccagttcgatgattttcgcttcccactctgggttgccttccagcgctttcagagcagaaccacgaacgattggagtgtcgtcgcctgggaagtcatatgctgacagcaggtcacgaacttccatctctaccagttccagcagctcttcatcatcaaccatgtcacacttgttcaggaacacgatgatgtaaggaacgccaacctgacgacccagcaggatgtgctcacgggtctgtggcattgggccatcagtcgcagcaacaaccaggatcgcgccgtccatctgcgcagcaccggtgatcatgtttttcacatagtcggcgtggcctgggcagtcaacgtgcgcatagtggcgagtcggggtttcatactcaacgtgtgaagtgttgatggtgataccacgtgctttctcttctggtgcgttatcgatctgatcgaatgcacgagcctggccgccgtaagttttagacagtacggtggtgatagctgcagtcagggtggttttaccgtggtcgacgtgaccgatggtgcccacgtttacgtgcagtttgttacgctgaaattgctctttcgccatggcgataattccttacgttgtgccttcaccatctgggtgaaggcatcagttcaaatttaaaccgtagcttatttgctacgagcttcaataacggcctgcgctacgttgtttggcgcatcgtcatacttcaggaactccatggagtaagaagcacgacctttggtcagagaacgcagctgagttgcgtatccgaacatctcagacaacggaacttcagcgtgaatctgaacgccagtagcgttagattcctgccctttgagcataccacgacgacggctaaggtcaccgatgacatcacccgtgttctcttctggcgtttcaacttcaaccttcatgataggctcaagcagaacaggtgtcgcttgtttaaagccttgtttgaaggcaagagacgcggccagtttaaacgccagtttctgaggagtcgacatcgtggtaagaaccgaagtgcagacgcacgcccagatccacaaccgggtaaccagccagagggcctgatttcagctgctcctggatacctttgtcaaccgcagggatgtattcaccaggaatcacaccacctttgatgtcgttgacaaattcgtagcctttcgggttcgaacctggctccagtgggtacatgtcgataacaacatggccatactgaccacgaccaccagactgcttggcgtgtttaccttcaacatcggtaactttgttgcgaatcgcttcacggtaagcaacctgtggtttacccacgtttgcttcaacgttgaactcacgcttcatacggtcaacgatgatgtcgaggtgcaattcacccataccggcgatgatggtctggttagattcttcatcagtccatacgcggaatgatgggtcttcttttgccagacggcccagagccagacccattttttcctggtcagctttggtttttggctcaacggcgatagagattaccggctccgggaactccatgcgctcaaggatgatgacgttatctgggtcacacagggtgtcaccagtggtcacatctttcaggccaatcgcagctgcgatatcacccgcacgaacttctttaatctcttcacgcttgttagcgtgcatctgaacgatacggcccagacgctcacggtttgacttaaccgggttgaacacggtgtcacccgtgttaacaacaccagagtaaacgcggaagaaggttaagttacccacgaacgggtcggtagcgattttgaacgccagtgcagcaaacggctcgttgtcatcagagtgacgaacagccggcgtgtctttaccgtcgtccagcataccgttgatcgcggtaacgtcagtcggtgctggcagatattcaacaactgcatccagcatcgcctgaacacctttgttcttaaatgcagaaccacaggttaccaggataatttcgttgttcagaacacgcttacgcagagatgttttgatctcttcttcagtcagttcttcaccaccgaagaatttctccatcagctcatcagagccttcagcagcggcttcaaccagcttcgcatgccattcttcagccagttcctgcatatcagctgggatatcttcgtagacgaaggttacaccctggtctgcgtcgttccagttgattgctttcattttcaccaggtcaacaacaccggtgaatttctcttctgcgccgatagccagctgcagaggaactggagttgcgcccagacgaacttccatctgtttaacaactttcaggaagttagcacccatgcggtccattttgttaacgaacgcaatgcgtggaactttatatttgttagcctgacgccatacggtctcagactgtggctgaacgccaccaactgcacagtaaaccattaccgcgccatcaagcacacgcatagaacgttcaacttcgatggtgaagtcaacgtgtcctggggtgtcgataatgtttacgtggtgtggttcaaactgcttggccataccagaccagtaacaggtggtcgcagcggaggtgatggtaataccacgttcctgtttcctgctccatccagtccatggttgctgcgccgtcatgtacttcaccgattttgtggtttacgccggtgtagaacagaacgcgttcggtagtggtagtcttaccggcgtcgatgtgcgcactgataccgatattacggtagcgggcaatgggtgttttacgagccatttgattcctctgattctcggacgttcaaggtaagtcgaccccagcgggttggctgattgagcgcccgctggtttaacaactacgtggtgattaccaacggtagtgtgcgaacgccttgttggcttctgccatgcggtgaacgtcttcacgtttcttaactgctgtacctttgttctctgcagcatcagaaagttcgttcgccaggcgaagagccattgatttatcaccgcgtttacgagcagcatctacgatccagcgcattgccagagcattacgacgaaccggacggacttctactggtacctgataagtagaaccaccaacgcgacgtgacttaacttcgacagtcggacgcacgttttccagggctacttcaaaagattccagcgcgtttttacctgaacgctgagccagggtctcaagcgcggtataaacgattgattctgcagtagattttttaccatctaccatcaggatatttacaaatttggccagcagctctgatccgaacttaggatctggcagaattttacgctgaccaatgacgcgacgacgtggcatggaaatactccgttgttaattcaggattgtccaaaactctatgagtttattatgacatttaatttaaaacgtttggccttacttaacggagaaccattaagcctttggcttcttcacgccgtacttggagcgagcctgcttacggtctttaacacctgagcagtcaagcgcgccacgaaacggtgtggtaacgcacacctggcaggtcttttacacgaccgccacggatcaggatcacggagtgttcctgcaggttatgaccttcaccaccaatgtaggaggtaacttcaaaaccgttggtcaaacgcacacggcagactttacgcagtgcggagtttggtttcttaggagtggtggtgtacacacgagtacaaacgccacgtttttgcgggcaagcttccagcgccggcacgttgctctttgcaactttgcggacgcgtggtttgcgaaccagctggttaactgttgccattaaatagctcctggatttgcttttgcttcgtaaacacgtaataaatcgcctcgtagaattacgaggaggcagaattttagggctgagtcaaaggggtgtcaagaaataaccaggttttagccgattaccagaccatttgttgctgatgcctgatcgttagcgtgacaaacccagtatagtctactgactgcacacgggtcgaaatttgtccagcgagaccgcgagcctggacatcttcgtccagcacccagagcgtcgcttcgctctctgacagtcgcatcaatgcgtggctgccagctaaagcggccagcacgccatcctgcaacagcagcaggtcatcacccgcacccgccattaaaagcaggctctcaaggtcacagtgtgccggtgagtgcagtaacgtatgcagcattaacgtctcttaaaaagtaagaatgcgatcgtagctggccagcgtctgtcgcagtgccggcgcgtccagtagcgtaacatccagcaaccggtcagcgtcaacctctaatccacgcgctatcagcgatgtccggcagagatagcagtgttcaatctcatatagtgccagcacgccaaaggtcgcggcatagtgacggctcttaatcgtctcaggttgctggtgcagattaagctgcagcacgccatcaccgataaaaaacaggccgatatcctcactgagcgcgcccgtggccagcgcggcatccagcccctcacgtcctgcgctgctgccgtgcggcgcccgggtaaagacaaacgcgacccgattcatcagaaactgcaccatgcgttcacagctcagcgccgcttccgccagcgcgcccagcccgctcagggtaaagcccggctgcaggttactgcccgccagctggagtcgtgccgcttcctgctggtcgctgacgccacgacgcagcgcggccgccacacaaatattcagtgccacaccctgctcctgatgcaatgtctgccatgcgcgcaccagatcaaactcatcactggcgggcgacgtcagttggttagcgttcagcaccccttcgcgatagaagaaaacactgtcaagctgatggcctgccgtcagcagtgcgcaggcaaacagccaggcactggtcgcctgttgcgtaccgtaagccgggccggtgaccagcagggtgtaacgcattaccgctcctgcccctggaagtcgccatttttaaactgacggatatagagatagacggtgtgtttggaaatattcagccgatcggccacctggttgatggcatccttgatgtcgaagatccccttctcatacaggttcagcacaatctgacgattcttggcgttgttcgatacattacggtcagcactcacctcttcaatggtgaactccagcgtctgcatcaccagatcgtctaccgaactggcgaagttgacgttggagtcaacctgctgcatctcgggcggcataaaggtcgacatgatctgtgagaacggcacatcaaggttcatgttgatgcagagcaagccaatgacccgctgctgacggttacgaatcgcaatcgtgaccgatttcatcagcacgccgcttttggcacgtgtgaagtaggcacgggagacattactgtccgcaccatgcatatcatgcagcatacgcagggctaaatcggtaataggcgaaccgactttacgtccagtgtgttcaccattagcgatacgcactgccgaacacttaagatcttcaagcgaatgcaggacaatttcacaatgcgaaccgatcaacatcgccaggccatccacgacagcctcgtacgatttcagaatatcgtaatcactttgttcgaaacgggcgctgctccagaagatcgaagtcgctcagttcacccggattgaatggattagacattgaagagtatcaccctgaatggctggagcctgtcacagcggcttatgggcagactcaatattgggataattaggcaggcattagtctggcaaatgtcgtcggcttatgccagaggtttgtcgtgaagccgaaatgaaaccgccgcccggaggcggcggtcagcagattactgcgctttttctgcagcagcaggcgcaggagcctgtgctttttcatctgcctttggcgctggtttgatatcaagcagctcgacatcaaacaccagggtggagttagccgggatgcccggaacgccatttttgccgtaagccagatttggtgggatcaccagcttgatcttgccgcctttcttcacgtgcttcagaccttcagtccagcccggaatgacaccatccagacggaatgaaagtggctcgccacgggtataagagttgtcgaattcagtaccgtcaatcagcgtccctttgtagtttaccactacagtgtcgctgtctttaggtgcgtcgccggtaccctctttctcaactttatacagcaggccgctttcggttttcttcacgccgctctctttagcaaatttggttgcgtaagcttcgcccttttcagagttctctttcgcatctttttccattttcgctgaggctgcgcctttcacgcggccttcaaaggattgcagcgtctgctcaatctcttcatcagagagtttgctcttgccaccaaatgcatcctgaacaccagcgatcagctgctgcttatccagtttgatgcccagtttttcctgctccttcagggagttgtccatgtagcgacccagcgaagcacccagcgcgtaggcagactgctggtcttcatctttgaaggcagcatttttcggtgcctgaggcgcagactgtggcgcggcggctggtgcagcctgtggcgccgcagcggtatctgccgccattgccagcggagcattcagcgcaacagccatggtggtagctaacaatgtgactttaaacagtgatttcatccattctccaaaaccgaagcgtctaacctcgggaaacattgcggacttcagggtccacactataactttacgtggcagtgtcgaacactcccacaatgtaattacccggttaacttccgacctttataacatcgggaagtttcatcagagatgatgccgcgctgccttttttcaagcgcaacgcctccgggcgtgaaaaaaacaggtgattcctggcattcagatcgtagaatcacgccccgagtcgcaccttaacagaggaacaggtcatgcaacaatctgagtgggaacagcgtctggagacgctggagagcaaactggcctttcaggagatgactatcgatcagctgaacagcgcggtcgttcagcacgagctggagatgaataagatgcgtgagcagatgcgcattttaaccgacaagctcaaagcgaatgcgccatcgatcgtcgcctcacaatctgaagagacgccaccaccgcactactgatcgcgggctatctggccccggcttacccgggcagaaccagaatacgcgccaaaagaaaggccacccgagggtggccttgaaaggtctgttgagacttagtggctgcagccgcagccgccagtgccacaaccgcctttaccctgatcatggtcgtggtcgtgatcatggccgtgatcgtggtcatgatgatggccatctgcaccgtgaacgtggccatgagccagttcttccggcgtggcttcgcggatagcaaccacttcaacgttgaagttcaggttctgacccgccagcatgtggttaccatcaaccacgacgtgatcatcttccacttcggtgatttctaccggtaccgggccctgatcggtttctgccaggaagcgcatgccaacctgcagttcgtcaacgcccatgaagacgtctttaggaacgcgctgcaccaggttatcgtcatactgaccgtaggcatcgtttgccgggatatgcacgtcaaacttgtcgccggcaatgtggttttccagcgcattttccagaccagaaatcagggaaccatgaccgtgcaggtagtctaacggtgcactcaccggtgactcgtcaactaacacgccgtcttctgtacgtacctgataggccaggcttaccaccaggtcttttgctactttcatgatatctcctaaccgttgagagctgagatcccgtctcattggtctattctttcgtgcaataacaccaaccagaaaggttcggggctgagtacaagagggttttcactttctcttgcgactacagcgttaatggcgacaattgtaacggaattcaatcccgctgtaagtccaggcgtaaaaaaagctgcgccattccgctactcaggatgaaaaataccgataacctgctcattagtgcgaacctgatcgcgcgcctgcttatcggcctcacgcatctggtgaccacacttcacgcactccaccacatcgacattattttcacgccacattgccagcgtgtccttctcctggcagtgcgggcatgtcgcaccagcaataaaacgtttacgcattagcttctgcctgtttaaagaggttattcatcatcgtcccagccgtcgatctgccgcttttcgcgctgcatttcgcgctggaagatatcttccagttcacgccgcgcttcacggacgcgcgaagcctgcgcgctttcagagagattgggcatcagctcgcgcagcatccgcatatcaagatggcggaaatactgctgggcgcggtgcgcctgatgcggatgcatccccagcgtcatcagcgttttacgtcccagctccagcgcactggagaaggtctcacgcgagaactgcgtgacgcccgcctgaagcagttcatgcgcttctacacggccccgggcgcgcgcctgaatctgcaactgcggaaaatgctgctggcacagatgtacaatcgtcatcacatcttcgggctcgttacaggtgatcacaatcgcctgagcgctggccgcaccggcggcccgcagcaactccagttcggtggcgtcgccgtaatagaccttatagccatatttccgcatcagactgactgcactgatatcgcgctcaagcacggtgatgcgtttgttattcgccatcagcaaacgccccacgacctgcccgaagcgaccaaagcccaccacaatcacctgcggctgatcgtcttcgacaaagtgtttctctgcctcgtcatccggctcattgaagcggcgtgccagcagacgatcgattcccttcatcaacagcggcgtggtcatcatcgacagggttaccgtcaccagcagcatcggcagttgatcgccagagaacagctttgccgaggaggccgcggaaaagagcacaaaggcgaactcgcccccctgactcagtacgccagcgaaactgctgccgctcagagctgcgcaagccataaatgcgcgccagcagatagagcaccagcgttttcaccgccaccagcgtcacgacacccagcaggatggtcacaatatgggtatagagcacaccgaggttgagcgccatgccaaccgaaataaagaacaggcccagcagtaaacctttaaacgggtcgatggcgacttccagctcatgccggtactcgctctccgccagcaggatcccggcaataaaggtccccagcgccatcgacagacccagcgcatccataaacagcgcggagcccagcaccagcagcagcgaagcggcggtaaagacttcgcgcacgcccgacgcagcgatgtaacggaagataggccgcagcagatagcgtccgcctaccagcatgccggcaaacgccagtactttcatgccgaccttcatccagtcgatatgaccgctgtcggttccggccagcagcgggatcagcgccagggctgggatcaccgcgatatcctgaaacagcaacaccgaaaagcccagttgccccgcttcgctgcggttcatgcctttatccatcatcagctgcagggccatagcggtcgaggacatcgccagaccaatcccgccaatgatcgcagcctgccagctaaagttggtcagccacaataagccgcccagaatcgccgctgagaagatcacctgcgccgcgccgacgccaaaaatggagcggcgcagcgcccacagctttgccggattcagctccagcccgataataaacatcaggaacaccacgccgagctcagagaagtgcagaatctcgtcgacgtcgctgataaagcctaatccccacgggccgatagcgatacccgccaccagatagcccagaactgcaccaataccgaggcgagccgccaccggtacaatcaataccgccgcgaccagataaatcaccccggcggtcagcagcgtttgcccttccatctatacccctccattcggcagcggtgccgccagccagtcgccataggcgcgggcgtaatttttcattaattcaggactctgacgacgcgcccagtagacgatcatcggcggcatccagtgcatacggcacatctgcgcggtcagctcaaaaggacgcataatgtcattgagcgaatagcggttcagaccctgatgtctgaaggcactttccggttctccggtggtgacgacgctgcgccagtactttccttccagcgcattgccatccacgccattggcgaaaccgcgcgacagaactctgtccagccactctttcagcagcgccggacagctataggtatagagcggatgctgaaaaatgatgacatcatgttcacgcagcagctgttgttcatggtgaatatcgataaaaaaatccggataggtcgcgtacagatcgtgcacggtaacgtgttccagtgcctgagccggctgcagcagaatccgattggcgatcgaatcctgtgattccggatgagcataaagcagcaaaaccctgggtggctgcgacatcctttccctccaaagcgtcgtcattggtgcggttttccgctaccatgcacgacgcagcaaaatctcattatgttgccagtaaattaacatattctgacgatacggcgcttacatgattgtcttctcagccttacaaattcgccgcggcatccgcgtcctgctcgacaatgccaccgccaccattaatcccggccagaaggtcgggctggtgggtaaaaacggctgtggaaaatccacgctgctgtcgctgttaaaaggtgaaatcaccagcgatgccggtaccgtcactttccccactcactgggcgctggcctgggtgaatcaggaaacccctgcgctggataaagccgcgctggagtacgtgattgatggcgatcgccagtttcgccagcttgaagcagaactggcggacgccaatctgcgtgacgatggcaatgccatcgcgctgctgcatggcaagctggacgcggtgcaggcgtggagcatccatgcgcgcgcctcaagcctgctgcatggtctgggcttcagtcaggaacagctgcaacgcccggtcagcgacttctcgggtggctggcgcatgcgcctcaacctggcacaggcgctgatttgccgttccgatctgctgctgctggatgaaccgaccaaccacctcgatctcgatgcggtgatctggctggagcgctggctgaagagttatgaaggcacgctgattctgatttcgcacgatcgtgacttcctcgatcccgtcatcgacaaaattattcatatcgaacaggagtcgatgttcgaatataccggcaactacagctcctttgagcggcagcgcgtcgccaaactggcacagcagcagtcactgtatgagagccagcaggagaaagtggcgcacctgcacagctacattgatcgcttccgtgcccaggccaccaaggcgaagcaggcgcagagccgcatcaagatgctggagcgcatggagatgattgcgcccgcccatgtcgataacccattcagcttcactttccgcaagccggagaacctgcctaatccactgatgaagatggagaaggtcaccgcgggttatggcgatcgtattattctcgacgccatcaagctcaacctggtccccggctcgcgcatcggcctgctgggacgtaacggtgccggtaaatcaaccctgattaagctgctggcgggtgagctggaggcgatggacggcaagatgggtctggcgaaagggatcaagctcggttacttcgcccagcatcagctggagtacctgcgggccgatgagtcaccgttgcagcatctgtcgcgtattgcgcctgaggtgctggaacagcagctgcgcgactatctgggcggcttcgatttccgcggcgataaagtcactgaaatcactgagcgcttctccggcggagagaaagcgcgactggtgctggcgctgattgtctggcagcgccctaacctgctgctgctggatgaacccaccaaccacctcgatctcgatatgcgccaggcgctgaccgaagcgttgatcgacttcgaaggtgcgctggtcgtggtatcgcacgaccgacatctgctgcgcgcgaccaccgacgatctctatctggtgcatgatggcaaagtggatgtgtttgaaggcgatctcgaagattatcagaagtggctgagcgatctgcagaagcagcaggcgcaacaggatgccgcgccgaagcaggataacggcaacagtgcccaggcgcgtaaagaccagaagcgtcgtgatgctgaactgcgcacccagacgcagccgctgcgcaaagagatagagaagctggaaaagcagatgagcaaatggcagagccagctggccgaagccgaagctcagctctcagacagcgctatctatgaacagagccgtaaagcggacctgaccaccgcgctgcagcgtcaggcggagagcaaatctgcgctggaagaggtggagatggcgtggctggaagcgcaggaacagctcgaacagattatggcatcataaaaaaatctccccgcgagcggggagattctcttttaacggggtttatcgcccagcaccgttgcccgctgcataatgcgccgggcaggatagtaatcagcattggcataatgctgcgtgacccgattatcccagatagccagatcgtctggctgccagcgccagcgcacctgaaactccggtttggtggcgtgcgcaaacagaaagcccagcaccgcatcactctctttctcgcttaaatcgacgatccgcgtggtaaagccctcattcacaaacagcgcttttttgccgctgaccggatgggtgcggatgaccggatgctgcactggcggatgtttttctaccgcctgctgccagcgctgatgctcgtcctcggttttgcggtacttatactcctggaatgactttttgaaatcatgctcggcatggagacctgccagcagctgcttaaagggttcagagagcgcttcgtaagccgcaatgccgctggtccagagcgtgtcaccccccgactccggtaacaccttcgaggccagcaaggcgatcgctggcggcgtatcaataaaggtgacatcggtatgccagttgtcattatctggcggattatcctgatgggtatccagcacgataatctcctcgacgccttccgcatgcggatagaccggatggatgtgcagatcgccaaagcggattgccagcgcgcggtgctgttccggcgttattttctggtcacgcagaaacagcacctgatgacgaagcaggccatgataaagctgctcaaactgagcatcactcaatgggcgagacacatccaggtttgagacctgcgcgccaatgtacgggccaagcggggtaaaactgagacgttcgttcatgattgttctccactccagggcgtcagacggcgctgcaacgcgcggagcccgagttctaagctaaaagcaataaaggcgattaccgcgatacccgccagcaccacatcggtggcgaggaattctcctgctgactgcaccataaaacccagaccccgcgtggcggcaatcagctcagcggccaccagcgttgaccagccaacccccagaccgatgcgcagaccggtgaggatctccggcaacgcgcctggcagaatcacccagcgcagcagttgccagcgattagcccccagcgagcgagccgcacgaagtcggacctgctgcgtgttacgcacaccggccagggtggagagcgtcaccggcgcgaaaatcgccagatagatcagcaggattttcgaggtctcaccaatgccgaaccagatcaccatcaatggcagataggcgagtggcggaatcgggcgatagagttcaatcagaggatcgagcaacccgcgagcgaccgggctgaggcccatcaggatccctaccggaataccgatggcggcagcggcagtcagcgcgatcagcattcgtgtcaggctggcggccagatgctgccacagcgtggcatccataaagccctgcgcgctggcaatcagcagcagcttgcttaacacctgctgcggcgacggcaggaacagcggggcaatcaggcccagcgcggtcacgccccaccagagcagcaacagcagagagagactcagcatgctcagcgtaaaggcggttgaaaacggccagcgcaaacgacggcgcaccggcagagacttgtcattgatgagtgcactcatgcaaacgcctcccgctgatcaaagacccggctcagcacatactcgcgctgggcgataaaatgcggatcggatttgatgctgcggcacgactcccctgcggcaaagcgctgaccaaagccaggacgcagccgctctacgatgcggcccggtcctggcgacagcagaatcagttcgctggccaggaaaatcgcctcttctatgtcgtgcgtaatcaacagaatctgtttaccgctgtcgcgccacagcgtcagcagcagggtttgcatctgctctcgggtaaaggcatccagtgcgccgaaaggctcatccagcaacagcagttgtggatcggtagccagcgcgcgcgcaatgcccacccgctgacgctgaccgccggacaactgccagatggcgcgcttttccgcgccctccagccccacctgcctgattaaccggcgggcaatcgtgtcgcgatccgggcgtgacatccccgccagctgcagaccaaaggcgacgttatccagtacgttgcgccacggcagtaatccttcatgctgaaacaccacgccgcgctccgcaccaggcccggtcaccggctggttatccagcgtgatgctgcccgactccaccggcaggaaaccggcaaccagattgagcagtgtggttttgccgcagccggaggggccgagcaccaccagcagttcatggctatccagctgcagattgatatcctgcaacaccggctgtccggcataacgggcattaaggtgagcgatgcgcagcatagtgcctccttaaggtttaactaatggctcgacgaaacgggaggtcacatagctgctgtagtcgttatccgcctgcggcacccggccctgtgctttcagaaactgcgcggtatcgacgatcgctttattgaccggtttgcccagttgctcaacctgctgctgcgccgtgaggtaggtattgcccttcaccagaccgggcacctgtgcttccggcacaccgctgaggcgagagagtttgctgaggttatcggactgcttcagccagctgtcggggctgttcaggtaggcctgctgcgcgtcaagcgcgctgcgggcaaaagcagtcacgatctccggatgctgctgagcaaaatctttgcgtaccacccagacatccagcgtcggcgatccccagcttcccacttccgcagagtcggttaacaccttgccctctttttccagctcattaaccgccggtgcccagacgtaagcgccatcaatgtcgccacgctgccaggctgcaataatcgctggcggctgcagattgaccagctgtacctgtgacggtttgatgccccagtgtttcagcgcagccagcaggctgtagtgggtggtagagatgaacggcaccgcgatgcgtttgccaattaaatctttgggcgtagtgatgttcttcttcaccaccagcgcttcagagttgcccagctgagaggcgagtaaaaaggcttcaatcggcagcttctgcgccgccgcgaccgctaacgggctggaaccgatattgccaatctggacgtcaccggacgccatcgcacgtaataccccggcgccgctgtcaaacttgcgccagtcaacgctggccccgctctctttcgcaaagctgttgtcagcctgcgccactttcgccggctcagccgaggtctggtaagccacggtgacattgaccgcatcagcccgaaacgccagcagcgccagcgctgcggctaaaaaagttaaacgtgttgctgccatgatcactaccccaccgtttttatagtggaggcagtgtctctgcgcgctatagtttcataaaggaattaaaaattatccctaatagaaataagttcttagatcactatctgcaaaacaaagttaaaaatcgcaaatgctgaaaatagctaaagtaagcaaaaatgtcaggcgctcacattgtccctgtgctattcatatgcgttcccaattattgcctgttaaggtttctgaatccgatgtcgatcgagaaagtcgctcagctggctggcgtctccaaagccacggtatcgcgggttctcaacgcgcatcccggcgtgaagcccgatacgcgtgagaaagttctggcggcaatctctgcctgcgactatcagcccaacttactggcgcgtcagctgcgtacgtcgcaaagcaacatgctgctggtgctgatctcggatatcaccaatcccttctgttcacgcgtggttcagggcatcgaggccgaagcggaactgcacggctatcacatcctgctctgtaactccgcctcgcagctccagcgtgaagccgcttatctctccctgctgaccggaaaagtggtggatggcgtgattacgatggatgcggcctccggtttacaggatttgcaggcgctcattgccggggcgccctgggtgcagtgctgcgaatttgatccggatatccccgcctcctcggtcagcattgatcaccttgaagccgcgcgcgacaccgtccattaccttgccggtaaagggcgtaaacgcatcgggctgatcaatggcgacatgcgttacctttactcgcatcatcgtgaaaagggctaccggcaggcgattgaggagctggggtatgtctggtccggcgtctcctacacttacgaaatctcctgtgaggcgggcagtcaggggctaagggagttgatggcgctgccggaaccgccggatgcggtgttcgcggtttcagatgtgctggcggtaggcgtggtgcatgcggcgctggaagcgggtctgcgcgtgccggaagatctggcggtggtcgggtttgatggcgtgtcgtttacccgcagcctgaatccgccgctgacgaccatcgagcagccgatgaaccagctgggcgcgcgtagcgtgcaattgctgctgcagaagatccgcaatcctaatgcgccagtcatccgcgaggtgctgccctggacgcgcgttgaacgcgcatccagctaatttagtgccagattaacagcacgcaggcggcggtcagcagccccatggcgaggttaaaaattttccaggcgcgacggctgcgcagaatgcggccgatcatcgcaccaaatcccatccagataacacccgataccagattaaccagaaacatgccgatgcttatcgccatcactgaatggcgatatgcgtcaccggccaggctgaaactggcgaccgcgcccagcgccatcagccaggccttgggattgatcaactgcaacaatccgccctgccagaagggcatcggcgcatccggcgcctgatcggtttccagcttctcataactggcggtagcgattttccacgccagccagagcagatagaggctaccggcgattttcagcaccaggtgcagcgaaggatagagcaggatcagcccgccgacgccaaaggccaccatcagcagcataacctgcattccgatcatgatgccaatcatcagcggaatggtgcgcataaagccaaaattagcgcccgaggcggtgagtaacatattattaggcccgggcgtaatggccgcgacccaaagaaatcccaacattgataagaaaagactcagttccatggcaatcgggtactccttaccctgcaagaaaaaacttatcgaagctaacagtgtgatatggaacagacaagcttttaccacatgaaatttaccggaccggaaaacgagcacttcacgcctcctgagagtctgcgtaacgcgcacctgcagaccctgctgccgcgcctgctacgtcgtcgtatcacgggcgatccccactggcaacgtctcgacctgccggatggcgacttcgtcgatctcgcctggagtgaagatccgcagttcgcgcagcataaaccgcgcgtggtgctgtttcatgggctggagggcagttttcatagcccctatattcatggactgatggcgatctgccatgcgcgcggctggctggcggtggtgatgcattttcgcggctgcagcggcgaaccgaatcggctcaaccgcatctatcactccggcgaaaccgaagatgcccgtttttttctgcactggctacgcacccgctggggccgtgtacccaccgcggcggtgggtttctcgctgggcggtaacatgctgggctgcctgctgggccagcagggcgcagccgctgaggtagacgcgggcgtcattgtctccgctccgctgctgctggagccctgtagcgtaaaactggaacgcggcttctcacgcgtctatcaatactatttgctggcgcagctcaagaaaaatgcccgccgcaaactgcacgcctggccggatacgctgccggtcaatctggcgcagctgaaagcgctacggcgactgcgcgactttgatgatgccattaccgcccgcgcccacggttttctggatgcggccgattactatcatcgtgccagcgccatgccctggctgaagcacgcagagaaaccgctgctgatcattcacgccaaagatgatccttttatgagtgatgaggtgatcccgcacagcagccaattatctgccactattacttatcaactgacaccacacggcggccatgtaggttttgttggtgggacattacgccagcctgaaatgtggctggaacagcgtatcccccagtggatcgccccttttctggataactgatctcgtgattattccctggcaacaggtctcacctgagacccttgaaaatctgattgaaacctttgtgctgcgcgaaggcacggactatggcgagcaggaaacgcagcctgatcgacaaggtggccgatgtgcgacgtcagctggaaacgggtgaagtggtactggtgtggtcagaactgcacgaatcggtcaatatcatgccgcgcaaagaatttcgtggctgatgcacccaacggcatttcgtgttaacaatgcctattgcccgacctcacagggagcttttctatgtctgcacgtcatcccattatcgcggtgactggttccagcggcgcagggaccaccaccaccagcgtggcgtttcgcaaaatctttcagcagctcgatcttcatgcggcggagctggaaggtgacagttttcaccgctttacccgccctgaaatggatatggcgattcgtaaggcgcgcgatttaggacgtcatgtcagctacttcggcccggaagccaatgactttggcctgctggagcagagctttaaagagtatggtcagagcggacagggccagtcgcgtaaatatctgcacacctacgatgaagcggtgccgtggaatcaggtgcccggcacctttacgccgtggcaaccgctgccgcagaacaccgatattctcttctacgaagggctgcacggcggcgtggtaacggcgcagcacaacgtagcagaacaggttgatctgctggttggcgtggtgccgattgtgaacctggagtggattcagaagctggtgcgcgacaccggcgagcgcggccattcacgtgaagcggtcatggattcggtggtgcgctcgatggaagattacatcaacttcatcacaccacagttctcacgcactcacctcaactttcagcgcgtcccgaccgtcgatacctcaaacccgttcgctgcccgcgctattccgtcactggatgagagctttgtggtgatccacttccaggcgctggaagatatcgacctcccctacctgctggcgatgctgcagggctcgtttatctcgcacatcaatacgctggtggtgcctggcggcaaaatgggtctggcgatggagttgatcatgggtccgctggtgaagcggctgatggaaggtaagcgaatagagtaagaggccaaaagggcctttccagactaatgccaatgccaatgccaatgccaatgccaatgcaggatgaatctgacagcagcgaaaaagcttaacacgcagggaaccgggtcagaagaggaaagcgtcccgcgccagggacggcgcgggccgagcggccagggattggcttaagcgactttccgatctgacccggttcccagcgcaggcacagtctgacagcggaccgacacaaaccgctctgaccctgttcaatacgcaggcacagtatcaaagcggattcccggcccaggcacagtcctaaagcaacctgcatcagatactggaagtgaagttagcaggtctgcaataacccctgcggctactaaagttcgatcacttcatagctatgggtaatgttgacgcctttacccagcatgatggccacagagcaatatttttcagcagaaagatccacggcgcgtgataccgctttatcctggagggctttaccactcacgataaaatgcaggttgatgtgcgtaaagattcgcggcgcctcttcacgacgttctgaggtcagttttacttcacaatcagccacatcgtttcggcctttttgcagaattgataccacgtcaatcgcgctgcatccgcccgccgccatcagcaccatctccattgggctgggcgctttatcacccgaatttccatccatcagtatctgatggccggatgaggattctccgaggaatgtcagcccttctacccatttcactcttgcctgcatgatttttgctccggaatacgctgttttgtcgccagagtacgctttcgcctggtaaacagcaatccagagaaatccgcccgtagctgaagcgagacaacagaagacagtcggcaaaagctgtgctacaaacagtgctgaaaatatttttcgtcacccgatgacgaagccgggaaggatgatgcgcactgcgcctgatgcggcccgaataatttcctgaaatggaaacgcttgaagctttcaccgcctgacagggaaaactgccccctgtattttgggcacgattacaacagaggataatagcgaatggttctcggcaaaccgcaaacagaccctacactcgaatggttcctgtcccattgccatattcacaagtatccatccaaaagtacgctgattcaccaaggtgaaaaagcagaaacgctttactacatcgtgaaaggttccgttgcggttctgattaaagatgaagaaggcaaagagatgattctttcctacctgaatcagggcgattttattggtgaacttggcctgttcgaagaaggccaggagcgcagcgcctgggtacgtgcgaaaagcgcgtgcgaagtggcggagatttcttacaagaaattccgtcagctgatccaggttaaccctgacatcctgatgcgactctcatcgcagatggcgcgtcgcctgcaggtgacgtctgaaaaagtgggtaacctcgctttcctcgacgtaaccggacgcattgcacagaccctgctcaacctggcgaagcagccagatgccatgacgcatcccgacggcatgcaaattaaaatcactcgtcaggaaattggccagattgttggttgttcacgtgaaaccgtgggccgtattttgaagatgctggaagatcagaacctgatctccgcacacggcaaaaccatcgtcgtttacggcacccgctaattcctgtcacccacggcgtgatggcaacatcacgccgttattgtttgtgttgggccgatgtggcgtcgaattatttaccatcctgaagtcaattacgccttgcggcaaacgctggtactctgtctgccggtggcgctgggctggctggctggcgacctgcaaaaaggtctgctgttctcattagtgcccgcctgctgcaacatcgccggtctggataccccgcataaacgcttcttcaaacgcctgattgttggcggcagcctgtttgccctcggcagctttctgatgcagtggctcaccctgcatgctattccgctgccgctgatcctgtttgctatgcccttattgctcggcgttaccggggagatcagcccgctgcatggccgtctgctgcccggcaccctgattgccgccatctttaccctgagcctgattggccgcatgccaatctatgttcccccgctgctctatatcggcggcacgctatggtacgggctctttaactggttctggttctggctgtggaaagagcagccaatgcgcgaaagcctgagcctgatctaccgcgagctggctaactactgcgacgcaaaatataccctgctgacgcagctgaccgatccggaaaaggcgctgccgccgctgctggctcgtcagcagaaagtggtcgatctgattaacacctgttatcagcagatgcatatgctgtcggcaagccgcgatcacagccataaacggctgacgcgcgcctttcaggtggcgctggatctgcaggaacatatctcggtcagcctgcatcggccggaagaggtgcagaagctggtcgaacagagccacgccgaagcggtgatccgctggaatgccaaaaccatctcggcccggttgcgggtgctggcggataacattctctatcaccagctacccgatcgctttgcgatggataaacagctcggcgcgctggagaaaatcgcccatcagcatcccgacaatccggtgggtaacttctgcctttaccacttcaaccgtattgcgcgggttctgcgcacccagaaacccctttatcagcgcgatctgatggctgaccgccagcgccgtctgccgctgttaccggcgctgcgcagttatctctcgttccgctcatcggccctgcgcactgccggccgctttgcggtgatgctgatgctgggcagcgcactggcgctgttcttcaacatccccaaaccctactggatcctgatgaccatcatgttcgtcagccagaacggctacagcgctacccgtgtccgcattcagcaccgggcgctgggcacttttgccggtctggtgatcgcggctgccacgctgcgcatggcggtgccagagtcgctggtactgctgatcatgctggcgattacctttatcagctatcgctttacccgccagttctatggctggtcgatgattggctttacggtcacggcggtttactcgctgcaattgctgtcgctgaatggcgcgcagtttctgctgccgcgtctcatggatacgctgatgggttgtctgatcgcctttggcgggatgctgtggctgtggccgcagtggcagagcggcttgctgcggcagaaacgcccatgacgcactggaaacctatcaggatgcgctacggctgttgctgggtgacgaacagtcaccagagaaactggcttatcagcgcgtgaaggtcaatcaggcacacaatgcgctgtttaactcactgaatcaggcgatgcaggaacccgcgttcaactcccgctatctgagtgatatgcggctttgggtcacgcacagtcagtttatcgtcgagcatatcaacgctatgacgattctggcgcgggagcacaccatgctcactgcctcgctggctgagcgttacctgcaatcctgtgaaatcgcgctgcagcggtgtcagcagcggctggaatatgatggtgaaagctcacaggttaacctgctggatgagctggagaacatcagtgagggaccgatcacggtggtggagcagcatgtgcggcgcattctcgatcatctgagcgtgatgtacaccatttcatcgctggcgtggaaccagcggccgcaacatggccgctggctgatcagacgcttacgtaaaaactaagctagccgttgagcacgttgccgacggccgtggcgaagcggctcatgccctcttcgatgtcggcaggctcaatgatcagtgacggggcaaaacgcatcacgtcggtgccggcaaccagcaccatcacgccttctgcggccgcggcattcaggatgtcgcgtgctttaccggcatgctgcggtttcagcgccgcgccaatcagcagacccttgccacgaatatcgctgaagagatcatacttcgcatcgatggcctgcagcgccgtgacaaagtgctgacgacgtgtctcaacgcctgccagcacctccggcgtattgataatatctagcgcggtttcggcgatggcgcaggcgagtggattgccgccataggtggtgccatgcacgcccggcgccatggtcgaggcgatctcgttagtggtcagcatggcgctgaccgggaaaccgccgcccagcgctttggctgaggtcagaatatcgggctggatgccataatgctcataggcgaacagcttgccgctgcgccccatgccgctctgcacttcatccagcaccagcagcgcctgatgctgatcgcaaagctcacgcagtccctgcataaattcctgcgttgcgggcacgacgccgccctcaccctgaatcggttcaaccacaatggcgcaggtgtgatcgtcaatcaccgctttcactgcgttcagatcattgaacggcacatggacgatatccgccggtttaggcccgaacccatcagaatattttggctgtccgccgaccgtgacggtaaacaacgtccggccatgaaaggcgttatgaaaggcgataatcttacttttgaacgggctgtgacgtttgcaggcgtagtagcgcgccagcttaaaggcggcctcgttggcttcggccccggagttagcgaagaagacccgctcggcaaaggtcgcctgaattaacttactggcaagacgcagcgccggtttcgttggtgaagacgttgctggtgtgccacagcgtctcgccctgacttttcagcgtctccaccagcgcaggatggcagtgtccaagtgcggtgacggcgataccacctgagaaatcgatatactctttgccctgctgatcccatacacgactgcccttgccttttaccggcacgaactgcgcaggtgcataaacaggcaaaataacgttatcgaacgtctcccgcgtgaccgcaattttttccgctgccattgatgaccccatttagatgattgatgtgcaactttgaaataataatcacaaaatatgcataaaaaatcactcaaaggcaacttattgctcaaggaaattgcgcagcagctgatgtccctgctcgctgagaatgctttcgggatggaactgcacgccttccagcgccagggttttatggcggaatcccataatttcgtcaggctcgccgtcacgcaccgtccaggcagtcacctcgaaggcatctggcagggagtcgcgctgtacaatcagcgaatggtagcgggtcacggtcagtggattattcagagtgcggaacacgccctgtccggtgtgctgaatcgcagaggttttgccgtgcatcacctgacgcgcacgcacgacctgcgcgccatacgcctgcgcaattgcctgatggcccagacagacgcccagcaccggcagctgaccggcgaaatgccggatcgccgccagcgaaatgcctgactccgacggcgtgcagggaccaggggagatcaccagatgagtcagcggtaacgccgccatctgctccagcgtgatggcatcattgcgcaccacccgaaacctgcgcgcccagctcgcagaaatattgataaagattccaggtaaaggagtcgtaattgtcgataagcagcagcatggccagtccagaataattacccgcgccgctattctacgcggttaagccgcctcgctcaccactttcgcaaatacctgctccagcaaagtcaggtctccggccacaccagcctgattcgccgctttccagctttcagcgtcagtctcttcccaggagagcagataaccggcatgcagcgccagctgttcaaagaaaatccgctgcgcccgaccgttgccgtggcggaaaggatgcaacatgttgatttcgcagtagtagtgggcaacacgctcaataaacgcgtcacgcggcaggtcaacgagtcccttctcctcctccagcgcggccatcagggcgttaccttccttttcgatatattcgaaatgacagaacggcgtctcatcgcgccagatatcgatagtgcgcagttcaccagcccagctgtagacgtcctgaaacagcgtacggtggatctggcacaggtaaggcagtccaggattacgggggcccagctccagcgtggcggcacgcgccgcactaaaactcagctccgccttacgcagctgcgcggcatcgtgaatatctggcaggtttttcagcacattgtcatgctgccacaggtagggatcctggctgacggcggtattagagtccatattgcctcctcagtgacgccagacgtgcggccacatcatcgctgtttacgctggtttcatttggcgagaagccttccagccgacagctggcctgatagctggcgctacgccgctgtcgccacagggtgaccttctgtttttcggtgagtttgttcgccatgccgcctcctgctcaggtttttgccctaagtataagagcaaattctggctttgccggatgcggcaggcggtcgccatccgcagatggcgacgaacggacttaaggcaggactttggcggagaggataactaccggtttggatggaacattctggtaaggacccacatctttggtcggtacctgagaaattttttcaaccacatcctgacctttcacaatcttaccaaatacggcatagccaaaatcgcgctgtccgtgatcgaggaatgcattatccgcgacgttgaggaagaaactggctggtcgcactgtctttatcggcggttcgcgccatggaaatcgtgccacgcaggttacgcaggccgttatccgcttcattcttgatcggcgcgttggtctgcttctgctgcatgtccgtagtgaagcccccaccctgcaccataaagcccgggatcacgcggtgaaaaatggtgttgttgtaaaaaccgttgttgacgtaatcaacgaagtttttcacagaaaccggcgctttctggttattcagttcgagttcgatattgccggcggaggtggtgagcagaacgtgggtgtcaccttttgcagccagcgcctgggcggaaacggaagagagcgctaacagggtgatggccgctgttaaagtacgtttaaacatgaaagattccttacctgggagagcgggcacaaaaacgtgattgattgtaaagagactctattccaggagccagcgttttacctatatttacgctgtggcagcaaatggggggagcaaacgttaaaccccgacaattacgtgattaaaatcacacaacacatgaaatatggatctctggtttcactggttgtttattaagatcacggttccgtttacactttctgacactttttggcacccggttctcaacaggttcagaacatgacaaaccgtaatcgtattggcctcacctggataagcttcttctcctacgcgcttaccggcgcgctggtgattgttaccggcatggtaatgggcgatatcgcaaaagatttccagatcccgatctccagcatgagtaataccttcaccttcctcaacagcggcatcctggcggcggttttcctgaacgcctggctgatggtgattgtgccactgaagcgtcagctgattttcggcttcgtcctgatggtactggcgataatcgggttgatgaccagccgcgatctgaccgtcttctcgctctgtatgtttgtgctgggcgtggtcagcggcattactatgtcgatcggcaccttcctgatcacccatatgtatgaaggccgccagcgcggttcgcgcctgctgtttaccgactccttcttcagcatggcgggcacgctgtttccggtgctggcggggattctgctggcgcgtcagctgccgtggtactgggtctacgtctgcatcggctttatctacgtcgcgatcttcatcatgacgctgtttgtcgagtttcccggtgctgcgtaagcccgaaaacagcccgacagttgagaaagaaaaatggggtgtgggcgtgctgctgctggcagtggcggcgctctgctacattctgggccagcttggctttatctcctgggtgccggaatatgccaccaaagtcatgggcatgaatattaatgatgccggacaactggtgggcagcttctggaccgcttatatggtggggatgtgggccttcagcttcctgctgcgcttcttcgatctgcaacgcatcctgatggtgctggcgggactggctaccgtgctgatgtactggttcgtcagcagccaggatgccagtatgctgaagtggatcattatggtgttgggcttcagctcgagcgcgatttacaccactatcatcacgctcggctcgctgcagaccaaagtggcgtcaccgaaactggtgaactttattctgacctgcggcaccgtcggcaccatgctgaccttcgtggtgaccgcgccgattgttgagaagagcggcgtgcacacggcgctggtcaccgccaacggcctctacgcggtggtgtttgtgatgtgtgtcctgctggggctggtcactaaacatcgctcgcacggtcacgttacgcattaatcattcagggcggcgattgatcgccgccctgatgtttaacgccggaagtctatccgctcccgctcccgccagtaaatctcgctttctgcaggctttgtctctgccaccacgatgccgcgacgcagtgagtagcgcaccggaacctgtcttcttactgcatcaaaaccactctctgccggcagaataatcaggctggcatcgttgccggtctgaatgccatagcctgacagctgcagcgtcttcgcgctgttatgcgtaatcagatccagacccgcatcaatctgctcatagcccatcaactgacagacgtgtaagcccatatgcagcacctgcagcatgctggcggtgcccagcggataccagggatcgaacacatcgtcgtggccgaaacagacgttaatctccgcctccagcatctctttcacccgcgtaatgccgcgccgcttaggataggtatcaaagcggccctgcaggtgaatattgaccagcggattcgcgacaaaattaatgcccgacagcttaagcagtcgaaaaagtcgtgaggtatacgcgccattgtaagagtgcatcgcggtggtatgactggccgtcacgcgcgcgccgttgccatcgcgatgcgccagcgccgccacggtttccacaaagcgcgactgttcatcatcgatctcatcgcagtgaacatcgatcagccgatcgtagcggttagccagcgcaaaggttttatgcagcgactcaacgccatattcacgggtgaattcgtaatgcgggatcgcgccgaccacatccgcgcccagccgcaatgcctcctccagcaacgcttcaccgttgggataagagagaataccctcttggggaaaagcaacaatctggatagtgatccatggcgccatctccgcctttagctccagcatcgctttaagcgccgtcagtgacgggtcagaaacgtcaacatgggtacggacaaactgaatgccgttggcaatctgccacttcagcgtctgcatcgcccgccgcttaacatcttcatggctgagcatggctttgcgttcagcccagcgctcaatgccttcaaacagcgtcccggactggttccacgcgggtttcgccagcggtctgggtggtatccagatgaatatgcggctcaataaaaggcgcgcaggctaagccaccctcgccgtccagcgattcatccgccggtgaagcgtgctgcggctgggctgagatccgggcaattttgccatcggcgatggcgatctgccataaaccatcccgccagggtaaacgcacgttattgatccacttaggtgacatcattgccgactccttttccggttttgtgttttaaaactaacacgattcaggtgacccgccgcaagcccgaataatcagcgggttatccgcaccagaaaaaattatttcaaatcaaccatatacctcttaataggtatatggcgtcgtggttgatgtatatcaataagtgccagaaacggcgcgctattgtagccgcagatatcgcaaatttgaggcaaaaatgagcaagcacaatgtcgtcgttatcggtaacggcatggtcggccaccgcttcatagaagaattactagagaaagcggaacctgaccagttttcgctgaccgtcttttgtgaagaaccccgcgtcgcctatgatcgtgtccacctgtccgcctacttttcccatcacaccgctgaagaattgtcgctggttcgtgaaggctattacgacaaacatcaggtcaatctgctgctgggtgaacgcgccatcaccattaatcgtgatgagaagctcatccactccagtaccggtcgcgcagtgcattacgatacgctgatttttgccaccggctcttatccgtggatcccgccaatcaacggtgccgaaggcagcgactgctttgtctatcgcaccatcgaagatctcaacgccatcgaagcctgttcgcgccgcagcaaacgcggcgcggtgatcggcggcggcctgctggggctggaagcggcgggcgcactgaaaaatctgggcattgaaacccacgtcattgaatttgcgccggtgctgatggcggagcagttagatcagcaaggcggtgagcagctacgtcgcaagattgagcagatgggtgtacgggtccacaccggtaaaaacacccaacagattgtgcatcacgaacacggcggcaaaacgctgcagtttgctgatggcagcgcgctggaggtcgatttcatcgtcttctccaccggcattcgcccgcaggacaaactggcgaaacagtgtggattagccctggggccgcgtggcggcatcgccattgatgaccagtgccggaccagcgatcccaccatctacgctatcggtgagtgcgctgcctggcagaatcgtgtctatggcctggtggcgccgggttacaaaatggcccaggtcgccagcgaccatctgctgggccgcgacaatgcgtttaccggcgcggacatgagcgccaaactgaagctgctgggtgttgatgttggcggcattggcgatgcgcgcggcaccacgccaggcgctcgcagcgtggtctggctggatgagagcaaatcgatctacaagcgcctgattatcagcgaagatcagaaaaccctgctgggtgccgtcctggtgggcgacaccagcgactatggcaacctgctgcagctggtgctgaatgctattccgctgcctgctaatccggaagcactgattctgccaaccggcagcggggataaaccggccatcggcgtcgattctctgcctgataccgcacaaatctgctcctgctttgacgtcagtaaaggcgacatcattaaggcggttcagggtggctgtcataccgtggcagcactgaaaagcagcacccgtgccggcaccggttgcggcggctgtatcccactgatcacccaggtttctcaacagtgaactcagccgtcagggcattgaggtcaataaccatctttgcgcccacttcgcctggtcacgtcaggagctttatcacctgattcaggtagaggagattaaaacctttgacgaactgctggcccgctatggtcagggttacggctgtgaagtgtgcaagccggtggttggctcactgctcgcctcctgctggaatgagtatgtgctcaagccccagcacgcgccgttacaggacagcaacgacctctaccttggcaacatccagaaagatggcacctactcggtgatcccgcgctcgcccggcggtgaaatcacgcctcagggactgaaagtgattggcgagatcgccgagcgctatcagctctacaccaaaattaccggctctcagcgcatcggtctgtttggcgcgcagaaagacgatctgcccgccatctggtcacagctgatcgacgccggatttgaaaccggccaggcctacgccaaggcgctgcggatggcgaaaacctgcgttggcagcgcctggtgccgttatggcgtgggtgacagcctcggcttcggcgtgatgctggagaaccgctacaaaggcatccgtacgccgcacaagatgaagtttggcgtctctggctgcacccgtgaatgtgcagaagcacagggcaaagatgtcggcattatcgcgaccgaaaaagggtggaacctctacgtctgcggcaacggcggcatgaaaccgcgccatggcgatctgctggcggccgatctcgatcagcagacgctggttacctatctcgaccgtttcatgatgttctatatccgcaccgccgacaaactgcagcgcacctcgctgtggctggagagtctggaaggcggcatcgactatctgcgtaaggtgatcgtggatgacaaacttggcctcaacggccagatggagcagcagctggccgcactgcgcgccagcgtcagctgtgaatggaaagcgacgctggaagataaggatcacctgacgcgctttgcccactttatcaactcgccgcagcgcgatcctggcgtgcagcgggtcgcggagcgcgaccagcaccgcccggcacgcgccgatgaacgcattgccgtgaccctgattgaggagaccgaatcatgagccagtggaatccggtgtgcccgctgacgcagatcctgcccgccacgggcgtctgcgcgctggtcaaaggccaacagattgctatcttccgtccccgcaacgatgagcagctctatgccatcagcaatatcgatccctttgccgatgccagcgtgctgtcacgcggcattattgctgaacatcaggatgcgctctgggttgccagcccgctgaaaaagcagcgtttccgtcttagcgatggctactgcatggaggatgaaacgcgctccgtggcggcctggccggtgcgggtcaatgccggacaggttgaagtctgcctgtaactcccgtcaacagcccgcctccgcgggcttttttaaggacgtctgatggactacttccccttattctgccgcctgcagggccgacgctgtctgctggtcggcgcaggtgacgtggctgagcggaaagcccgcctgctgctggaggccggcgccgaactgctggtcggtgcccttgatttctcccccgccttccggcaatgggcgcagcaggaaaccatcacgctgctgccaggggcgtttgatccgcactggctcaccggctgctggctggtggtcgccgcaaccagcgacgatgcagtcaatcagcaggtggctgaagccgccgaaaaacagcagatcttctgcaatctggtggatgcgccgcagcaggccagcgccattatgccgtcgatcatcgatcgttccccgctgatggtcgccgtctcttccggtggacgcgcgccggtactggcgcgcctgttgcgggagaagctggaggcgatgctgccgcaacaccttggccagctggctcagctggcaggcactctgcgcgcgcgggttaaacagcaattcagctctgtcagtgcccgccgccacttctgggaaacgcttctttaacagcgagcggctggcccagacgctggccaacggcgacagtgaacgcgcggagcagattaccgaccagctctttaacgctgaccttcaccaacagggtgaagtggcactggttggtgccggtccgggtgatgccggattactgaccctgaaaggcttacagctgatccagcaggcagacgtcatcgtttatgaccggctggtctctgatgagatcctgaatctggtgcgccgcgatgccgagcgcatttttgtcgggaaacgcgccggacatcactgcgtgccgcaggatgagatcaaccagctgctctgcgaacaggcgcagcggggaaaacgtgtagtgcggctgaaaggcggcgatccctttatctttggtcgcggcggtgaagagctggaagcgctggcgcagcggcagattccgttcagcgtggtgccggggatcaccgccgcatcgggctgtgcggcctacagcggtattcccctgacccaccgcgatcatgcgcagagcgtcagactggttaccggacatctgcagaaagagggctcgctcgcctggcagacgctggcggcggaacagcagacgctggtcttttatatggggctcacgcaggccggagagattcagcagcagttgataaagcacggtatgcgcagcgatatgccggtagcgctggtggaaaacggcaccactacgcgtcaacgcgtggtcaccgggacactgagcgagctggaagcgttagccggtcaggtgaccagtcccagcctgatgataatcggcagcgtggtaagtctgcgcgacagtctgcgctggttctgagtccggcaaataaaaacggcgggcacaatgcccgccgtcctggttgtctgctcagccattacggcatcgcgacaaagcctaccgcctgatacaccttcttcagcgtttcctgcgcctgtgcgcgtgctttggccgcgccatcacgcatcacctgctccagcagtgcttcatcgttgcggaagctgtgataacgctcctgcagctcagagagcatacccgacacagcatcggctactgcgcctttcaggtggccatacatcttgccttcgaactcctgctccagctcggcgatggttttaccggtcacgcccgacagtatatccagcaggttagagacgcccgctttctctttgatatcgtagcgcaccactggcggctcttcagaatcggtgacggcgcgtttaatcttcttcacgaccgctttcggatcttccagcaggccgatcacgttattgcggttatcgtcagacttggacatcttcttcgtcggttccagcagcgacatcacgcgcgcgccagacttcggaatcaacggctctggtactttgaagatatcgccgtagatcgcattgaagcgatgcgcgatatcgcggctcagctccagatgctgcttctgatcttcacccaccggcacctggttggtctgatagagcagaatgtcagccgccatcagcaccggatagtcgaacagaccggcgttaatgttctcttcgtaacgcgctgatttatccttgaactgcgtcatgcggctcagttcaccgaagtaggcgtagcagttcaggatccagctcagctgcgtgtgctctggcacatgcgactgaacgaagatggtgcttttttgcgggtcgataccacaggccagatagagcgccagcgtgtccagcgtcgctttacgcagtgcaacaggatcctgacgcacggtgatcgcgtgcagatcaacgatgcaataaatgcagtggaaatcatcctgcatctgcacccactgacgcagcgctcccatatagttgccaatggtcagttcgccggacggctgtgcgccgctgaaaacgatgggtttcatacttatgtcctgatatttacagccccagagcgggcaaaagttcgtcgaaagagtcgagggttaaatcgggctggctggcggcaatcggctcgccatagttatagccaaaggtcatgccgatattgggtacgcccgccgcctgtgccgcctggatatcattgcgtgagtcgccgacaaacagcaactcattcggcaacacaccaaaggtgcccagcaccataaaaattgccgcaggatgcggttttttaaccggcacatcgtcgccaccgataatcagcgaaaacgcattagcaatgccaagcgactccagcagcggtgccacaaacggcgtcggcttgttggtgactatcgccatcggcagcccggcagcctttaatgcggccagcgtctgctttacctgtggaaacagcgtactgcccgcatccacggtatcggcataatgccggtcaaacagtgcccgcgcatcacgctgctcttctggctgcggctcacggcccagcgcgaaggtcagcgcgcgggccatcatgatatccgcgccgttgccaatccaggttgagacacgctcaaggcccgcctgcggcagacggaggtcattcagcgtgcggtcaatcgcatcggccaggccgggtgcgctatccaccagtgtcccatcaagatcaaacgccagcgcacgaatatcagtgaaatgagccattggccttctccagttcgttgcgcatatcgtcgatcacttttttatagtcagggtgaccgaagatcgcggaaccggcgacaaacatgtcggcaccggcggcagcgatctggccaatgttgtcgatcttcacgccgccatccacttcaaggcgaatgctgtaaccgctctgatcgatacgcctgcgcgcttcacgcagtttatccagtgtgccaggaataaatgactgaccgccaaagccagggttcactgacatcagcagaatgatatccagcttatccatgacgtaatcgaggtagctcagcggggtcgccgggttaaacaccagacccgctttgcagccatgctctttgatgatttgcagggtgcggtcaacgtgttcgctggcttcgggatgaaaggtgatgtaggtggcacccgctttggcgaaatcagggattagcgcatctaccggcttcaccatcagatgcacatcgatgggggcagtgatgccatagtcgcgcagtgctttcagcaccatcggacccatggtcagattaggcacgtagtggttgtccatcacgtcgaagtgaaccacgtcacctccggccgccagcgctttggctgtgtcttcgcccaggcgagcaaagtccgccgaaaggattgaaggggccagcaaatattgtttcatccgattctcccactgttgtgcgccagcacgcaggctggcgtaatgcgttggtcgcggacgaaacagactagctataaagtgccagcagttcgtcgaccttggtgcgacccgttatgcttcggctgatagaacgccgggctttgaccacatgtaactctgcatcctgataccataaacgcgtcagtgcagtgtcgtggttagaaatcagtaccggtatccggttctccgacgaagccagctttgccgctaacgccgccaggttttctcctgctcacgcaggctgaagctgttggtgtgataagccgtgaaattggccgttgccgacagcggcgcataaggcggatcgcaatagactaccgagcctttaccggcattggtcagggtaacatcgtacgattcacagacaaacgtcgctttttgcgcacgctcggcaaaccataacagttctgcttcaggaaagtagggtttgcgatagcggccaaacggcacgttgaactcgccacgcaggttatagcgacagaggccgttgtaacagtgacggttcagatagaggaacaacagcgcgcgcaggtaggcgtcggtgctggtgttaaattcggtgcgacgctggtaataacagatttcgttgttactttccggcgtaaacagcagctgcgcgtcacggatgaaatccgccgtgcgcgttttaacaatgttatagagattaatcaggtcactgttgatatcagccagatggtagcgatcaaattcagtgttcagaaacaccgaacccgcgccaacaaagggttctaccagacagtcgccttgcggcagatggcgatggatctcttctactaagggaaattttccccctgcccatttcaggaaagcgcgattttttttcatgctgtcgtggttattacatcttattgtgaggctgtggctggaccgacagcagatctgcgcttaaaacggggccagaaactggccccacatccgctattggctggcttctttcttcacctggcttactggtttaacccacgggttcttcgcacgcacttcggcaggcagtgaggctaccgcgcgtttggcatcagccggtgtggcataggaaccactcaccagcacgtaccacgactgaccgttacgggtggttttgtagacgtgatacccactcagattctgctgcttagcccaggcattcaggctttccgccttcgatgcaccgctcagctgcagggtatagctgccgcctggcaatgatttgctggctgaactgctgcctgccgccgcagcagaaggggctggcgtacgtgctggcgtggtatgtgttttgctgtcacgggttgcaggcttcgaagcagttttatgcgatgaatcgtgcgccggacgggcagaagcgtttgatttgtttggcgtctgacggcctgcaggggccgtaaccggattcgcagccgttccggcattaccgctgaccgtggcaggcgctgttggcagtgaactgccaccctgcgtgcccatcgcggcactgtcgacctgctgctgctgattactcagcgcgctgttcagatcgcccggcagcgtgacacgctgctgatttgctggcgtctcaacaggggcggcctgcgtaggcgttgaagccacaggcggcattgagacgtcgcgctgcgggtcagacacagcattaccgctggtcgccgcgttattttcgctggtagctggcgtggtctgcccgccggttggcgtcgtctgtccacccgacatggaagaggagccggccaggtcgatattcttttcgctgccggaaccgccaccagcggcaggcgtattgcccgcagtcgcaggttttttctcatccgggccattcagcgccgaaccaatacccagtaccagtaacagcagaaccaggatcccgacacccatcatgatgcgctggcgcgaaaccggtattttggctgcgggagacgacttacgagggcgcgagggacggcgatcgctggcgtcaggttttaactcatcttccggtttaaactcatccattttgcctcctccgtaaagcggcattccgcactgcgcaccctgcgcgccgcgtcaccactcaactgcttaatctcaggattgctgacaatcattaattgcagccagcaccatatcatgtgccacgccaccacgcacttcagagcggccaatcgacagcgggagtaccagccgcaattcgcccgccagaactttcttatcgcgcatcatgtgcggcagatacatctccgcactcatcgcctcaggcccatgtaccggcaaaccggcacgcaggaacagggcaataatgcgatccgtctcctgcgcctggaactgccccaggcgttcagccgtgcgtgccgccatcaccatgcccgctgcaatcgcttcaccgtgcagccagttgccatagcccatgtgtgcttcaatcgcatgaccaaaagtatggcccagattcagcaacgcccgctgaccgttttcacgttcatcggcggccacgacttcggctttcagttcacagcagcgacgaatgcagtacgccagcgcctgttcatccagcgccagcagggcatcaagattctgctccagccactggaaaaacgcaccgtcgaggatgatgccgtacttaatcacttccgccagacccgacgccagttcgcgcgcgggcagcgtctgcagacaggcagtatcaatcaccaccgacgcgggttgataaaacgcgccgatcatgtttttgcccagcggatggttaacggccgttttgccgccaaccgaagagtcgacctgcgacagtaaggtggtcggtacctgaataaagcgtacgccacgctgataactggccgcagcaaaaccggtaagatcgccaatgacgccgccgcctaaggcgataagcgtcgtatcacgaccgtgcggcttttgcaggagcgcggtaaaaacctgatccatcacggccagcgtcttatattgctcgccgtcgggtaagatcacctgatccacttttacacctgccgcggtcagcagcgccgtcagctggtcaagataaagcggagccagcgtctggtttgtcaccaccatggcgttttcgcccgcggttagcggccaaaaagaagccggatcgttaaacagtccggcagcgatagtgatggggtaactgcgttcccccagtgagacggtgatcttctccatgatgcccgatacctgttaaggagccttcgaacgttggatcaacttttttccaacatgtggataatctgattcgccaccactttcgcactctgatcatctgtgcgaatggttacatcggcgatctcttcgtagagcgggttacgttcgccagccagcgcttcgagcacttcacgcggcggtgaatccacctgcagcaacggacgttttttgtcacgttgggtgcgcgccagttgcttctcgatggtggtttcaagataaaccacaacaccgcgggcggagagacgattacgcgtttcccgggatttgacggaaccaccgcctgtcgccaggacgatgccttgcttctcggtcagttcgttaatgattttttcttcgcgatcgcgaaagccagcttcgccttcgacatcaaaaacccagcccacatccgctccggtgcgtcgctcaatttcctgatcggaatcgaagaactccatgttgagttgctgagccaactgacggccaatagtgcttttgccggcacccatcggcccaaccagaaagatattgcgtttctctgccattttgtcggtattactaagaattcgttaatgataccccgcgttcagcatttgctggcgggacaggaaactgagacctcatgagcgttagcaagagtcagatgaaaaattatctcaacactcaaggctgtttggcaaccgattatattgccttcagcacatccatttctgaattggcctgtgttcgcgaaactgtaacgcgccagcgctgcgtctttacaacgctgcgtacagaggagttttctgatctgtttgccgggatttacccagcatagacggttacaccgtattgaaaatcgctaaaccttgtaagctaattcctctcctgcgtcaacgcagatggccttaagggacgcattttccgttttatccagccgtaagcgctgcttccctgaccaatcgcggcgtaatgaagatcaccagctctctttttttgcgctgatcagattgctggcgaaacaacccgccaatcagcggcacatttcccagtagcggcacctgattctgtccgcgggtgcgctgctgctgaaagataccgcctaacgccagtgtttgcccgtcactgaccgtgacctgagtctcaatttcctgtttatcgatggataatatgtcgctatcgccggttctgatgctgcgacccggcatattctgactgatatggatcttcagctggatgcggccattgccggaaatcgtcggtgtcacctccatacccagtaccgcttctttaaactcaatactggtggccccgctgtttcctgccgacacttcataaggaatttctgtgccctgcttaatcgaagcggtctgctgatgtgaggtaaagaggcgcggactggcgataatttcaatctggttctcctgctccagcgcacttaactccagatccagaagctgccctccaatgcgcgccagcgccatacccacgctgatgccgggtgaactcaccgctagcggaacatccagccgcggatgatgcaggatatcagtaacggcggcgtcccccgcctgcaatccccacttcacgcccagctcctgcagatgctcctcgctgatagtgacgatgtgggctgacagttcaatctgttccagtggcagatccagcgcccgtatccagcgctccgtctcttttaaagccgccgcactatcgcgcagtaacaatgcgttggtgcgtttgtcgaccgtcacgctaccgcgcggcgtcatcagcgactgacgctcactcagcaggctggcatacacctcgctggcgctggcataacgcaatatcacagcgcgctgttgcaaaggaacctgctgcaactgcgactgctgctcagcctcacgtgcctgctgctgagcctgctgccagctttccggatagaccagcaggacattattctgttcaaccagcgtcagctttgccatgcgcgccaccaggttgagcgcctgatgccagggcaggttatccagccgcagcgataacgaaccttcaacctctggcgcaatcatcagattgatctgctgatagtcagccagcgcctgcaaaatacgctctaccggggcgttatcaaaagtcaggctgagaggctcctcatcagcggcgtaaaccggcagcaggcagcttagtagtagcagcagagtggttatccttatcatgcgaacgtccttttaaataaaatgcggcctgttgtgcgttgcagctattcggcaccgctaaggtgaggctgcggcgggtcatacccgccagttgccagggtgcgaatggaaatggcttgccggtgcgggccgtaatactctctccctgcggggtcagcagccaggcatggaaatgcgcctcccggccaatgatcccctgcagacgccagccggtgagcggttccactgtcgcctcacagacggaaccggctacaggccggaacggatcgcgcgccagcacgccgccacagcacaacagtaaaatcagcagactatggcgcatcgtcaggttccagccagagttgagccaccaggtactgcggctgcgccagcagctggaaatgcaccggaaacggtgcggaggcctgggccagctcggcaaaaagcgactggaacgccggccactgcagatgcagcgtcagcatgcgtgagggggcgtccggctgccactcttccagctggctacggcgtgccgccaggatctcttccactgcacggcccgatgcagatgctgatctcgcgatctgtatcgactgcagctgcgcctgcaactgtgcattatcggggttctgacgccactggtgctggcgcagctgcagagtgcgggtcaactgcaacagcgtctgctgttcagcaatgagcgcctgctgctgtggccgtaaccacaggatccaggagagcagcagcagaccggataagagtgcggcgagcaagccatagcgcgcaatagcggccatctgccaccagcgctcccaccattcactcactgttcacctcctgcatctctgcccgcagtgaaaaccgataatggccatcagcctgacgcttaaccccgccctgcttcaccagaccaaacagggccacagtggttaattgctggcggaactgtcggactgccgccatatcctgtgcctgcccctccagtgtcagacggtcgtcgcgcttctccagccgggtcagccaggcggtgtcgggaagtaacgcgggtaaatcgagccagaactgctgccaggcggccagttgtgcagcctgctggcgatgcttcgcctgctgtttttgcacgaccgcgagctgctccagtaactgcttctgttgcgctaactgctgccccaggctttccagcgcctgctgctgcgtcctgctcgcctgcgccacctgctgacgcgtctgctggatccgccaggtttgctgcatcaccaccagtaacagggcgccagtcgccagtgacagcacgaccaggctttgtcgccgctgctgttgccgacggcgctgccgccagggcagcagattaaccgcgaccatcactcatctccgtcgcgcagcgccagcccggccgccagcgcaaaagcgcccggattctccggcaaaggtggctgcttataacgaaacagatcaaaaggggaaaacgcgctaacgtctgcgggcaacggcgtctgctctgcggtacaccaggcgacagaaacgcgccccgggaaaggcctgccgttgcagtgcctccagcgtggcggcttcgcctgtgtcagcagcggtgtgcgcatcgctccagagccagcggttatcctgctgcagaaccagtaccgcatcgtcctgcagcgctgcctgccgggctaaccgcttcagcgcctcggtggtcagttcgaacacctgcggttttaaacctgcctgcaacaggggtgccgcccactggtcgataatctccagccgcgctgccgtgacgcagagctgaccgctctgcgcatccggccggtaatcaagcgccagcgcagcgggctccagcggaaagagacggcgcgcggccgcctgcacgtagtgccccagcgcgggctcattcagcgactgcgcaggaagggggagctggcgctgcagcaccagctgggcaggcaatccgacccgcagcgaataacggcgtggcaaccgctgacgccaggtcgttaaggccgccagtaattcaggcgaagattgcagcacgccgtttcttaacgtatcttgcggcagccgctgctgccaccagtggcgtagctgccagccatcacgacgaggctggagggccagggcgcaaatctgcctattctgaatatccagcccaatttgccaggtatgaaaagccatacgcgcgatctccttatcgtccgggaaaatggacatatcaaagcgtctggcttgcctttatactaccgcgcggttgtttataaactgctcaaacgacaacagatgggaaattccaggtgaagttcgtaaagtatttattgatccttgcagtgtgttgcatcctgttgggagctggctcgatttatggtttatacaaatacatagagccacagctgcccgacgtaaacacgctgaaagatgtgcgtctgcaaacccctatgcaggtttacagcgccgatggcgatctgatcgcccagtatggcgaaatgcgccgtattccgttgactctgcagcaagtgccacctgtgatggtgaaagcgtttattgcgaccgaagatagccgtttttatgagcaccatggtgttgatccggtgggtattttccgtgcggccagcgttgcgctggtctccggtcacgcctcgcagggtgccagtactatcactcagcaactggcccgtaacttcttcctgagcccggaacgcaccctgatgcgtaaaataaaggaagcgttcctggcgatccgcattgagcagttgctgaacaaagatgaaatccttgagctctacctgaataagatctacctcggctaccgtgcttatggcgttggcgcagcctcacaggtctattttggtaagccggttgaccagctgtcgctgagtgagatggcgatgattgccggtctgccgaaagccccttccacctttaacccgctttactcgccgagtcgtgccctgtcgcgccgcaacgtggtgctggcgcgtatgctggatcagcattacatcacgcagcagcagtatgatgaggcgcgtaatacgccgctggtcgcgaagtatcacggtccggaaatcgctttctctgccccctatctcagcgagatggtgcgtcaggagatggtgaaacgctacggtgagaatgcctacaccgacggttacaaggtctacaccaccgtgacccgtcgcctgcaggaagccgcgcagacctccgttcgcaataacgtcatggcctacgatatgcgtcatggctatcgcggcccgaccagtgtgctgtggaaagtgggtgaaccggcctgggatcagaccaggattgagaaagcgctgaagacgctgccggtctatggtccgctcaatccggcagtcgtaacggaagcgcgcagcgatgaagcgaccgtgatgctgaaagatggcagcaatgtgtcgctggcattagccggagtgcgctgggcgcgtccttataagtctgacaccgtgcagggcccgacgccgaaaagcgtgacgcaggtattgcaggcaggccagcagatctgggtgcgcaaggtgggtgatgagtggtggctgggccaggtgccggatgtgaactcggcgctggtctcgctggatccgaatgatggtgcggtgcgcgcgctggtaggcggctttgcctttaaccagagcatgtttaaccgtgcgacccaggcgctgcgtcaggtcggctctaacatcaagcctttcctctataccgccgcaatggatcgcgggctgacgctcgcctcaatccttaacgatgtgccgatttcacgctgggatgcgggtgcgggtgctgactggcgtcccaagaactcaccgccaacttacgatggtccgattcgtctgcgtcagggtttaggccagtcgaaaaacgtggtgatggtgcgtgcgatgcgtgcgatgggcgtggattacgccgctgagtatctgcagcgctttggtttcccggctcagaacattgttcacaccgaatcgctggcattaggtgcggcctcatttaccccgttacaggtggtgcgcggctactccgtgatggcgaatggcggcttcctggtcgatccttacttcatcacccggattgagaacgaacagggcggcctcgtatttgaagagaaaccgaagatcgcctgcccgcagtgcaatctgccggtgatctacggcgagaccaaaaaagcgctggccctgaatgaagagagcgtcgagaacgttgcagcctcaaataacaatcagaatcaggccgttcctcagcctgaactggagcaggttcccgctcaggcacaacagggtgagcagcaatatgcgccgcacgtgatcaacaccccgctcaccttcctgatcaagagcgcgctaaacagtaacatctttggcgaaccgggctggatgggaacaggctggcgtgccggacgtgacctcaagcgtaatgatatcggcggtaaaaccggtaccactaacagctcgaaagatgcctggttctcgggttacggccctggcgtggtcacctcagtctggatcggctttgatgatgcgcgccgcaatctgggccgcagcacgctctccggcgccattcccgatcagatttcgggctatgaaggcggtgccaagagcgcgcaaccggcatgggatgagtacatgaagagtgcgctggatggtgtaccggtgcagccgttaacaccgccggatggtgtggtcaccgtcactattgatcgcagtaccggcaagctggcaaatggggggggtaacacccgtcaggagtacttcatcaatggcacccagccaaccgaatattcggttcatgatgtgggtaccaccattatggataacggtgagagtcacgagctgtttctgatgtgacccacgaaaccgcactgtaaaaaaggccgacgtcagtcggcctttttttattcagtcacagatgatattcagtaactcagccgcccctgcttcaccagccattcgcgcgccataaacagcgcactgacattacgtgcctcgcggaaatcgggttcatccagcagcgacatcatatcgctcagcggccagcggtggacaatcagcggctccggctcatcgccttccagcttttcagcgtaaagaccttccgccaccacgatgttcattttgctggaaaagtaagagggtgccatggtgagtttgcccagcgttgtcagctgatcggcaccaaaaccgacctcttctttcagttcgcgaactgccgcttcattcacggtttcacctgaatcgatcagccccttggggaaaccaagctcataggtttccagtccgacggcatactcctgaatcaggatcagatggtcatcaataatcggcacaatcatcaccgcttcacgctctgagggcttcatccgctcataaacgcgatgcgcaccattgctgaaagtcagatcgaccgattcaatggtgaataaccgtgaacgtgccacggcggtgatattgaggatgtcaggtttttttggaattttcatatcagcctcaaattattttgcgccggctatctggagcgaattagcatacctaaccacaggcaattgtgcgacagtcagacaatcacgttatcgttacacagattacatcgattgaataacagcctttggttatcagttaagactaaatttgcattagtcaatatgctgcgataagtttcagataataccgatatttaatccagtctgagccggttaccattcggacaaggcagggtttaacaaatgctaatcagatatacgctggcactatttcatcgggtgtctgactcctcagggttatataatcttccggaatgcctcttttatagtgagcataaccgaaagcgaaagtttaaagtgaaggcagcattttggctgaattgagcagagcatgagcacaatcttgatgatcctggccatagtgctgacctgttcaatcctggcaggcattgggtttctggtacgctatgcggcatcgtccgccgttggcgaaacctctgccatttatcagtccgccctgccgtaaactctctgctcaggagcgtgaggcggttgataagtatgtcgccgcgctggaaaagcagccccgtaccacggtgacgaccgataagcgcagcgcgtccgaacgactgacgctgacggcacaaagcaacaatgtctaccccgttacccgtgcgattacccgctacggactctctacggacgatccccataaatggcgctactaccttgatgaagttgaagttcatctgccgccgctgtgggaacagtacatcgccgacgaaaactacgttgagttaatccgcacccaatctattccgctggtgatctcgctgaacggccactcgctggtggattacgccgtggatcagcaatcgctgccgacgctgatgcgtccggtgtcgaccaacgcctctatccgcaaagcggaaacggaaaacgtcgaactgctgcaggtgcgcaaagagacgccggaagagtatcgtctgtcgcggccagatggcacgcgtgaagcggtgatcatctctcttgccttcttactcttcttcttcagcctgttagtccccgcaacgctgatgatctggctggtgctgacgggtgcagtcatgattgccgccagcctgtggctgctctaccgcattccgggtgagcgcggcctgcgtgacatacactgcctgcgcggcgcgccaaagcgctggggcctgttcagcgaatcgaaccaggagcagagcaatatcacgctggggattattgacctcgcctatccaccacactggcagccttatgtcgcgcacgatctcggacaggtgacggatgtggagatctaccttaaccgtcaggtggtgcgtcaggggcgcttcctgtcgctgcaggatgaagtcaaaaacttccctattcagcgctggcggaaaaacgtggtgctggcctgtggttcactgatggtgctgaccatgctggtcacctggatcccgctcggcatgccgatcaaactcagtctggcctgggccaggggcactgacagcctggaggtcagcagcgtcgataaactcagcagcgtgcccctgaatattggcgacaacctcaaagtgagcggtaccggcatgtgttcggtgccggacaactatcagagcaaccgaagttacgccttcatgccgttcgactgctcggcggtctactggaataacgccacgccgttgccgcagccacaatcggacattattgataaagcagctgctctgctggagaccaccacaaagcagctgcatccggaaaccaataccgatcctaaactgaatccgcagctggcctccgcgattcagaagtccggcatgatcctgctggatgacttctccgatctggtgatgaaaacgcaggatctctgtaatcagccacaggattgtatgcgcctgaaaaatgcgctggtgaacctgggcaatgccaaagactgggaagcgctgatgcgtcgcgcagattccggccagctaaacggcatgaatgtgctgctgcggccggtcagtgccgaagccctggaaaacctggtcaataccgccacctcgaccttctttttccgcgaaacccgtcgtgcagcggaaaatcttaacagcccgccgccagggggttttctgatcgtcagcgacgagggtcgccagctggtgaatcagcctcagccaaccgtgtcgctgtttgatctcgatccgccctctcagtggcgcgaaactgcaacgtatctccgccatgctgctgcatacgcctttcagcgccagcggcatcatcaccagcatttcaacggatgccaacggcacgcgtcatatcgtgctgcacaatgaaccggatgccatggcgcagtggcgctatctcggcaccgtattgctgctgctggtgctgttaacctgcggtgtgatcaatgggttactggcgctgcgccgtatgcaccttaatcgccagcgcatgatcgatatccagcactactacgacaagtgcttcaatcataacctcggcactttgcagagcgtgcgcccgatattctgagccctgcccttctgtgctaccctgtcgcccggtttttttacagggtgaaacatccgcatgctcaactggtctgagattgataccgtgctgctcgacatggatggcacgctgctggatttggcgtttgatcgccacttctggctggagcatgtgcctgaacaactcagtcagcaacgcggcattacccgggcggaagccgaagcaatcatcgcagaaaagtatcaggccgttgcccatacgctaaactggtattgtctggattactgggcagaagcgctggcgctggacatccgtgccatgacctgggcgatgcgcagccgcattgcgctgcgtgacgatacgctgccttttttgcaggctctgcgccgtgccggcaagtccactatcctgctgaccaacgcgcatccttacaatctggacgtcaaactagcgcagacaggtttagcgccgcaccttgatttattactttccacccatacctttgggtatccgaaagaagaccaacgtttatggcaagcggtacaacagcacaccggcttttctgcgccgcgcacgctgtttatcgatgatagcgaagtgattctggatgctgcggcgtcatggggcatcggcgagtgcttaggcgtaaagaaccccgattcgggtcgtcctgagcaaatctttcagcgtcatcgcgccaccggcgactaccggacgctgatctgagtcaggagcagcaatgaagaaagagaaaagcagcgaagaggtacgcctcgacaaatggctgtgggccgcgcgcttttacaaaactcgggcgattgcgcgggagatgattgaaggcggcaaagtgcattacaacggccagcgcagcaaacccggcaaggtggtagagctgaatgcggaactgacactgcgtcagggcaacgatgaacgcaccgtagtggtggcggacatcagcgctcagcgccgtccggccagcgaggcccagcagctctatcgcgaaaccgatgccagcattgaaaaacgcgaaaaaatggcgcaggcgcgcaaaatgaatgcgctgactatgccccatcccgatcggcgacctgacaaaaaagagcgtcgcgatttgatgaagtttaaattatcgggcgatgaataacgccgtcttagctgacgcgccatcgccccgtaccagtgagagaaaaaatatgtcagcccaggatcaactgcaccgttatctgtttgaaaatgccgccgtgcgcggcgagctggtgaacgtctctgacacctggcgtgaaaccgtaaagaaccatgactatccggcaccggttaaaacgctgctgggtgagatgctggtcgccaccagcctgctgactgccacgctgaagtttgatggcgaaatcaccgtgcaattgcagggtgacggtccgctgtcgctggcggtgatcaacggtaacaacaaccaggaaactgcgcggcgtagcgcgtatcaaaggcgacatcccggacgacagtaccctgaaaagcatggtgggcaatggctatctggtgatcaccatttcccctgaaaagggcgaacgttatcagggagtggtgggactggaaggtgaaactctggcggagtgcctggaagattacttcatgcgctcagagcagttgccaacgcggctgtttatccgcaccagcgacaaaggcgccgcgggtattctgctgcaggtgatgccggcgcaggatacggagaaagaggttttcgaccatctggcaacgctgaccgaaaccattaaaacggaagagctgatcgatctgcctgcgaatgaagcgctgtggcgtctctaccatcaggaagaggtcaccctctacgatccgcagccagtgatctacaaatgcacctgctcgcgtgagcgctgtggcgaagtactgaccacgctgccgcaggaagaggtagatgagatcatcgcggaagatggcaaaatcgacatgcactgcgactattgcggctcaaactatgtgtttgacgccgtcgatatcgccggtattcgcagccactcccttgagaataataaccagcttcactgatttatcgggcggcttctgccgccccttccccgccgcccatgcctatccccataatttttcagacaaattatctttttttactttcataacatcttttaaacgttcgaaacatagccttaacgcgccctgagtcgcatttttagatcactgctctttttcccttaacgcagaagagtaaactgcgcgcgatcgtgcaaacgcccggaagtcagaggcagatgccctgaattgcccggtgatctttgcaggctgtcgtgacgaagcgcagtcgactgtcagtgatttgccgcacccgatacaacagccggtggcacgatcccaacctatctctgctttgcagaacagacaccgatttaaggagcagtaaaatgcgcgttaacggcctgacctcgcaagaccttgccgctttgggcatcgtggataccacggaagtggtttacaaccctgattacgacacgctttttcaggaagagacgcgcccggacctcgaaggttttgctcgtggcaccctgacgcagagcggcgcgattgcagtagacaccgggattttcaccgggcgatcgccaaaggataagtacattgtgcgtgacgacaccacgcgcgataccctgtggtggaacgaccagggcaccggcaaaaacgacaatcagcccctgtcgcaggagacctggaacgcgctgaaaagctgcgtcacccgccagctttccggcaagcgcctgtttgtggtggatgcgttctgtggtgccaatgccgattcccgtctgagcgtacgttttgtcaccgaagtggcctggcaggcacacttcgtgaagaacatgttcatccagcctgacgacgctgaactggccgaattcactcccgactttgtggtgatgaacggcgccaaatgcaccaatccagactggcaggcgcagggtcttcactctgaaaactttgtcgcctttaatctgactgaacgcatgcagctgattggcggaacctggtacggcggcgagatgaagaaaggtctgttcgccatcatgaactacctgctgccgctgaaaggcatcgcctcaatgcactgctcagcaaatgtgggtaaagcgggcgatgtggcggtcttctttggcctctcgggcaccggcaaaaccacactttctaccgatcctgaccgccagctgatcggtgacgatgagcacggctgggacgatgatggcgtgtttaacttcgagggcggctgctacgccaaaaccattaacctctctgagcaggctgagccggagatctaccgcgccattcgccgcaatgcgctgctggaaaatgtggtggttcgcgaagatggcagcgtcgattacgacgacggcagcaaaaccgaaaacacccgcgtctcctatccgatcaatcacatcgacaatatcgtgcagccggtctcaaaagcgggccacgcgaagaaagtgattttcctgaccgccgatgcgtttggcgtgctgccaccggtttcacgtttgacgccggagcagacgcagtatcatttcctgtcaggtttcactgccaaactggcggggaccgagcgtggcgtcactgagccgacccccaccttctccgcctgtttcggcgcggcgtttcctgatgctgcatccgacgcagtatgcggaagtgctggtgaaacggatggaggcgtcaggtgcgcaggcttatctggtcaataccggctggaacggcagcggcaaacgcatctcactgaagaatacccgcgccattatcaatgccattctggcgggtgagctggatgatgcgccgatggaaacgctgccgatctttaatctgcagatgccggttacgctgggcgaactggatagtgatacgctcgatccgcgtcgtagctgggagagtgaggagaagtggaccgccgccgccgaaggtctggcgcagcgctttattgataacttcgacaagtacacggataacgccgcaggtgctgcgctggtgaaagctggcccgcaacgctaaaagaagcggcgcggcaatgaaactgccgcgccgtttttatcatcccgacacgctgttgctgccgttgttgtggctcagcgccatgctttccactaacggcaaccaggcacgaatgcgtaaaccgccgcgttcgctctcgccaatctccagcgagccctgatgggcatcgatgatacgctgcacgatcgccaggcccagaccggttccgctggtgctgcgggcgctgtcgccgcgcacaaagggctggaacagatgcgccagctgatccggcttaatgccaggtccatcatcttccacctggaaccaggcacgatgcagttcccgtccgctgctgaccctgatccagccattaccgtatcgcgcggcattgaccaccaggttagccagtgcccgtttaatcgacagcgggttgatatccagcattaactcttccggcatcaccgcattttcgatctcacgttcatagccgctttcagcggccaccacttcgcccagcacactgttaaggtcggcgcgctcagtctgcatctcctgaccggtacgcaggtagtcgatgaactgttcgataatggcgttgcactcttcgatatctttattaatcgattcggccaggtagccatcctgctcgctcatcatctcggtggcgagacgaatacgggtcagaggcgttcgcaaatcgtggctgacgcccgccattaacagcgtgcggtcatccgccagctgcttcaccccggccgccatctggttaaaggcgcgggtcaccgatcgcacttctgacgcgccatactcgcgcagcggcggcggaataatcccgcgcccgacctgcagagcggcgtgctccagatccaccagcgggcggttctggatgcggataaacagccaggcaccgccaatcgccagcagcataatcgccagggtgtagcggaacagcggcgagaagtcgccctgatgaatctcagtcagcggcacccgcacccagatatcgggcgacagccaggttttcagccagacgacgggcgagtttttgttaacctcaacccgcacatcggtgggaccgccaagctgctggcccatctgctcgctcaggaattcatagtgctgcgcccatcgcaatccgctctcctctgctgctgcattggtgtagagcgagatccccagtttcgcggtagatttcccggcgaaacgccggtggcacttccagctgcgtgccatcttccagctgcaaccggtcggtcatcagcatacgaacttcgtaagcgagcaccttattgaactgttgcaggctgggaagaatggcgaagttcagcaccaccagataggtcgttaccaggctgacaaacagcagggtaacgatcagcagcagggtgcgggcaaacgaactgcgaggcgagaagcgcagtcgcttcatgctttactgccgtccggcacaaagacgtagcccagaccccagacggtctggatataacgcggatgcgcaggatcctcttccaccatgcgacgcaggcgggagatctggacgtcaatcgaacgttccatggcgctgtattcacggccacgcgccaggttcatcagcttatcgcgagacagcggctcacgtggatggctgaccagtgctttcagcaccgcaaactcaccgctggtcagcggcatcggctcatcttcacggaacatctcgcgggtgccgaggttaagtttgaacttaccaaaggcgatgatcgcctcttcctgcgaaggtgcgcctggcagttcattggcctgacggcgcagcaccgcacggatgcgcgccagcagctcacgcgggttaaagggtttaggaatatagtcgtcagcgccgatctccagccccacgatacgatccacctcttcgcccttggcggtcaccataataatcggcatcgggttgctctgactgcgcagacgacggcagatggaaagaccatcttcgcccggcaacatcaggtcgagcaccatcagatgaaaggattcacgggttaacagacgatccatctgctcggcattagcgacactgcgcacctgaaagccctgctcggtgagatagcgttcaagcagtgcacgcagacgcatatcatcatcgacgaccagaattttgtagttctcttgcattttcaactcccaaaggcgctattgcctgagccaacattgttaaaaaaagatgccttatagtgacagtcattaatggtttatattctagccaaaattgttacaaagcatattaaacaggagcttatatttgatttaaggcgatttcgggtcagttttaacgcgtctggcgctgcccggcccctgttacggcaaatctgaaaaaacggctctgtttctctgaatcgctggcgtcagaagcgggccagtttttattcgatgaacgaattcagcaagttagcagacaatttgacttaatgatcagccatcattgtggataagctccagataatctacctcaacagcagtcaggcagcataatattccagcaaacctgcgtaacgccccactctcctctcggattagtttcagcggtgccaccagcaagaccagttgaaattaaagtccgttaaatcaatcagtaaagccaacttttcgccatctccgttttcaaccagactgctcaggcaacattcgatgtctcaacggggattacacacaatgaaaaaaacaattttactgctgagcgcgctggcattaagcagcgtcactccagcttatgctgccacagccaccggtgaagcagctggcgcagcggcaaccaccacagcacaaggtaactctaacgccatcggtgttggcgcagtcgcagccctgctgggcgttgcgctggccaccatgggcggcggcggcggtgacggtcacagcaccggtacatcgaccaccacggcgactcacgccggtaaataagtatcacgacttcttttacagcttcagattactggcttcagattgttgttcagcaccaaccctttcgccgccggggaagtcaacgtgggtttttagcctttaaaaaccctttccccgcccttttttgccgcgccccctttgtcttacactgttcctctttggatctctctggccggtatagcatgaaaacccgactcattacccgcgaaggcttcgataagctgaaagcagaactcgactatctctggcgtgaagagcgaccggaagtgacaaaaaaagtcacctgggctgccagtcttggcgatcgcagtgaaaatgccgattatcagtacaacaaaaaacggctgcgtgaaatcgaccgtcgcgttcgctatctgaccaaaagtcttgaacagctgcgtatcgttgactattcaccccagcaggatggcaaagtcttctttggcgcctgggtggaaattgaaaacgatgagggcgacctcaaacgcttccgcattgtgggctacgatgagatttttggccgcaaagattacatctccatcgactcgcccatggcgcgggcgctgctgaaaaaagaggtcggcgatgccgccaccgtcgagacgccagtggggccggcgctgtggtatatcaacgcgattgactacccgcaataacccttcagattatcgctgaaagccgcccgcgtctctggcaattttaaccatcaatccgtataactgtcggctatttctcaacccggaaagcaagacaatcctgatgatgaaagttctgagccagataattgccagtgagctcaaggcgcgtccagagcaagttgacgccgccgtttcgcctgctggatgaagggaataccgtgccgtttatcgcacgctatcgtaaagaggtcaccggcgggctggatgatacccagttgcgccagctggaaacccgcctcagctatctgcgtgaacttgaagagcgacgccagtcgattctgaagtcgattgacgatcaggggaaactcactgacgacctcgcccgcgcgatcaacaccaccctcagcaaaaccgagcttgaagatctctacctgccctacaaacagaaacgccggacgcgtggacagatcgctatcgaagcgggtctggagccgctggcggagacgctgtggcaggagccgtctcacattcctgagcagcttgccgaacagtatgtcgatgccgacaaaggcgtcgccgacgtccgtgccgcgctggatggtgcccgctacattctgatggagcgtttcgctgaagatgccgcgctgctggcgaaggtgcgtaattacctgtggaaaaatgcccatctggtgtcacgcgtggtggaaggcaaagaggaagcgggcgcgaagttccgcgactactttgatcaccatgaagcgctgagcggcgtgccgtcgcaccgtgcgctggcgatgctgcgtggccgcaacgaaggcgtgctgcaactgtcgctgaatgccgatccacagtttgatgaagcaccgcgtgaaagccatggcgaaacgctgattgctgagcacctgaacctgcgcctgaataacgctcctgccgacaactggcgtaaagcggtggtgagctggacgtggcgcatcaaggtgatgctgcatctggaaacggagctgatggggacggtgcgcgaacgcgcagaagatgaagcgattaacgtctttgcccgcaacctgcacgatctgctgatggccgctcccgccggtatgcgcgccaccatggggctggatccgggcctgcgcaccggcgtcaaagtggcggtggtcgatgccaccggcaaggtcgtcgcgaccgataccgtctatccgcataccggccagaccgcgaaagccgcggccgccgtagcggcactctgcattaagcatcaggttgagctggtggcgattggcaacggcaccgcttcacgtgaaactgagcgcttcttcctggatctgcagcagcagttcccgcaggtcacggcgcaaaaagtgattgtcagtgaagctggcgcatctgtctattcggcctctgaactggcggcgctggagttcccggatctcgatgtttcgctgcgcggcgcggtgtcgattgcccgacgtttgcaggatccgctggctgagctggtgaaaatcgatccgaaatcgatcggtgtgggtcagtatcagcatgacgtcagtcagagccagctggcgaagaaactcgacgcggtagtagaagattgcgtgaacgccgtcggcgttgacctcaacaccgcctcggtgccgctgctgacccgcgtggcgggcctgacgcgcatgatggcgcagaatattgtcggctggcgtgatgagcatggccgcttccagaaccgtcagcagttgctgaaagtgagccgccttgggccaaaagcctttgagcagtgtgcgggcttcctgcgcatcaaccatggcgataacccgctggatgcctcaactgtgcatccggaagcctacccggtggtggagcgcatcctggccgccaccgagcaggcactgagcgatctgatgggcaacgcaggcagcctgcgtaatctcagcgcccgcgatttcattgatgaacgttttggtctgccgaccgtcaccgacatcatgaaagagcttgagaagccgggccgcgatccgcgtcctgagtttaaaaccgcacagttcgctgaaggcgtagagacgctgaacgatctgacgccgggcatgatcctcgaaggtgccgtcactaacgtgaccaacttcggtgcatttgtggatatcggcgtgcatcaggatggcctggtgcatatctcttcgctctccgatcgcttcgtggaagatccgcatcaggtggtgaaagcgggcgatatcgtcaaagtgaaagtgatggaggtcgatctccagcgcaagcgtattgctctgaccatgcgtcttgatgagcagccaggcgaaggcaatgcccgtggtggcgcgaagaacgctgctccgcgcgaggagaaacgtcagaacaacgcgaaaggtcgtccgcgtccggtcagctcgtcagcaggtaacagtgcgatgggtgatgcgctggctgcggctttcggtaaaaaacgctaagcttttcagggggccactgcctggccccctcttcacacccttctccccggttgaaaatccccgccatcgcgctacgctaaaaagacgcctgtcataaaaacaacacctgctgtggcacccaattcacgatggaaacgatcaccgatctgattgataagatttatgctggcacatttccggaggcgacctttgcgcgcctgctggctgacatcgccaccgcccgcgaggccattaagctgccgcgcaaggcacactgggatgagcaggatgtggtgctgatcacctatgccgatcagtttcgcgaagccgataaacccacgctcagcaccttttcccggttctatcagcagcacctgcaatccacgtttccgctggttcacctgctgccctttttcccctggtcgtccgatgacggcttttcggtgattgattaccatcaggtcgatccgctgtgcggcgactggcaggacattgcgcggctgcatcaggaaacccggctgatgttcgattttgtctgcaaccatatgtcggcacacagcgcctggttcagccacttcctggcgcaggatcccggctgggacgatttctttatcagtatgccgcccgccaccgatctcagcgccgtgacgcgtccgcgcacctcgccgctgctgacgccgtttaaaatggcggatggcgaaacccgctttatctggaccaccttcagcgctgatcagatcgacctcaactttgccaatcctgaggtgctgctgcgcatggtcaatgtgctgctcgactacctgaaacgcggcgctgactatgtgcgtcttgatgcggtcggctatatgtggaaaacgcccggcacgcgctgtattcatctggaaaagacccatcagctggtgaagctgtttcgcgctattgccgaccaggttgcgccaggcacggtgattatcaccgagaccaacgtgccgcatcaggacaacatcagctatctgggcaacgggcacgatgaggcgcagatggtctatcagttttcgctgccgccgctggtgctgcatgcgattcacaccggctcggcgcgcgcactgcggcagtgggcgagcgctctggatctcagcagcaacgacaccacctttttcaactttctggcgtcacacgacggcatcggccttaatccggcgcgcggcattttgtctgaagtggagattgtggcgctggtgcgcgatctggcgctggaaggcgcgctggtctcctataaaaacaaccctgacggcaccaccagcccctatgaaatcaacgtcacctatctggatgcgctcaaccgtgaagatgacgatgacgccacgcggctgaaacgttttttgctggcccatgcgattctgctggtctttcccggcgtgcctgccatctatatccagagcattctgggtggtcgtaaccattacgatggcgtgcgcgccgccggacacaaccgggcgattaatcggcagaagtatgatttacagcagatagaagcggatctggcgggcggtaactggctgcgccagcaggtctatacgcggctcggccagctgattcagctgcgtcgtcgccagcctgcgtttcacccggataatccgatgacgctttatgagagcgaaaacgccgtgctggtgctcagacgtcatcagccagaaagcggtgacgggctgctgtgcgtgtttaatctcagtggacggtcagtggagacgcaattaccggtggcgcatacgttgcaggatgtggtgagcggagagaaaattgatggcacccagccggttaagctggatgcctggcagttcatgtggctacgttaattacttgtagacttcagccgttgcgctgaatttaccgtgttcgcggcctgcgatcacgcggtagtatttaccgcccttttcgtcagcgagcttcgacaacactttcttagcatccattggcgaggtggtttccgccgtggtgttaacgttgccgatcttttgcaggttcattgttttaacttcttcctgggtgacttctttcgctgccatcgcagaaaatgaaatcgcgcccatcatcattgaagccacaacccatttaaaaaccttcattatgtttaccctcattcatgatccattgtgagatgtaagcagccgctaaacgcgtaaggcagtatggaacggcatagtcatttccatgactaatcacataaaattgcaacggcctcgctcacagagagaagtattgctgctgtctgcgattttgccagttcaaagcgtcattatcacggcagattactgataaaattaacaatatgctggcaaaagctctcaggatgggaaataaaaggcgcatgtgcggctttttcgataaccactgagggcgatgctggcaacatttcatcaatctccgccacaatccggcgcggcaccagtccgtctaacgcgccatagagccgcaggaaacggcagcgtaatctgcggtaacgcgtcgcgcagatcgacctggcgcagaatctccagtccgccatccagcaccgccacctccggcatcggctgcgacagcaccacctctttcagctgccgcgcatcggcgcgagccgtttcggtacccagcgtctgcagcgccagaaagcgctccaccgtgcgctggaaatcgttgctgagcatctgctgaaagttctgcagcgtctccggtttaatgccgggccagctctctgtggcggtgaaacagggcgacgaggcaacggtgatcaatgcagccagtttttctggcgcactcagcgccagctgcgtcgccaccagtccgcccagcgaccagcccaccacaatcgactgcggtggcagcgcaggcagcaattgcgctgccatctgctccagcgtcagcgcaccgaaatgctggctgcggccatagccgggcagatcgaccagatgcaggcgatagtgcgcgctgagtcgcggaatgatgctttgccagacttcggcattcagtccccatccgtgcagcagcacaagatcgcgttttccttctccgcaggtgtgccagtagagcgacgtcatcagttactatcccgaaaatgataaggaggtcgctatgctagcaatgcccgccctgtgttggctatgccggatgccgttgcggatagcccggcacggcatctgcagcttatgtctgcgcggattaccgccgttaccgctgctctgtccacgctgcggattgccggcaggttcagcaaaggtcgcctgcggccgctgccagcttaaaccgcccgcctggcaggcgctggtctgcgtcaatgactattgtccgccgttcagccagtgggttaaccagcttaaattttctcacataaccgcactcagggtgatgctggcgcggctgcttttgctaagctggcttaatgtttaccggcgtggcagtgtgccgcgtcccgatctgctgctgccggttccgctgcatcggcgacgacgctggcagcgtggctttaatcagacggtactgctggccgcaccgctggcgcactggctgggatgtgaatggcgcgaaggtctttcccgcaagcgcgggggcgcattacagcatcagctcagcgcccgccagcgccgcaccaacttacggggtgctttctgccttgaaatggtggtgcagggacgccatatcgctctgctggatgacgtcattaccaccggcagtacggtagatgaaatcagccgcctgttaatggcccagggtgccgccagcgtgcaggtctggtgcctgtgccgtaccttgtagagcgtctttgatgggcgtattataaccaactaaattagtcaactattgagcaatcgacatgatccgaattactgactctgcccaggaacatttttctaaactgctatccaaacaagaagatggcacccagattcgcgtattcgtgattaacccgggtacgccaacagccgagtgtggcgtctcttactgtccgcccgatgccgttgaagctactgacaccgaactgaagttcgaaaagctctctgcttacgttgatgaactgagcaagccgtatctggaagatgctgaaattgacttcgttaccgacaatcttggttcacagctgacgctgaaagcgccgaatgccaaaatgcgtaaagtctctgatgatgcgccaatggttgagcgcgttgagtatctgcttcaggcgcagatcaacccacagctggccggccatggcggtcgcgtgtcgctgatggagatcaccgatgagggctacgccattctgcagtttggcggcggctgtaacggctgttcgatgatcgacgtgaccctgaaagatggtatcgagaaagagctgctggccgccttcccggaactcaaaggcgtgcgggatattactgagcatcagcgcggtgaacactcgttctactgatgattaagcgcggcagcctggctgccgcgcttctgttattgccctttctgtcctgactgacgctgctggctgaccaccttcagcagtgcattcacttccttgtccgcaaagatctcctccagcgttttgctcagcttgcgtcgccagttagggtactgctccaccgtgcccgggacgttgaccggcgtggtcatgccaagccagtcctcaggctgcaggccaagcagcgcactgtcggtatccgccaggaagcgatgtattgcccgattcagcacaggcgtcatggtgagcttctctgccttcttctggctgcgtgccggtaaggcgcccgcctgatgcagcgcatccagcagcgcctgcttctgcgcggcgcgctgctgatgtaacgctttcaccgcatcgcccggatagaggccaatcttctcacccagcgccaggtcgccctgctcccagaagccggtcagcgtaggcagatcatgcgtgctggcgctggcgatcgactggcgcggatagtcctgcggcgcgcgatagcgctcatccttctcctgctcaaaccagagcaccttccatgaaaagacgccacttttacgcagcaggctgacaatctcctggggcacagtgccaaggtcttcaccaatcaccatgcagcgcagccggtggctctccagcgccaggatacccagcagatcgttgaccggataggccacataggcgcctttatccgccgtctccccggcaggcacccaccacagacgcagcagtgacatcacgtgatcgatgcgcaacgcgccgcagtcgcgcatattggcgcgcagcatgtcgataaatggctggtagccgcgcgccttcattacatgcggatccatcggcggtaagccccagttttgtcccagcggaccgaggcggtcaggcggcgcacccaccgaggccttgaggcggtaaagctccgggtcgtgccaggtttccgcgctgccttccgccacgcccactgccaggtcacgatagagtccgacgctcatgcccagcgcctgactgtgcgtccagcagccagagaactgctgctgcgctagccattgcagccactgccagaaagcgatctcctcatcatgctgtgcacaccactgctgcacctccggcaactggctgttgcgccacgcttccggccacgcaggccagccgccctgctgcgccttgtctgcccgccgctccagctgtatgccgtcgtaagcggcctgataacgcaggctgtcgccgccttcacgcacaaaggccgcccaggattgatgctcttcgctctggctgtctcgcgtctgaaagtgtgcccaggcgagccgcagcgcagcgagcttaagcgccattacggcctcgtaatcaaccagctccgcctcacgcgctttggtcagcgccttccgggttctggcgcttttccaccacttctgtgccgccgcgctttgctgaaaatcggctacctgactgacgtcgatatagattacgttcagccagcggcgcgacgacgggctatacggactggcgaaaccggcgctggcgggatagagcgcatgcagcggattcagcccgacgaaatcgccaccgcgttcagccagctgcaccagcagctgatcgagatcgccgaagtcgccgatgccccagttctgttcagagcgcacggtgtagagctgcaccagcgcaccccagcgtttttcccccgcctccagcggcggaggcagatagcagcggcgcggcgcgacgataatccgcgtctgccagctttttttgcccttactgagtgtgagctggtggtacccctgcgccagcgggccaggcagtgtaaaaggctcactggcggttaactcgccgctgtgctgtttgccgttttcagtctgcaactgccagcggtaaacgccgctgccctgtggcgtcagctgtcgcttgccactgccgctgaacaccgcgaccggcggcagcggcgatttttttgcgtcctgcggatcgtccatcaccgccagcagcgcctgcagggtctcatcgctgatcgcctctttctcgccattgacgttgatgtagtccagtgaaattcccgcggcacgggcggcctgaccgagtgaatgttgcttcattgctgctccttagcgcggtgcctgccagatacgttgctgatagtcacgaattgaccggtccgaactgaacatgccggttcgtgccgtattgaggatggcggcgcgggtccagccttccgggtcgcgccacagggcttccacccgttgctgcgcctcgatgtaggcctggaaatcggccagcaccagccagggatcgccatgtttcgtcaggctctccagcatcaggtcaaacgcatgtttatccccgttgctgaatttgcccttctccagcgatttcagtagatcgtccagcggcttgttctgcttacgcacctttttcgggttatagcctttcgccttgagcgctttgacctcatccacggtgtgaccgaagataaagatattctcctcacccacctgttcggcaatctcgacattggcgccatccagcgtgccaatcgtcagcgcaccgttcagtgccagcttcatgttgccggtgccggaagcttcatatccggcggtggagatctgctctgagagatcggccgccgggatcatcagttcggccacggtgatgcggtagtccgggatgaacaccactttgagtcggtcaccgacccgtggatcgttgttcaccacctccgccaccttgttaatggcgtaaatgatatttttggcgaggtaataacccggcgcggctttggcaccgaacaggaacacccgtggcgtaaaggtgacatcctccgggttatgacagagcttctgatagcagtagaggatatgcagcaggctaaggtgctggcgcttgtactcatgcagccgtttgatctgcacatcgaacagcgcggccgggttcacgataatccccgtgtggcgggcgatatactccgtaagctgcgctttgttctgctgtttgatgctgcgatagcgctgacgaaacgcctgatcgtcggcatacgcctccagaccgcttaacgcctcaaggttattggcccactcggttttcagcgtctcatcaatcagcccggccagcgccggattacactgcttcagccagcggcgcggcgtgatgccgttggtaacgttgtggaatttctgcggccagagctggtgatattccgggaaaagatcgctgaccaccaggcttgagtgcagcgccgccacgccgttgaccgcaaagccgctgacgacgcagagattcgccatccgcacctgaccgtcagcgaccaccgccagcttgtgccacatcgctttgtcatccggccagcgctgcttcacctgctttttcagccgctggttgatctctttgatgatcagcatatggcgcggcagcagactgcgcatcagcttctcatcccagcgctccagcgcctccggcatcagcgtgtggttggtgtaggcaaacaaccggctggtgatctgccacgcctcatcccagctcagctgatgctcatccagcaacacgcgcagcatctccgggatggcgatggtgggatgtgtatcgttgagctgaatcacttcgaagtcaggcaggctgtgaatgctgcgtcccgccagatggtgacgacgcaggatatccgccaccgcacaggcgcactggaaatattgctgcatcaggcgcagccgcttgccggcctgatggttgtcattgggatagagcactttggtcagttttgccgcctcgatgcccggctgctccgcctgcagaaaattgccgtcattaaacgccgtgagatcaaaaggatgcgcactcactgcctgccacagacgcagcggcagcgtcacgccgttgcggtagccggtcaccggcaaatcccaggcctcaccgcgcagcgtaaaatcaggcagccagcgtacactgccgttttcctgcttttctacccggccccccatcgcgacttccacatccagcgccgcgttgtggcggaaccagggatagcgctcacgttgccagtcatcgggcgcttcaatctgctgaccatcatcgaaagactggcggaacaggccgtactggtagttcagtccgtggccggtggcggactgccccaccgttgccatcgaatccatgtagcaggcggccagtcgtcccagcccgccgttgcccagcgccggatcgacctcctgctccagcagttccgttaaatcgaactcgtgctcagccagcgccgctttgacgtcgttataccagccgagattgagcaggttgttgccggtcagacggccaatcagaaactccatcgagaggtaattaacgtgacgctgctgcacagccggacgcggtgccggttgtgcgtccagtagctccgccagcgccgcgctgaccgcctgccacgcctggtgcggggtcatctgctgggcggaaacggagacttaactgttgccactggcgggtaaaggcggcattaaaacgggctttattaaatttttgctgcggcatatcactcccttctgttacgcaatgaggtgaagcaaaaatagaaagcgcacgggctggcaaccgggtgccagcaaccgttaagtaaagacgggagtgaggaaaaaagcgacagcaatcaaagaaaaacgccagccgggaggctggcgtggcaggaatcagcagagttcgaggtgaacctcatgctgctcaatcaccttcattacgctggcaggcggcgttttgtccgtgtagaggtagtcaagcagactcatgttgccgaggttgaccatcgcattacggccaaacttcgagtgatccaccaccagcatcacgcagcgtgaattttcaatgatggcgcgcttggtgcggacttcgtgatagtcaaactccagcagcgaaccatccatatcgatgccgctgatccccagaatgccatagtcgagccggaactgagaaatgaagtcgagcgtcgcttcacccattaccgcgccatcgcgggtccgcacttcaccgcccgcgataatgacccggaaatcgggtttatccatcagcagcatggcgacgttaaggttattggtgaccacgcgcaaatcgctgtggttgagcagcgcatgcgccaccgcttccggcgtggtgccgatatcgataaacagcgtagcaccatccgggatctggctggccacgcgctgggcaatccgcgctttttccgctgaccacatcattttacggtcgtgccaggcagtattctcagagctggagggaagcgccgcgccgccgtggtgacgctgaattttgttctgatcggccagatcgttgagatcgcgacgaatggtttgcgggctgacctcaaaatgatccaccagctcctcagtactgacatatccctgacgacggactaaatcgataatcgcgtcatgacgttgcgtctgcttcacgttcctctcctgttaacccgcataatcctgtctaacgacgcgtgactttacgcgtatccaccagcgccatcgccagtccgaccaccagaccggcgacgtgcgccgcgttggcaatagccagaccaaagacgccaaaccagccaatcaccagccagaccagcgcaaaaccgatcaatccccgttcaagatagacgccgctgtcgggatcgcgctccccgcgcagccagcagtaacccatcagggcatagaccacgcccgacaggccaccaaaccagatgccgctgaacttcgcctgcagccagccgctgagcagagccgaaatcagcaggatgacaaagagtttgccgctgccaagtcgcttctcaaccgcgccgcccagataccaccaccacatcagattaaacagaatgtgcagcagtgaaaagtgcagcagcgcatggctgaaccagcgccagacctgaagatgctgatcggcatccggccaggagagccaggccatcacggtgcgatcgcccatgacctgcatcagaataaatatcgcgatacagagcaccatcagcgtcatggtcagcggaccggcacgctcacggatattcgcccagatattgctgcgctcatagcgcaggccactgtcggtttttccgctgtgccagctggcggcctgataacgcggatggttagggtcgtgcaaaaactgctgaagttcgttttcgaccagtgaaatcttgctctcatcatccagcatgatgacgtagtgattttcatgctcaatacgcagcgtgatgccccgcgtcgccatgtagtcaacaaaggcctgcgccatgcggggctgattaaattgagtaatgcgcatcagtaactctccatgtgacgagcggcaatctattcgctgccgagggcaacctgctgaggaaaggcagcacgccaggcatcaaagccgccatcaatgctgtacgccgcgctgaagccctgtcccagcagatattgtgccgcgcttttgctgctgttgccgtgatagcacatcaccagcaccggcaggctgtgatcggcgccgctgacaaaatcgctgaggttgctgttggtcagatgcaacgcaccggccgcatgacccagggcataactttgcggatcgcggatatctaccagcagcgcaccctgcgccagacgcgcctgcgcctgctgcacatcaatacattcgaacgtttccatgggatctctcataacagcgtcacaatagcgcgtagtgtaacccgagaatccacgccgataacctgacaatcgttacggctatcggtttttttggtgggcagaatgttagctatatcacgcaaaaatgtttttacctggttaaaagctggcgtcaatgttggtttgcgattatgattatgctcgaaaacgaacattagtgaactattccgaacatcggaggagatgacgtggaaaccaaagacctgatcgtgatcggcggcggcatcaacggtgccggcattgcagcagatgctgcaggacgcggactgtcggtgttaatgctggaggcgcgggatctggcttgcgcgacctcctctgccagttcaaaactgattcacggcggcttgcgctaccttgaacattacgaattccgtctggtcagtgaagcactggccgagcgtgaagtgctgctgaaaatggctccgcatctggcgttcccgatgcgcttccgtctgccgcatcgtccgcatctgcgtccggcgtggatgatccgtaccggcctgtttatgtatgaccatcttggcaagcgtaccagtctgccaggcagtaaaagtttgcgatttggcgcggattcggccctgaagccggaaattacgcgcggattcgaatattctgactgctgggtcgatgatgcccgcatggtggtactgaacgcacaggaagtcgtgaagcgtggcggcgaagtccgtacccgcacccgcgtgacccgtgcctggcgtgaaggcggcctgtggaaggtcgaagcggaagatgtcgacagcggtaaaacctttacctggcaggcgaaaggcctggtcaatgctgccggcccgtgggtcaaacagctgttcgacgacagcctgaagctgaaatcgccttacggtattcgcctgatcaagggcagccacatcgtggtgccacgcgtccataccgaaaagcaggcttacattctgcagaacgaagataaccgcatcgtgtttgtcatcccgtggatggatgagttctctatcatcggtaccaccgacgtcgagtacaaaggcgatccgaaaaacgtcaatattgatgacagcgagaccgactatctgctgaaagtgttcaacggacactttaaaaagcagctgaccgctgacgatatcgtctggtcctattccggtgtccgtccgctgtgtgatgacgaatccgattcgccacaggcgatcacccgtgattacaccctggatgtgcgcgacgataatggtcaggctccgctgctgtcggtatttggcggcaagctgaccacctaccgtaagctggcagaacatgcgctggagaaactggcgaagtactacccgaacgcgggcccggcatggacgaagaactgcgtgttgccaggcggaaatatctccggcacccgtgaagattatgcggccagcctgcgtcgtcgctatccgtttatcagtgaaaatatggcgcgccacttctcgcgcacctacggcagcagcactgaaaccctgctggctggcgcgaaaagcctggacgatctgggcgagaacttcggtcacgagttttacgaagcagaattacgctacctggtgcagcatgagtgggttcgtgagctggatgatgctatctggcgtcgtaccaaacagggcatgtggctgaccaaagagcagcaggcgcgagtcaccgagtggctggcagcgaaagctaaacccgccctgtcgctggcatcataaacggacagtaactaactaaagaatcagaaagcaggcttcggcctgctttttttatgtctgcgatagcgggtcggtgaatccgggtgctgatccaacaggttgcgcttttcagcgtgtagcagagtttatttttgtacgacgaactttttattaaaaatgccaggctcaaaccattttttatacagaaatccgtttatgcgatcacatttttggtcagcgcctaaactcaactctttctgcttcgcatatcaaaacgttcacatcctattgttactgtaaatataacgttcaggctttttgcttaattgaacgacgtcatcagaaagcacaaactttcctcagtaaaaacgaaacaaccgttattttaatcaggaggttgaaatgaacacaggccaaacgcctgcccgggaatggaacacgcgccgcagtgaaaaagcgcgtcgtctggcatccttccctgttgatggcaaagtcattcctactgaaagagctgtagaagcatttgaaaaactgattgcaccgggcgaccgggtggtactggaagggaataaccagaagcaggccgattttttatcacgtaccctggctgaggttaatccggcgatagtacacgacctgcatatgattatgccgagcgtgggtcgcagtgagcatctggatattttcgaaaaaggcattgcgcgtaaactcgacttctctttttccggtccgcaaagtctgcgtatttctcagttgttagaagatggtcagctggaaataggcgcaatccacacctatatcgaactctattcccgcctttatgtcgatctgagtccaaacgtcgcgctgattgccggttataaagctgaccgcaaaggcaacctttacaccgggccgagtactgaagatacgcctgccctggtggaagccgccgcgttccgtgacggtatcgtgattgcccaggtaaatgagctggtcgatgacgagaccgacctgccccgcgtcgatattcctggctcctggatcgattacatcgtcgtagccgataaacctttctttatcgaaccgctgtttacccgcgatccgcgcctgattaagcaggaacatatcctgatggcgatgatggcgattaaaggcatttacgccgaacatcaggtgcagtcacttaaccacggtatcggttttaacaccgccgcgatcgaactgctgctgcctacctacggcgaacaactcggcctgaaaggcaaaatctgtaagcactggacccttaacccgcatccgacgctgatcccggcgattgagagcggctgggttgaaagcgtgcattgcttcggtggcgaaactgggcatggaagagtacattcgcgcccgtcccgatatcttcttcaccggcagcgacggctctatgcgctctaaccgcgccttctgtcagctggcaggtcagtatgcggtggatatgtttatcggtgccaccctgcaggtcgatggcctggcaaactcctcaaccgtgacccgcggtcgcctttccgggttcggcggtgcgcctaacatgggccacgatccgcacggccgacgccatgccacgcctgcatggctcaatatgatcaccgaaccggatccgatgcagcgcggtaaaaaactggtggttcagatggtggaaaccttccaggccggtgccaaaccgacctttgttgaaacgctagatgccgttgaagtggcgaaatcgaccggtatgccgctggcaccggtgatgatttatggcgatgacgtcacccatgtgctgaccgaagagggtattgcctatctttatcgcgcggaaagccttgaagagcgccgtgcgatggtcgctgcggtagccggtatcaccgatatcggccttggcgtcgatgcggcgcgcgtggcggccctgcgtaaaagcggcaaagtggtctatccggaagatatgggcattcgtcgttcagatgcgacccgctcactgctcgccgccagcagcgtctctgacctggtggaatggtcgggtggtctttataacccaccggcaaaattccggagctggtaatgaaacttctgtcgcagactcaaaccgaggcgcaggccagccagctggcgacgattgcgcgcgattgtctgaccgatgaagcgcggctaagccccaagccgggtctggtagacagtcgggggaacggcgcgcatcaggatctgacgctggcgctgatggagcgttccgctcacagccttgtgccgacctttctggcgctggcccgtcacagctggctgcgccctgctgatattgccctgcgtgaaacggtgggtcggctgggccgtgacggtgaacagcagatgatggcggcaaccggcggcgtcaacacccatcggggtgcgatctgggcgctgggactgctggtcagtgctgcagccatgcacggtggcgcggccagtgccgaccagctgacccgcaccgcagccgcgctggccagcctgcccgaccgcgccgcgccaaaactgttcagcaaagggttaaaagcgacgcatcgctatcaggtgcccggcgcacgcgaagaggcgcagcaggcgtttcctcacgtgatgaagctggcgctgccgcagctgctgacaagtcgtgcaacgggtgccagtgaaagtgaagcccgtcttgatgcgctgatggcgatcatgacctcgctcagcgatacctgcgtgctgtcacgggccggtatgaccggactgaaagcgatgcagcaaggagcacgcgccgtgctgctgtctggcggctgtcgcacagcaggcggccagaaggcgctggcgcagctcgatcagcgcatgctgtcgctcaacgcttcgcctggcggggccgccgatttgctggccgcgacgctgttcattgatcgggtctgttcacctgaacattcttatttctagaggccattatggaacacatcacattatctttacctgctaaccgctcactcagcggtaaagctctggcaggggtcgttggttccggtgatatggaagtgctgtacaccgcaactgaaggacaaacgcttagcattgatatcaccacctcactggataacagcgacgcccgctggaaggcgctgtttgaccgcctgaatttaaccaacggtctgcctgccggaaagctgattattcacgatttcggcgcgacacccggcgtggcgcgtatccgtattgaacaggtttttgaggaggtgagccatgcgtaacgatgccagttttattgaattacgcgcccgtgagcgcgcccgtgcactgctggacgacggcagctatcgcgaactgctggatcctttcgaaggcatcatgtcgccgtggctggccccgcagggtgtggtgccgcagtcagatgacggcatggtggtggcacgcggcacgctgaacggtcagcctgcggtcgttatcgccattgaaggcaccttccagggtggcagcatgggcgaagtctccggtgccaaaatggcggcggcgctggaactggcagccgaagacaaccgcaatggaatacccactcaggcggtgctctgcctggaaaccggcggcgtgcgtttacaggaagcaaatctggggctggcggcgattgccgatattcatgccgcaattgtcgacctgcgtcgctataccccggttatcggcattattgccggtaccgtcggctgctttggcgggatgtccatcgccgctgcgctgtgcagctacctgattgtgacgcgtgaagcgcgcctggggctgaacggtccgcaggtgattgagcaggaagcgggcattgaagagtatgactcgcgcgatcgcccatttatctggagcatgaccggcggtgaaatccgctacgccagcggcctggtcgatgcgctggtcggtgatggcgtcaatgcggttaaaagtgcgatgaatgactgcatcgccaaaggcgttccggcgcagcaccgcagcgataaatatgccgatttcctgccacgtctgacgcagttcgacacccgtcagcaggcggacacggcgcagattaaacagcttttcgcccgggaggataaataatgacccagacaaacagccgcggtgcaacctggctggaaaaacttgcacctgatgcgcagcgcctcagcggcctgtgcgcctctgtccaggtggcggacggccagctcaatggcgaaagcgtgcgctttatcgccgtggtgcccgatgcacaaaaccactatccgcgtgccgcgcagggcgaagtcggcctgctggaaggctggacgctggcgaaagtggtgaatgaaacgctggaagaggacaagaacagcgacgtgaaacgcccgattgtggcggtgatcgacgtaccgagtcaggcctatggccgtcgcgaagaggcgttcggtattcatcaggcgctggcgggggctgcgggcgcttatgccaaagcacgccttgcgggtcatccggtgattgggctgattgttggcaaagcgatgtctggtgccttcctggcgcacggttatcaggccaaccgcctgattgcgctcaacgatcagggtgtgctggtgcacgcgatgggtaaagagtccgccgcgcgtatcacgctgcgttcggtggaggcgctggagaaactggcggcgaccattccgccgatggcctatgacgtgaataacttcgccacgctgggtctgctctccgatctgctgaacgtggccaatcccgatgcgccttctgacgccgatgtggcgatggtcgagatcgcgttgcagaaagccattagcgatgcgcgtcaggatccgagcctgaaaaaccggctgggcgcatccaatcgccacagctcctccctggttcgcgagcggatgcgcgcaacctggtaattaaataaaaaaataaacctgccgaaaccggtctgacggggcgcattgctaagtgcgccccggggcagtggccgtgttcagaattataaacatcgctgttaacagaaaattctttcttaaatacaggtgatttatgatttatataattgttcatgcccttgctccgatttttgtcatcatgctgctgggtttctgggccggtaaggccggaatggtcaacaacaaagacgtctctctgctgaatattttcgtcatggattttgcactgcccgccgcgctgttcagtgccacggtacaaacgccctggccgggcatcgtggcgcaatggccgctgattgtggttattaccggcgcaatgtggattacctatggagctgtctatttcgcggctacaaaagttttcaaaaagtcaccgcaggatgcggctgtgctgacgctgacggtggcgctgccaaattacgccgcgctgggcctgcccattctggccagcgtgctgggtgaaaatggtgccacttcgctctcggtagcggtctccatcgcctgtggttcagtgctgcttacaccgctttgcctgctgattctggaacgtgaaaaagcgtttgccgacggcaccgaacacggttcaaccctgaccatgctgccgattctgatgtggcgttcagtgaaaaaaccgatcgtactgggaccgttgattggcgtggtgttatcagcgctgggcgttaaaatgcctgatctggtgctggccgccatcaaaccgctgggtctggctgccaccgccgctgcactcttcctgaccggtgtcatcctgtcggcacgcaaactgaaactcaacgcggtggtgggcgtcggcacggtaactaaactgctgattcagccctttatcgcctggggtctggtgctggcattgggtctcagcggtccggtggcaattaccgccattctgatgattgcgctctccgccggtttcttcggagtggtgtttggcaaccgctttggcgtgcagtcgccggatgcagaggctgtgctgctgctcagctctattctctgtattttgtcattaccgctgttcattacgctgacatcaggaatgtaatatgagctctgtaccgcgcccccacgatcttctctggctgcgagacggcaacgccttagccgccatcagtgagagctgggtcagtcagttctggcatcccggccttccggtcgtggtgcggcgcgacagaagccaaaccgggctgataccggtgggtgtgcgcggcgagcgccgcgaaacagcgcgccgccggatgggtcaatgcagcggatatcgttcgcgttgtcacaccggagatgctggcagcgcgtgcgcagttgcttgcctcgccgttcaccggttatgcgccggtcggcgcggcgattgccctcagtgagcacgactggccgtggcgctggggcattaccggcagtaccggttacgcactggcaactcagcaacccacgctgcatgccgccagcgatcttgatttagttattcgcgcgccagagccgctggcgcgcgatgcgctgcaacgctggcaggcgcaaaccgacacgctggcctgtcgggtcgatacgcagatagaaacgccgtccggcgcgtttgccctcagcgagtggctgcgtgaaggccgcgcactggttaaaaccgttaccgggccgatactgaccgcttcaccctggagcagggagctacaatgaaaatactctttacctttcccggccagggcactcagcgtgccgggatgttacagcaccttcccgacggcgacgccctgttaaacagcgtgcgtgcagtgctgggcgacgagactgaccagctcgacagtgccgatgcactgcgccacacgcgcgccgtgcagctcagtctgctgatttgcggtgtcgcctgggcgcgcgagctgatccgccgtggagtgaaacccgatatcgtcagcggtctgtcgattggtgcgtttcctgctgcggtgatttccggcgcgctggatttcagtgatgctctgcggctggtggcgctgcgcggcgatctgatggagcaggcttatccggagggatatggcctgaccgccatcaccggcctgacgctgagtcgtctggaaaaactgctgcccggcagcaacacctatatcgccaacctgaatgcggaaacgcagattgtgattgctggccgcgacgaggatatggcggtagtcgcgcagaaagcgctggatgccggtgccagcaaagcgattaaactcgcggtgagcgtgccgtcgcattgcgcgctgctggataagcccgctgcagaactggcgcgcgcgttcgggtccgtcagcctttcccgtccccattgcgcttacctcagcggttcaaccggacgcgtgatttgggagccggagaagattgccgacgatcttgcctttaatatggcgcgtacggtgcagtggaatgatgcgatggtttcagccaatcagcgcgatgcccgactggcgattgagatgccgcctggcaatgtgctgaccggcctgacgcttcaggcaggctggcagggcgacgcgatttgtctggagcgcaacagcgttgaggttgcactccatctggttaaacggctaagtcagtaaggctgcgggcgtacatccgcccttctgccgccagtgccagcaggtcattatcccgtttcgcggcgatgtgagtagacaatcgagatctgctgacgcatctggtaaggctcagcgagcgtcagcagctgaatgttgttttcatacaccttcttcatccgtcccgggatcagtgccaggccgacgcccgcctgcaccaggcttatcatcgagaagatgtcattcacctgggtgaccatgcgcggttcaaatccggctatctggaacgcctcctgcgaaccggcataggttgcaaacccttcagccagggagacaaaatcacggtcggcataatcacgcagatccaccggaccagctccgtcccgcgtctcaccggccggtgtggccagaaagatcctgtcttcaaacagcggaatcacatcaaaatgcgcgtcgctgagttcgccgtcatcggtggcgatcagaatcgcatccagcgcgtcatcttccagcatattcagcagcatttgattggaacccatggtcagatcgagctccagcgtgggccgacgcagcttcatgcccatgatcagccggggaatggtctccagcgtcagggagtagagcgtgccaagtcgcagacgccctccgccgatgcctgcgactttgcgcgcctcttcaatgcctttgcccatcagggtggtcacatcgcgacagtagtccagcagcgtccaggcggcaggtagcggcaccaggttgcggcccttgtggataaacagcgggcagtcgatgccctcttccagcgtatgcagtgcgcgatgcacgctgacgctgctcagctccagcgcttccgccgtacgggcgatattgcccttgctcataaacatcatgaagacgctgagtttacggaaggtaatttcctggttgatgttgtcactcattgctgctgttgcctgtagggtcattttgctttcccgcatagtagcgattctcagccagggtgtaatgatctggctcgcacaagaggcacttacggaggcagaggcgataagaggctgaaccttctgaaagaggagcgggatagacggtgaacaaagagtgcaaaggagagtgcggccgatccctcggccgcaaagaaagtcagaaaccttactgcacgcgccttacaaccttactggcgagatattccagatctcatcagcgtactcctgaatcgtacggtccgacgagaagtagcccattccggcgatgtttttagccgcgcggcgttgccactcatccggtttacggtagagcgcatccactttatcctgggtatccacatagctgcgataatccgccagcaactggtagtgatcgccgaagttgaccagtgaatcgaacagattgcggtagcggcccggatcctgcggactgaacagaccggaagcaatctgagtcagcacctgatgcagctcttcatccttttcataatagtcacgcgggttatagccccctttacgcagggcttcgacctgcggcgtggtattaccgaaaatgaagatgttctcttcaccgacgtgatccagcatttcaacgttggccccatccagcgtaccgatggtcagcgcgccattcagcgcaaacttcatattactggtgccggacgcctctgtccctgcggtagagatctgctcagagagatcggccgccggaataatgatctgcgccaggctcacgctgtagttcgggatgaagaccaccttcagtttgttcttcacctgcggatcgttgttgatcacattggcgacatcgttgatcagatgaatgatgtgcttggcaacgtaataggccgacgccgctttaccggcaaaaatattgacgcgtggcacccaatccgcctgcggatcggccttgatacggttgtatcgggtgatcacatgcagcacgttgagcaactggcgtttgtactcgtgaatgcgcttgatctgcacatcaaacagcgcgtttcgggtcgagcaccacgtccagattcttcgccacccagtcggccagccgacgcttgttctgatacttggcgaccgccactttttcaataaacgccggatagtcgatctgcgccttcaactcgcccagctggctgagatcggtgcgccagttgcggccaatctcctcatccagcacctctgacagcgccgggttcgccagcgccagccagcggcgcggagtgacgccattggttttgttacagaagcgaccagggaacaggcgggagaaatcggcaaacagcgactgtaccatcaggttggagtgcagctccgaaacaccgtttactttgtggctgaccaccaccgccagccagcccatgcgtatccggcggccatcgttttcgtcgatgatcgaaatgcgcgacagcagatccaggtcatcgggatagtgatcctgaatggtcttaaggaagaagtcgttaatttcaaaaataatgctgaggtgacgcggcaggatcttgccgatcatatcaaccggccaggtttccagcgcttcggtcatcagcgtatggttggtgtaggagaagacctgacagcagacgtcaaaagcgttgtcccagctgaatttatgatcgtcgatcagcaggcgcatcagttcggggatcgccagcaccggatgggtatcattcaggtgaatagcgattttatccgccaggttatcccaggtctgatgcatccgccagtgacgattcagaatgtcctgcaccgtcgcggagaccaggaaatattcctgacgcaggcgcagttcacggcctgagtaggtcgagtcatccggatagagcacgcgcgacacgttctcggagtggtttttatcttccaccgccgcaaagtagtcgccctggttgaacttgccgaggttgatttcgttgctggcctgcgcgccccacagccgtaaggtgttggtagcgtcggtgtcaaagcccggaatgatctggtcataggccatcgccaggatctcttcggtctccagccagcgcactttcgcgccttcgtgctggacgcggccaccaaagcgcactttgtaacgagtattgaaacgctggaattcccacggattaccatattcaagccagtaatccggcgactctttctgctcaccttccacaatgttctgtttgaacatgccgtagtcataccggatgccatagccacggcccggcatgcccagcgtcgccagcgagtcgaggaaacaggccgccaggcgacccagaccaccgttgcccagccccggatcgttctcctcttccatcagctcggccagatccagacccatctcatccagcgcctggttgagatcgtcataaatccccatcgccagcagcgcattgcccagcgtgcggcccatcaggaactccatcgacaggtaatagacctgccggacatcctgcgacagctgagcacggctggaacgcagccagcgctccaccatccggtcgcgcaccgccagcagtgaggcgttaagccactcatgcttattggcgatagagggatctttgccgatggtaaacatcaatttataggcaatcgaatgctttaaggcatcaaccgtcaacgttggtgaggcgtaagtgaaaggtgcattcatatccagttttcccaatccgttacatcaaacgttggtagagatcacggtaggcttgtgctgccacctgccagctaaagtccatcgccattgcctggcgctgaacatagcgccagagcgaaggacgggaccacaacacaaacgcgcggcggatagcccgaagcagtgaccaggcgttggcatcttcaaaactgaatccactggcgatgccgtcggccagattctccagtgagctgtcattcacggtatcggccagcccgccggtgcggcgtactaacggcaacgtaccatacttgaggccatagagttgtgtcagaccgcagggctcaaagcgactcggcaccacaatcacgtctgcgccgccgacaatgcggtgtgagaacgcttcgtgatagccgatctgcacgccgacgctgcctggatgctctgctgccgccgccaggaagccctgctgcagttcagcatcgccctggcccagcagcaccagttgaccgccctgcgccagcaagccgggcagcgcctccagcaccaggtccagccctttctgtttggtcagacggctgatcacgcagaacaccggcgctttatcatctaccttcagacccatcgccacctgcagctggcgtttgttctccgctttcgcttccagcgtgtcgcggttataacgcgcgctgagcagcagatcgtgcgccggatcccagatagagggatcaacgccgttgagaatgccgctaagacggccttcacgcatccgctgtgccagcagggtttccatgccgtaagcatattcggcagaggtaatttcatgggcgtaagtcgggctgaccgccgtgatatggtcggcgtaaaaaagtcccgctttcaggaaggagatctgaccgaagaactccagcccgtgcatgttaaagaatgaccatggcaggccaatctcttccatgtggtgcgccatgaacagcccctgatacgccaggttgtgcacggtgaagaccgatttagccggacgaccacgcgcttccagataggcgcaggtcaggcctgcgtgccagtcatgggcatgcacaatatcgggacgccacatcgcgtccatgccgcacgccagttcacagccaacccagcccagcagcgcaaagcgcagatagttgtcgacatacgcaaactgcgattcgtcatggtagggactacccggacgatcgtagaggccgggagcatcaattaagtagatgcccacaccgttaaattcaccaaatagcagacgtacatgaccggcaaatgtttctcgctctgtcacgacctggagatcaggtatgcctttgcgcaatgcgggaaaaccgggcagtagtacccgcgtatccgtgccgcccgcaatttgtgcctgaggtaatgccccgactacatcagccagtccgcccgtttttagcagcgggaaaagttccgaacagacatgtaaaacctgcatcctcgacctcattaagttatccgacacgctccgcgtgccgattgcgtaagtttcgcttatcgcttacagccccgctttggccagcctggccagcatggcgcgggttaccagtacgatgccttcatccgaacggtgaaaccggcgactgtcttcatccgggttttcgccaatgaccatgccttccggtaactcgcaggcacgatcaatgacgcagcgacgcagacgacacgatcggcccactaccacatcaggcagcagtacagttgaatctatattgcaaaaagagttaacgcgtacccgcgggaacagcaccgaattgaccaccactgaaccggagatgatgcagccccccgagaccagcgagttcatggtcatcccgtgactgccggaacgatcctgaacaaatttggccggcggcagcggctccatgtgggtacgaatcggccaggtgacgtcatacatatcgagttcaggcatcaccgatgccaggtcgagattggcgcgccagtaggcttccagcgtcccgacgtcgcgccagtaaggcggcgcattgtcatcgttctgtacgcaggagagcgcaaaggagtgcgcatagccttcgccgcttgccacgattttcggcaggatatctttgccgaagtcgtggttagagcctggcgtctgcagatcctcttccagcagttcatagagatagtctgcgttgaaaacgtagatccccatgctggcgagcgcctgagtgtcatcacccggcatggtgggcggtttcgcgggtttctccacgaagtcgatcaccatgttctcttcgtccaccgccatcacgccaaacgccgtggcttcatgcaccggcaccggtaaacaggcgatggtacatttcgcctcgttgaccacgtgatccagcagcatgcgtgaataatccatcttataaatgtggtccccggcaaggatcacgatgtactgcgcctgatagcggcgaattacatcaaggttttgcgtcacggcatcggccgtcccgcgataccactgttcggtcgaaaatcgctgctgcgctggcagcaaatcgacaaactcattcatctcttcattgaagatcgaccagccacgctggatgtgctgagtcagggtatgagactgatactgagtaatcacgccaatccgtcggataccggagttgacgcagttggagagggcaaagtcgataatgcggaacttgccgccgaaatgcaccgccggtttggcacgtttggccgttaagtcgaccaggcgcgtgccgcgtccgccagcgaggatcagagcaaccgtctgtgtagggagctggcgggccagcatcaggtgatctgttctatctaacttaaccatgtctgactccttatgattgcttttggaacacgcacacaccgtgtgcgggaccatgccagacagttagcaggatggggttgtcgtccccggcgaaaggaggaagggcgcgccattctccgtctggtaacacgatgtcattcaccgtatccgtggcgtttattgttattaaccagcggccggacagcaggatctgcaatctgtgcatcccctgtgcccattcatcgtgttgcagtggctggccaccggcattgagccactgcacattgccgtcaccgtcctgccaccagcgatctgcggtcagcgccggaatgcgctggcgcagctcgatcagtgcagcggtgaatccgactaatcccttctcatccgcctgccagtcaagccagctcagggcgttgtcctgacagtaagcgttgttattgccgcgctgggtgtggccgcgctcatcgcctgccagcagcatcggcgtgccctgtgacaacagcagcgtcgtcagcagtgcccgcacgctgcgacggcgacgttcaatcacgtcgaagctgacgttcagcccctctttgccgtggttgtggctgtagttatcgccgtgaccatcacggttatcttccccgttcgcttcgttgtgtttacgttcgaagctcaccacatcccatagcgtaaagccgtcatgggcggtgatcaggttaaccgtggcgtgtggcgaccggtcatcatgctggtagagatcgctggaggcggcaaagcgacggacgaaactcgccgttgcttatgtcgccgtgcagccagtaacgacgcgcggtgtcgcgaaactgatcgttccattcggcaaacggcggcggaaaacggccaacctgatagccgtcagggccgatatcccagggttcagcaatcagcttgacctgagagagcagcggacaggcgcgtatcgcctcaaaaaatggcgcatcacgctggtaatccggtgtgcggcccagcactggcgcgaggtcaaagcggaagccgtcgacgtggcagatccgcacccagtagcgcagcgcctctaaagcccacgtcatcacctgcggatgatgaatattcagcgtgttgccgcagccggtccagttctgataatcgccctgctcatcgagccagtagtagctggcgttgtcgatgccgcgcatggagattgtcgggccaatctcatcgagttcagcggtgtggttgaacaccacatccagcagcacttcgatacccgcggcgtgcaggtttttgaccgcctgctgaaactcctgcaacggcgtcacgtccggctgaccggaggcgtaacggggatccaccgcccagagcgcaaacgggttataaccccagtagttgctgaggccgagctgcagcagtcgcggctcgctggcgaaatgggccaccggcagcagctcaagggtggtaatccccagactgcgcaggtaattcaccataacaggatgaccgagcgccgcgtaagtcccgcgcagcgtttccggaatttccggatgctgctgcgtcaggccgcgcacgtgggcttcgtaaatcaccgtgttaccccacggaatacccggtgcgacgtcgtcctgccagtcaaaatcctccgcgactacccgtgacttcggcgcaatcgccgcgttgtcatgcggatcgggctgcgtctcgccgccatgaaacagcgggtcatccgctacatcgccctcaaccgcgcgggcgcaggggtcaaccagcagcttcgccggattaaaacggtgtccctgctgcggcgcccagggaccatgcacccggtagccgtagcgctgtcccggtttcaacgccggaacataaccatgccagatatccccgctgcggccaggcaggtcaagacgctgttctgcgccctgttcatcaaacaggcagagctctacgcgcccggcatgctgtgagaacagggtgaagttaacgcctttgccatcgtaactggcacccagcggttcgggatctccggcagtgatggtcattcagcctcccgcaccagccataccgttgccagcggcggcagattgaggctcagcgactgcggtcgcccgtggctctcctgctcatcggtatgcacacgatggttgcgcacgtcgctgccgtgatactcatgctgatcggtgttcagcacttcacgccagtagccaggctggttaacgccaaagcgatagcccggacgcggcactggcgtaaagttactgacgacgatcacttcattgccttcacggtcacgacggacaaaggcgaagacggagtgttccgcatcgtttaccaccagccactcaaagcctgccggatcgaagtcgagctgatgcagcggcgtgtagtactgataggtgtggttgagatcgcgcaccagacggtgaacgccgtggtgccagttgtcgtccccttccagcagatgccagtcaaggctgacgtcgtggttccactcgcgaccctgggcaaattcattgcccataaacagcagtttcttgccggggaagccccacatccagccgtagtaagcacgcagattggcgaacttctgccatgcatcgcccggcatacgatcgagaatcgagcgcttaccgtgcaccacttcgtcatgcgacagcggcagcacaaagttttcggtgtagttgtacatcatgccgaagctcatcagatcgtgatggtgcttacggtagatgggatcgaccttcatgtagtcgagggtgtcgtgcatccagcccagattccatttgaaccagaaacccagcccgccgtcttcggtgggacgcgtcacgccagggtagtctgtcgactcttcggccatggtcaccgaaaccggatgccacggtgccgagcgtacggttggtgtgacgcagaaactcaatcgcttccaggttctcacggccgccgtactgattcggcacccattccccttcgctgcggctgtagtcgcggtagatcatcgacgccaccgcatccacacgcaggccatcaatgccaaagcgctccgtccagtagagcgcgttgcccgacaggtagttgctcacttcccggcgaccaaaattgtaaatcagggtattccagtcctggtgaaagccttcacgcgggtcactgtgctcatagagctcggtgccgtcgtatcttgccagaccgaaatcgtcgctggggaagtggcccggcacccagtcgagcagcacgttgaggcccgcttcatgggcggcgtcaatgaaggcgcggaactcgtcacgggtaccaaaacgtcgggtcggcgcatacatgcccagcggctgatagccccagctgccatcaaacggatgttcgttaatcggcagcagttcgatatgggtaaagcccatctctttgacgtagggcaccagctgttcagccagctctttgtagctcagccagaagttgttgtcggtgtgacgacgccaggagcccagatgcacttcatagatggagatcggcgcgtcaaaggcgttggccgccttgcgctccgctttcatctcaaccggctccggcagaccacagatcatcgacgcagtctggggacgcatctgcgcctcaaacgcgtacgggtccgctttgatgcgcagttcgccattggcgtcgatgatttcatacttgtagagctggccgttgaccgcgcccggtacaaacagctcccagatgcccagttcctgacgcagacgcatcggatgacggcggccatcccagaagttgaaatcgccaaccactgacacgcgacgggcgttgggtgcccagacgcagaagcgggtgccgaagacgccatcgatgacgtcaccgtgcgcgcccagcgtctcataagggcgcaggtgcgtcccttctgccagcagccacagatccatctcctgcagcagcggaccaaagcggtaggcatcgtctaccaggttttgctggccgtgccagttcaccgccagctgatagcggaacgggtttttgcggcgtggaatgacgccactgaagaagccacgtgcatcttcacacaccagctgagccagtttgcgcccggtggaggtttcaatgacccacacttcaagcgcttcggggagcaatgccctgacttcaaggccttgctgagttcggtgcatccctagtaacgaaaaagggtcggcataattacccgcaaacagggcattgatcgcatcgcgatcgggaagctctgacatgactttcttcctgtgataattggcagccgaaatgaacgcgacacagcctgtcgcggttcacctgcgctgctcttcattgagccatacgtacaacgacaaagaagtcaggccattccgtgggaaaagtgtttttgccgtgtaccacaaccatttaatccggaaagcacaagagttacctgtggcacatcatggttaaatcatagcttggtcacggcacttgccatggactaaagcaaaataatctttaccgaccggcaaaaaagggaagttgatcactgagtaagcgaaacggcagattgtttcgtgtacgacaaaaacaaaaaaggccggataaatccggcctttggcgatgttttctgtttagctggttaacaaccgcagcatgcgacgtagcggttcggctgcgccccataacagctggtcgcccactgtgaaggcagagagatattccggccccatattcagtttacgcaaccggccaaccggcgtggtcagcgtaccggtgacagcggcgggcgtcagttcacgcatcgtcagttcgcggtcattcggcaccactttgacccactcattgtgagaggccagcagctgctcaatttcagccagcggcaggtcgcgtttcagcttcagcgtaaaggcctggctgtggcagcgcagtgccccgacacgcacgcacaatccatccaccggaatgacgttacgggtggcgaggatcttgttggtttccgcctggcctttccactcttcgcgactctgaccgttttccagctgtttgtcgatccacgggatcaggctgcccgccagcggcacgccgaagttatcggtcggcagggtgccggaacgggtgaagtcggtcacgctacgctcgatgtcgaggatggcggaggccgggttttctgcagcgcaggcgcaacgtgatcgtgcagcatgcccatctgggtcagcagttcacgcatgtggcgcgcgccgccgccagaggccgcctgataggtggcaaccgaagcccactccaccaggtcctgagcaaacaggccgcccagcgacatcagcatcaggctgacggtacagttaccgccgacaaaggttttgatcccactgtcgataccctggcgaatcaccgcatggttgaccggatcgaggatgatgatggcatcatctttcatgcgcagcgtggaggccgcatcaatccagtatccctgccagccgctggcgcgcagctttggatagacgtcactggtgtagtcgccaccctggcaggtaataatgatatccagcgcccgcagcgcctcaatatcaaacgcatcctgcagtgtgccctgctgtttgcccgcaaatgcgggtgccgcctgaccatgctgcgacgtcgagaagaagaccggattgattgcatcaaaatcgcgctcttcactcatgcgggacatcagcacggagccgaccataccgcgccaaccaacaaaacctacattcttcatgtcgtgtccgtctaaggcagttacacctgcttttcatttcagaggagagagcggcgtgctattttcacgccgctctgcgtaataataagatttacctgtgtcccttcactctacaaaatgcaggccgggtagcaagtgaattaattcgattacgctaactttttcagcagcgtaactaataactccgctttttcgtgaacaacatggcgtaaaaccgatgactgaaatgatttcagcgacaatattattgttgttaattatggatccgctgggcaatctgccgatttttatgtcggttttaaagcatctggagccgaaacggcggcgagtggtgctgatccgtgaaatgttgattgccctgatcatcatgctgctgttcctgtttaccggcgaacgcatcctggcatttttgaatctgcgcactgaaacggtgtcgatttccggcgggatcatcctgtttcttatcgccattaagatgattttcccgtcggcggaaagcagcagttctggtttaccggcgggtgaagagcccttcctggtgccgctggcgattccacttgtagccgggccatcgctgctggcgacgctgatgctgctgtcgcatcaatatccgcatcagatgtcgcacctggtcggcgcgctgctgatcgcctggggcgtgacggtgggtattcttctgatgtcaggtctgttcctgcgtctgctgggtgataaaggggtcaatgcgctggagcggctgatgggattaatactgattatgctggcaactcagatgttcctggacggcattcgggcttatctgaagctgtaggagagtgtctgcgcttcccatgaagccagggaagcgcagaaccgacatgattaagagagtagtgtgaaggcgatcattccgaccaccgcaccaacggtaccgagaatggtttccatcagtgtccaggtcttcagcgtttccgcttcgctggccccggtgaagcgaccaaacagccagaaacccggcatcgttcacatggctgataatgattgagccaccgccgatgcagatcgatagcgccgccagctgagcgccgctgtagtgcaacggttcaatcaccggcatgattaagcctaccgtggtcagacaggcgaccgttgccgatccctgaatcacccgcaccgcacctgacaggataaagcaggccagcgcaattggcagtcctgcgccggtcagcgcattgcccagcaccggacccacgccggagtccaccagcacctgcttaaacacgccgcccgcgccaatcaccagcaggataataccggccggttgcagcgcgctgccgcacacctgcattacccgctctttatccataccctgacggtaagccaggccataaatcgccaccagcagcgccagcaggattgcggtgaaaggatggccgataaattccagccactcatacagggtggtgccttcggtcgtgaagcgtgcgccgatggttttcaggccaaccagcaccagcggaaacagaatcagtgagaggctgaagccaaacgacggcagcttgctctcatcgacatccggttgatgatcttccggcggcgcgctgaacgagacgtggttgccaatgaagttgccaaacagtggcccggcaatcagcatgcccgggatcgccgcacagagacccagcaggatcatccagccaaaatctgcgtgcatctgcgaagccagcagcatcggggccggtccgggcagcagaaacgccgccgctgcggccacaccagcaaacagcgggatcaccagcttcaccagattgccgccggtacgccgtgccaccgcaaaagcgatactgatcaacagcacgactgccacctcaaagaagagcggcagcgcgcagatcagaccggcaatgcccatcgcgtaatgggcacggctctgaccaaaggttttcagcatccggatggcgatctgatcaactgcgccggtttcatgcaggattttgccgaacatcgcgcccagcgcgaccacaatcgcgaggaagccgagcgtgccgcccatccccttctgcatggtttcagcgatttgattcagtggcatgccggagaacagcccggcaccgatggacactaacatcaatgcgacgaaggcgtgcatacgggccttcatcaccaggaaaagcagcagcaggacggagcctgctgcggtcaaaacgagtgttgcggtattcatctctatccctggctgatagcgtcctggatagtcgcaaccgtagccgccaccacatcgtccagtgaatgcgcgatatccaccaccagtacatccggctcatcgctacccggctcttccagcgtcgcaaactgcgtcaccagcatctgcggcttgaagaagtggcctttacgcgctttcaggcgggcttcgatggtgtcgaaatcgcccttcaggtagacgaaacgcaggttgtcatttccctgacgcaggatgtcgcgataacttttcttcagggctgaacagacaatcacggaaattgcctgggtgcgctgcatggcaaacgcggcgtcgtttcagtgcctgtaaccacggctggcgatcgttgtcatccagcggatgaccatcggccatcttcaggatgttggcgcgtgggtggagaaaatcaccgtcaagaaaggctgtattcagctggtgagagacctgattggcgacggcagactttccgctgcctgaaacgcccatcaggataaaaacgtgatgcgacggggattgcgttgtcatttttctgctccggcaggtgagaatttgccaatgttaccgataacaatatcgtttctcattctcctggccgcttaacagcctggcaacctttttaccaggaaatgcatgaaagtgtgagctgactcataaaaacgccacaatcagatgctgccaccttcactgatctcaaaaccgacatccagcggctggcaggtgctggtttctccggcaatgcgcgccagcagcagcgccgcggcttcgcgccccatgcggtcgcgtggcgtcagcactgttgccagttgtggcgtgacaacctgactgatgtcatggccgtggaaaccggctatcgccatctgagagggcacctgcaatccctggcgctggcactcaaacatcgcgccgaccgccagatcgtcattggtacagaacaggctatctgtttcagggtaaaggcgctgcgcctcacgcagcagatcacaaccggcgctgaatgaagaggcatcttccatcatcacactgcgtggcgtcagccccgcttcgcgcatcgcgatttcgtaaccgcgctgcttctgcagcgtacgttcatccaggcgtgcgccaaggtagacggtatgacgatgacctttgctgaggattgcctgcgtcatctgccgggccgcttcaacgttatcaaagcctaccgccatatccaggcagggcgtgacgctgtccatcacctcaatcaccgggataccggccacttccagcatgcgcagcgtgcctggtgtatgggtgcgtttcggtgaggataaccccatcaatgttccagcccagcagcgagcgcagttgcagctcctctttttgcgggttgtaaccaaagtgggcgaccagcgtctgatagttggcttcgtcggtgacggcttcgatgccgcgcaatacgtcagcaaaaacctggtttgtgagtgacggcagcagtacgccaatggcgcggctggtggcgttagaaagcatatcgggggcgcgattggggatataacccagctcatccagtgccaccgcaatcttatcccgcagggcaacggagacctgctctggattacgcaggtaacggctgacggtcattttagtaatgccgacgcgatcggcaacgtcctgtaataccggtcttttcttcttcatcgtagcgcctgggatcgcccttaaagctaaagtacgatgagtctatcacttttctgtcacaaaattgccaaccgggcgcgacgatgcgcgcccgttatctgcttagaccggtggcagatcaaacagcaggacttctgcagccgagctggcttcaatggtcagcgcgctttcgtcccagatagccagggcgtcgctggtggtgatcgcgttgccgttaacggtaacatcacctttcaccacctgaatccagatacgacgtcccgcatcaatcgcgacattgtcctgttcgccggcagccattacccagcgcgataaggtcatgtcctgaaagactttcagcgatccttcacgggcatccgggcttaacaccagctgacgtccctgcacatccgggaagcggcgctgatcatagcgtggctctataccggtacgctcaggaataatccagatctgataaaggtgcagcggctcgctttcgctggcgttgtactcagagtgacgtacgccggttccggcgctcataatctggaactccccggccgggatctgctctttgttgcccatgctgtcctgatgctcaaccgtaccggagagcacgtaggtcaggatttccatatctttgtgaggatgggtaccaaatccctgaccgccatcaatcacatcttcgttgatgacccgcagcgcggagaaacccataaagttcgcatcgtgatagctggcgaaagagaaagtgtgccagctatccagccagccatggtttgcgtgaccgcgttcttcagctttgcgtacatagatcatgttcaaatctcctcaatgttttttatagtctgtccctgagggggtcagattgatagctgaaaaacttcacgcctctgttcaaaatagttgaatgagcattgagcagtggctgaaaagcactgaagaagggcaggcaaaaaaaaagccagcggataagctggctaaataatactggaagcaatgtgagcaatgtcgtgctttctcaggctgtcgggcgacctcccgagaatgcatgacaataataatcattatcattcgcgtctgtaaagtcattttcactttttttaccctgattaacgcggtgaataccttgatgtttaaagggttttaatgctgtggcgggttttaaatcgcgtcacagcgtattttaactctgatcccctgaatgcaaaaaaggccccttccggggtaatgctgatcagttaagattagatttgtaaaggctgtcacggtcaaacgtggcggctttttttccgggcgggccagccgcagggcgggcctgagcacctctgctgctgccgggccgtcctcgcgccgctcacgcggtaccttcggctttgacgtcgtgccgacgaaccgttcggggatcggccctccctggccggccccgaaactgtccacgcttcccggcgtggacttctggcccgccgtcacgcctcagcgctgcggatagccctttcagcagcagaggcgctcaggcctccactctcgtgccctttttaacaatacacactgaagcttcagagcaggccggtgccgggcaggggcaggcaatccgcagcgctgaacagaatgagtctgccaggagagcccgcaggacgcgggcgaaaggcggggcggcacaggatgtgccatccccggcggtccgtcaggcagaggaatgacgtgaaggaaccgcgcagcggcgcgaggaccgccagcccctgcccggcaccagactgcgttatcacctgtcgcttaactgactggcattacccttccggggccctttctgattgctgactctgtctgacacggttcactgttaaaccgtgcctgcgcaaacaacacagtaaaatctcaataacccgcactcaaatcatcaatgctgcgcggatcggaagcgccatagagcatgccatccggcccgatcatgatgctctgcgtactgcccatcgacggcagtaccttcacatgctgacctttggtttccagcagacgcagcgtatcggggctgaagcccttctccacccgcagctgatccggcagccactgatgatggaagcgcggcgcattagtggcttccgccacgttcatcccgaaatcgatgctgttaaccaccatctgcaacaccgtggtgataatgcggctgccgccaggactacccgtcaccagccaggtttttccccctttggcgacgatggtcggcgacatcgatgacaacggacgtttcgccggttgcaccgcattcgcttccccgccgaccagtccgtagacattgggcgtgcctggcttggctgagaagtcatccatctcgttattcatcaggatgccgctgttgcccgccacaattccgctgccgaaataggtgttaagcgtataagtcaccgcgaccgcatttccctgcttatccaccaccgagaaatgggtagtctgattgctttcataaggttcgagcttgcccggtttgatctcgctggagggccgcgccttcgccacatcgatctgctgcgccagggttttggcataggctttactggttagcgcctgccacggcaccttcacgaaatcgggatcgccgagatattccgagcggtccgcgtaggcatatttctccgcttccgccatcacctgcatggcatcagcactgccaaagcccatcttcgccagatcgaaattctccaggatattcagaatctgcacgatgtggatgccaccggatgacggcggcggcattgagaagacttcatagccacggtatgtcccgctaatgggcttacgctcgaccgcacgataggccgccaggtcagctttgttgatcagcccgccatgctgcgccatctctccggcgatctcatccgcaatttcacctttgtaaaaggcatccggtccctgacgggcaatcagttgcaggctgtgagccaggtttttctgcaccagcctatcgcccttctgccacggcgtaccgtccggtttgtagaagatcgctttgctgttgggatgagtgatcagcacttctttgccgtaggtcttcaggtcatctgccagcgcgtcgttgaccggaataccgtcacgcgccagtttgatcgccggtgccagcagcgtgctcagcggcagagtgccatatttctgcgcagccagcgccagtccagctacggtgcccggcgtgcctgaggcgagatgtgatgtcagcgacagcttgctgtcggcgttgccctgcttatccaggaacatgtcacgcgacgcgtgtcccggtgccatttcacggaaatcgatagccgtggcgcggccagaggcagtgcgcagcagcataaaaccaccgccgccgagattgcccgcctgcggatgggtcacggccagcgcaaagcctaccgccaccgcggcatccaccgcattaccgccctgacgcaggatctcgacgccaacctgcgtcgccatcgcatccactgacgctaccatgccgtgctgcgcttttaccgggtgaaaagtgtcactgtccacaccgtaggagaccggaggagcctgcgttggcgcggcgttagcgcctgccactacggtgaaactcatcaccagcgaccagctaagctgacgcactgtttgctgcattttcatcctgccaccatcccatattgttatttacatttttttatcatttctgcaagtgcctacaaatacagcaaaataaccggggttaagtcaaatcaggaatagatcggaaagtaaggtctgtgatatcgggtaaacttatggctacgaccctgatatcggtgtacgccgttgtgcacccaaaaccctgtcgctttaaggaaggaggagtgatgaaaaagtggatgattattctggccgctctgctgcctttcgccagtcaggcgaacacgctgaacagcactaacgatccgaataaacctggctataaccccagccagcagcggatgcagtcgcagatgcagacccagcagcaacagcaacagctgaagctgcgccaggatcagcagcgtcagacgcaggacacgcagcgtaaaatgcaggagcagcggaacagcgcccagcagcgggtgattaccacgcagccgggccagcagaatcagaatcagaatctaaaccagaactaatgaaaatcggggccgatgatgtcgatggcatcagtacagatggcatcgacgccccatttcagcaattcccgcgcccgatccgggctgttcacggtataaaccagaatcttcaggcctgcggctttcagtttcggtgacccgctcagcggtcagcaccttatgattaaggtgaattgagacgcacgccagcgcagctgttttctcctgccactgcgggtcccagctgtgcgacagcaggccacgcggcaactgcggctctgccttcatcgcggcttccagcgcctcaaaagagaacgaagagagcaacggtgcgacctgatcctgccacagtatcgcggcagcctgtgccacggcgcgtccggtttcagcatcgctgccggtggtcggtttgatttcgatgttcgccatcatctgatgctgacggcagcgtgccgccacctgatccagcagcgccagcttttcaccggtaaacgcgttgccaaaccagctgcccgcatcaagctgcgacagcttctcccacggcagctgacccgccacgccccagccgttgctggtgcgatcgagcgtgtcgtcatgcagcaggaagatctgcgcatcggccgataatttggcatcaaattcaatcatctgatgaccatatttcgcgccagtgtcgatcgccgccagcgtattttccggtgccagtttaccgccgccgcgatgggcgacgatgtggggatagggccagtgttgtgtgctcattccagacgctttccatgggttgaatcgaagaagtgtaacgcatctgacggcagatgcagccacagcgtactgcctggctgcgggcgttcactgtgggctaagcgtaccaccagtggcgtgtcaccgatgcggccatgtgccagattatcagcccccagcatctccagcgtatcgacccgcagcggcacgccgccctgctcgcggctactgagccggatgtgctctggccggatgcccagcaccaccggtcggttagcccatttcgcttttgtatcgctgagcggcagggcgtgcgaggcgtcgaggtcaaagcgtgatccatcgctgctgaactgccctttcagcagattcatggcgggcgcgccaataaacgaggcaacaaactggctggcgggacgctcatacacctcgactggtgtgccgagctgctcgaccacccctttgttcatcaccatcacccgctgcgccagcgtcatcgcctccacctgatcgtgggtaacatagaggctggtggtctgtaagcggcgatgcagctgctgcagttccagccgcatctgcacccgcagacgggcatcaaggttggagagcggctcatcaaacagaaaaactgccggttcacgcacgatcgcgcggcccatcgccacgcgctgccgctgtccgccggagagttcgcgaggccgacgcatcagcagatgatccagttccagactgcgcgccgcgtcgagcacccgctggcggacctgctctttgcccatgccacggattttcaggccataggccatgttctcctccaccgacatatggggatagagcgcgtagtttctggaacaccattgcaatcccgcgatcttttggctcttcctgagtaacgcgccggtcgtcgatatagatatcgccggagctgacgcgctccagtccggccaccatgcgcagcagggtcgatttaccgcagccggatggcccgaccatcaccataaattcgccgtcattgatggtgacattcagcggctggatgatctgatttttgccatcgtaggatttggttactgcctgaagggttacgcctgccatcttatttctcactctcaaccagaccgcgcacaaaggcacgctgcatgactaacaccaccaccaatggtgggatcagggttaataacattgccgccatcacttcgttccactgggtcggtgagccgctggtggagatcatgcttttgatccccgccaccgccgtgccgaggctggcgtcattgatgatcagcagcggccagaggtactggttccagccgtagataaaggtgatcacaaacagcgccgccagattggttttcgacagcggcagaacaatgtcgataaagaagcgcatcgcgctggcaccatcgatgcgtgccgcctccaccagctcatccggcagcgacataaagaactggcggaacaggaaagtggcggtcgccgaagccatcagcggcagggttaatccgctgtagctgtcgagcaggttgagatcggcaatcacctgtactgtcgggaagatacgcacctcaaccggcagcatcagggtgatgaagatcagccagaaaaagagcgtgcgcagcggaaaacgaaaccagactagcgcaaacgccgacagcatcgacaccgtgattttgccgaaggtgatgcccagcgccatgatcatgctgttgagcagcatcaggccaaacgccggcccgttgccgttgacgccatgcgtccagatgcgcgagatgttctcccacaggtgcgtgccgggcaccagcgtcatcggcacctgatagaccgcttcgttagccagcgtcgccgccacaaaggcgacatagagcggaaacaggatggtgagcacgcccagcaccagcacgatgtggctgaagagatccagcccgcgtcgattctcaatcattggtattgcaccttacgttcaacaaagcggaactggagcaccgtcagcccgatgaccagcagcatcagcaccaccgactgcgcagcggacgaggagagatccagaccggtaaagccttcgcgatagattttgtagatcagcgtggtggtcgcctgcaccggcccgccgcctgtggcggcatcgatcaccgggaaggtatcgaagaaggcgtagatcagattcaccaccagcaggaagaagctgaccggcgtaatcagcggcagcgagaggttgaagaagcgacgcaccggtccggcaccgtcaatcgcggcggcttccaccagcgatttcgggatcgattgcagcgcagcgaagaagaacaggaagttgtagctcatctgctgccagattgatgcaagcacaatcaggaacatcgcctgaccgctgttttgcgcatagttccagttgtagccgatgtggttcagcagatagctgaacaggcccaggcccggattaaacaggaacatccacagtaccgcggccacgacaggcgcaacggcgtagggcagcagcaacagcgtctgatagagacggcgcagccgcaccacataatccaccagcgccgccagcagcagcgaaaagaccatgccgaacaccgtgaccatgccgctgaattttatggtggtccagaacgaatccagatagtaaggatcggcaaacaggcgtctgaagttttccagcccgacaaagctgctggagatgccaaagggatcgaggctttgcagcgagtaccacagcgcttcaccggcaggccagagaaagaagatggcggtaatcagcagttgcggcagcaccagaagatagggcaacagactggtgcgaaagaccggacgagatgaagacatggtgcacctggcgtcagagagaggggccagcctgagctggcccgcaaggagagattacttcacctgctgctggaagcggcgcagcaactcgttaccgcgtttcactgcgttatccatcgcgtttctgcggcgactgcttgccggtccagacgctttccagctcttcgtcgatcacggtacgaatctgcggcatgttgcccagacgcatgcctttggtaaacggcagtggcggcttgttcatcatctgacgggtggcgatatccgcgcccggattcttatcgtagaagccctgctgtttagtcagctcgtaggcggcggtggtaatcggcagatagccggttttctggtgccattccgcagcgatttccggtttagcgaggaactgcataaactcagccacgcctttgtaggttgtcgcatctttgcctttcatcacccacaggctggcaccaccgatcagggcgttctgcggcgcattcggcacggtctcgtcatacggcatcatgccaacaccgaagttgaatttggcgtaatgacggatatcagccagcgaacccgatgaggcggtggtgataccgcagtcgccgttgtagaacttggcggtggactcatctttgcggccaaagtaggtgaagtcccctttcttgttcatcgcttccagcagctcgatatgacgaaccagtaccggcttgttgaactccagcacggcgtcgagtccgtcaaacccgttgtttttggtcgctaccggcagagcgtgccaggcgctgaagttttcaatctggatccagccctgccagccgctggcgtagccacagctcatgcccgatttgcgcagtgcggcggcatccgtcgccagctcctgccaggtttttggtggctgatccgggttcagacccgcttttttaaaggcgtctttgttgtagtagagcactggcgtcgagctgttgaacggctgagagatcagctgacctttgctgtcgctgtagtagcccgccaccgttggcacgaactgcttttcatcaaaggggataccggcgtctttgaagacctgatgcaccggcacaatcgcctgcgaggccatcatggtcgccgtaccgacttcataaacctgcagcaccgcaggggctttgccgctgcgcactgccgcaatccctgctgccaggctctgctcgtagttacctttgtaggtcggaacaattttgtaatcgggatgcgtctggttaaaacgctgtgccagcgaatccacttctttgcctagctcgccttccatagagtgccagaaagggatctcagtggcggccatggcatggctgctgagcgtcagaccgagcagcacgctcatcaggctacgacgaaaggtaacgacggacatagaattttcctgtgcaggtaaatacgcgtgaaatcacggatttctgtttcgcgaagtaacatgacacggggaaatgaaggattaataacagaaagatgacagccgggtgacagaccggtatgcgcaaaagaggaggctggcagcgcagcggtaacgcgtcactgctgccaggttttggttacataatttgcagagcggttgggcagtaaaaaagcccgcagcggattctacttcaccaaatgcaaaaggcgatggcggcccctctaacaccgacactcaaggccgtctgcgccgcatcacacacccattttgaaagccgtcggcggcgcaggcaggttgcgggcggacagcgcgcagccaccggagcgtacacgtagtacgtgaggatggcgagcactgcccaaccgcaacctgaccagtaagccaggcctgtgtaccaaagcgcgcagtaaccggagcgtatatatatacgtgaggattacgagcactgcccggtgtcgaaatggcaagtaagccaggccgtgccccatcaggcacctaagtaagcactgcggacggcttcgttggaaaggagagctgaacctgtgtcttcgagcaccacatgcccgtttctccagcacatagcccctatccgccagcttcagcgcctgattcgcattctgctccaccaggaaaatcgtcatcccctcgctgcgcagctgctcaatggtgtcgaagatttgctgaataatgatcggtgccagtcccagcgacggctcatccagcaacagcaggcgcggctggctcatcagcgcacgaccaatcgccagcatctgctgttcgccgcccgacatcgtcccggcgcgctggattttacgctcctccagacgcgggaagagttcataaacgcgcttgatccgcgtcagatagtccggacggctggcaaaaaagccccccatcgccaggttctcttctaccgtcatgcgcgaaaagacccgtcggccttccggcacgatggcgatcgcttcacgcataatgcgtgaggtttgccagtcggtaatggttttgccatcaaaggtaatggtgccctgcgtcgcgcgcggctcgccgcatagcgtacccagcagcgtggtttttccggcaccgttagcgccaatcagggtgacgatttcgccctgattgatatagagactgacgttgtgcagcgcctgaattttgccgtagtgggcgctgacgttctcaatggttaacatcgcatttgccatctcaggcctctcctaaataggcacgaatgacatccgggttattacgaatctcttccggcgttccgttagccagcggcgttccctgattgaccacataaatacggtcagaaatccccatcaccagcttcatatcatgttcaatcagcagcaccgacaccttatgttcgccacgcagctccgcaatcagcgcgtccagctcgtgcgtctctttggggttaaggcccgctgccggttcatccagcatcaggatttccgggcgcgtcaccatacagcgcgcaatctccagccgacgctgctgaccataggccagattgcccgcctgacggttagccagatccagcagccccacccgctccagccaggtcgccgcacgatccagcgcctcgctctcactgcggcgaaacgccggggttttcagcagaccggaaaatacgccgcttttcagatgctgatgctgcgccaccagcaggttctcaatgaccgtcatctcacggaacagacgcacgtgctggaacgtccgcacgatgcccatccgcgcaatcttctggcccggcaacccttcaagatgctgctcacgcaatgtgatcgtcccgccggttggcttgtaaaagccggtcaggcagttgaacacggtggttttaccggcaccgttggggccaatcagcgaaacgatctcctgcggacgcagctccagcgccacattgttcacggctaacagaccgccgaagcgcatcatcaggccttcaacggctaataaaggctgaatcatgcctgctctccttgtttaccggttctgagcttcagatgcggacgcttcatcggcaacaggccctgcggacgccagatcatcatcagcaccatcaggccacccagcaccagcatgctgtactcattgagatcgcgcatcagctcgcgtgacaccaccagaaggatggcggccagaatcaccgcaaactgcgaacccatcccgcccagcaccacaatcgccagcacaaaggcggattcgacaaaggtaaaggattccgggctgacaaagccctgacgcgccgcgaacaggctgccggcaaaaccggcaaacgcggcactgatggtaaaggcggtcagcttgatgcgggtcgggctgaggcccagtgaacgacaggcaatctcatcctcgcgcagggcttcccaggctcggcccagcggcatccgcagcagccggttgatcacaaacagcgtcagcaccaccagcagcagcgccaccaggtagaggaagataatgcggtcgctgggatcgtacttcaggccaaagaagttatggaaggtatcccagccaccttcccgcggcgtacggccaaactccagaccaaacagcgtcggtttcggtatctggctgatgccgttcggcccgccggtcagggcggtattgttcagcagcagaatacgcacgatctcaccgaagcccagcgtcactatcgccagatagtcgccgcgcagtcgcagcaccgggaagcccagcagcagaccaaacagcgcggcaactatgccggagagcggcaggcactgccagaagccgagaccgtaatagtggttcagcagcgcaaaggtgtaggcaccgatggcgtaaaagccgccataacccagcaccagcaggccagagaggccgaccaccacgtttaagcccagaccgagcatcacgtagatcagcgtcatggtggcgatatcgacggtgccgcgtgacaccaggaatggccaggcaacggcggcgataatcagcaccgccatcaccagcttctgcttcggcgtcgagccatccagacccggtaacaccagcgccggacccgagattttcttcaggccgctttgccataccggacgcagcagttgaaacagaaacaccaccgcacagcctgtggcgatccagttccagcgcacgctaccggcgttctgcaccaccagattagtgccgtccagattcaggcgcagccccataaagaaggtggcgagcaccagcagcatcaccgaggagatcagggcattgataaaggaagtcttcatactttttcgacctccgggcgacccagaatcccggtcggcatcaccagcagcaccacaatcagcagggcaaacgagaccacatctttatattccgtgctgagataggccgaggtcagcgcctcggcgatgcccagtaccagaccaccaatcatcgcgcccggaatactgccaatcccgcccagcacggcggcggtgaatgccttcatacctgccataaagccgatgaaggggttgattgaaccgtagaactgtcccagcaatacgcccgccaccgcggccatcgcggcaccgatgacaaaggtcagcgagatcacgcgatccgtattaattcccagcaggctggccattttcaggtcttctgcgcaggcgcggcaggcgcggcccatgcgtgagtagcggataaaggtggtcagcgccagcatcgccaggaacgtcaccacccagatcactatctgcatggtagaaatcgtggcggcaaagccgttgctctcgcctaccgtccactgtccggtaatcagactcggcagcgccaggtcgcgtgaaccctgcgtcaggctgacgtagttttgcaggaatatcgacatcccgatggcggagatcagcgcaatcaggcgcttggacgagcgcacaggccggtaggcgacgcgctcaatgctccagccgtaggcgctggagataattaccgccatcacaaagccggccgcaatcatcagccaggtggtgtcgatgcccatcatcatcagggcggcaatcacgataaaggagacatagctaccgatcatgtagacctcgccgtgggcgaagttgatcatgccgataatgccgtaaaccatggtgtaaccgatggcgatcagcgcgtaggtgctgcccagggtcacaccgttaaacatctgctgaataaaatagagaaactgctcggacataccttgacccttacttaaccgatcatgggcgatcggggtacaaaaaacgcctggcagacccgcaccaggcgtttcgtgtcgctggtcaggggaaaccggttaaccggcctcccgctcaccacaaaacagcctggtttacttcactgcggtcgaggtgccatcggcatgccatttaaagacgccgaattcaaagcccttaaggtcacctttctcatcccagttcaggttgcccatgacggttggcaccgcggcaccttccttgaggtttttcacgatagcgtccggctcagcgctcttgctgcgttccatgccggttgccagcgactgcagtgcggcataggtggtccagacgaacggtccggtcggatccagtttcttcgctttcagcgcttccacgatcgttttgttggtttcaacctgatcgtaacgttttggcagggtcaccagcatgccttcagaagcggcaccggcgatgttcgacagcgaggcgttacccacgccttccggtcccataaactgggttttcaggcccgcagcacgtgcctgacgcacgatctggcccatttccgggtagtaaccgccgaaatagacgaaatcgacgttctctttcttgaagcgcgcgaccagcgtagagaaatctttatcgccagcggtgataccttcaaacatcacgatattggcgccctgctttttcaggctctcctgtacggagcgcgccaggccttcgccatactgctgtttgtcatgcaccacggcgatgcgctgcggtttaagctcgctcatcacatatttcgcggcggtcggaccctgatcggagtcgagaccggtggtgcgcataatcagtttatagccgcgggaagtcaggtcaggggcggtcgccgccggggtaatcatcagcacgccttcatcttcatagatgtcagaagcgggctgggtggatgaagagcagagatggccgatcacgtagcggatgccgtcgttaatcaccttgttcgctaccgcaaccgcctgtttcgggtcacaggcgtcgtcatatttcaccgcaaccagtttgttgccgttaacaccgcctttagcgttgatatcttcaatcgcctgagtcgcaccggcgaactgcatgtcgccgtactgcgccaccgggccagacattgcgccgacaatcgccactttgatatcttcagccagcgccgcatggctcatcgccagtgctacacatcccgccagtaatgcgcgacctttcattttcatcctgactaccccatttgttttgtcgtgtatgttgtgagtgtttgtgctgtcagataaagtcgaaaactgattaagcatgaatgagttagcgtacttttctgacattttttattaataaggctttatttttcaggttattaaacaggaagtttcttctgtaaatcaactgacatattcagaattgactgagtgaaacagcataatacactggaggcaacggccggtttttcaccgctttgccagcgcgttatgctggattgatcgcacgctctccctgtttacaactatcatcctggcatcccgaccatcttttgacctgttttattgatgaaaatgtggtagcactctggttgtacattttcgctgcactttcccctgttacagaggtttttgttatgaagctcactatccagcgtttaaccacgctgaccgcgcaggaccgcatcgatcttggcaaagtctggccggatctggagattgaacaactggagcagcagctggatgagcgccatcgtctctatgctgcccgttttaacgaccggctactggcgggtttgcagctggaaatcgccggaatccacggcaaagttcaccggctgtcggtgcgcgatgtcacgcgccgacgcggggtgggacaatatttactggaagagacgatcaggcagaatgggtcgatagcggactggtggattgccgatgatggcagtgatgatcagcaggtgcgggcagcctttatgcaggcgtgtggcttcagggcgcagagtgacggctggataatggcggtagaatagtcaggcgcagaaaaacaaaaagggcgacataaagtcgccccttaagatgtcgaagtgcgttacgcttcgatcgccatacgcagtttcttcatggcgttcttttccagctgccggacacgtttcggctgacacgccgtactgatcggccagctcctgcagcgtggttttattgtcttcgtccagccagcgggcgcgaatgatgtgctgactacgctcatccagaccttccatcgcatagctcagcttgtcagccgcgtgcgcatcccagttatcctcttcaatgccgtcagcaaagtcagaggttttatcctgaagataaagcacgggtgccatagatcggccttcgctgctctcgtcgtcggcagacatatcaaaggtcatatcctgcgcggccatacgcgattccatttcacgcacatctttgctgcttacgcccagctcacgcgcaaccatctcgacttcgtcctgattgaaccagcccagacgctgcttggttttacgcaggttaaagaacagcttacgctgtgctttggtggtcgcgactttcacgatacgccagttacgcagcacgtattcgtgaatctccgctttaatccagtgcacggcaaacgaaaccagacgcacgcccacttcagggttgaagcgacgtaccgctttcatcaggccgatattgccttcctggaccaggtcagcctgtggcagaccgtagccggagtaattacgagcgatatgaactacaaagcgtaggtgagacaggatcagcgtctttgccgcatccagatcgccctggtaatgcagccgttcagccaacgctttttcctcttctgccgaaagcatcggccaggtattcgcagcccggacgtaagactccaggttgccaagaggagcaatagctaaagtttgcatttctttggtcattcaaaccctcacaaattcagtggaattgccgcacatttccctgcgcagacgatacattacgttaacgtcgcgcgaaatccgaaagcaatctgtgctacttagagtggtaaagttatccacaagttcaattatagcggtgaatattttacacacagatgacaggaagggaagagaggaaatatcctctgcacccaccatcggtagcagaggaccattataacaaaaaaatgttgcaggcgtttactgcggcgtaaatcgacgtaaatgttgtaccgttgccagccacgcagccacccagccgatgattgccgcaatcagtaacagcagcagcgcctcatcccacgagaagccttccagcgagaaggtggtaccaaataccgtcgccacgctggcaacaacggactgcagacgcagcaccagcacttccgacagcagcagcgacagcaccgcaccgctgaagcccagcagcgccccgccatagaggaatggacgcaggataaagccgtcagtggcaccaatcagcttctgcacgttaatggtgtcgcgtcgggcaaagatgctgagccggacgctgttaccgatcaccaggaacactgccacgatcatcagcacgccaatcattgaggcgatctgccccaccagcccggtcagcgccgccagccgcgcaaaccagctatcatccatccgcacttcatccacgccctgcactttagttacccgatcgcgcaggctttgcatggtgtctgagttctggaaattgagcttaggtgtaatgatggccaccgcaggcagcggattctgctccagcatatccattgcgccgccaaagcctgaccagttgcggaactcgttcagcgcctcttcccgcgtcaggtagttgacgttatccacgccttcgacctgcttgagctgcgccaccacgttttctgccgccgtgtcatccagcgttttggagagataaacggttaactgcggcgccggataccactgcgttgccgcctggctgacgtttttccacaccatgtagcagacgctgggcagcgtcagtgaaatggcgatgaccatcaccgtcagcagggttgccagcggctgacgccacatatcagaaagcgtgccgcgcagcgcatagcgccactgctcctgccagccgcctttcagcgctttgctcttcgactgctgcttcgctttcggcgcagccggacgtttaatgcgtttattgaccatcgtggcctccgtgcagacgtccctgattcagcgtcatcatccggtagttgcgtcgggcaatcagaccgctgtcatgcgtcgccatcaggacggtgacgccgacgcggttaaactcttcgaacaggcgcagaatatcttctgacagcgcgtcgtcaaggttaccggtcggttcatcggccagcagcacggctggcttgttcaccaccgcacgggcgatgcccacacgctgctgttcaccgccagaaagctgaatcggataacttttcgctttgtcgagcagacccactttatccagtgccgccgaaacgcgacgacgaatgtcttcgccgctggcaccggagataatcagcgggatcgccacattttcataaaccgaacgatccatcaacaggtggtgatcctggaaaatcatgccgatctgacgacgcaggaaaggcacctcgctgttacgcaggcgggaaatgtcatggccgctgaaccagatttttccggcactcgggcgctcaatgccacaaatcagcttcagcaaggtacttttaccggcaccggagtggccggtcagaaacgccatttcgccaggacgcagacggaaatctaccccctgcagcgcctgacgtccgccgagatatgccttactgacctcttcaaagcgaatcatcctaattagtcctctcgggcaaacagtgcctcaataaaatcttccgccttaaacggccgtaaatcttcaatgccttcaccgacgccgatgtagcgaatcggaataccgaactgatcggccaccgagaagatcacgccgcctttggcggtgccatccagcttggtgagcgcaatcccggtcacgccaacggcttcattaaacagtcgggcctggctgaccgcattctgtccggtgctggcatccagcgtcagcatcacttcgtgtggcgctgaatcatccagttttttcatcacgcgggtgatttttttcagctcttccatcaggtgcgatttgttctgcagacgacccgcggtatcggcaatcagcacgtcaacgccacgcgatttcgcggcctgaatagcatcgaagatcaccgaagcggaatctgcaccggtgtgctgagcaatcaccggaatgttattgcgctggccccacacctgcagctgctcaacagccgcggcgcggaaggtatcaccagccgctaacatcacggatttgccttcagcctgatactggcgcgccagtttaccgatggtggtggttttacctacaccattgacgccaaccatcaggatcacaaacggcgttttgcctgagacgtccagtggcgcgtccactttcgccagaatcgaggccatctccgctttcagcaggccgaagagcgcttccgcgtcacgcagttgcttgcggtttgcctgctgggtcagatgcgtgatgatgcggcgagtggtatccacacccacatccgcaatcagcagttgctcttccagctcgtcaaacagctcatcatcaatctttttgccacggaacaggctgataaaaccggaaccgaggttctgacgggttttcaccaggctgcgcttcaggcgggcaaagaagccctctttgctgggacgctcctgctcctgcacgatgagtggcgcggcggccagcgggagatcgctgacggtatcggataatgtctctgccggttccgcgtcggtgacttcggcttcgcccagtgccagtgcggtcagctcttcctcggtgagcggtgcttccgtttcgctgtccggggtttcaacgatcgcagcttcgtccggcgtcagcgcttcatcgcttaacggcgcttcggcttcgctgtgcggggtttcaacgatcccggcgtcatccagcgccagcgcggtcagctcttcttcgcttaacggcgcgtccgcttcgctgtccggggtttcaacgatcggggcgtcgcccagtgccagggcggtcagctcttcttcgcttaacggcgcatcggcgggttccgcatcaacggctggttttaccacgtcgtcggcgtcaataaccggcgtcgcgtcatgttcaggtgcggtgatttccagtagcgcttcaggatcggcctcaatcggcgcagcttcatccagcaccatgggtgccgactcgtgcggcgctgccgcggtgacttccgcctcacgctgctgcccggccaccgtttcggtgataacgacagtctcttccgcttgcgcttcagcctggcttaatgccggggcgtcctgttctgcctgctgctctgcgggtttctgcgacctcttgtgtctgctcctccgctacaggttgtttctcttcctctttgccaaatcccagccaggaaaaaaagccacgttttttctcttttgccattgtgtgacgacactcctcgatggctttgtcccggtcgcgcgtggtttccaggggtaaatcaatgaaagttggtcagcgccagaccggcgtaaaccgcagaataatgcatgacttcagcaactcagtagtctaacactttccagccagctcaccacagcacccttttttaacgtttcttctcaccgattcgcccgttaaactacgcaacaaattatgacgagttgtgagcaagatgaataaaaacccccgcagtacaggcggtgccgggcagattcgcatcattggcggccagtggcgcggacgcaaactgccggtgccggacagcgccggactgcgcccgaccaccgatcgggtacgtgagacgctgtttaactggctggccccggtgctgccagatgcgcgctgcctcgactgctttgccggtagcggcgcattaggactggaagccctgtcgcgttacgcgggatcggcgacgctgctggagctggaacggccggtggcgcagcagctgacaaaaaatctgcagacgttgcgcgccagtaatggcaccgtgattcagaccaatgcgttaaactggctggcacagccaggtgaaccctttgatgtggtgtttatcgatccgccgtttcgtcagggattgctggaacagacgttacagctgctggagcagaatcactggctggccgatcaggcgctgatttacgtcgaaagtgaagtggaaaatggcgcaccgccggtgccgccagagtgggatctttatcgcgagaaaatagccggacaagtggcttatcgtttgtatcaacgtcaacaggagacgcaggatgttacttaatttggggcgtctgttgatgctatgcgtgtggggatttttactggctaacctggttcatccctacccgaaaccgctgacttattttatcaacgttgcgctgattttcatgatcctgatgcatggcctgcagctggtgttactgcgcaccacgcagaccaaagatgcgccgccgattgaccgcgtcacccaagccaaagtgtttctgttcggggtattcgaactggtcgcctggcagaagaaaaacttcccacgcaagaaataatcccgggcgggcgcgatgcccgccggttactgccggggtgtgaagctgataaagcgcgtgccctgcatcttcagctcgcctctggcgcccttgtccagctgatgatattccgcctctttaagctgcactttgatgtcgctggcaccgttcagcgggtgaaacagcacctcgtagcgcatctcttccccggcgatcacttcccgctgccgtgaacggcgattgggtgcaggaaattcacgtttggttttgacctcaacctgcagagaaacgctcgggtgaagcgtcatttaccgccacttcccggcgttgcttaatgaactgacgggtcgccagcacggcgataatcgccagaacgatgataaagattagcggcggtttgctcatagcgttcttgtgcctgcaggatgattaatcaggcggcaaagcatacaaccagagttgcctgattgtcacatctcagaggcttaacctaaactggaagggatattttgggatctttcaccattttgaacaaaaaagggagaaacaatgctctggtctttcctcgctgtacttttctccggctggctctatgtcgacgccacctatcgcggcccgcaatggcaacgctggttatttaagccggtcacgctgctgctgcttgtcgggctggcctggcaggcaccggtgctgcagactacggactacctgattctggccggtctggtcgcgacgctggtcggtgatgcgttaacgctgctgccgcgtcagcagatgctctatgccatcggggctttcttcctgtcgcacctgctttataccctctgcttcgccgccagcatgaccatgaccttcttctggccgattccgctgacgctgctcatcatcggtgccgccctgattggcatcatctggagccgactggaagatctgcgctggcctgtctgcacctttatcggcatgacgctggtgatgacctggatagcgaccgagcagtacttcttccgcccgaccgattacagcttctcgatcatggttggtgccggtctgctgctgctggcaaacgccgtctggtttatctctcactatcgtcgccgctttaccgccgacagcgcgattgtcgccgcctgctacttcgccggtcactttatgatcgtgcgctcgttgtgggtcgtctgaaaaaatagccttgactctggagttcactccagagtgtaggataaaggatgggctgcgttgctcatcccactattcttacactctggaggtcatatgcatcaacatcacgcctgtggctgcggcaaaccccgtgccagtcacgccgcagcaaaaccgctgtgccaggttcgccaggcccgccccctctccctttctattcatgccgcgacgcctgtacctgccgagacggcaggatgttgctgtgacagtcactgcagccctggcaacgacaccgacaccgctgaggaaagcgaccggcgaggtgccgacagttatccctttagctggcaggtcagcgggatggattgcccgtcgtgtgcccgcaccattgaaaccgctgtccgtcaggtgagtggcgtgaccgatgcccgtgtcttgttcagcagcgagaaactggtggtcaacgctgaccaggacgtacaaaacgccgttgaacaggcggtgaaaaaagccggcttccagctcgcaaccccatcagccacgtcggccacatcccccgctacgccgggctggcagcataaccagatgctgattttgctggcgctgctggtgcttgccagtagcattctcagccagttcgcgcccacctggggcgatcggctgtttgtgctgaccacgctggtcggcctggtcccggtggcgcgcggcgcctggcagcgtctgcgcagcggatcgccttttaccattgagacattaatgacgctggcgtcagctggcgcactgattattggcgcacacgctgaagccgcgatggtgctggtgctgtttcagctgggcgaaacagctggaaagctatgccgcttccagggcgcgcagcggcgttaccagcctgatggcgttgcggcctgaatcggcgatccgccttgaacagggcaaacgtactgaggtaccgcttgcagcgctgcaacccggcgatgtgattgaagtcgcggcgggcagccgcttgccggtcgatggcagcttaatcagcccgcttgccagtttcgatgagagcgcgctgaccggtgaatcgctgccggtaacgcgggccagcggcgaaaaaattcttgccggtgccaccagcgttgaccggctggtgatgctggaagtggtgtcgaagccgggtgaaagcgcgatcgaccgtatcctgcagctgattgaagaagcggaaacgcatcgtgcgccggtcgaacgctttatcgaccagttcagccgtatttacacgccgctggtcatgctgctgtcgctgctggtgatggtggtgccgccactgctcggcgcaggcgactggcagccgtggatctacaaagggctgacactgttgttgattggctgcccctgtgcactggtgatctccacgcctgccgccattacctccgggctggctgcggcggcgcgacagggcgcactgatcaaaggcggtgcggcgctggagcggctgagttcggtgcgcagaatggcgtttgataaaaccggtactctgacgctgggcaagccacagctgacgcagatcctgcgctttggcacggccagcgagtcagagatgctggcgctgagcgccgctgcggaacagggtgccacccatccgctggccagcgctatcgtggcggccgcgcaggcgcgtgatctggtgattcctgacgcgcaggatcagctggtgcaggcgggacgcggcatcagcgcgaaagtcgctggccagcagattcagctgctgacgcccggccatgcacccgatctgacgccgcagcaaaatgcgcagatagcgcaacaggaagctgaaggtgaaaccttggtgttgctgatgcgcgatggcgaagcgctgggtgcgctggctctgcgcgatcagctgcgcgacgacgccgttgaggcgttaaaggcgctgaaaaagctgggtattgagagcctgatgctgaccggcgacaatccgcgcgctgcggcgaccattgcccgccagctggatattgattatcgcgccagtctgctgcccgccgataaagtcgcggcgatccgcgaactgagtcagcaacagccgctggcgatggtcggggatggcattaacgacgcgccagcaatgaaagcggcaacgctgggcattgcgatgggcagcggcaccgatgtggcactggaagcggccgatgctgccctgacgcgtaatcagctcagcaatctggctccgatgattgcgctggcacgccggacacggcgtatcatccgccagaatatcggtattgcgctggggctgaaggcgattttcctggttacaaccctgctgggtctgaccggactctggctggcggtgctggcggattcgggtgcgaccgcgctggtcaccgccaacgcgctgcggttactgcgtcgccgcgcctgatcaggcggcttctgatctgaagagtgaggttaacggcggcctgtacggctgtcgtcaacccgccatgcctttgcggatcagaaactgatagggcagcgtgtcggtttgctgcgccagcaagccatgttccataaagcggcagaagccgggaatatcgcgcgtggtggccggatcatcggcgatgatcagcaacgtctcgccatcctgcaggctgcgtacggttttgcgcaccatcatcaccggctccgggcaacgcaggccacgggcatccagctgatggtcggcagaggaaaaagcatcgctcataatcaactcggttcaggtaagggacgctcattctagcgcgtgctggcggtgaagcaaggcgataacgattgcgctaaaattaaccattgcataaaaagcacaacgcggtaagatgccgccgctttttgctcataaaactgccaggcgctgcccgaacggcgtcccgcaatgggttccctcaccccaacattaaaaaggttgaatatgctcgcattttcttcgcgtcagcgcatgcatgcgcttttctggttatcgctgtttcacctgctggtgatcacttcgagtaactatctggttcagctgcccatttcagtgtttggcttccacaccacctggggtgcattcagcttcccgtttatcttcctggcgaccgacctcaccgtgcgtatttttggcgcaccgctggcccgacgcattattctggccgttatgatcccggcactgtttatctcttacagcgtctcagcgttgttctatcagggtgaatggcagggctggcaggcactggaagtgatgaatctgtttgttgcccgtatcgcctgcgccagctttatggcttacgcgctgggtcagatcctcgacgttcacgtgttcaaccgtctgcgtcgcctgccacagtggtggattgcgccgggctgcgccatgttcctggggaatatcagcgatacgctggccttcttctttatcgccttctataaaagccccgatgcgtttatggcgcagcactgggttgagattgctctggtggattatagcttcaaggtgctgatctgcatggtcttcttcctgcccgcctacggcgtgctgctcaacgcggcgctgaaacgtctggctgaacgccagaccgcccgccaggtcaatttcggctaagtgcccatacggtttccactactatccgctaagatcttctgacaatcatcaggttgcgtttgcaacctgattcctgttgtattaatgcctgactggaaacttaaaaagggattctgatgcgcaacctggtgaaatatgtaggaatgggtttactggtactcggcttagcggcctgtgaccagaagaaagatgaagcggcgaatgacaacggcgtcagcgccagtcagtcggcgcaaaccgtcacgctgatggatggcaaactgagcttctcgctgccaccaggcatgtccgataaaagcggtaaactgggttcgcagaccactaacatgcacgtgtatgcggatgaaaccggtgcccgcgccattattgtgattgccggtgacccgaccaatgatggtctggatgtgctgtcgcagcgtatggaacagcagcagcgtaaccgcgatccgcagttgcaggtggtgtcgaacaaatctgtgacgctaaaagatcagcccgcacagcagctggatacggtgatttctgccaataaccagacctcatggtcttcagtggttctggcgaaagtggatggcaaactggtgacgctgcagattacgctgccaggtgataatcagcagcaggcgcagagcgatgctgacaacatcgtgaaaagcattacgctgaagtaaaacaaaaggctggcttccctgcacggggaagccagccttcggtctgaagggctttttataaacctgcattctcgcgaatatatttccgcgctttcaccgcatattcaaacggattggccagtgccggatcctgctccgcttcaaccaccatccagcctttatagccgtaatcatccaggattttgaacaccggtctgtagtcgatcacgccatcgcccggtacggtaaaggtgccctttttcactccttccaggaacgaaagatggttctcacgcacctcggcgaccacctcatcacgcacatccttaagatgaacgtggaagatgcgcggcagatatttctccagtaccgccagcattttctgctgggagccttcggagtagtagacgtggccggtgtcatagagcaaaccgacctgctcgtcggtcatctccataaaccggtcaatctcttcagtggtctgaatgccggtgcccatatggtgatgcagcgtcacgcgcatccccttctccgccgcgatgcgggccagtttcgttgtagccttccgcggttaactgccactcttcatcgctgaaaatggctttctcttcaaacaccgcaagcccggtgccctgaatacttttgctctgctcggaacagccaatcacccgcgcgcccattgcatgcaggaagttcatatgctcgatgaactgttcgatggttttctgtttgtcgccgttggcgaaaaaggtgctgaaccaggcgttacagatctcgatgccgcgaatgtcgagcatcggtttcaggatcgccggatcgcggggatatttgctgcctacttcgctgccggtaaagccagccagcgccatctcactgacggtctgctggaaggtattctcactgccgagatccggcatgtcatcgttggtccagccgatcggggcgatcgccagttttacattctctttgttcattatcttattcccaggcggagagcggccatgccgcatagacagctaaatcagttatagaaagcaggacgcggcggcatctctaccggctcaatcgcaccactgttctgcgctttaatgcaggcatcggcggcgactgaggcggcaaagccatcccaggcagaaggaccggtcaactggcccgctttgatgtcgttgataaacgcctgcagctcaacgtcatacgcttcgataaagcgatctttccagtccaccagaatggtgttcgacaggcgggcctctttgcgcagctgcaccgaagagggctctggcaagcgcgcaatcccctcttcacccaccacttcacactggatgtcatagccgtaagcgcagttaacgaagatctcgacgtcaatgcgaacccctttctgggtttcaaacagcacgatctgcggatctttcagctgactgtgtgacttcgaggtgacgcgcgggaagactacctgcaccgttttatagtcatcgtttgtcagccagcgcagcacatccagctcgtggatcagggtgttggtgatcgccatcggcgtggtgtagttctccggcacggtcgggttgcggtgcgcacagtgcagcatcagcggctcaccgatatcgccatcggtgatcacttttttcagtgcacggtagcccgcatcgtaaggacgcataaagccgacctgcaccaggcgtttacccgcctgaatctctgcatccacgacccggcggcagccctcagcgctcatcgccagcggcttctcacagaacaccggtttaccggcggcaatcgccgctaaggtgaactcttcatgggtcggatcccatgaggtgaccagcaccgcatcaacatccggagactgaatcacgtcgtgtccattttcgaataccttcgcctcaatattcaggcgttgcagtgcggcacgcgcgccttcgacattaatgtcagagacggcaaccacctgtgcaccctgcaacacatggctgcagcgacgaatatgttcctgaccaattgcacctgtaccgatgacgccaagtttcaaagtcataattacacctgtgtagggttcgtacggagaagagcaaaacgggccgtggcacggccctgaaattaatattttcgcgcctgatccagatggctgttgagcttgtccgccaccgcctgagaacgttcggtcttcgaggcctgcgccacgccgacgtgccaccagctgaaatatttgtggatcatggtttttggcagcactttgatgtcgataagggtggaaaccgtctgcgtgcgggcatcttccagcgccgccttgagctgctccagcgtggtcacacgataggttttgcagccataaccggcggcgatagcggcaaaatcgaccgggataaagccgccgtccagcttgccaccttccgcattacggaaccggaactcggtggtaaagctgtccataccgtgttccatctgcaggttattgatgcagccgttggtcatgttatccagcagcactacgttgatcttcgccccttcctgaatcgaggtgaccagctctgagtgcagcatcataaaggagccatcaccgaccagcgcatagacctcgcgctgcggctgcgccagcttcacacccagcgcggcattcacttcataacccatgcaggagtagccatattcaacgtggtaggcgttgtaatctttggtgcgccagacgcgctgcaggtcgcccggcagactgcccgccgctgccactaccactgcgtctttcggcagttgctcatttaaggtgccgagcacgctgctttgcgtcagtagcgactgggtcaggcggttaaactcagcgaacaccgcttcgcggtcgagatgatccgcaatctccggcacaaagtcgccatcgtgatattccacctggtagacgcgctgcgtctctttcagcagctggctctgcgcctgctcaatctggttgccccagtcgttgctgtagtgctgcgaggccagcccggcggtgagcgcggtcagcccttcgcgtgcatcagccagcagctgcacgccatcgagcttgtagctgtcaaagttgctgacgttgatgttcaggaagctgacatcgggatgctggaaaatccatttcgacgcggtggtgaagtcggtgtagcgggtgccgatgccgatcactaaatcggcctctttcgccagcaggttagccgccagacagccggtttcgcccacgccgccgacattcagcggatggtcagagaccagcgtgcctttgcccgcctgcgtctccgcaaagggaatctgatagcgctcggcaaactggcgcagcgcctcgcccgcttcggagtatttcactccgccgccgcagataatcatcggcttgcgcttacggttaatcagcgtcagggcatctgccagctgcgccgccaccggcaggcggcgatccagacggtgcacccgtttctggaagaagtagtccgggtaatcccaggcttcgccctgcacatcctgcggcagcgacagcgtgaccgcgccggtttctgccggatcggtcagtacgcgcatggcgttgatacaggcggacatcagctgtttccgggcggctgacgcgatcccagtatttgctgacggcgcggaaggcatcgttggtgctgatgctgagatcgtagctctgctcaatctgttgcagcaccggatcgggctggcgggtggcgaagacgtcgcctggcagcagcagcagaggaatgcggttggcggtagcggtcgccgcggcggtgatcatattggccgcaccaggccccacagacgaactgcaggcgataatctggcggcgcagcgactggcgcgcaaagccggtggcagcatgagccataccctgctcattacggccctggtagaccaccagatcgccgctatcctgttccagcgcctggcccagccccagcacgttgccatgtccgaaaatggcgaagatgccttttacgaacttcgtctcaacgccatcgacatcaatgaattgattatcaagaaatttaaccagcgcctgtgccgtggtcagtctgatagtgcccatattcttccttacatgctggtggaccccgacttccgcgacagcacgccaggcgttgtcatcggcggaaaaggcgacctgaataactgaaacgtgaggcgattataaacaaatatatttttcataaaacacgattacagaagaaacatttcattttgcgagtgagatcaaatttaatgacggcaacaggtctggcgggcgattacagtggggaaatctggaacgtttaacagagagtggtgcctgatgaaaaaattcatttcaatgcagcagcttgcctgactggcgtgcggattcctgcgatccccttcacaaccctgacataccgcacatcacgctggcagagttcgctcaggcgggcggcaatcaggagttttacctggttcacaaaattgcgatggatatttcatttcgtattgaatatggaatttttattcctcatactcccctcatagccagtcagacacctacagacccggaagcagagcgtaactggtgtcggtcttcacgcccgccagcgctgctaatcacagaaggaaaccacaggtatgagtacacaacagaaaccgcttgatgtgatttgtatcgggcgcatcgccgttgatttttatggccagcaaatcggggcgcgactggaagatgtcacctcctttgctaaatatctgggcggctcgtcgggcaacgtcgcctatggcaccgcgattcaggggctgaaatcggcgatgctggcgcgggtgggagatgagcataatggtcgctttctgcgtgaagagttgcagcgcgtaggctgtaacaccgatgcgctaatcaccgatccgcagcgtctgaccggactggtgatcctcggcatcaaagatgaagagacttttccgctgattttctaccgcgataactgcgccgatatgggcctggttccggacgatatcgatgaagcctttattacctctgcgcgcgccgtcgcggttaccggcacccacttatcccatcctcagacccgcgaagcggtgctgaaagcgctggatattgcccgccgcaacggcctgcgcacggcgctggatatcgattaccgtccggtgttgtggggactgacctctctgggcgacggtgaaacacgtttcattgagtcgtcacaggtcacgcagcagttacaggaagtggtgcactatttcgatttgatcgtcggcaccgaagaggagtttcatattgccggtggcagcaccgacacactgaccgcgctgaaaaacgtgcgtcaggcgagtcaggcgacgctggtctgcaaacgtggaccgctgggttgcgtggtgtttgaaggcgagatcccggatagctgggaacagactgagctgcacacgggcgtacgcgtcgaggttctcaacgtgctgggcgcgggcgatgcctttatgtctggcctgctgcgcggctggctgaatgatgagggctggactcaggcgtgccgttacgccaacgcctgcggagcgctggtggtatcacgccacggttgcgcacccgccatgccaaccaaagcggagctggatgatttcctgagtcgcgacaaagaggtgaagcgtcccgatctcgacaaccgtctgaaccatctgcaccgcgtgactacccgcaagcagcagtggccggagctgaatgtcttcgcctttgaccaccgcaaacaactggcggatatggcgcaggaagcgggcgtggacgagagccgcattccggaactgaaactgctgctgctggaagccgctcagcaggctgccagagaagcaggattagagaataaaagcgggattctggcggatacgacctacggtcagaaggcgctgaacgccatcaccggtaagaaactggtggattggccgcccgattgagctgccgagctcgcggccgctgcgcctggaacatggcaacatcggctcgcagctgatcgactggcctgccgaacacgtggtgaaatgtctggtcttctatcatccacatgatagtgctgaactgcgtaaagagcaggatgagctggtgctcgacgtctggaacggctgtaacaaaagcggtcatgagctgctgctggaagtgattctgcctgacaacaacccggataagaatgaaacgtattactttgatatgttgagccatttctacagtctgggcatccagcctgactggtggaaactgccaccgctgtcggcggaaagctggcaggcgatcagcggtctgattgagcagcaggatccccactgtcgcggcattctgttactcggtctggatgcgcccgaagagaagcttaaagcgggcttcgccgcggcggccaaagcaccctgggtgaaaggttttgcggtaggccgcacgatctttggtcagccttcccgccagtggttacagggggagctggacgatcaggcgttgattgacacggttaaaggcaactatctgcgactgattgagtactggcgcgctgcccgcgcctgatttgctgctctgtcaaaaagccgcttttagaccgtgcagccacagggaacacggtcagatcggaaagacgcaaaagctgccatccatggcatgctcggcccgcaccatccttggtgcgggacgctttcctcttctgaccgtgttccctgctcgtttagctaatgtgttgctgccagacccgatttttcagcaatctgcagccattccaatctgaatggtgaaagactgcatacttccatccctgctggcatttcatcccggctttcatcctgacattgcccgcgaaaagtcacgcatcgggcgctaaagctaatctgtgaaccatttcataaagccatgaaataaaccgcgtcgttgacgcaaagaaatgaaattttccatccatctgatactatagcgctcattatgcagccattattctaattatacgggcagaagtgatgaacaataatcccacccaactttctctcttgcaggacgatattcgtcgccgctacgaaacgctgagcaagcgtcttaaacaggttgcgcgctacatccttgataacagtaacagtattgctttcgataccgtcgcctcgattgctcaacaggccgatgtaccaccgtcgacgctaatccgctttgcgaacgcttttggcttcagcggcttcaacgaaatgaaacaggtttttcgtcagcatctgatggaggagacggtcaactataccgagcgcgctcgcctgtttcgccagacctccacggacgacagcgccagtgcgcctgaaagtccggcggaaatcctcaacgtctttaccatggttaacagccaggcgctgcagcagctggcgatgcaggttaatcctgagcagctgaacaaagcggtgaaactgctgaatgaggctgagaatatctatgttatcggcctgcggcgctctttcagcgtcgcctcctacctggtctacgcgctgcgtcatcttgagcgccgcgctttcctgattgatggcctgggcgggatgtttaccgagcagctcagcctggtcaacccgaaagatgtggtgattgcgatcagctactcgccttatgcacgtgaagcggtcgaggtggttgaaatgggtgccaaacgcggtgcgcatcagattgccattaccgacagtcaggtcagtccgctggccgccttcagcgatgtctgctttgtggtacgtgaagcgcaggtcgatggcttccgttcgcaggtcgcttcactctgcctggcacagacgctggcggtttcgctggcactgaacaacgcaaagaccagctgagttccacacacaaaaaagggcagcgcgacaggctgccctttttactgatatgaacgcgggttataaaccgtgattgctgtttatttttctgcgatgacttacgctttccgcggatagctgtcgctgttcacccaggcgtgatctttctcccaggtaaatttccacagccgcaccggccccgccatcacgttcagatagtagttattgtatcccgccagcgtcgctaccggatgatagccgcgcggtaccatcaccacgtcgcgattatagggtgccatacagacatccagggaacggtcgtcggtgtagacgcgctgcatggcaaagccaggttccggatcgaaacggtgatagtaggtctcttccaggtaggtttcgttttcactctcctcctggtcgtgcttgtggctgggataagagctggtatcgccctcgttggtatagacttccaccaccagcaggctatcagccggttcattgtcaggcaggatattgtgaaccaggcgctggttgcgcccttttccgcgatgctcaacgccgacatcggctggtgcaatcaggcgcgcaggcagattcccctgaccgggcgcattacagaccgccagctcaagatcgctgtcagcgtaaacctctacttcatcatcatgcggcacataaacagaataaggcggtacgcgctcaaaaggcgacatgcgctgaccgataccgggaaaatcagcatggcgggtttttaccgaggccagcccggccaccagcaccagacacagctctttatcaccactgctaagacgcagggtttcccctttcttcagcaaataggcatcaaatcccacataacgccagccggcacgctcaggcgtcacatgctgaatacgaccctgcgcgtcaggggcttgtgctttcgacagtaaagacatcctgatactcctctctgtcacgattgacgctgcggtgggctcgcgggcgcggtgccagcgaacaaagcgaccggcagattatcctgccggtcgcgcaccgggatcagcgttgaaatgaatcagcctaaggttggcatactgaattcagacacggtctgctgaccggatggccagcgtacggtggccgttttcatgcgggtatagaaacgcacgccatccggcccatgaacattgagcgcgccaaacactgaacgcttccagccgccgaagctgtggaatgccatcggcaccggaaccggcacgttgacaccgaccatacccgcttcaacgttctgcacaaactcacgtgcggtgtgaccgttgctggtgaaaatcgcgctgccgttgccgaattcatggctgttaaccagttgcagcgcactgtcgtagtccggcgcgcgcatgatgctcagcaccggcccaaaaatctcttcacgccagatcaccatctcagaggtgacatgatcaaacagcgtgccgccgacgtagtaaccttcggcgtgacctgcaacctgcacgttacgaccatcgaccaccagcttcgcgccttcctgctcgcctttgtcgatgtagcccagcactttcttctggtgcgccgccgaaacgaccggtcccatctcattttcatcagcgccctgattaatgccagggccgatacgcagcgcgttcaccagcggagtcagacgggcgatcagcttgtcggcagtatcatcgcccacggcgaccacaaccggcagcgccatgcatcgttcaccagcagagccaaacgcaccacccatgatggcgttgacggtggcatccagatcggcatccggcataacgatagcgtggtttttcgccgcgccaaacgcctgtacccgcttgccgtgggcgctggcggttttatagatatgctcagccacgccagaagaaccgacgaagctcaccgcggcaatacgcggatctttatagagctgctcagcatcttcattggaactgtgcacgacgttaaatacgccatcgggcaggcccgcttcggtcagcagttcagccatacgcactgcagcagaaggatccagcgccgggggcttcagcacaaaggtgttaccgcaggccagggctatcgggaacatccacagcggcaccatcgccgggaagttaaacggtgtaatgcccgccacgacgccgaccggttgcatcagcgagtagctgtcaacgccgctgccgacgttcggggaatattcgcctttgagcagatgggggatcccgcaggcaaactcaatcacttcgatgccacgcgtcagttcacccagcgcatcagaccagactttgccgtgctcagagacaatcagcgccgccagctcatcacggtgctgctccatcagggctttaaagttgaacagaacgcgggcgcgacgcagcggcgaggttttcgaccaggcggcaaaagcgtcatgcgcgacaccaatcgcctgggccacttcatcagcggtactttgcgtcagttcacgtaccactttgccggttgccggatcgtaaacaggaatggtttcgttgctggcgctgaaagtggttttaccgccaataaagttacctatgattgtcatgatgttgcctctttagatggttaagttccctgcagacggaccatgcgacctgccacactgcctgaccaggcaaacctgaaagcgtgctatgaagctattacagtggaacaaatttttcaaatggttctttttggaaaatttgattttagcggcacagatcgcatttttcccgccacttagtctctcgcggcatcacgatgacgggaggccactaatagcggccagccttagcgtagcagggtaatagccggggagtggtttgggcgttttactgcgaagttgatccagcctttatgcatcgggctgaaacggaatatgaaattaatgcgaggctgatctaataatttgtgtttcattattcactattaatgaaataaatgttctctttggtcgcatcatcctcctgtcccggagtcagtgcatggccatcgatccaacccgtttctgtatcaaccgcaaaattgcgccccggctctcgctggaggcattttttcagctggttcagcgtctggggctgagcaaggttgaactgcgtaatgacatgccgggcggcagcgtcactgacgatctcagcaccgatcagctgcgcgctctgaccgacaggtatcatattgatatcatcaccattaatgcgctctatccgtttaaccgcattgatgacacgctactggcccgggccgaagcactgttacagacagcacaacagattggtgcaaaggcgctggtcatgtgtccgctgaatgaggggatagccgtgtcgcctcagcaaacccaggcggcgatgcagcagctggccccgcgctttgcccactatggcattcagggtctggtggagccgctgggttttccggtcagctcgctgcgttcggcggtacaaacgcagcaattgatcgccgcggcggacgtgccctttaagttattgctggatacctttcaccatcatctctatgagcaggctgagcaggagttcccagcaggcattgatgttaaccagattggtctggtgcacctttcgggcgtggaagatcgccgtccgaccgccgaaactgaccgatgaagaacgcatcatgctaagtgataacgatgtactgaagagcgtggtgcaggtgaagcggctggagatgcttggctataagggcgtttatgcctttgagcctttctccagtcagctcagcaactggacccctgcggaggttgaacgccagatccgcaacagtattgaactgctgcaagcctgaatcctgttctgcgctttgcgcgcaccattaatcggtttatctgtgtctgaaaagacgttctggcccgctgctgggccattttttttatcctgaagaatcgtctgctgccggcaacaccgcctgacgccgctgcatgcgcagcgtgcagaaaaaagcgacgcagaccagcagcgccgtgagcaggtagacgcgtgagacacccgcataagtcatgatgaatccggcaagtggcccggttatccccagcgacagatccataaaggcggtgtaggtcgccagcgcgctgccctgattctgctgcggcaccacttttaccgccaccacgcccagcgccgggaataccagcgagaacccggcaccggtcagaaatgcgcctgcttttgccatccagggatcacccgctgcggccaccagaaacagtccggcggcttcaaccgccaggcagatgctggcgacccgcagaccgccgtggcggttaatcgcattcgggaacagcaggcgcgcgccgacgaaagcgccgctgaacagggagagcgcaaaggcggccccttcccagcctttatcctgatagaacagggtaataaaggtggcgatgacaccgaaacccgccgaacccatcgccagaatcgcaccaaaaccggcgattttccccagcaccgcacgaaacggcaggggtctggcccggctggcttttacggccggacgcggcaccgcgcagacgatgcctaccacgcagatagcaacaatgaccagcgacagccacagcaggccacccgcccggaatatcaccacgccgagcggcgcaccaatcgccatcgcgccataagtgacaatgccgttccaggagataacccggccaatgtgcagcgaaaacccacccgcgccacaccccacaacgaggtgccggtgccggtaaaactctggcccacgcccagaatcaagcggcccacgcagagcagcgtcaggcttaacagcggtgattcgatgagcgcagccagcaaaatacacaacccgctgatcagacagcccaccagtccggtcaccaccactttctttggcccccagagatcggcgtagcgtccggcgtgtgggcggctcagcagcgtcgccacatattgcaggctgattaccaggcccgcccagaatgcgctgaagcccaactggtcatgcacccatcctggcaataccgccagcggcagaccgatagtgagatagctggcaaagttgtaggccacgatagagaggatcagcagagagatgttcaggtttccggatggggtgttcggttccgcggcaggctgttcaggcatgagtcctcgcgctcgtatttggctgaatgataaggtttatcctttaactatacccgctttcgccactggcgcctcttaatgacacggctatcgggcggctgcccctgcccggacgtgcagcagaaagccgggtaaaaaccggcacaatggggacttgctgctctgccgcgatagctgagtgctgtggcgctgattacatcacccacctgccaccgcgctttaccgtttctctgataaatcagattgttaattttgtttcagctacactttcaacagccaaattacgttatgagagagagaatgagcgagctgcaacgggaaaagatcggacaaaatattctgataaaactggcgatgctggtcattatcctcgccggggttcgggcagcgtccgatattctggttccgctgctgctggcggcgttctttgccattgtgctgaatccactggtgacaatgctgatgcggcgtggcttccgccgtggactggcgattgggctggtgatcacggtgatcttctgcgctctcgtgctgctgggtgccattattgccagctcaatgagcgagttttccgatctctatccgcaactgcgcgccaccatggagcagaaaatgacggtactgcaacatctggcggcgggctttcatcttaatatttcaaccgatgcgctggtacagcgtttcgatcctaataccatgatgaacctggctaccgtggcgctgagcggcttttccggcgcgatgaccaataccgtgctgctggtgctgaccgtggtctttatgctgtttgaggtccatcacctgccctataaaatgcgcaacgcgctggtgaatccgaaaattcgcatcgccggattgcataaagcgctgaaaggcgtcacgcactatctggcgctgaaaaccctggtgagtctgataaccggcatcgcggtctggctgagtctctatctgctggatgtgaagtttgcgctgttatggggtgtcgtggcgtttatcctcaactttattcccaatatcggcccgattatcgccggtatcccgcccttcctgcaggcgttgttactgaacagcctgtttgatgccgcgatggtggcggcgctgtttaccgcgattcatatggtgtttggcaatatgctggagccgcgcctgatgggccgcggtcttggcttatcgacactggtagtgtttctgtcgctggtgttctggggctggctgctcggtccggtcggcatgctgctctcggtgccgctcaccagcattactaaaattctgatggaaaccacgccaggcggcagccgtctggcgattatgctgggcaccggacgacccaagcgggcgcgggcattaaccaagtagccgctgctgcacgtgctggagatggctctccatcgcctgacgggctgctgcttcatcgcccgccacaatcgcattggcgatctgctgatggtcagcgttcatctcctgcgcgaagctgttatcggcataatggcgctccagtcgctgcacatgcgggctgtggcgccggttccataactgctccagcaggtcgcgtaatacatcattgccgctcatctcactgatcagcagatggaagcgcttgtcctgctccagaaaggccgcgtcgttttcattgtactgctgcagttcagcggtcagcgccagcaatgctgcccgctgaacggtagtgccgttacgtgcggcaaatcctgccagcatcccttcaaaggcttcacgtgcctgcaacagatcctgcagactgcaggtttcgctctcctgcggaaccgcggcttgcggcagcggctgggcaacgtaaacgccgttgccagtgcggatatcgacccagccggtcatctccagcgcaatcaatgcttcacgcactgatgaacgactgacacccagctgttttgccagctcacgctccggtggcagtaaaccacctgccacaaagtcaccgcgcgtgataccggccatgatgacgttggcgatctgacggtacaggcgctcggtttttattactggcagcgtcatcaccctctcctctgattgcacgtaaaagcgatctcttcaccgatgcagtttgtcatgctgcgatccggatcacggccctgttttttccactatcatactcttggtccagcggcctgaccactgggccacatcacagttgaggagtaaaaatggaacatacatggcgatggtacggccccaacgacccggtctcactggatgacgcgcgtcaggcgggcgcgaccggcattgtgacggcgctgcaccatatccctaacggcgaggtgtggccggttgaggagattaaagcgcgtcaggcactgctggcggaaaaaggtctggtctggtcggtggtggagagcatcccggtccatgaggcgattaaaacccagcgtggtgactaccttcgctatatcgccaattatcagcagtcgatacgcaatctggccgcctgcggcattgataccgtctgctacaacttcatgccggtgctggactggacccgaaccgacctcgcctggacgctgccggatggcgcaaaagcgctgcgcttcgacgccgacgctttcgcggccttcgagctttatctgttgcagcgtccgggagcggaacaggattacagcccagccgagcagcaggccgccgctcagcgctttgccgccatgagcgcagaagagaaaagcaccctggtgcgcaatattatcgccggtctgcctggcgccgaagagggttacaccctggagcagtttcaggcgcagctgacgcagtatgacggcatcgacaaagcgaaactgcgcgagcatatggcgaccttcctgcgcgccattgtgccggttgcggaggaaacgggcgttaaactggcggtgcatccggatgacccaccacgtcctattctgggcctgccacgcattatttctacccaggaagatatgcagtggctgaaagaaaccgtggacagtctgcacaacggtttctgtttctgtaccggctcctatggcgtgcgtgccgacaatgcgttggtagagatggcggaaacctatgccgaccgcattaactttatccatctgcgcgccacaaaacgcgaggcaaacccggccagcttccatgaagcggcgcatctggcgggcgacgtcgatatggtcggcgtgatcaaggttattctggcggaagagcagcgccgccgtcgggcgggcaacctgcgggcgattcccatgcgtcccgatcacggccatcagatgctggacgacctgcataagcgcaccaatcccggttattccgccattggccgcctgaaaggccttgccgaactgcgcggcgttgaagtagcgctgaaacagatctattttgccgattaaataaaacgtcctgccctgcgcccgccccaggacgggccagggtctctcctggccgctgcggcggatcggccttttgccctgcctgcctcccgttttcacctgattgttttgctgcatcgcaacgaaaaccaaacaatctgtcaaaaaatgcaatgtctggtcgataattgaccttagtcagttctcctgatcgcaaaaacgctaatctgcaccgcccggagagatgctatgctgcgccactgatcagcacctccgcataacaccaataatactcagaggattcagcggtgccgctactgaaacgaaaacgcgactacgccaggctggtgattattatttccggcgtgctgcctctgattattggcatttttttcaccgctctggatgcgcgccacaccgtgcatcagcagcaggtcaccgcggcgaatacgctgttatctcaggctgagagaatgagcgacagcgcctgggatatgattaccgtgctgcgccagtttcatcatcagccctgcagccagattgaaaaccagttgcagcgcattggctcgctcaacccctattttcgtgcgatcggtaaaatggagcaggatcacatcgcctgctcgtcggtgtatggttcacgcccaggcctgctgaaagagatgatcatgcgcgacgcgccggttgccggaaaagcctggtggagtctgtccattgccgggacatcgggcgtaccgaatcgtccggccgtgatttttatgcgcgatttgcccgatggcgagggattctgggcagtgattgatggccagtatctgatcgattttatgcgcgcgatcagcagcagccatctctatcatttcagcatgacgttcagcggcggcgcgccgatctcgtttggcgatccgcacatcgccgcgtccagctggtttgaacccatgatttatcaggctatctcccatcgctatccgctctctgtcaccctcattgcctcaccctctgaactgatctcggcctggcgtcaggtgatgtttatcatcatgccgatggccgctatcttctctattctgctgatgatgctgatggcgaactggctgaaacggcgtatttcatggcgcgatgagattcgccgggccatcaccagcggccagttcagggcgcactatcagccggtctacgacaaccggctgcaacgctgcagcggcgctgaagccctgctgcgctggacaacgcccgacggtaaaggcgtgcggccagatatttttatcggcgcagcagaagcggaaggcatgattgtgccgctgacccgccatctgctcgatttaattgcagaggatgtgcaggcatggcaggttgagccccatttccacctggccattaacgtggcggcggatcatctgcagcatcctgactttgtcgacgatatgctgcagtttgccgaacggatcaaagataagcagttcctgattaccctggagctgaccgaaacgcagcctgatcaaagatggcgctgaggtggctcgcaagctggagcagttacgtggttgcggaatgaaggtcgcgattgatgattttgggaccggtcactgttcgctgagctatttacagaccttcacgatagattatctgaaaatcgatcgcggctttatcaacgcgattgaatccctggaaggcagaacgccggtgctggacgccattatccagctcagccatgagcttgagctggaagtgctgggagaaggcgttgagaccgcgttacagttcagctatctgcaacggcgcggcgtggtctttatccagggctattattatgcccgcccgatggacaacacggcgctggttgcctggctgaccgatcggggcgaacagccgattgaacgggagctggctcttcaggcccggcaggaacccgacgtctgaaccagagcagatggcagctgaaccgccagtcgtgccacattcactcatctttctgctctccgccctgtgatgcaaagggatagccgcttccggtgccagcatggcccgtatcttcccttctttgcccctgattcgctgaaaaaaacggcggtcgtcacgctcagtgataatttttttgcggttgcaaacagctctatttgttgtaaaaacaggccggatgtagcccaaacatgacagatatcacacaaaaacggtatactctgtcgctgttcgcaataatcacaacagtaattattgtgtctgccggcgcataaacagtgcttatttacggctatgcttaaatttctcaacgcagcggtctgaacgactcacacccggctcgcgccgttgaggactttcgtgttccaatacagggtaattctatgaaattgcgtaggaagcgtgtaaaaccaattgggatcgatgatgtgactatcatcgatgatacccgtttacgtaaagccatcaccgcggcctctctgggcaacgcgatggagtggttcgacttcggtgtttatggctttgtggcctatgcgctgggtaaggtctttttcccggacgtttcaccgggcgttcagatgatagcggcgctcgccactttctctgttcctttcctgattcgcccgctgggtggactgttcttcggtatgctgggcgacaaatatggtcgtcagaaaatcctctccatcaccatcatcatcatgtcggtcagtactttctgtatcggcctgataccgtcctacgcctccatcggcatctgggcacctattctgctgctgttagcgaagatggctcagggcttctcggtgggcggtgaatataccggtgcctcaatctttgtggccgaatattcgcctgaccgtaaacgcggctttatgggaagctggctcgactttggttcgattgcgggcttcgtgctcggtgcgggcctggtggtgctgatttcctccattatcggagaagagagtttccttgagtggggctggcgtctgccgtttcttcgtcgcgctgccgctgggaattatcggtctttacctgcgtcatgcgctggaagagaccccggcattccagcagcacgtggacaaactggaacagggcgaccgcgaaggcctgcaggatggtccacaggtatcgtttaaagagattgcgaccaaacactggcgcagcctgctctcctgtgtcggtctggttatcgccactaacgtcacctactacatgttgctgacgtacatgccgagctacctgtcacataacctgcactacagcgaagaccacggtgtgatgattatcatcgccatcatgatcggtatgctgtttgtccagccaatgatcggcatgatgagtgaccgtttcggccgtcgtccgtttgtcatcatcggcagtatcgccctgatgatcttcgcgattcccgcctttatgatgatcaacagtggcgtactcggactgatttttggtggtctgctgctgctggcagtgatcctcaacgcctttactggcgtgatggcctcttcactgcctgcgatgttcccgacgcacatccgctacagtgcgctggcgagtgcgtttaacatctcggtactggttgccggtctgacgccaacgctggctgcctggctggtagaaacgaccaataacctctacatgccagcctactatctgatggtggtggcagtgattggtctgattaccggtctgtacatgaaagaaactgccaataagcccctgaaaggcgcgacaccggcggcttctgatatggaagaagcgcgcgaaatcctgcaggaacatcacgataacatcgagcacaaaatcgaagatatcgacgaagagatctcccgcctggaagcgaaacgtaaaaacctggtgcagcagcatccggatatcaacgagtaatcgttctgctctcccgccgcccggcgggagagttcttttcccctctcctgaccgcacacaaaccttcatccctcgcgggcaaagggagtaaactgttgtcacttttttcacctgcgtaagaatgaaaatgtctgattattcccttatccagcgcccaagaagattgcgcgccagcgcctcaatgcgtgaaatgttccaggagtcctcactgagcctgaacgatctggctctgcccatctttgttgaagaagaagtcgacgattacaaagcgattcaggcgatgcctggcgtgatgcgtattccggaaaaacgtctcgcctatgaaattgagcgcatcgccaaagcgggtatccgctcggtgatgaccttcggtatttcgcaccacaccgatgccaccggcagcgatgcctggaacgagaacggtctggtggcacgtatgtcccgcatctgcaaagataccgtgccagaaatgatcgtgatgtctgacacctgcttctgtgaatacaccagccacggccactgtggcgtgttgtgtgatcacggcgtcgataacgatgctaccctggaaaacctgggtaagcaggccgtcgttgccgcagcagccggtgcggatttcatcgccccgtcagcggcgatggatggtcaggttgaggcgattcgccgggcactggacgccgcgggcttcactcagaccgccatcatgtcctactccaccaaattcgcctcctcgttttacggcccgttccgtgaagcggccggaacggcgctgaaaggcgaccgtaaaacctaccagatgaacccgatgaaccgccgtgaagcgatccgtgaatcgctgctcgacgcggcgcagggcgcggattcactgatggtgaaaccggcaggtgcttatctggatatcctgcgcgatatccgtgaacgtaccgaattgccgctggcggcttatcaggtgagtggtgaatacgcgatgatcaaatttgccgctcaggccggtgccattgatgaacgcaatgtggtgctggaaagcctgggtgcgattaaacgcgccggtgcagacctgattttcagctatttcgcccttgatctcgccgaacaaaaagtgctctgatcccctccttataaagagcgtgatggctatgtcacgctcttcttcttcgccgtaaggcaaacaccagaacctggcttgagctaaaaaaataaagggctctgtgatgaaagcacctcaaatcgctgccgacgaggcacaacgtttatcgcagttgcgtgcgctgaacataatgaacaccccagcggaagaacgatttgatcgtttaacccgtctggcgcgccgcctgtatgacgttcctatcgcgttagtcagcctgctggaagctgaccatcagtggtttaaatccgctcagggctatgaacccgcaggatcgccccgcgacatctccttttgcggtcatgccatcctacaggatgagatcatgatcgttgaagatgccacagaagatgaacgtttttatgataatccgctggttaccggcgaaccgcacatccgcttttatgccggctgtccgctgcgggcaccgggcggcgctaaaatgggtaccctctgtatcattggtcgtgaaccgcgtcagtttaatgaagaggatcaggccacgatgcgcgacctggccgccatggccgaagcggaactggtcgcctttcagactgccacctgtgatgaactgacgcagatcaccaatcgtcgcggctttatgacgctgggacagatggtgctgaacgagtgccggctgaaaaaccggcccgcctgcctgacctttctcgatctcgacaaatttaagcagattaatgactcgctgggccaccgcgaaggcgaccgcgcgctgatggactttgccgatgcgatgaaagtggtgtttaagcattcggatctgtttgcccgtctgggcggcgatgagtttgtggtgctgtttaatggtctgcagcagcagcagagcgaagcgctgctcctgcagtttgaccgttatctgcaacagcaatcagtcagtctgaaccgccgttaccgcctgcaattctcgtccggcgtcgtggagtttgacgcggcgcatccgcaatcgctggagcagttgctgcacgacagcgatgagcagatgtacctcagtaaaaagcagaaacgcgtggcgatctaaggtcaggcgccgcagcgcctgacggttcagggacgcgccagatcgtcgagcagcgtctggttaaattttgccggctcttccatttgcggcgcgtgtcccataccggggaattcgattaagcgcgcccccggaatgcgttttgcgacctctttccccagtaccgcgtaatcacccagccgggctttcacctctgccggggcgatatcactgccgatggcagtcgtgtctgaggtgccgatcatcagagtggtgggcactttcagatcgccgaattcataaaatacgggctgagtgaagatcatgtcgtagattaaggcggagttccacgccaccttctggtggcccggcccgctgttgagtccggccagcatatcaacccacttgtcatattcgggtttccagcgaccgacatagtaggtctgctgctcatacttcttaatgccctctgcgctgagtttgagttcgcgctgataccactgatctacggatcgccacggtgcgcctttggctttccagtcctccagcccgatcgggttaaccagcaccagcttctgcgtctgttccgggtacatcagcgcataacgtgttgccagcattccgccagtggagtgacccataatcaccgccttcttcacacccagccgggtgagcaactggtgggtgttatctgccagctgctgaaaactatactggtaactggctggcttggtcgagctgcagaagccaatctggtcgggcgcgataacgcgatatccctgctgactgagtgcgcgaatggtctcttcccaggtcgcaccacagaagtttttaccgtgcatcagcaccacggtttcgccgttggcccgttgcgccggtttcacatccatatagcccatgctcagcgattgctgctgggatttaaaatcaaaatgctgcaacggataggggtattgaaatccttccagctgttcgccatacacaccagcggcactggcaggtgcatgagcaaataacgccagcgaggtgagcaaggcggcaagcggttttttcagcgcgtatgtcgggctcatccggggggtttctccaggttaaaggtgagccgtaagcctggcatgtcgcagccaaaaatctattgatgtgccgtgctatagccgtgattacagagattccggcaaggtaaaccgtgagtctggctgcggactcacggctcgttttgattaacgtcccgcggaatcacttattcattcacctacaattaccaacagattaatcacaattcatcttttttattaataacaccccctcaaatgaatatcttcagagataacgattaaaatcctgaaaaatctttacgcaaagaataagcacattaagataaatattttagaatcttcttaaatcaaacagggggttctatgaacgaaaataaatataatgaaagcgtgatcgtctctatcacggagtggattaataataatctggatcagcgtttaagcgttgatgatattgcagaaaaagcgggttactctaagtggtatttacagaaactttttgcccgttatcataatgaaaccctggcgcgatatattcgtaagaaaaagcttaacgccagtgttcatgatttaaaaaacagccgcacgcccatcatcagcctggcgctgaaataccattttgaaagccagcaatcctttacccgatcttttaagcagattatgggttgcacaccgagcgtctgccgtaaacgtctgatgaaggacgaggcaaagcagcagctggccgacgttgatgatccctgtgcgctgtgcagttacggtcgggcggaaagcataaagcagagctgtggcgtaacagtccggcctgttacgcgctcagcgcgcggatatgcgccggcagacgctttccacgatataggttaatcaggattcatccggctgataatattgcacaccaatcttaatacgctcacgtccctgggtgacgcgatgacgattagtgtcgcgcagtgaatagacacagccacaatattcctgctgatagaaactctcgcgcttgctgatttcaatcatgcgcgacgacccgccgcctttacgccagttaaaatcccagtacatcagatccggatacgccgccgctgcgcggactccgcagctgttaatctgcttcatatctttccagcgcgaaatacccaggcaactggtcatcaccggaaagccgttctcatgggcatagagtgccgtacgttcaaagcgcatatcaaagcacatggtgcagcgttcaccccgtttccggtgaccactccaggccgcgcgcccgctcaaaccagttatcccggtcatagtccgcatcaataaacggcacaccaaatttttcggcaaagcgaatattctcctctttacgcagctcatactctttgagcggatgaatattcgggttgtagaaatagatcgtgtattcaatgccggatgccagcatcgcttccatcacctcacccgagcagggtgcgcaacaggagtgcagcaggacttttttatgaccgcccggcagaggcagcggctgacgctggaaaggttcagacataagcaccttcaatcaatagcagtaaagcggcagtgtaatgccgcaggcgggcagttgcaaaacctgacccgacgcgccctgttttgcgtaatcgtgccccggccgcggtttccctctcctgaaccaacccgctgatctctgatgctttcttatcgcggcaatgctgtgtggcaccggtgatagccggaagtgtgatcgcccccacactggcatcgactatgtttacataacattaacaatattgacacagaaaccccgcaaggagactcgcatggtcgcggcaaaaaaatcgggaaatcaacagaaccgctttacctggttcgtctgttttatggctgcgctgtccggcctgctgtttggtctggatatcggcgtcattgcaggtgccttgccgtttctggcgaaggatttgcagatcactaaccatcagcaggagtgggtagtgagttcgatgatgtttggcgcggcgctgggcgcactggcggcgggctggatgtcatcaaagctgggacgcaagaaaagtatgctggcgggcgcgacgctgtttgtcattggctcgctgtggtcagccttctcaccggatgtggagtcgctggtctgtgcccgcgtgatgctgggtctggcggtgggaatcgcctcttacactgcgccactctatctggcggagattgcgcctgaacgcattcgtggctcaatgatttcgatgtaccagttgatgctgaccaccggcattgtcgtggcctatctctccgacaccgcgttcagctacagcggtaactggcgcgggatgctcggcgtgatcgccattccggcggtgatcctgtttatcggcgtgctgtttctgcccaacagtccgcgctggctggcggcgcacggacgctttaacgaggcgcagcgggtgctggatcggctgcgtaacagcagcgaacaggcccgggaggaactggaagagatccgggaaagcctgcaggtgaagcagcgcggctggtcgctgttccgttctaatggcaatttccgccgcgcggtgtggctgggtatgctgctacaggttatgcagcagtttaccggcatgaatgtggtgatgtattacgcacctaaaatcttcaacatcgccggcttctccagcaccagcgagcagatgtggggcacagtgattgtcgggctggttaatatgctggccacgctgattgcgatcttctttgtcgatcgctggggtcgcaagccgatgctcaccaccagttttctggtgatggcggttggcatgggcgtgctgggaaacgctattgcacatcggcgttgaaacagatttccgcaaatactttgctgtcgcgatgctgctgatgtttatcgtcggctttgcgatggcggccggaccggtgatctggctgctctgttcagagattcagccactgaaagggcgtgatttcggcattaccgcctccaccaccactaactgggtcggcaatatgattgttggcgccaccttcctgaccatgctggatcaactgggtaatgccaacaccttctggttctacggcgcgctcaacctggtgtttatcgtgctgacgctgatgctggtaccggagaccaaacatgtgacgctggagcacattgaacgcaatctgatgaagggtaaagcgctgcgtgacatcggggcgtaaccgccccgcttcaggctaccactgcatttgctggccggcgtaatcgacgtagtgatgaccaccgcgaccgcgccactggatcagctgctggacgataccggcggcactctcttctgccgtcaggggcgcactctcgccgcccatatccgttttcacccagccgggatgcagcgtcagcagcgtcccgctctgcgcttccactgccggagtcagcgtgcggctcagcatattcagtgcggctttgcttgccgagtaaatcggcatctgcgcctccggattttcattcaggctgccgagctgggatgaggtcagcgccagcacgccatcctgtttcagcagcggcaacaggatctctgcgctgcgaaccggggctatcgcattggtcaggaacagctgcgccagcgcctgatcgtcactctgcgacaccttctggtgcgcaggcccggaaatcccggcgttaatcagaatcgcatcgaacgacttgccactgagctggctggcaaactgttgaaccgctgatgagtgggtcatatccagcgaatgccagtgaatgtctggccggttaccctgctccgggatgccactgcgatgcgtggccgtgacctgccagccctcatcggcaaaggcctgcgccaccgccagaccgataccgcgtgaagcaccaataatcagaacctctttttgctgagccatattcattcctcgttgattgtctcgtcacaagcttaacggtaaatctgcccaggcagcggccagttgtgctttttagccagacgaccgcactgcaggtaaaaccccacggcgtagcgctgttgatggttttccatcattaaatcgctttatcttttacttttaaccggttagaagagataaacagtctggcaggcagcagtcaatttgccattttcgcatggagtctgaatgaaaaagctcaccttagaggtggtggcaaaaatggcaggcgtcgggattgcgacggtcgatcgggtgctgaatgagcgcggcggcgtctccctggagaccagccgtaaagtcctgaaagccgcacgcgaagtggggctgaagcgtctgctgccagaggagtaccagcatccgtggcagattgaggtgttcctcagcaataacggctcatccttttttcaacagctcaccacccatttcagcgaggtcgccagtcagcttggctatcgccgcctgaaactacacaaaaccctggtggccgaagcgcagcctgagcagctggcgcaaagcattatcgcccgcagcagcacccgcgacggcatcattgtttttgcgcatgactcgccgcccatctatcgggcactggcgctgtgccgcagccgcaatgtgccggtgatcaccatcgtcaccgatctgcccgatgccgaccgcttgtgtcatgttggtatcgaccagtatcaggcgggacgcacagccggactgctgatgagtaagacagtgaatcagcccggcgacattatgatggtcagtggccgttttgattaccgcgcccatcgtcagcgcatcgcgggatttcgtgaggccatggagcagcgcgcgccgcagcgtcatctgcgtgaagtgctgtcgggtcaggatcagcgggaaaccattcgcagtgaactggctcgccatctgcgtccgtcgcaggcgattgcaggggtctataacaccgggatggggaatagtgatgtcagcgacaccctgcgcgcccaccagttgctgggtaaatgtacctacatcacccatgagctttatgatgtcacccgccagctactgctgaacgatgaagtggcctttaccctggatcagcatgctcagcagcatgcccgtttagcgattgatctgatgctgagtcatctcgaaaccggctatcagccggatgtctatcaggcgggcaaagtggcctttcggctgtttacggcggaaaatatggtgtgaggtggaatctgtttcccctgatgaagcgctgtcattaagggaaacagatcgagctcgattaacccgcggcatcccggcttttatcgtccgggctgtccgcatcgtcattaccctggctcttctccacttcctgcggatgtcccatcgaaagcgcagccgcactggccgggtcgaacagcgacagactctcaatctggtcaaccatgatcactttacggaacgacatcgcatctttgggtttcgagtcgagcgtgatgccatgctcggcgtaccacttgctgtagttatgttccaccgccagcttcagcgtcttgctgtcgcgatatccgctcagcatcgggatcagaacgatgtttttggtgctttcatattcaaaggtcgaggcatgaaccatgccgatgtaaatgcggcgcgacttcagcgtaatccacgccagttcgccctcttccatgcattgaaacaataattgctccacgccattggagcgtgacagtcgctgatagaggtctttacgaccagaaacgttcagtcgtgcgctgcctgcccagtttgagcgatagagacagagcagaatggcaaaggcgagcatgatcaccaccggagcctggatacccaggaagctccagttcataaactccacctgccacttcagatgaacgccggggatcatctggacggcgttggcgatgccggagatacagagcagcagtaaccagacgatgccggtcgcgaacacaccctgcaggacgaaaatacaaccgtaaagcgcgaccaggaaatagacatcccagcccgacgaacgacggattttaaagcggctgttcaaatcacggctggtgtaccagtaaccactgaccatcaacaccataaatattgcggtacccacctcacactccctttaacgtattcacgtggcgggaaaaatcttcatggacttcctcgctcagcgtgttaaccgagatattgccgttttcatcaatgatgatgcgctcaccttcagcgatagaatcgttgatatcctgacgggtcatgatctgcaaaaacttctcgggactggcaaagaccgacttaacaaatttaaacatggcgatccacttattggcctgaaaattgaagtatgtgaccgaatccacactctcgcctgtttaatttcgggtgaaatttcttaaaatcaattaattagcgaagcggtagtggcgttgcccatgccgttttccgctgaaatcttcaacgtaaccagcagtatggcgtagcagcatcgcatttttaccgtgcaggtctgcaacgacgttacatcgcctctctgcaaggaagcgctaagctcattggttagccgctttctgtcaccctgtctgaaacgcatcgaggaatgtttgcatgaaactacgaacactgggccgtaccggtcagcgcgtctccgaaattggctttggcgcatgggccattggcggaaacctggggggaagtgagcatggaggatgccaaagccgcgctgaatgctgcgatggatgcgggcatcacctttattgataccgccgatgtctatggcgatggccgttccgaaaaaatcatcgcagaagtgctgaatcagcgcggcggtgaacgtccgtttgtggcaaccaagctggggcgtcgcctctcgccacatgtggctgaaggttacaatgctgaaaacctcaacgcctttattgaccgttcacgcgagaacctgcaaaccgacacgctggatttagtgcagctgcattgcccgccgaccgaggtctactacaacccggacgtctttgcggtgatggatgagatggtcgctgccggaaaaatccgtcactacggtgtctccgttgagaaagttgaagaaggtctgaaggcgctggagtttccaaacgtctcgtcaattcagctgatctacaacattttccgccagcgtccggctgaactgctgctgcgtgaagcgaaacgccgtgatgtggcgatcatcgcccgtgtaccgctggcgtcgggcctgctgaccggcaaaatgcgtgccgacagcgtgtttgccgctgacgaccaccgcacctttaatcgtaatggcgaagcgttcgataagggcgagaccttttccggcgtaccttatgaggtggcgctggaggcggttgaagagattcgccgctttgtcactggcgacaccaccatggcgatgtttgccctgcgctggatcctgatgaacgaagatgtcagcgtagtgatccctggcgcgaaaaaccgcgaacaggctgaagccaatgcccgcgccagcgatgtcggtgcgctctctgcagataccatggcggcgctgaagcagatctatcaggagaagatcgcgcctcacgtgcatcagcgctggtaagcgccttacaacgcctgggcgcaggcccaggcggaactccacgcccactggaagttatagccgcccagccagccggtgacatcagccacttcaccaataaagtaaagtcccggcactgcacgcgcctccatcgttttcgaggagagctgtgtggtatccacgccgcccagcgtcacttcagcagttcgatatccctcggtaccgtttggctgaatgcgccaggcgtgcagcgtctgcgccagctcggtttgctgtttgctgttgagctgcttcagggtgatatccggcaccaccttcagcgcctgcaatacttccaccagacgcttcggcaggattttcgccaggctgttcttcaggctgagattcgggtgtgcttcacgctgcgccgtcagaaacgcctcaagcggcgtggcaggcgacagatcgatggtgacgaattctccgggtagccagtagctggagatttgtaacaccgccgggccggagaggccgcggtgggtaaacagcatcgcctctttgaagcgtgtgccatcctgcgcatcgatagtggtctccagcgcgacgcctgacagcgtctgcaactgctccagcagcggcttgtgcagggtaaagggcaccagcgccgcccgcgtcggaaagacgctcagcccgaactgctccgctattttatagccaaacggcgtggcacccaggccaggcatcgacagaccgccgctggcgatgaccagcttctccgcctgaaccgtgctgccgttaagttgcagggtatagccgctttcatcgcgcgccacgctgagcacttcactgcgcagccgcagggtgacattgcctttgtcacattcggccagcagcagatcgacaatctgctgggcggagtcgtcgcagaagagctggcccagggttttctcatgccaggcgataccgtggcggttaaccagatcgataaaatcccactgggtataacgcgccagcgccgatttacagaaatgaggattgtgcgacagatacgccgccggttcggtgtagagattggtgaagttgcagcggccaccgccagacatcagaattttacgtcccggctttttgccgttatccagcagtaacacgcggcgtccccgctgcccggcctgggcggcgcagaacagccctgcggctccggcaccaatgatgataacgtcaaactgttccactacgactcgctcacttaactggaaaggcgcagattgtagtgatctgctcactgagacgccagcgtcaaaaaaatgccgcaaatgtgtcatattgtatctgtctaatatctaaccctttttctctgagttacccttacgccttacatcgaaaggttaaattagcgctatattttcctttcccatacagcacgttgtcgcggataatgcgccgcgttcatgtcctccaaaaatggcgtaacgtttatgctacatctgtttgctggtctagacctcagtactagcctgttattggttcttgccctgctgtttgtattgttttacgaagcgatcaacggtttccacgacacggccaacgcagttgcgacggtcatctatacgcgtgccatgcgtgcccagcttgctgtggtcatggcgggtgtatttaacttccttggcgtgctgctcggtggattgagtgtcgcttacgctattgttcatatgcttcccaccgatctgttgttaaacgttggatcggctcacggtctcgccatggtgttttctatgctgctggcggcgattatctggaacctcggcacctggtatctcggtctgccagcctccagctcccatacgctgatcggcgccattatcggtatcggtctgaccaacgccctgatgagcggaacctcggtggttgatgcgctcaacatcccgaaagtgctgaacatcttcctttctctgatcctgtcgccgattgtcggtctggtaatggcgggcggcttaatctttatactgcgtcgctactggagcaataccaaaaagcgtgcgcgtattcatatgacgcctgctgaccgtgagaagatcgacggcaagaaaaagccgccgtttctggacccgtatcgccctgattgtttcggcaattggcgtgagctactcgcacggtgcgaatgacggtcagaaagggatcggcctgatcatgctggttctgattggcgtggcacctgctggtttcgtggtgaatatgaatgcctccggttacgacatcacgcgaacccgcgatgcagtcaatcacctggagcagtattatcagcagcataacgcctcgctgacccacatcatccagatggcaccgcctaagctgcccacgccggaagaagtgccagcaaccagcccgcaggagttccactgtgacagcgcgcgcgcattacaggcggtacagggtgcgcaggtgttgctgaataacctgcagagctacgatcagctgacggttgatcagcgcggtcagatgcgtcgtctgctgctgtgtatctccgataccgccgataaagcggctcgtctgcaggaaacctcgccagatgacaaacgcttcctcaataagctgaaaagcgacctgcttggcaccatcgagtatgcgcctatctggattattgtggccgtcgcgctggcgctgggcatcggcaccatgattggctggcgtcgtgttgccaccaccattggtgagaagattggtaaaaaaggcatgacctatgcgcagggaatgtcagcacaggtgacagcagcgctgtcgattggcgtcgccagctataccggcatgcccgtctccaccacgcatatcctctcttcatcggttgccggtaccatgctggtcgacggtggcgggctgcagagccggaccatcaagaacatcgccatggcgtggatcttcaccctgccggtctgtattctgctgtcaggttcgctctactggattgccttaaaactggtgtgatgccagctaaaaaaagggcgacgcaagtcgcccttttttaatgccagatcgccagcgccaccagactaatgactaccagtccgcacagcgcactggtcagcataaactgcccacgcacccgctcgcagcgccggataaactcatcgtcgtgatgatcaagatagcgctttgcccagatataagtgaccagccgcacctgcttgctcggctggccatgagaggtgaaaaaacccgccccatcgacatactgatacagcagcggatcacaaccgcgtaagaccgccagcagagcgcgcagggatgaaaaatagcgcgccatattcacgatacacaccacgcaaagcgcccaaaaaagcgcaatagtgctgatcatattctccccctcccggctggaatcgcagcaacaggcccagcgtcagacactgagtccacctgcagaaataaccagccactgaatcaccggactgcgaaagtttttcgaccccctgagcggttgcgaatcggaccgccttttttcagtgtaggagaaatctttacattttttccaacgatgattttcgttcagcgcgagtaaatctggcatagccttgatcttattcataagccaggcggcaacggcagcatttacagtgggagaaggctatactgaggacataacaacatcatcacctgcaatgcaggtagacactttggtggcgctcatcgcccgctcgcgcaagggatttcgctaagctgtgacgcggcaggaacaccggatgccatccttaacctcgtgaaaggagttttatcatggcttataaacatatcctgattgcagtagacctttctcccgaaagccagttgctggtggataaggccgtctcgctggctcgtccgtacgatgccagaatttccctgattcacgttgatgtcaattactccgacctctacaccggcctgattgatgtcaacttaggggatatgcagaagcgtatctctgaagagacgcatgcggcgctgaaagggttgtcagatgcggcgggctacccgatcagtgagacgctgagcggcagtggcgacctcggccaggtactggttgacgcgatcagaaaatatgacgttgaccttgtagtatgtggtcatcatcaggatttctggagcaagctgatgtcctcagcccgtcagctgatcaacaccgtgcatatcgacatgctgattgtgccgctgcgcgatgaagacgaggcgtaatttcgccgtataaatgattaaagccggcgcagagccggcttttttatgctttaaagcggtgggtaaatatcaaagcgatggcttttggtcaccacggccgcctgcgtcacaatacccgccagcggcggggcgtagtctggccgtttaaccacgatgcgtttcttcgccagccggcgagcgggttccagtaatgcgtcagcatcttcatccggccccaccagcgactgaaacacccgcatctcctttttcaccagcgcacttttctggcgatggggatacatcggatcgagatagaccacatccggcggcggcgtgatatcccccagcgcctgcgcgctggccgcatgaatcagcgtcagccgatcgcgcagccaggggccaatttccgcatcctgatacccgcgctgcaatccatcttccagcagcgcagcgacaacaggatgacgctccagcattcgcacccggcaacccagcgccgccagtacaaacgcatcacgtcccagcccggcggtggcatcgaccacatccggcagataaccacctttgatgccgaccgctttggcgacggcttcgccgcgtccaccgccgaagcgacggcgatgggccatcgcgccagtgacgaaatcaacaaaaatgccgcccagctttggctcatcacgcttgcgcaattcaaggtgcgtcggggtctgcactagcgccagcagtgcctcttcatcgtgctccagctgccagcgctgcgctaaacgtgataaggcgccgtcttcggcgcctgattcatcgagcaaacagattttcacgaaccgacttatccctgaatgccgtaatgttccagcatcgcatcgagcttcggttcacggccacggaagcgtttgaacagctccatcggctcttcagaaccgccacgcgtcaggatgttatccaggaatgactgaccggtttcacggttgaagatgccctcttcctcgaagcgggagtaagcatccgccgccagcacgtctgcccacagatagctgtagtaacccgccgcatagccacccgcaaagatgtggctgaaggcgtgcgggaaacggccccattccggacccggaaccactgccacgcggcttttcacttcgcgcagggtttccagaatctgtgcgcctttctccggattaaactcggtatgcagacggaaatcgaacaggccgaactccagctgacgcaggataaacagcgcagcctgatagttcttcgccgccagcattttatccagcagctctttcggcagcggttcgccggtttcaaagtggcccgagataaaggccagcgcatccggttcccagcaccagttctccatgaactggcttggcagttccactgcatcccatggcacaccgctgataccggagacgccaggcgcttcgatacgggtcagcatgtgatgcaggccgtgaccaaactcatggaacagggtgatcacttcatcatgggtgaacagcgcaggtttgcctttcaccggacggttaaagttacaggtcaggtaggcaaccggcttctgcaggctgccatcggctttacgcatctggccgacgcagtcatccatccaggcaccgccacgtttatgttcgcgggcgtagagatcgagatagaagctgccgcgcagttcgccggtttcatcgaacagatcgaagaacttcacgtcaggatgataaacctcaacgtcgttacgctgcttcgccgtgatgccgtaaatgcgtttcaccacttcaaacagaccggcgactgcacgctcttccgggaaataagggcgcagttgctcatcgctgatggtgtagagatgctgcttctgcttttcaccgtaataggtgagatcccacggattaagctcggtcacgccgtgctctttacgggcaaaggcgcgcagctgctccagctctttttcaccctgcggacgggcgcgtttccgcaaggtcattaaggaagtcgattacctgggacgggctttgcgccattttggtcgccagcgatttatcggcgtaggagtcgaagcccagcagctgtgccagctcgtgacgcagcgccagctcttccgccatgattgggccgttatcccacttaccggcgttcggaccctgatcggaggcgcgcgtcgcataggcgcgatacatctcttcacgcagcgcggcgttgtcgcagtaggtcatgaccggcagatagcttgggatatccagcgtcagcagccagccttcctgctctttggcttcagcctgtgctttcgccgccgccagcgcgctttccggcataccggccagctcgctttcatcggtaatcagcttgctccagcccatggtggcatcgagcacgttgttgctgtaagccgagcccagctcagagaggcgcgcggcgatttcgccgtagcgctgctgtttatcttttggcaggccgatgccggagagttcgaaatcacgcagggcattatcgaccgctttcttctgcgccagatccagtgcagcgtactgatcgccctctttcaggttgcgatacgcctgatagagcccttcatgctgaccaacccaggtgctgtattcagagagcagcggcagcgtctgctcataggcttcacgcagctccgggctgtttttcaccgcattaaggtggctgaccggtgagaagatacggctcaggcgatcgtcagtttccgccagcggctgaaccagattatcccaggtatacggcgcaccctgcgccacgactttttcgacttctgcgcgacagtggctcagcacttccgtcacggcaggcaccacatgttcaggcttaatggcagaaaaagggggtagcgtaaaagatgtcagtagcggattggtcatagcgcagtcctttatagatgtatggggcgcagcgggtcgcgcaacgcaatctaagtaacatgcggcttagtgtagcgaaaatcaatggcagccaggatgaggtggggaagaaacgcgcgaatagcagcacggaagatgcacgcttttatctcatgcacgtaatgctggctggcgcgtcggggaggatttgcggtcgctttccgtaactgcgtgccgggaaccacacgccccgccctgagcggctcgcggtaatcccgatttgttatcacgcttctggcacatcaacaggtcatccctgatataatcgcggattctcatgcttttcctgcgtcggttgctgtgcgtcgttctgtgggtaatacgtgaggtaataattggtataaattgattttccatcaattaaaaccttataaattcaacaggataaacaatgctgagttatcgccatagcttccatgctggcaaccacgccgacgtgctgaagcacaccgttctgagcctgatcatcacggcgctgaaagagaaagagaaaccgtttttctacctggatacccatgcgggcgcaggccgctatcagctcagcggcgagcacgccgagcgtaccggtgaatatctggaaggcatctcacgtatctggcagcagcccgatgcgccggaattgctgcaaccctattttgatgcgattcgtgcgctgaaccgtagcggcacgctgcgctactatccgggtttcgccactgattgcccgccatctgctgcgtgaagatgacaaactgcaactcactgagttgcactccagcgactatccgctgctgcgtaacgaattcagcaaagacaaccgcgcccgcgtcgatcgtgccgacggttatcagcagttaaaatcgaaactgccaccgccgtcacgtcgcggtctggttctgatcgatccgccgtatgagatgaaaagcgactaccaggcagtggtgaaagggattcaggaaggccataaacgttttggcaccggcgtctttgcgttgtggtatccggtggttttacgccagcagatcaaacatatgctgcgcgacctggaagcgaccggcattcgcaatattctgcaaatcgaactggcggcccgtccggacagcgatcagcgcggcatgaccgcctccggcatgatcgtgattaacccgccgtggaagctggcccagcagatgaataccctgctgccgtggctgcaccagaaactggttccgacgggtaccggccactacgcggttaaccagatcgtacccgaataactctctttgtcttctacgccgctcactaccggtgcggcggcgttgtaccaggtctttaccatgtggatcatactggctggcgcgctggccgcgctgcaaccggcccgacggctggcattattattactggcgctcgccacactgctgggtttttatcaggacgtgttagcgtggccggtgctcctgctgtttaccggcaccgccgctgtggtggcactccgtatttatgaccgtgaccatcatcgacgacaaatagtgaccgaagcgctgctggtgctgatcgccatcgggttgctcctccatctttttccaggctttaataacccccttcaggcagaggatgtgcaggccggaccgcgcagcgtgcctttcagcttcgggtttaacttcgataaagcgcttattccttttgtactgctggcctgcctgccgacgctgtttcgcgcgcctgccacgccaccacgctatcgactacccgccgcactggcgctgatcgccgccattccgctgctgctgtactgcgcggtattattgagcggattagcgtttgagcgacatacaccggactggctggggccatttatgctcgccaacctgttctttgtttcgctggcggaagaggccctgtttcgtggctatctgcagcagcgattaaagcaggtagtgggcggcatccctgcgctgttactgagcgcgctgctgtttggtctggtgcatctgagcggcggcctgttgctggtgatcttcgccaccctggccgggctgttatatgggctggcgtggcactggagcggccgcttatggctggcgaccgccctgcactttggccttaacctgacccatctgctgtttttcacttatcccgcactgcatcattagaggttaaaaaccgccagatcccaggccagctcggtgcagggaaaaatcgtctggcactccgccagcaggcggttcatgtcttttgccagatagcgtgaactgaaatgggtggcgatcagccgttttgccccggcgcgttttgccacttcggcggcctgcagtgtggtggagtgcccgcgcccgttggctttttctaccatcgcggcctccagcgtggtttcatgcaccatcaggtcaacattagccgccagttgcagcgcgacctcagtaggtgccgtatcgccaaagatggccagcgttttgccgggtgtcgcggggccaagatagtcagcaccgttgattacccgcccatcttcaagcgtcacgcattcaccctgcttcagctgctgaaaccacgggccgcgtggcaccccttccgctttcagccgcgcagcatccagcaaaccgggtttatcatgctgttcaatgcgatagccaaaacactccaccggatggctcagcggccaggcgctgatacgaaactcaccgtcgtccagcgtccagcccgcctcaatctcaacgatggtcagcgggtagtcggtgtaagagccgctgatcgacagcgccgtctcaacaaaggtttttaatcccctggggccatagaccgtcatcggtgtggtcagcccggccattgaccggctggtgagtaatcccggcagcccgaaaatatgatcgccatgcagatgggtgataaaaatcttatccagcttgcccggtttgaggctggagcgcataaactgtaattgtgtgccttccccgcagtcgaaacagccaggtttcaccactcagcgcgcgggtaaaaacaatagacgtgacgttacgttgcaggctgggagcaccgccgccggtgccgagaaaagtaaggtgcatggtatgcttccctgtaagcgagtgaaaaaacagaaccctattacaatcataggcgcaaactttgcgtcatttcgacccgcagcgttacactcaaccccaattttttatgcaaccggatggatacttcaatgacccgacatttcgactatctcgccattggcggcggcagtggcggcatcgcctcaattaaccgtgcggctatgtatggccagaaatgtgccctgattgaagcgaaagagctgggcggcacctgcgtgaacgtgggctgcgtgccgaagaaaatcatgtggcatgccgcgcaaatcgccgaagcgatccatctctacggaccggattatggcttcgacaccaccgtgaatcgcttcgactgggccacactggtgaaaaaccgcagcgcctacatcgatcgcatccacaactcctatgacaacgtgctgggtaaaaacaaagttgaagtgatcaaaggctttgcccgctttgtcgatgcgcacagcgttgaagtcaacggcgagattatcacggctaaccatattctgatcgccaccggcggtcgtccggtccacccttctattccgggtgcagagtacggcattgattccgacggtttctttgagctggacgcgctgccaaaacgcactgcggtcatcggcgcaggctacatcgcggttgagctggctggcgtggttaacgcgctgggatcggaaacgcacctgttcgtccgtaaacacgcgccgctgcgcagcttcgatccgctgcttaccgaaacgctggtagaagtgatgaacagcgaaggcccggcgctgcacaccgaatctattccaaaagctgtgattaaaaacggcgatggcagtctgacgctgcagctggaaaacggcagcgaatataccgtggattgtctggtctgggcgattggccgtgagcccgccaacgataccctgaatattgacgccgctggcgtcgcgctggacgacaaaggctacatcaaagtcgataaattccagaacaccagtgtgtcaggcatctacgccgtgggcgacaacaccggtgcggttgagctgacgccggttgcggtcgcggcgggccgtcgtctctctgagcgtctgtttaacaacaaaccggacgagcatctggattacagcaatattccgacggtggtgttcagtcatccgccgattggtaccgtgggactgaccgaaaccgcaggcacgggaacagtatggcgacgaccaggtgaaggtttataaatcgtcatttaccgccatgtacactgcggtaacccagcatcgtcagccgtgtcgcatgaagctggtctgtgtgggtgcagatgagaagattgtcggcattcacggtatcggattcggcatggatgagatgctgcagggcttcgctgtggcgctgaaaatgggtgccactaaaaaggacttcgataacaccgtggcgatccatccgaccgcctccgaagagttcgtgacgatgcgttaattccccgaacagaatactattgcgaaaaactggtcatcagggccagttttttcctgcaactgcgctcaacgaaaattaatgcgcccgctgacgcgaaatgtaaaacctgcgtttctcttcatattatcaacacccagcaagagccaggctgattaacagcgaaaaaaccgaaccgacagtaattaaatccatttatatatgaaattatttaatgactaccgattatattcacaggcccggcgtccatttccacaggattatcgttagtgaatttatcgctgtgcttaatgaatgcctgaagtgatacgactgctaaataacctctccacgctgtcgcttttgaggagatagcctttcttcgaaactctcaggatcacatcatcacttaaacccagaaaaaagagcttcgactttaaattagacataacctgccagacccgctgcgtagaagaactcagtccatgtttatcccagacgttctccataagttccgaatccgtgacaacatcaatagtggcattttcaaaaagatactctaatacgtgcgacatggtttttctcaggatgatatcttcaccatacccattcagacaaattagtcgctttgtcttgtgtaaataaaccacgttctcttcaataagatagccaataaaatttacttcattacccggtagcatgatgttctccagaacaatgatgaaaacaagataataacttttattcaggtatttaaaaaacatcccttcattatttgtacatcactttttaatcagccctggccacgcctttccattgttcctggtctgtaatagcgatgcctcgatgatcgtcatgcatataaccctttgttgtgtgttaaaatcctggctatccacctcgccacatcgttaataaaaagtaataataaataagtctgttctggcggagaagcagactgaccttaatactcatccgacagagtgcaataagatgttgttgcttatcatcgccggcaagaaaacttaaatatttcttagttaaatcagaaaccaccgataaactgaccaggatggattgctgtctgatttgcctcatcttatgcgtagccgttatgaaatcatctaacgttaacgaagacaataaagtgggatttttattttagttcaaaacttacgggttttatcacggccatctgtagcagaatcagccaaaataaagcttaaaagaagaatcgctttggattgaaagacgattgcgtcatccgaacacgcccgcttcaacgctttcattagtttttttataatccataagacctgatatttctggccaatttttgatctgtatcaactggcaatatatcggtggaaaaagcaaagtaatggcggaaaaacagaagcaaaagatatgagacaggaatgttcttttcccgggaattaatcagatccgtttgtttattaagataattattaaagcgtccttatttagctattttgtaccctactaacggcaggagattgtcatctcattgtataccgagtcagaaataagcgtgagtgccccttagctccgtacaccctcgttaacgtgataaataagaatgagttattaatgcgccctgacctgtcagcatagtccgctgatatcaatattaaggggttgggtctggctctggattgggagatttaagatggcagagggcgcagcattaaccgggaccgggacaaagggtcaccttcgatctggtgaccttgcgccaggcagggggagaaacggatcccccggtgcagttgtgcaccgcgccagtgcaactcagctcacgcgatccagccagcgaacataagcctgatcccataacgccgctggcgtgcccgccttgccaaggccaaagccatgcccgcctttgctgatctgaatcagctcaaccggcacacgattacggcgacaggtgtcgcgcatcagctcggtgttaaacggatttgaggtgtgatcgtcctcggcctgcgccagaaacgtcggcggatattgccgggttacgtagttctgcactgaccagttcgcctcatcctgcggcgtggcatttttgccgaccatcatcagatgggtattggtgtgctgataaggcgcttccagggtgatgaccggatagatcagacccacgctgtcgactttgggcaccacttcatccagcggatcgatggccggataggattcaaagtccggacgcgccgccgccagccccagcagatgcccacctgccgagaagcccagcacatgcaccttgcgctcaaaggatcgcaccagccggatggcacgctgcgcatcctgcagcggtgccagccgccccgcctgccacttctcatgcggcagccggtagctgagcacataggcggtatagccattggcattgagccagcgcgcgaccggccaggcttcgcgtcccatgccgatccagcgataaccgccacccgctgcaattaataccgcttcgccattgggattttccggtttaaagcgctgaatcgccgggctgacgatatttgaccaggaaccggtgctgttaatatgcaactggcccgatgggccgccgccgccgggcggatcgtccggccagaggggaataatgtcatcgcgggcaaatattttgccggtggtcatggagagcccgagcgctcccgtgccgagaataaagcgtcgacgcgtaatcataatgcctgttatgtgataccagaagagtgagcaaaccgttgcggcaggctgcagtagaatcaacagatgcaagtcgggtgccatggctggcgattatgtacgcaatggcccctgaaaagccataaaaaaacgcgcccggcaggcgtaatgctgatcagttaagcgacaggtgataacgcagtctggtgccgggcctgctctgaagcttaagtgcatgttgacagaaagggcacgaaagtggaggcctgagcgcctctgctgctgaaagggctatccgcagcgctgaggcgtgacggtgggccagaagtccacgccgggaagcgtggacaggtcggggccggccagggagggccgatccccgaacggttcgtcggcacgacgtcaaagccgaaggtaccgcgtgagcggcgcgaggacggcccggcagcagcagaggtgcgctggcccgcactgcggctcgctcgcccggaaaaaaagctgccacgtttgaccgtgacagcctttacaaatttaatcttaactgatcagtattagcccggcaggcgcgtttttatttaatccgatgcggttaatcttcctgctggaactgcgccatcacggcctgctcacactgctgtttcgttaacgcgcagtttggcacgctcatcatctcccagctgcagccaggcactggccacttcacgcgcggactcttcatcaaattcaggctgattcatcgccgacggcgactgactgcgcgccacggtcgatttcatctgttcgacatactgatccgcactggcgacctttttctcgccgctgacaatgtggcacagctgactggcataaacattctgctcagtgtcagcctcgtccgccgccagcgcgctgccggtggcgaggatgctcagcagcactatctgagttactttcattcttaactcctgttagttcgggttaaaccttacgctgaagggcttctaggcgtttctgacgccagttcagcagcggcgacacggtggtgccgtggaccaccacgctgcagaccaccagcgttaacgccatattggtcataatttccatctgcgggccttccataccgtgcgtccaggcataggcgatgtagttcagactgccaatcccgcggatgcccagccagccaatcagcagacgctgccccagcggcagtccggcgcgcagcgtcaccagccagacggccagtggccgcaccaccacaaacagcaccaggccaatcagcacgccgtagatgttccagtgctgcgccagtgtgacgcccagcaccaccatcatgccagccgccagtaaacgttcaatagtatcgccaaaagagagggcgtcgcctactacaaaccctatcgacttcaccatattgttgtcgccctgatgcgccaggcgtttattagggttcaccagtgcttcagagggcagcacgcgctcgtcgtcagagagatcgtccggctgatggcgacggaatacgcccatctcagcacggcgtaatcccagcccggcggcgaaggcagccaggaagccggaggcacccagccactccaccagtgaataactcagtgcaatcagtgccagcgccaggaaatcattgggcgccacatcgccattggcattgcgcagtcgggtcgccagcaggccaatcaactgccccagcacgaaaccgatgatcagaccgccgccaattgcccagagcacctcgaccgcaccccagtgccccagcatcgccacgctcaggctttcgccattaaacagcagcagcgccagcatcagcaacggcagcgcggaaccatcattcatacccgcttcgctggagattgccacgcgcagcgagtcatcatcctgcgcatcgttgaccgagattaagctcgccagcaccggatcggtaggcgcaacaatggcaccaaacgccagcgcaatcggccagtctaatcccaccaggaagtgcgacagcagggtcatcgcggccacggtcagcagcatggcgggaaaagccagtttcagcccggtgtgccagcagttattttgcagcggctgacgcagcttgaggccggtgatgaacagcgaggcagccatggtgatttcagtgatgtgcgccacggcttcggaatgggtaacaatatcgatgtggataacatcaaatccccacgggccgcacagcatgcccgcgataaggaacagaccaaatgaggtgactggcccccggtgaatccaaccggaagccagcgacatcagcagcagaaggccgcccgtcgctgctgtccaggctaaaaagttcataatactccagattatttcgggtttatgaataagcctggcacattttttgacgggcgaggtgtcagtttttcaggtgacgactggcgaagcggaccgccagcgcggcggcaccggctaaggtcgagagcgcaaccacgccattccagccccagtgtgccagcgccagacttcccagcgccgcaccggtggccataccgataaacaccacggtaaacagcagcgcattcaggcgactgcgtgcttcaggcgccaggccatagaccagcgtctgatgcgccaccagcgtggcctgcactcctaaatcgaagccgatggtgcagaggacaatcagcgccagctgggctggcattggcagcagcggcagcagaaacatcagggcaaaggagatcattaccagcgcggcgccagcctgcgtgacccttgccggaccgatgcggtcagcaaaactgcccgccagcggtgccgccatggcacccgccgcaccggctaaaccaaatgccccggccacggcactgtccagatgaaagcggtcgctgagcattaacgccagcgtcgaccagaaggcgctaaaacccactgacaacagcccctgagccagtgcggcacgacgcagcgtctgatggtgacgccacaggtgcaccagcgacagcaacaggcgcggatagctcaccgaggtgcctggcgcgaaacgcggcagtacccgccacagcgtcagcgttatcagcagcaccgccagcgcggcaatcatatacatggtgcgccagccgaaatactctgccaccaccccgctgaccacccgcgacagcaggatccccaccagcagcccggtcatcaccgtgccgactgttttaccccggctgcgtttccggcgccagcgccgccgaagcgggtacaatatcctgcgccaccgtggcggtcaggccggtgataaaactggcaatcagcagcgcgctgagtccaccggaaaaaccacacagcagcagcgccgccaccagcattaagcctttgataaagataatggtgcgccggtcatggcgatcgcccagcggagccagcagcaggatgcccagcgcatagcccgcctgggtcagcatcggcaccatgccgaccgcgccgatgccggcgttaaactgcttgctgatgatatccagcatcggctggctgtagtagatcgacgcgacgctgagtccggcaccggcggccagggtaaacaccagcggcgcagagagcggttcattttgagtctgggtctgtatggctgacatgctgtaatcctcatcatttcgtcctgccattaaagcgcattgcggttatacgcggtagactgacatcaggcaaaaccgttatgcgtggtgcgtatgaacaaccctaacagcagcgatcgcatcgatctgatgcagacttttatccgtattgtggagagcggcagcttatccgccgccgccgcgcagctcggcacgacacaacccaccgtcagccgccgattgcagagcctggagcagcggctgggcctcaagcttatcctgcgcaccacccatgcactgaagcttaccgatgatggcgagcgctgctacgcccaggcgcggcagctgctggcgacctggcatgcgctggaagatgagctgaccggggccagcgatgacccggtcggtacgctgcgggttcgcgccccacacgcctttggtcaggatcagctgatcgccccgctggtggactatctgcaccgctacccccggctcaatattgagtggatgctgaatgaccgcacgcccgactttatggcagagaatgtggactgcgccattcaggtcggtgcgccaaccgatccttcggtggtggcgatactgctggcagaagtgccacgtattgtggtggccgccccgcacctgctggcgcagcagccgccgatagagcgggttgaacagctgcgcgacctgccgtggctggcactgaccagtttttaccgtaacgaagtggtgttgcagaagattgacgacggccagccggtaaacctggcgattacgccccggctgagcagcgacagtttatatgcggtgcgcaaagcggcactggctgggatgggagccgcgatcgtctcctcatgggcagtgcaggaagatctggcggatggcagcctggttcagctgatgcccgcgtggcaggcaccgccgctgccggtgtggctgacctatccctgggcgagttactacccggccaggctgcaacacttttttgccatgatcaaagaggtgatgccgcagctggcgggcacgcgtccggcctcacagccagcgggtcgttcagggggaacagagcggaaagggtaaagcaggcgcccgcctcagcgggccgccagaaaggttacttcggttttttatcgctgcgcgacatctgatccagccagcccatcacaaaggcggagagcacaaaggtcaggtggataatcacgtaccacatcagcttgtcgttttcgacgttgcgcgcttccataaacacccgcagcaggtgaattgaggagatggcgacaatggaggcggcgactttgtttttcagcgagccggagtccatcttgcccagccagctcagcttctctttatcttcgtcgatatcgagcttagagatgaagttctcataacctgacagcatcaccatcaccagcaggccgccaaccagcgtcatatccaccagcgacagcagcagcaggatcagatcgttttccgcaatgctgaaaatgttgggcagcaggtggaaaatttcctggaaaaatttaatggtcagcgccagcaatcccagcgaaagtccaatgtaaaccggggccagcaaccagcgcgatgcatacatcaggttttcggtaaaacgttccatacaatcccacgaataatcaaacaggtccgggagtataaccgatcaactgtgaagttatttcagcccttcgtcagaaatttcagggaccggcggcagcggcagcgagagacgaaatgccgcgcccccttcggccctgttctctgcccagatctgaccaccgtggctctcgataatggttttacagattgccagacccagcccgacgcccggcaccgccgactctttgtcgccccgccagaatttatcgaatatccggcttaaatcgtcttcggcaatgcccggtccgctatcccagaccgagatctccagccgtgacgccgcacgccaggcgcgaatgccgcgtggtgcgctgttaccggcatacttcaggctgttctcaatcaggttggtgaagacccgctccagcagcgtgctgtcgcctttgatcagcacgatgtcgtccggcagatcgagccggacctcatgccctttcagtgatggtgccatgctgctcagcgccccgccgaccacctcttccagcgccagccactcctcacgcaggttgaggccgcccgactgaatgcgcgccatatccagcatgttgctcaccaaccggatggtgctcagcgtctgctcgcggatctgactggcctgcggcacatattttgagttgtcgctggccaggtcaagcatcagcatttccgcctgaccaaacagcacggtcagtggggtgcgcaggtcgtgggacagcgccgacagcagcgcattgcgcagctgttcacgctccgccgagagccgggacgccgcctcgctatgcgacagcgccatccgttccagtgcgttagcaatcagcaccgtaaaggtttccaccagccgctgctgctcggggatcatcagctgacgcaggttctgcggctccaccaccagcaaaccccggcagtgcgcgccacttttcagcggcaggatctgataaggcaccgccggtaaggtatcagtgcccgcacccgcaggctggcctttgctgtaactccatttagcaatcgcgcgatccggctcgctggctggtaacgcatcgcccaccggttgcagttcgccctgctcatccggcagcagcagcaggcagcgcgcctgtaacgtggcatccagcacccgctggctggtggcggcgatatcctgcggcgttaacgcactgcccagcgatttcgccatctcatagagctggcgcgcccgctgctcgcggtagcgcgccacccgcgcctgataacgcacgcctgccgtaagattgccgacgattacgcccaccgccagcatcacgccaaaggtgaccagatattgcagatcggagaccgccaccgtgccggtgggggcaacaaagaagaggtcaaaggcgacgatattcatgaccgtggcgatcaccgacggccagcgaccatagcgtagcgccacgatcaccaccgccagcagatagatcatcacgcagttggcgggatcgaaaccgatcagcaccgactgcccggcggcggttacaaggatacagagcaccagcgccatcattacgccgcgcagctgaatacgccatttttcgctggtgacgcggccatccggcagcggatgcggcgcatccttcagcggctcatccagcgccaccaccagcagatcgagatccggccccagctggccgagccgttcggcaaaactgtcacgccgccagcgccgcagcgggcgacgaccggtgacaattttgcccagattgtgtgcgcgggcgtaacccagtaccgcttcggcttcatcgggttcagagagggtcgcggtttccgcgcccagctcctgcgccagctgtaacgtgcgcagaatcgcccgtcgccgcgcttccggcagccggtgcagccggggcgtttcgacatagaccgcgtgccattcactgccaagccgcgccgccagtcgggcggcggtgcgcaccagcttttcactgccgctgtcgtcgccaatgcagagcagaatggcgtcgcgggtgtgccagacgcgctcccgtccctgctgatcgcgccaggcgcgcatctgatcatccacccgatcggcggtgcgacgcagggccagctcacgcagggcgaacaggttacctttgcggaaaaagttttcgatggcgcgttccgcgcggtcgccaatgtagactttgccctctttaagccgctgccgcagatcgtcgggcggcagatcgaccagcaccacttcgtcggcgctgtcgaaaaagggatcgggcacggtttcgcgcacctgaatgccggtgacgccgcctaccacatcattgaggctctcaagatgctgtacgttgacggtggtcagtacatcgatgcccgcttccagcagctcctcaatatcctgccagcgcttgggatggcgcgagccctgcacgttggtgtgcgccagctcatccatcaggatcaccgccggatggcgagccagcgcggcatcgagatcaaactccgcatgacgcgagcggccggttgcgcgacgcggcagcagagttaaccctgtcagcagctgcgcggtttccggccggtcatgggtctctaccacgccgattaagacatccagaccctgcgcgcgcagccgctgtgcctcctgcagcatggcataggttttacccacgcccgcacaggcaccaaagtaaattttcagctgcccgcgatgactttcgcgattagcctgcagcagcgcgtcgggatcgggacgctggggtttcgtggttcatcgcttcctttacaccattacagttcgttgagcgccatattcagctgcaacacgttgagggtcggggtgccgaggaatggcatcagcggacgatgcgtcatcttatcaatcagcgcctcgacctgcggcaacggcaactggcggctggcggcgatacgcggtgcctgccaaagggcggcctgtggcgaaatatccggatccagcccgctggctgacgcggtgaccagttcaaccgggacggcggccggtgcctgcggattggcggcccgcagcgcagcgacgcgatcggctaccgctttgtccagcgccgggttgctggcggccagattgctgccccctgaggccagcggattataaggtttatcgccactggctgaaggacggccccagaaatagttgggctgggtaaagttctggccaatcagcgccgatccgcgcgccacgccatcctcctccagcagcgagccgctggactgggacggaaacagccactgcgccagaccggtggtgagcaaaggataaaccacgccggtaacaagcgtaagcagcaacaacagtaaaattgccggacgtaactgactcatttttctctcctcaggccatgcctgaaaacactaacagcagatcgatcgctttgatgccgacaaacggcaccagcaggccacccagaccgtaaatcagcaggttgcggcgcagcagcgcagcagcgctcagtgggcggtagctgacgcctttcagggccagcgggatcaggaagacaatcaccagggcgttaaagatcaccgccgacagaatcgcactggctggcgagtgaaggtgcatcacgttaagcatgttgagctgcggataggtcgccgcaaacgccgccggaatgatggcgaagtatttcgccacgtcgttggcgatactgaaggtggtcagcgaaccgcgcgtcatcagcatctgtttaccaatgtgcaccacttcaagcagcttggtcgggttcgagtcgagatcgaccatgttgcccgcctctttcgccgcctgggtaccggagttcatcgccaccgccacatccgcctgcgccagtgcaggcgcatcattggtgccgtcgccggtcatcgccactaaacgcccttccgcctgatactggcggatcagcgccagcttggcttccggcgtggcctctgacaggaagtcatccacgcccgcttccgcggcaatcgccgcggccgtcagcgggttatcgccggtgatcatcaccgttttgatacccattttgcgcagttcggcaaagcgctctttgatgccacctttgacgatatctttcagcgccaccacgcccagcacgttcgcgccctctgacaccaccagcggcgtgccgccactgcgtgccacctcttccacctgcgcattgacctcggccgggaaacggccatggttcgcttcgatgtggcgccgtaccgcatcgaccgcgcctttgcggatcagtcgatcctgcacgttcacgccgctcatgcgggtctgcgcagagaacggaataaagctggcacccatgctgctgagatcgcgctcacgcagattaaatcgctgttttgccagcaccacgatactgcgcccttccggcgtctcatcggccagcgaggcgagctgtgcagcgtcggccagttgctcttcgctgacgcccggcgcgggcaggaactgggtcgcctgacggttacccagcgtgatggtgccggttttgtccagcatcagcacatccacatcgcccgcggcttccaccgcacgcccgctggtcgcaatgacgttagcacccagcatccggctcatccccgccacgccaatcgccgacagtaagccgccgatggtggtcgggatcagacagaccagcagcgccaccagcaccgtgatgctgaccggcgttccgccccatgccgagaacggccagagtgtcacggtcgccagcaggaacacgatggtcagtgacaccagcaggatggtcagggcgatctcattcggggttttacggcgtttcgcgccttccaccatggcgatcatccggtcaaggaaggtttcgcccgggttggcgctacaggtgatcaccagccagtcagagagaatgcgggtcccgccggtgacggaggcgaagtcaccgcccgactcgcggatcaccggtgcggactcaccggtaatggcgctctcatccaccgaggcaccgccctccatcacttcaccgtcgcaggggatgatgtcgcccgcttccaccagcaccgcgtcgcctttgcgcagctcatcggcactgacctgctgccactcggcgccatagcgcgccgctgagagttttttggcaaagctggtctttttcacccctttcaggctgctggcctgggccttactgcgcccttctgccagcgcctccgccaggttggcgaacagcacggtgaaccagagccagaccgcaatcgccccggtaaagctggcgctgccgctgatccggccggtcagcatcgccagcgccagcagcgaggtcagaatgctgccgaggtagactacaaacatcaccgggttacggaactgcacccggggatcgagctttttcactgcatcccaggccgaggtacgcagcaatgctgcgtcaaataacgcctgttgttgacgactcatgaggattgtccctgaacaagttgcagatgctcagccaccgggcccagcgccagagcaggaataaaggtcagtgcacccaccagcagcaccgtgccgatcagcagtccgataaacagcggaccgtgggttggcagcgtgccgttacccaccggctgcacttttttcaccgccatcgcaccggcaatcgccatcaccggaatgatgatgccgaagcggcccagcagcatgcaggcagccagtaacaggttccagaacggcgtgttagcactcaggccggcaaaggcgctgccgttgttgttggccgccgaggagaccgcgtagagcacttcgctgaagccgtgaatgccgggattggccatggcactgcgcccggcgtcggtcatcatcgccagtgcggtaccgatcagcaccagcgccggtgtgaccagaatcgccagcgcggtcatcttcatctcccacacatcgatttttttaccgaggaattccggggtacgaccgatcatcagcccggcgataaacaccgccagcagcacaaacagcagcatgccgtagagaccggcaccgacgccgccaaacaccacttcgcccagctgcatcagccacatcggcaccataccgcccagcgcggtaaaggagtcgtgcatggcattcaccgcaccgcaggaggcggcggtggtgatgaccgcgaacaggctactgttaagaatgccaaagcgcgtctctttaccttccatgttgatggcgctgtcagcacccagctggaggaagtgcgggttgccctgcagttcggcccacatgacgaccgataccgccgccacaaacatcagcgtcatcgcccacagcagcatgtggccctgacgacgatcacgcacgctttcgccaaacgcgaagcagagcgccgccgggatcaggaagatgctcagcatctgcaccaggttagtcagcaccgtcgggttttcaaatggatgggaagagttggcgttaaagaagccgccaccgttggtgcccagcattttgatcgcttcctgcgaggccaccggtcccatcgacagcgtctgctgcacgccttccagcgtggagaaactgtgataaggcgcgaagttctgaatgctgccctggctgacaaagaacagcgccatcagcaggctgatgggcagtaagacatagagcgtgatgcgcgtcaggtcgcgccaggcgttacccaaggtcgcagagctgcgattagcgaagccacggatcagcgcaaatgccacggcgataccggtcgcggctgagaggaaattctgcaccgtcaggcccaccatctgactgaaatagctcagggtgctttcgccgctgtaggattgccagttggtgttggtgacgaagcttacggcggtgttcagcgccagatgccagctcaggccaggcagctgctgcggattcagcggcagcacgccctgcatcagcagtattgccagcagcaccacgaaacccagcgcattgaacagcagaatcgccagcaggtagtgcggccagcgcatgtccgattgttgcgcgcccagcagtcgccacagcggcgcttccagccgggcaaacaccggcttgtcagccactaacgacgccagaccccgtccgagcggctgcgccagcaccatcagcagcagcagataaaatgcgatgagtaaaaaagcattggccgccatcagaaggcctccgcatttaacagggcatagatcagatagcccagtaacaacaccaccagcacaatgccggttattacgcccacgctcacaggaacctccagaggattggatttatggcttagcttgcgcggaggcgtataaagaaggggttaaaatgcagcgggcgggcgtaaaaatagtgtaaaaatggcgaaaaatcaggcgacttccagcgcccagatacgattgagatcgacgttaccccacagcgtgctgtcctctgcacccacaatgctgtcggtgcagaagctgtcgccaaggtcgagctcttccggtttcacttcacgctgggcgtgcagtgaccagaagacatgcacgcagggacgcatcagcgatttttcgcccgctttcaccaccagcgccacccggccggaggccagacgcaccagcgatcccaccggatagatgccgatggtccgcacgaaggagtgcagcaagccagggtcgaaatggccgcgccagctcagcatctggtgcatcgcctcggcgggtgtccagccgttgcgataggagcgggtcgaggtcacggcatcatagacatcgcacaccgccgccatgcgggcgtagagcgaaatcgcctcgcctttcaggcggtgcggatagccgctgccatcatatttctcatgatgatgcagggtgatatcgagcagatcgtcatcggcgtcggcttctatcagcatctgcgcaccgaccaccggatgctcacgcatcaccctgaactcctcttcagtcagcttgcccgctttattcaggatcgccagcggcacggccgctttgccgacatcatgcagtaaaccgcccatgcccacccgacgcagctcctgctcatccagtccaagttttttacccagcgcaatcatcagcccgcagaccgccatggagtgcagataggtgtagtcatcatgatttttcagtcgcgccacgcttagcatggcggagggttcacgcgtgatcgatccggcgatttcatccaccagatccatcatataatcgagcttcaggccgttacccagccgcgcttcgttgaacatcgccagcactttcggtttgccctgcaaaaagatctgctgtgcctgatccagttcctggaaaaacggggtgcggccaatggttctcttcgcgaccgtggaggcgatcggcgcctgcaccgatcgatcgaggtcgatccagagctggcggatcccttcagtgcgaagcatggcgatttgtcggggatcggtgatcagcatctcattatgaatgcgctggtcttttatccaccagacctccagcttgtggataaacatccctgggcgcaattcatcaatggtaatcagctttatcacgctatcactctttaatatcagcgggtggtaaggtgatatcggcagccggacaaattttcttcaggctgttttgtgcgaaggtgagggtctggtgagtggtcagaggagaggcgtcctgcctcgcccccgtttcagcagggggttaaggcgccgctgtggttacactacccgggtcagcaccggctcaccacgggcaaacgccagcatattctcaaagaccaggtcagccatcgccgccatggtttcgcgggtgctgctggcgatatgcggcgtgatcaccacattgtcgcgctggcgcagtgcgtcaggcacctgcggctcctgttcaaacacatccagcccggcaccggcgatctgcccggtttccagcgcatccaccagcgactgctgatccaccacgctgccgcgcgcaatgttaatcagatagccctgcggtcccagcgcctgcagtacttccgcattgataatgtggcgcgtcgcggcaccgcccggcagggtcagcaccaggaaatcggcctgctgcgccagcgccaccaggctctcatgacgggtgtagggcacatcgggccgtgaacgcggattgtaatagtgaatcgccatatcaaacgcctgcgcgcgccttgccaccgcctgaccgatattgcccagcccgacgataccgcacaccttgccaccgattttgctgctcagcggaaagcggccctgcgtccagtgaccggcgcgtgtgaagcgatcggcctcgctgatgcggcgcgccacatccagcagcagcgccatccccagatcggcgacgcaatcattgagcacctccggcgtgttggtcaccacaatgccgcgcgaccgggcggcttccgtatcgatgctgtcataaccgacgccgttactgcagatcgctttcaggtttggcagcgcggcgatcagcacggccggtgcgcccatcaccgcgttgccgctggtgaccagcatgtcgatatctgcgccctgctcagccagaaaggctgcctcatcttccgcctcccacagccggaacgcggtgaacgtcttttcaatgttctctatcagctgcggtggcaggaatttccctctgatcagcaccttacattgctttaatgccatcttctttctcctgattgttataggatgccgggcgatcgctctcttcaccgacgcgttcaatcggtcccatcaccagcaggaaacagcagcgccgctaccacgcagtgtgccgccacaaacgccagcccgatgctgtagctgccggtcagaccgacgatgatgccgaacagcagcggcgtggtgaaaccggcaatattgccgatgccgttaaaaatagagcctgccaggcccaccgcctctttgggtgcggtgtcgctgatcaccgtccaggtgcctgcaccggccgctatacctttaccgaaaaaggcgaaggacataatggcgataatgccgctattgcccggaatgatcgccgccagcaccagactggacgccatcagcatgccgacgatatagggcgttttacgcgcccaggagacgctccagccccgggcgattaacttgtctgacaggtagccgccgctgatcccgcccagaaaaccaaacagcgccggagccacggtggcgaagcccgcctccatgatgttcatgccgcgcgcctgcaccagatagatcggaaaccaggtaataaagaagtagctgagcgcgatgatgcagtactgaccgagataggcgcaccagagcatgcgattagtgagcagctttctgaacatcgctttactgaccggtggccgcgctttcagcgtctgcgccgagtcgatatccaccagcgcaccaccgtcaacgatgtggcgcagttcactctctgacacgccagggtgattgcgcggctcgcgcatccaggcagcccagacaaacaccgccagcaggccgatgccgcccagcacaaagaacggccactcccagccaaagcgcgacaccagccagcctgacagcggcgagaagatggcgacggcaaaatattgcgccgagctgaacagcgatgaagcccgtccccgctctgcgccagggaaccacataatcaccacgcgcgcattggcgggaaagctgggtgcctcgatcaatcccagcataaagcgcagaccaaacatcagcatcagcgcgccggtcatgccgctggagaactcgccaacgaatcccatcgccagcgtcgagactgaccagagcgccagcgtgacgccatacacttttttagccccgaagcggtcaagaaacagtccgccggggatctgaccgataacgtaggcccagctgaaggcagagaggatcaatcccagctggatcgctgacaggccgaactcctctttgatcgccgatccggagatcgagaggatcgaacggtcggcataagccacgaccgacagaaagaggatcaggcagaggatccagatgcgcacatgagacgtccggtgagtcgtttggtctttaagcatgagctgaattccttaaaaagcggcaggttgcgccacgaggtttttttcaggaataacgctgagatttcccgcttaaggaaatatagataggaggctaacgatggatcattgtgcggatgttgagatcgtcaggcccgattcaacggttttctgacaaccaccacaaaggccagtgcgatgctgcacaaaagcgcaaaaagccgcggctgcctgccgcagagtgtgcgccacgtcgaggatttcatcggcgcggccagctatgacgcggcgattttacggcaaagtgtggcggcgctagcaagagtgaaaagggccggttgtcaaacccggcgactgttcataagctgcaaatgataatctttgtccatttttacaataaatgaaaaatctattccactcagttaacctcgggagtctgcaatgaaaaaacgtgcatgggccatactctgtctgctctctctttccacgtcggcgctggcagagaaaattggcgtctcaatggcctatttcgaccagaactttctgaccattatccgccagtcgatcgagaaagaggccaaagcgcgtcagctggatgcgcagttcgaagatgcacgcggcgacgtgggccgtcagaccgatcaggtgcagagttttatcagttccggggtggacgcgattatcgtcgatccggtcgactccgctagcacccctgccctgaccagactggcgcagcaggctcacattccgctggtctacgttaaccgtacaccgggcgataaaaccctgccgccgggcgtggtgtttgtcggctctgacgaacgcgaatcgggcacgttgcagatggaagcgctggcgaagcaggcgggttatcgtggcaaggtcgccattatcatcggtaacctcagcgatgcgggtgcgctgcagcgcaccaaagatgtggagcaggtggtggcaaagtatcccgacatgaaagtggtgctgaagcagaccgcaaactattcgcgtaatgagggcatggatttaatgctcaactggctgtcgaacggggaagagatcgatattgtcgccgccaacaacgacgaaatggcgattggcgcaaccatggcgattgcccaggcgaaaccgaagaaaaccattctggtgggcggcattgatgccacgccggatggcctgaaagccctggcaagcggcaaactggccgtcaccgtgttccaggatgccgtgggtcagggcaaaaaatcggtcgaggtggcgcagcagatgatcaaagggaaaaaagtcgattcccaccagtggatcccgtttgaactggtgacgcagcagaacatgcagcaatacagcaataaaaatccgtaatgaaaagcggagcggcagcgctgccgctccggttatcacttctcgtgcagcagtttcgccatcatcaccacatcgcgcagctgaccgtcgcgcagggcagcctgccgcatcaccccttcacgctcaaagcccagccgctcatagagccgcagcgcccgttcgttgtcgtgaaacacctccagctccatacgcgtaatccccagccagttacgggaatagttgagcgcggtgcggatcaggcgctcaccgacgccgcgaccggcgtaatcgggatgcacacccagcccaaagctgatgcagtggcgggtgcgcggcttgttatccacaaacagcgtcagctcaccggccagcacgccctcgatctccgcgacaaaggcgataaacccctcggcatccattctggcgatttttttctcccaggtggcaacgctgggaaacggcagctgcagcgtccagggatagacatcgggatgactgtagagtcgctgataggcggcggcatcctgcggttcccgtgcccgaataatgatttccatattttctccttttagccgaatggggttcatgcactaagctgtagctctttaccggacggaaagagtatcgctatgttgtatcgccgttttgagcgttttatcaatatttttcatgacgcgcccaccgactcgcccccctcaacggtctggtcgttttacctctactatctgcggcaggtctggccgagtttcgcggcactgctggtagtgggactggcgtcagccctgattgaagtgtcgctgttcagctatctgagccgcattatcgacatggtcaatcactccacgcccgccagcctgtttcgggataactggccgatactgctgtggatgggggcggtggcgctgattctgcggccgatttttatcgccctgcacgacatgctggtgcatcaaagcatcagcccgagcatgaccagcatgatccgctggcagaatcacaactacgtgctgcgccagagcctcaatttcttccagaacgatttcgcgggtcgcatcgcccagcgcattatgctgaccggcagttcactgcgcgattccgcggtgcagctggtggatgccatctggcacgtgctgatctacgcggtgacttcactggtgctgtttgccggtgccgactggcggctgatgatcccgctgattctgtggatggtggcctacagcgcctcgctgcgtttctttgtgccgcgcgttaaagcgcgttcggtggtctcctcagagtcgcgatctaagctgatgggcaccattgtcgatggttataccaacatcgccaccatcaagctgttcgctcacagcgatctggaacggcagtatgcgcgtgaggcgattcaggagcagaccgaaaaaacccagaacgccggtcgcatggtcaccagcatggatctgaccctgtcggcgctgaacggcctgctgattgtctcgacctccgggctggcgctgtggttatggagccagtcgctgattagcgtcggggcgattgcactggcgacaggtctggtgatccgcctggtgaatatgtccggctggatcatgtgggtggtcaacggcattttcgaaaatattggtacggtacaggatggcctgaaaaccatcgcgcagccgctgagcgtgcaggatgcgccgcaggcgaagcagcttaaggtgacgcgcggcaacatccgttttgaggatgtgcgcttcgattatggcggtggccgtcaggtgattaacggctttaacctcgacatcaaacctggcgagaagattgggctgattggtccctcgggcgccggtaaatcgacgctggtgaacctgctgctgcgcctctatgacctgaacgcggggcggattgtgatcgacgatcaggatatcgccgccgtgacgcaggagagcctgcgcagccagattggcatgatcacccaggacacctcgttgctgcaccgctcaatccgtgaaaacctgctgtatggtcgtcccgacgccagcgaagaggagctgcagcttgcgattcaccgcgcccgcgccgatgagtttatcccgctgctctctgactcactgggtcgcaccgggctggatgcgcacgtgggcgagcgcggcgtgaaactgtcgggcggtcagcgtcagcgtgtggcgatagcccgcgtgctgctgaaggatgcgccggttctgatcatggatgaggccacctcggcgctcgactccgaagtggaagcggcgattcaggagagcctggagtcactgatgcagggtaaaaccgttatcgccatcgcgcaccgcctgtcgaccatcgcgaagatggatcggctggtggtgctggataaaggcggcattgccgagatgggcagccatcacgagctgctggcgcaaaacggtctctatgcccgcttgtggcagcatcagaccggcggttttgtcggcatcgattaatcgccgcgtcgatagggtaaggcgtcgcgggcttcttccgcccagccgcgcacgccttcccgctcctgcaccagaaaatctgccacggcatcgcgcaggccgggatgcagcagatagtgccaggagtgggtaatctgcggctcgaagccgcgcaccagcttgtgctcgccctgtgcgccggcatcaaaccgcatcagcccctcatccagggccaaatccattccctgatagaaacaggtttcgaagtgcagccggtcaaactccgccagacagccccagtagcggccatagagcgcgttgctgtcccgcagataaaacgccatggcggccggttgctgctgtaaacgggcgataaccaccacaatattctgcggcatgcgttccgccagcaggctgaagaagtcacgcgtcagatagggacgctgaccgcgcaccgcataggtgttggcgtaacaggtgtagacaaaatcccactgatcttcgcgcagctggtagcccaggtagcggtcaaactcaaagccgctctgcatcacctgctcacgctctttacgcagttgtttgcgcttgcgcgacatcagcgaatccaggaaatcctgaaaatcgcggtagccacggttatgccagtgatactgacagccgagccgggagagccagtcgggctgatcggccagcagctggttagcctgcgcatcggtaaagttgatatgtgccccgcttaagccctgctgtaacaggctctcaggcagggccgacagcagttgcgctgcggcagcggtttcgcccagcaggcgcgcaccgctgaccgggctgaaggggatcgcgcccagccatttcgggtagtagcggatcccggcgcgctgactggcatccgcccaggcgtgatcaaagacgtactcgccctgtgaatggcgtttgcggtagcctggcagcgcggcgcgggtcaccccctcctcccgccacagcagatgatcgggctgccagcccgcctctaaccgcacgctgccgctctgttctaacgtgagcagaaaggcgtgacgcaaaaagggctggtcatcaggcaacagcgcatcccactcggcggccgggatctccgccagtgacgtcaggtgaatcagcgacatgaattactccagagaacgtcgggcagagagtcagtcaagcaggttttccgcgtcagcgaaagggttaaggcacgcaaagtgaaggctgcatcagcggagcccagcttctatactgcgactttatctccacaggacaccgccatggatcgactcgattgtgaccggatgtttgtcacggtgctggaaaccgggagcttttctgcggcggcgttgcgtctcggcaccagcagcagtcaggcttccaagctggtttcaaagctggagcagcggctcggcgtccagctgtttaagcgcagcacgcgcgccctgtcacccaccgatgtcgggcgcagctattatgagcgggtcaaaaacctgctcgatgcgtttgagacgctggatgccagcgtgcgtgaaagcgctacgacgcctaccggcaggctgaaaatcagcgcccccggctcctttggtactgtggtgttgtctgaggtgctggtggcgtttgcccggcgctatccgctgattgaactggatgtcagcttttcagaccggtccgtcaacatcgtcgatgaaggctttgatatggcgatccgtatcggcaccctcagcgacagcagcctggtcgcgcgcaagctgggtgaagtgcatgtgcgcatcgccgcctcgccggtctatcttgagcagtttggcacgccgcagcactggcgcgagatgccccagcatcagtgcatcatcgacaccaattttcgcgatccctggcactggccgtttgccggcggcgacggcgacggcgacggcgacggcgacggcgacggcagcgagattgtcaccgtaccggtccgcgggcgtctgcgcttcgccaacaccgaagcctgcctgcaggccgcgatggccggactgggcattgcgcggctgcccggttttatcgcggctcccgcgctgcaacgcggtgagattgtccggctgctggagaattttgacacgccaccgcttggcctgtttgcggtttatccgcccgcccgtcatctggcacaccgggcgcgcctgcttatcgacttgctggtgagccactttacccgttttccgcccgcgtaatttcttccagaatggaagaaatgattgtctttatgaccggattatcagccgtttagtcatcagttaagctgcttctcacattacagaggagtcgcgcgatgttagtagaaggcaaatggagtagtgactggcacccggtgcagtcgaccgataaacagggcggatttgttcgtcagacgtccggtttccgggattttatcagcagcgatggctccactgaatttgcggcagaagcggatcgctaccatctctatgtggcgctgatctgtccatgggcgtcgcgcgcgttaattgcccgcaagctcaaagggctggagtcgctgattagcgtgacggtggttgaaccgcagctcggtgcccagggctggcgctttggcaattttcccggcgcacagcaggacccgctgaatcacgcgcagtacctgcatgaaatctatacccgcgtcgcgcccgattacacgggccgggccaccgtgccggtcttgtgggacaagaaaaccggcaccatcgtcagcaacgagtccgctgacattgtgcgtatgttcaacagcggctttggcgatctggccgataaccgcatcgacctctatcccgccgcgctgcgccctgagattgatgcgctgaatgagagtctttatccgcgtctgaataacggcgtttaccgcgccgggttcgccaccacatcgatcggctaccagcaggcatttaatgacgtcttcagccagctcgacgaactggaagccctgctcagcgatggacgcaccttcctgctgggtgaacggctgactgaaaccgatattcgcctgtttcgtcaccctgattcgctttgacgtcgcctatcatggcctgttcaaatgcaacctgcgccggatacgcgactatacgctgctgaatcgctatcttaagagcgtgctgtcagtctccggcgtgcgtgagacggtcagcatcgatcatatcaaacagggttactactcaatcaaggcactgaacccgaacgggatcgttccggcaggcccggatctgagtgagtacggtctttaaaggagcaataatggcaaaagcactggtgatttttctgcatggcgtaggcagtaacggcgacgatctggcaccgattggccgtcactgggcgacgctgttgccggatgtgatttttgcctcacccaatgcgcccgaacgttttaccgccggttttggctggcagtggttcagcctggaggaggtgacgccagagaaccggccaggtcgggtacgggccgcgcgggcggcgtttgacgcgaccctcagcgacgttatcgcacagcacggcttcgccgaccgctggcaggatgtggtgctggtcggcttttcacaggggtcgatcatggcgctggatgcgctggcatctggccgttatccgctggcgggcgtggtcgccttttcgggtcgtctggcggttgacggtgaactgacgccacagcctcatctgcccgcgctgctgatccacggccaggccgatgaggtgatcccgtggcaggagagcgaatctgccgcagcacgactcagagccgcattggtgccggtagaagcgcgatttgaacccgccaccggccacaccatctccgctcagggtgccatgcacgccgccgcgtttatcgggcagtgcttacaggattaaccccagcagcgctttaatgcctgccaggcatgacgggcagcaacctcaggcggcaggcgtttcagcgcatcattaaagacttcaatgcccaccggcccctgatagcccgcgcttttgagcttatcgacaaagcgttcaatgtcgataatgccatcgccgggcagcagacgctggtgcttcgccatcgccatcaggctctgcttatcctgcgcgggaacggcggccatgtcacacagctgcacttcatagatgcgatcggccggaatgccgtccagttgcgaggcatcgccgcccagcgcgcagatatgaaacaggtcgaccaccagcccgatattgggctgatcgagccgctgcaatcgctgccacgccagcggcagggtgttatccacgctgcaccaggccatcggctcatacataatgcgcatgttgtagcgcgcagcttcagaggccatccagcgcaggtcatcatcaatctggtcggcgcagcaatcctcacgggtgctggccggcgcctgaatggtgtcgcagcccagcgcctgggcaatctgaataaactggcgcagctcttcgcgcttctgtccgcgcaacgcgctgggtgccccggtgaaatcgcgcagcacctggagattggtaaagccaggtccctgccgggcagcgatctcagccagtgccgccgcgccgccctcgcacgcctcgacatcctcgcgccagatctccacctgatcgaaaccggcgtcatgcgccgcctggagcttctggccgggttcaccgtttaacagcaccaggttaaggaatgtggggttagttcgcattgctcggctccttaatcgtccggaataatcggtgacgttcagcttctgcgcccgttcatgcaggatggtcgggcgtaaaacctgaaacagtatctacctcttaaggagtatgacaagcgccgcttagccggatcagcccagcatcgtgaccagtgcgaaaccggcaaacgccatcagcagcgaaccgatcacatgcaccagcgcgctggtcatcgcccagaaatagttccctgattgtagcaaccccattaattccgccgtaaaagaggagaaggtggtcagcccgccgcacagtccggtgacgatcagcagtttccagaatgggtcgaggtcgggatggcgaacaaaccaggccatcgcgccgccgatcaccagaccgccgatcagattcaccagcagcgtgcccggcggcagattgggaaagagcgcattaaagcgcatcgcaaagagccagcgcagtacacagccggcagagccgccgatcatcacagccaataacggtttcaacatgtcttgctcctgattgcagattgacgccgggctgagggggaaaggcagagataaactgcgcctgacacctcagctcccgcgaaaggattgagtgtcaggcgtcatcagccggtgtaaagcccaccggcggttgggaaaggtggcacgccatcaccttgagccggtgataatacgacgcccgtttcaggctggcaacagtgaggtcatggcggctgaaaaccttgacgcgcacgccacagacggagtaatgctgatggtttacagcctattgcggagaccctatgcgtaccctgatttttgataccgatatcggcgtggatgacgcctttgcgctggcctatgcggcgcggacgcagcatctgctggggattaccacggtcttcggcaacgtggcagtgggtcaggcggtgaaaaacgcccgactgttttgcgggaaaatggcgattaacgcggaggtctatcgcggctgttcacgaccgctggcgctgccaccctctgcgcccgccagactgcacggtgaagatgggctgggcgatgcgtttgataatgcctgcagcgatcaggcgccgggcgcggtgcagtttattatcgacagcgtgcgggcgcagccgcatcagatcaccctggtggcgattggtccgctgaccaatatcgccacggccattaatcaggcgccggatattattccgctggtgaaagagctggtgatcatgggcggcgcatttggcaccgacgggcacagtggcaacgtgacgcccttcagcgaatttaatatctggaaagatccgcatgctgccgatcaggtgctcgcctcggcgctgaacgtggtggtgatcccgctggatgtcacacacaaggtgctgatcagcggcgatgaggttcagcgtctgaatcagccggtgctgagtgcgatctgtcgcccttacctggcttacagtctggagaaagagggattcgagggtatggcgctgcacgacaccctggcggtggcgtggctcactctgccacaggcgtttaccctgaccgaaagcccgcttcgggtgatcacggagggcatcgcctgcggtcagacggtgcgtaagctgagcgcgctggcctcccgccaggatccctttaacggcctgcccgcccagcgtatcgcacttggcgtggatgctgacgcggtgcgggcgcacttctttcagaccctcaccgcgccctgaaccacgcgaaccgactggccgcgttaccggtcgaaatgaatcacgcctttgatcagctcgcggttgttgatgatttgcgcctcaaaggtttcatccagcgtggagaaggccagatggtgattcagcatcatttcggcgcgcagctggccgctggccatcagcgcacgcacccgatcgaaatcttcacggatggcgttgcggctgcccatcagggtggtctcttttttatggaattcactgtccgggatcaccagatcgcctttgtgcaggccgacataaacgatcgtgccgccgtgtcgcatcaggttgaccgcattgttcatcgccgccgggctgccggtggcgtcgatcaccttcagcgccagacggccaccaaactcctcgcgcagcgcgctgtaaaacgcttcatcagccggattcagtgccgccaggccgagctggtcagcaacatgctggcgacgaaattcgctggtatccgcgaccaccacctgcgcgccgctggcggcggcgatagcggcaacacccagcccaatcggtccggcacccaccaccagcacctgctcatccgccacaattgcggcacgacgcactgcatgggcgctgatggcaaatggctcaatcaacgcagccgcttccggcgcgacatcatccaccgccagcagcgtgctgaccggcacgctcaggtagtcgcagaacccgccatcctgatgcacaccaatcactgagatctgctcacagcagttggtcttgccgctctggcaggcgtcacagcgcaggcaggagatgtaaggcattaacgctacccgctggcccggctgaaagtcctccgcatcacttcccggcgccacgacttcggcacagatttcatggcccagcacccgtggatagctgaagaatggctgattaccggaccaggcgtggatgtcggtgccgcagattcccgcggtgaggattttaatgactacctcgccagcggcgggcgtggggatatcgcgggtggtccataccatcttacgtggttcagcgatgaccagtgctttcattgttgtcatggtgattctccggttgtcctgcaggcagttatggcaaatcctgcacgcgctgcggtgttcgtttgcgggaagtgtgaagcaccgcgatttttttgggctttgaatggtttttaatgcataaaaaaccggagagtgagatgagccgcagccagaatttgcgccagaaacgtcatcaaccagatgctggaaagcatcgctcagcaccacattcgttcaccgctgccgccccaggcagcactggcggaaatgttcaatatcagccggactacggtgcgccacaccctgcactatctgcatcagtgcggcgtgctggataaggtggatcaaacctgggttatcgtgcgcgatccgcgcgaagatgacggttttagcgcgttaacgccgccgattgagcagcaggccagccactttgagcagatgttttttaatatgattaatcagcggcagctggtgcccggcgataccttcagcgagctgcaactggcgcagcaggtgaaagtcagtccggtggtggtgcgcgaattcctgctgcgctttatgcgctatgacctgctggagccggtcagacgcggccagtggcggatgaaaaaattcacccaggattacgccgagaagctgtttgaactgcgcgagatgctggaaacccacgccctgagccgcttcctgaatctgcccgcaggcgacgagcgctgggttcaggcgcgggatctgctggatcgtcaccgatcgatgcgcgacaccatcgccagcaactatcgccactttgccgcactggatcgtcagatgcattcgctgattttatccgccgccaacaacccgtttttcaatcagtcgctggagattatctcggtgatctttcactcgcattatcagtgggacgagagcgacctcaagcagcgaaatattgtggcgctggaggagcatatggcgattctgaccgcgctgattggccgtcaggatgtcgacgccctctgtgcattacataaccatctggcgaccgctaaaacctcgatggtgcgctcaatcggtcagtacaattaaaaaccgattaaaaaccacaaagcattagctcccgcacgattcagaaacatctttgcaacatccttaaccctttgctcttagtctcgactgcaacgtcacggcggccttttgccgctgcgcgcagaccccttctcaccataacgataagtacccagtttcgggagagtgcaatggaaaagacttcagtaaccggccgcgacagcgcagctggcgacacgccatcagaccaggatttcgtgccgatgcgtagcgacgtggtgcgttcaccgcgtatccgcaagattcagatcacggcgatgctgctgttgctgtttcgccgccatcatcaactatctggatcgcagctcgctgtcggtcgcgaatatgaccatccgcgaggagatggggctgagcgccaccgaaatcggcttcctgctctccgccttttcgctggcttacggcctggcgcaactgccgtgcggcgcgctgctggatcgtaaagggccgcgcattatgctcggcattggcatgtttatctggtcgctgttccaggccgcctctggcctggtgcataactttacccagttcatcctggtgcgcatcggcctcggcattggtgaagcgccgatgaacccgtgcggcgtgaaagtgatcaacgactggttcaacattaaagatcgcggcatgccgatggggatgttcaatgcggcttcgatgattggactgtcggtggctccgccgattctggcggcgatgatgctggtgatgggctggcgtggcatgtttgtcacgatcggtatcctcggcatgttcctcgctatcggctggtatatgatctaccgcgaccgcgacaacaacaccctgagcgctgaagagatccactatctgcaggcgggcagcgtcgcctcgcgtaaagagccgatcagcttcaaagagtggcgcggcctgtttaagcagcgcaccatgtggggaatgatgattggcttcagcggcatcaactacaccgcctggctctatatcgcgtggctgccgggctatctgcagtcgacctatcatctcgatcttaaaagtaccggcctgctggcggcgattccgttcctgttcggtgcggcgggcatgctgctgaatggctatgtggtcgactcgctggtacgtcgcggctttaacgcggtgaaaacccgaaaagtctgcatcgtcagcgggatgctgctgtccgccggctttaccgccgtggtgacccgcgcgaccgacaccaccagcgcggtaacgctgattgggatggcgctgttctgtatccacttcgccggaacgtcgtgctggggattgatccacgctaacgtcaccgcccgtatgacagcgtctgtcggcagcatccagaacttcgccagctttatcttcgcctcgttcgcgcccgtcatcaccggctgggtgctcgacaccaccaaatcgttcagcatggcgctgatgatttgtgcctgcgtgacgctggttggcgcactcgcctacctgctgctggtgcgccagccgatcaccgacggcgaataatcacgactgacggcgcgactgttacgtcagcgccgtcagggtgaccccatgtttcgcaccataacgctgaatacccgtcatcaccttctccgcgctcagcgcgggtggaggtggcaacagcggtgcccgttcacgcagcgccgagtcgaaacgggcaaacgtcgcgaaatcacgcgggaaacgttcttcatccaccccgatgaatacgccttcatcacgtgcatgggagagcagcgcccgccagcggtcaatctccgccagcccgatgctgtcggtgccgtgagaaaaaagcatcatgtcgatgttgcggaacggcggctgtttttccaggaagcgttgcagggccgcggccgaaggctcggtgcaaaagaccagccagaacgggatggcgtgctgatgcatgctgcaccacgggtccatcagcaggaagctgtccaccgtcagccgggtcggtaaaattcccgccgccagataccagtcgcggtagatctctgccaccacatagctcatcgcctctggatcttcataacgaatctccatcagcttccagtttctgagcttccgccagttttttcagcggcgaaatcagataaccatccagtccccactccgcttccggcacgtggtcagtaatggccggcggcgtccagcgctcgcgatcgatgccatagcgtgccagatattccgccacccgcgggccaccctgtaagtactctttttcggttgcgccgccgagcgcaccaaactggaaaaacgagcggtcgctggtgcgggttaccggccactgtcgggtacaatgattgataaacagcgttgatccggcgggcagacttcccatcaggaattcgttgaaggccagcggcagctcgcgcagttttagccggaagtagcgcatctgatcgagcatcaaccgatcctgattcgggtcctgcatatggtgcaccgccagccgtggccaggcagccagcagcgcggcagcaatctctttgccctgctcaaagctggtctgtgcatcatcgggatcgttattcgcggcccgcaccgggcaaagaaaagtctggggcaaccagggcacacccatcgccgccgccagatgcaccagtgcaccgttcgatgaaccgataaaggccgccggataatcctgttgcgggtattcactcaccatccattcggcgatcccttccacatccagttcacccgcctggcgcaggctgatgccttctgccatgccgcccagcgcatagccccactcacgcagtccggtcggtagccggttcagtgagggcaacaggcgatccagcgtcggtgactggctggggctggcaaaggggcggtcgtgcagcgcattggccagcgcaagcagcatggcggcagcagagtcaaagcgggcaatccctcttggtggtttactcatgttgatcctcctgctggatacgtgccaggaacgggcggatggcgtgacagaaactccacgggtagacgtagtgcaaagtgtgcgtcccgtcgcgtaatgtcagtctttcgctgcgcggcatcagggcggcgagttcatccagccagcgggccggacagacgggatcgcgcgagccccgcagcagcaacgtgggtgcgttaatgtaagtaaggcgatgctcaatgcggtcgcgcatcatggcgcgcagggtaccgaaggcgcgccgcaggcccgctttggcgtaatcgattcgggccagtggccccggtggacgacgggattccagccggccattacgccagtcgcgccagagctgacgcggcagactgcgggcatgacgatcgaccgtcggcccctgcagcaccagtcccgccacagcctgtggatgtttcaccgccagcgcggccagaatctggcagccaaacgaattgccgacccagatagcgcgctggaaaccgttatgctgtaaccacagccacagcgcatccgccagctgatccaccgacatgatcggcgcagaaggtggcagtgtgctggcgccaaaaccgggcagatccggcaccagcacgtgatagtcgcgccccagcgccagcgccagtggctccatcgcccggcccgacatcaccagaccgtggatcagcacgaccggcagtccctgagcctcattgggcgtaacgcgggtaaacatgcgccagtcaccaatctgctgataataaccggccagaccggcgtgatgactgtttcggcgacaccggcggcgtctccttaagctgccgccagcgtttcatgccccataacgtggccgccacacccaatccaacacctgccacaatcgctgcctgttttcgtcgatgcttctggatcatccgctgctcctggtttggggagaataattcagtgtaggtcgggatcaggcagcaggcgggttatcggcgcgatggtgtgaaaaagtatggggtttcgcctaagaagacgctggcattgcgggtgatgaactctggcgggggatgtgtctggtgtaagcgggaaggcaatgacggcagtgaatgatgtgtgtacgctgtgagcgagaagcggacatgagagatataattaatccgccatgagaatctcagattcccaggacttattaacccggtgaatgacgccattaaaagggagacagggtggcaatcgatcacaacggctttattgccctgccagaaaccaataaattgcagccagagttccggaatattgttgcacaggtcgtggcaaagctaatccaaagttttcctgagcttatacatagcctttatttgtatggcagtgtggctgaaggccgggcaaaaatcgggacgtccgatctggatatgacagtcatatttagcgttgatcccggcgaagcggctaaagtgcaaattactgaaatacaacgtaaacttgaaaaaaataatcctgttgtcagtaaaatcgattttgattgtggtctgttacaacaggtagtgcatccggataatctgcttagctggggatactggctcaaacatcactgtgtctgcgtttacggagaggacctgagtcaacgattccaggcatttaaaccttcaaaagaaattgctgtagcagtgaatggtgacttcctgccggtgctggaaaaattaataactcaaatgcagttatctgctgacgaaaataaaaagttgcagctacagcgtgctgctgcacgaaagacaatcagagcaaccaatattcttcgcagtgaacatgacaaacagtggcctgaaacactcgaggagtatcgctttacattcaatgcccgatatccagcgttagcaaaagaaatggattacttgctggcaatcagtaatacgcctcaggggagcatcgctgatttcaaaaggcgcgttatggcttttgcccgatggcttaacgtaacatttcatcacgggcaaggcttatgaagggaggattaacatctgggtagcctgataaacgcggagcaggtcaacggaccagagataatacgaatttcaggcaataaaaaacccgcactgggcgggtttcttttattatcagcagatcttatctgctcagacttatgtcttcatcgctattgtaagcgtcgctgataatgagcgcggtttactgcgctgtgacgttgccagctgcagggcctttggcgccattttcaatggtgaaggagactttctgaccttcatcaagcgttttgtagttatcaccctggatagcagagaaatgcacgaatacatctttgctgccatcatcgggagtgataaagccaaaacctttatctgagttaaaccattttactaaaccagtcattttgttagacatagatatttccttaatcgattagccactaagagcggcgaagatggcctgtagttagagatttacttattgggcacttaggaggaggctctcgaagaaggatatctgtggataacacttgaactgaggactactttactaaaactgctttcataaggtctgtgttccaaaccgatgacgcattaagacatagcgataataatttagcaatgtatatgtttatttattttaaccatttaaacgctcagatggctgaatggctgttttattttgactgctcaggaagtgcttcaggctccgctgtgtgcgaagaggagcaggctaatcctgtcataatgacggtgccgatttaacgttgatgcttaacaataaacagagccagtaaggtcacattgcgtaaaaatttccgcacggccagtgaagcgctgtcatcaccctcttcatctgtgagctttacctgctgcatgtcgaacgcccggctcttcggtatctttcatcctgataccggtcagtatccggacgacctgcccgccctcaccctgcatctgaaatgctggagatttgccacccgcctccattctggtgcagaagcagcctgccgcgatgagcgagaagcgggctaaaccctacctgtccgcccattttgggcatgctgactgtctcagtgaccgtgaacggtcaatcctacgagccggataacaacaggacggacaaccagtatgcaaaagaaagccgctggcatggcgacacggtaagcattcatcacatttgtcatgtaatgaggccccattccgaattcggctaacgtgatgaccagactcatcaggaacgccatgatgatcgccatataaagcgcaaatatgtaaggtgtcgtgcgcaccggcaagcgggttcgtaaggttttttttgttgcagcatcagtcatctgaatatcctgtttaacaaaagtagataagactgtggctaacttaacaagcttatgcggggggttgtagagcggttatgctttaatcattattaagtaaaagtgacgaattaacggttgaggatacgatggacattttagggctgattagcacttttattcgcgtggtggaaaacggcagtattgcagcggcggcacgcgctaaaggtatgagtccggcagcagtcagccagagtctttcccgtcttgaagcgcatctgggcgtgcgactgctatcgcgcaccacccgcagcatgaccttaacggaaaacggtaaacgctatttcgagaaagtccgtcacatcccacaggatatcgaactcgcctctcaggctgctgcgaatgaaaccaaaccgcagggcccactttgtatcgccacaacagccgcgtttggtcggtacgttctggctccccttatgcccgctttcaaagcgtctttccccgatatagatattgaactgatcagtaccgatcgcaacgtcgatcatcgcctggaaggcgtcgatgtcagtatccgcatcgaagcacagctgaatgatcaactaatcgccagaaaaattgcatcgttaccctttatattctgtgcggctcccgcttaccttgatcgcgctggtacgcctcagacgcctggagaacttagccagcacgcctgcctggttttccgctatcccaccgacagacggtttctgccatggacgtttatggtcaacggacagcctgttaatgcaaaacttaaccccagttttatcagcgatgatattgatatcatcgccagaatagccgtaaacggcggcggcattgcccgtctggcaagttttgttgctcagccactgatagacagcggtctgctaaggcctttgtcctggtcaggtcacagtggcgagagcaccattgagtccctgccgatgaatatctatgcctgtgtcaccgaaacgttcggcactcaattcgaaagtacggacatttattgaatttgtggccgatgcgatttaagacaggagcgtttttgccgggcgaaaattgtccgtacttttcggcttatccacccgcaaaagtaattcaccgctgccggtcgcggttatacagaaagcggcccttttgacgatgtgcagaaaggatataagtacgctttgagaaggggtttaacgcggtgagaatgggatccgaaagtatctggcagtcggtgaaaactgccagaattgaggaataaaaattcgttatcagtcactaattctgatgacgattttgccaaatgcaccacgggagagatgccggaaggcttcaaccgcctcattaaagctgtaaacctgttcaatgacgggtttaatattatgtttattgaggaacggattcatccgatcaaacgaggagcgtggtgcaaccgcaatgccccggatttttgtctgacggaaaattaacggcatcaaatcaagctgtgctgtctggccggtcagaaatcctacctgagcaatcgtaccggcaacttttgtcgcagcaattgactgattgatgccattgcccccggcgacatctatcgttacgtcagcgcctttaccatcagtcatttcaagcacttttctttcccactcagggtattttttatagttaatcccttcatctgctcccagtgatttaatgcgctcaaggtttgcatcgttactggaggtggcaatgacacgtgcaccataggcatgcgctatctgagcagcgaagaccgatacgccaccggtttccctgtacgagcacggtctgaccgggctgcagattgccgatatccattagcgagtaccatgccgtaagcgcagcgatgggaagtgtagaagcttcttcatcggtcatgctgtcaggcgctttaactgcgctgtcctcatgaataatcatgtactcagccagcccgccgggtaacggcattccaatacaccatgctggctcatcggccgcaggttcaccctctaaccagcgtgaatagagatgcgagttaacgcgatcacccgtgctaaaacgggacacaccctgccccgtggcaacaacggtacccgtggcatcagagacaggaatcagtggctttggaaccagatgaggctcatagaagccctctactattgccttatccctgaagttcagagacaccgcgccaactttaaccagaagttcacccggaccaggtacaggcgtttccacctcttcaagctttaagttttcaaggccaaaatctttcagtaaccatgctttcattttgtcatttcccatgtgtatgcatcgaataggacgatgataaaaaaagcagggaggcgtaaaaagccacgtaaaaggacttcagtgttactgcaggagaaacaatcggaatgagatataatccgcaatacactatttcggcaggaatattttttgcggagttaaatgatgcgctcgaacatgctggaattgatggatatttttgttcacgtcgttgaattccgtagtttcacccgggccgctgacgccttgcagctgcatcgccctgcggtcagtaagtccgtacaacaactggaagacaagcttggcgttaagctattgcaccgcaccacgcgcagtctgagtgtgaccgttgaaggggaggaaatttatcagcgggctaaaacgctgctgagtgatgccagcgatatcatggcttcttactcttcaaatcagcgacctcgtgggcagctgcgcattgatgttccactggcgctggcgcacagtatcctgatcccacaattaagcgagtttcaggctttatatcctgaaattgaaatagtcttaaccgcttcagatcgcctgacccatttaatcacagagggtgtggactgtgttattcgtctcggtgagcttgctgattcgaattttatttcgcgcagaatgggcagcctgcagatggtcacctgtgcagcaccctcttatctggataaatatggcactcctttaacacctgatgaccttaaagatcataaagccatttatttttttaatgaacacagtcgggacgtccaggaatggaaatttgtcatgaatggcgaaattgtttcacggcatccgggaagcagcgtacgagttaacaattctgacgtccttctttcctgtggcgtggcgggcctcggcatgcttcacgcattatatacggcattaaagccctgcctcgaaacaggccagctgaaggaagtattatcgggttatgcgactgtgacgaaaccggtttcaatactctaccctgaccgacgctatcttccgcctaaggtccgggtctttatcgaatggtttactgaaatattcaggaagaatcatcagggttaaccgtgaatctttgtttcggcacaggcaatcccgtgacccattaaaagtgcttgtttcctgtttaaggtatgccgccattttgtctggcatccggaaatctcccgggcagattagatcactgcagcaacgtcttttctggctcaaagtgacgcataacgggaaaatcagaaggagaggagtagcaacaaacaggatgcacccgaagtgcaaaaacgcgggtttaaatcagcagaagcaaaggcagaaaaagcagaaaaggtgataatcacaggtcgatccctgaccgcgattatcgagggtttcttgcggggtgcttagtacatggcacccggcggtacgtgtttgaacgtctcaacgtaagcgcggaacacgtgtttaaaaatacgtttcatggaacacctgattcaaatttagttgaacatataccgaaaaagtatagctcctgcgcgttttaacagcaaataaatttgaaccagatcacaaaaatgacggttttatgtgcaaaagccctacgcggtgtagccgagatgctgcaacagaatggtagagccgacggcaatcagcactactccacccaacacttccgcccatttgcccagaatcggaccgataaagcgcccgactaatacgccagtcgtcgccatcaccgtagtggctgcaccaatggtcagcgcggtagtaatgatgttcacctgcaggaaagccagacccacaccaacagccagcgcatccaggctggtcgctaccgcggtggtcgccagtaccataaagccatggctttgcggggcttcacagggttctgcaacagcagtctgacggaagccttccatcatcatacggccacccagaaacgccagcaggatgaaggcaacccagtgatcccacgccatgatgtaacggctggcggccaggccaagcgcccagccaatcagcggcgtcagcgcttcaattgagccgaaaatcagaccggtacgcagcgcttctttaaaaccgggacgatgcaacgtggcacctttgcccagagcagcagcaaacgcgtccatcgacatgcccagcgcaagaattaaagtggcaataaaggtcatgatttattcacctggggcgaaaaagcggcaattcacgctgaattcaccacacaaagtgttcagttatgaaaaagtgggcgcagtctaccatgcaaacccaaagataaaaagacagtaaaatcagggatttaagtatagcaaaggctataactcttatcatccgctatgaatcgagctaagtcgatggtagcaaagcgttttctgaccattcctctggccatgtagcatgccggatgcgcacgaagcagcgcgccaccattgaaccgtgtcgccgtttaccggaaaatgccgggctgataaatatgggataccggttatgaataacccttttgaaacgttgatcgtgcctggtggcattttattgctgggctttctctcggcgctgctgctgcccgcgcccgcctttagcgtgacggtagcgcagcatctgttgcagatgttccatttgcaggacctgaatcagctttacacggtggtgttttgcgtctggtttttgctgctgggcgcactggagttttttgttatccgttttatctggcgtcgctggttcaggggctgaccgcctgcgcatcgaccagcgcctttagccgttcggcactgcgcgcataaccttcacgtggcagatgtgccgcccccagcaacaggcccgcaccgcgctgatccgcctgctgataccagatcgacagcggcgacggtgccatgccccactccaccgcctgctgcgcaatcacctgatccggtgaaccggcgggtaaacggacaatcaccgccagcccggcgcgttgcaggtcaggaaagtgaggatgcagcgccgcgatcatctgctccagccgctcatgatagacgcgcttcatgcgccgcagatgccgcataaagtggccatcccgcagaaattccgccaccgcgttgtgcagcaatccggaggaggcaggcgaaagcaacgcgcagacctcaccgaatcgggccatcagcgcgggtggcaccaccataaaaccgagacgcagttgcggcgtcagcgtcttgctgaacgtgccgatgtgcaacacccgcccctggctgtcgagcgcggccagtgccggcgcggcgcgattgccgggctgaagctctccgagatagtcatcttcgataatccagcgctgcgtgcggctggcccagttaagcagggcatgccggcgtgccaggctcatcgtcatgccaagcggcgcctgctgtcccggtgtgaccagcgcaaaagcggcatccggcgcgcgggcaatcccggcctcaacctgcaacccttcggcatcaaccggcacggcaaccggcgtgacgcgcagcgcttcaaccgcgcgacgcgccacccaaaatccgggatcttccagccatgctgttttaccctgaaaattcatcgccagcccaatcagtcccattgcgccagcatagccgctggtaataataatctggtccgcctgacagcgcaggccgcgtgccaccgccaggtaggccaccagcgcctgccgcaacgctaagctgccgcggggatcgggatagctggccggtctgctgacctgcatgcgcgtctgatgctgcagaatgcgcagccagactttggccgggaatgcatcgctggcaggaatgcccatctggaaggtcagcggtggcgcttcatactcctctgcaccctccagcagctggcgttcagcctcggcattgaccggttttaacggcggtaatgggctgacgaaggtacccgctgcgcctctggcctgcagaaactgaccatcaaccagcatgtcataactggcgcgaacggtgccacgcgccacgccgagctgagcggccagatcgcggcaagaaggcagacgtgcgccaggttgtaaacgtccttcaccaatcgcctgttcaataaactggcgcagttgttcactgaggccacgtgacgcgccgcgctgcagtgtcagcgtggaaagcggcgatggaccagtcagactctcattttttggcactttatctgctccattgaaaggctgaaaatcgccttatcaaccctgaatgaggcaataagatgagcgaacgtatcgattttcacagtgcagcaccggcaggcatgaaagcgctgggcggcgtatacagttatctggcacaaaccgatctgccgctcactttactggaactgctgttccttcgcatatcgcagattaatggctgtgcctactgcattgatttacataccaaagcactgaataaagcgggcatgggctgggataagatcgtgctgacctcggtctggcaggaatccggtacgctgttcagtgataaagagaaggctgccctgcactgggctgaatgcctgaccctgattgctcagcagggtgcgccagacggccgctataccgcactgaaagcgcacttcagtgaaaaagagattgtcgatctgaacatcgcgattggtctgatgaacacctacaaccgcatggcgataagtctgaaaaagttgcccgccagcgccagtcagtcataagtgaatccgatgcgtgcgccggtgtgcacgcattttcagactcacaaaaatgtaacattatttttacacaagcagcctttcagcctctcttcccccgattcccgttattccttactgcataataaatcgctaaatttcagcgaattaaataattccgcacggttcatatccattccgtcgttgcaccagcatggggcttttcagcaacatgccatttccgttaacccactgacttcacactaaaaaacccctaatacgccgctggccctgatgattaattcttatgctgaatcatttctgcatttaaaaaataaacaaatgtttaattcagatgcgagaatgttatattcagatgacaaagcataacgtgcagttaacgcgttattaccgctttaaccctatacctgagacttaacctttgagaaatagcgcaacgcgctcgtaagaagcgtgactatttcgcctgcaaaactgttgggcttcaggtcaacagaagaggagatgtcgcctcatgtgcaattcagctgtaaaccttgcgctcgcgatgagtgccatggcaaaggacaccactactaccgcgcaggagcgcaaagacgttgacgtgctgctgattggcgcaggtgtgatgagcgccaccctcggcgcgtggctgcaggatttagagccggactggtccatcgaaatggtggagcggctggatagcgtggccgaagagtcgtccaacggctggaataacgcgggcaccggtcatgcggcgctggcagagctgaactatacgcctcagcaggcggatggcagcatcgacatctctaaagcggtgacgatcaacgaatcgttccagatttcccgccagtttctgggcttatcaggtccagaaaggcaacctgcgcaaccctaaaagctttattcacagcacgccgcacatgagctttgtctggggtgacgacaatgtcgactttctgcgcaagcgctttaaggcgctgcagaaaagcaccctgttccgtggcatggcctactccgaagatccgcagcagattgcccgctggatcccgctggtgatgaatggccgtgaccgcagccagaaagtggccgcgacctggacggagatgggcaccgatgtgaacttcggtgaaataacccgtcagctgatcgcctcgctagagaagaaagcgaatttccagctgcgtctgcgccaggaagtgcgtgagctgaagcagctcgccgacggtcgctggcaggtgacgctgcagtgtctgaacagcggcacgcgtcgcacactgacggcgggtagaatatttatcggtgctggcggcgcagcgttaccgctgttgcagaaggctggcatcccggaagccaacggttacgctggtttcccggtgggcggttcattcctggtaacggaaaatccgcaggtcgtcgcgcagcacatggctaaggtctatggcaaagccagcgtcggtgcgccgccgatgtccgtgccgcacgtcgacacccgcgtgctggatggcaagcaggtgctgctgtttggcccgttcgccaccttctcgactaagttcctgaagcagggttcgctgatggatatgttcacctcactgaacagcagcaatatgctgccgatggtgaaagtggggctgaaaagttttgatctggtgaaatacctgatggatcaggtgctgcaaagcgatcgcgaccggatggacgccctgcgcgcctatgtgccgcaggcgaagcaggaggactggcgcttagtgactgccggtcagcgtgtgcagatcatcaagaaagatgagaaagagggcgccgtgttacgcctgggcaccgaagtggtcgcctcacaggatggctcgatttcagcactgctgggtgcatcgcctggcgcctctacggcggcaccgatcatgctggagctgctgcacaaggtctgtcctgagcagatggcttcgccggaatggcagaacaaaatccgtacggtgatcccatcctggggacgtaagctgaacggcgacgtagcgctgacagagaaagtgttagccgaaaccagccggattctgcagctcgactattcgccggttaccccgatggcagcaaacgatgaaggacgggaaaccgcgttcgtcgtcggcaaataattcagcgccattgataaaaaggctccgcactgcggggccttttttattggccggttacctggttgatccgggcattctctattagggttaaggcatcttttagctgcacgatcaggaggaaactgcatgtcttactcccctgcttcaccggaattcacgctgctcgaccgctactggcgggcagcaaactacctctccgtcggacaaatttacctgatggataacccgctgttgcgtgagccactcaggcctgaacacattaaaccgcgtctgctgggtcactggggcactacgccaggcctgaattttatctatgcccacctcaaccgcgttatccggaagcaaaacctggatatgatctacatctgcggaccaggacatggcggccccggcatggtggcgaatacctggcttgagggcagctacagcgagatttatccgcacatcacgcaggatgcggcgggcatgcagcgtctgttcaaacagttctcctttccggggggcattcccagtcacgcggcaccggaaacgcctggctcgattaatgaaggcggtgaactgggctattcgctctcccatgcgtttggcgcggccttcgataatcccgaactggttgtaccctgcgtgattggcgacggcgaagcggagaccggtccactggcctccagctggcacggcattaaattcctgaatcctgaacgtgacggcgcggtcctgccgattctgcatctcaatggctacaaaatcgccaacccgacgctgctgggtcgcagcagcgatgaagatttgcaccagttgttcagtggctacggctatgagccgctgttcgtctgcgggcatgagcctgaaaaaatgcatccgctgatggcggaggcgctggatagtgccttcagtaaaatcgccgcttatcagcgcgaggcgcgccagggtaaagccaccaccggggtgccgcgctggccaatgattatcctgcgcagccccaaaggctggaccggccccaaaacggtcgacggcaagaaagtggaagatttctggcgggcgcatcaggtgccggtcgcggcctgtcgtgaagatgaaggacatcgccagatccttgagacgtggatgcggagttatcagccagacgacctgtttgatgaacagggtcgcttaaagccggaactgcaggcgctggcaccggaaggtgataaacgcatgggatcttcgccttatgccaatggcggcctgttgcgccgtgagctggatgcgcctgaactcacggagtttgcctgcgatgtcagcgagccaggcgcccagatggcgcaggccactgagcatctgggccgctatctcagcgtgctgttccagcgcaaccgcgataatttccgcctgtttggcccggatgaaaccgcctctaaccgcctgacgccggtcttcgacgtgaccagccgtacctggctggaacgaacagagccttacgatgagcagctggcgcgtgatggccgggtgatggaaattctcagtgagcatcagtgtcagggctggcttgagggctatctgctgaccggccgccacgggctgtttaactgttatgaagcttttatccacatcgtcgattcgatgtttaaccagcacgccaagtggctgaaagtctcgcgtaaactgggctggcgtaagccgatctcgtcgctgaactatctgctctcttcgcacgtctggcgacaggatcacaatggctacagccatcaggatcctggctttatcgatcacgttgccaataaaaaagcggacattgtgcgcatctatctgccgcccgatgccaatacgctgctgtgggttggcgatcactgcctgcgcacctgggaccgcatcaatgtgattgtggcgggcaagcagcctgcgccgcagtggctggatatggcgagtgcggtgacccattgtgaagcgggcatgggcgagtggcgctgggcgggcaccaccccagagcatgaggagccggatgtggtgatggcctgtgccggtgatgtgccgaccatggagacgatggcggcggtggatctgctgcgcggtatgctgcccgaactgcgtatccgcgtggtgaacgtggtcgatctgctggcgctgcagccgcaggatcagcatccgcatggcaaatctgatgcggaattcgacgtgctgtttactcaggataaaccggtgatcttcgccttccacggttatccgacgctgatacatcgcctgacctattcgcgtaccaactaccgcaacttccatgtgcgcggcttcaatgaagagggaaccaccaccacgccatttgatatgacggtgctgaacgagcttgaccgctatcatctggcgcaggaggcgattctgcgcgtgccgggcctggccgatgcgcatcctgagctgctggacgatctgcaggagcgcatcgctgagcatcatcgctatgtgcgtgaacacggtgaagatgtgccggaggtgcagaactggaaatggccgtcggccacagcacctggtgcacccgattaagcggccagcaaggcgtcggtcagcatccagatggtagtcgccaccagcgacagcgccatcaggctgttgaataactgacgcttccaggcaatctgcagatggctgcgcaggcgatcgcccagcgcagcccagatcagaatgcagggcaggttgagcagcataaagccgatcatcaccgtcagcacgccgctgctggcgctgtacaacagcgccacattggtcgccatcagccaggctttgggattgatcgcctggaaacaggctccgcccagcagcgtcatgggctgcggcttgctgcgcacttcaggtgctgccgcacggaaaatcttccacgagagccacaacagataggcacagcctgccagcgtcagcggcaggcgaatcgccgccatccagtgcagtaagacctccagtgcgacgccggcgatcaccgtttgcagcgcacaacctaccagtatgccaaacaccatcggcagcgtgcggcgcatgccgaaattgacacctgaggtcgccagcagcagattgttcgggcctggcgtaatcgacatgacggtaacgtaactgaagaaagagggatcgagcatggtgactctcctgaaaacagacagagttctatgctacggcggcaaaagggatggtaacagtgacacaaaatcactattgttatggttacagttcccgttaacagcaattgtacccatccaatccggaggctactgtgtcccttgctcccacttccgatcggcctctctatcagcagctggcagacagcttcgctgaggctatccatcagggcacgctgaaacccggcaaacgcctgccggcgatccgccgcgtcgcccagtcacatcaggtcagcgtcaatacggtactgaatgcctggcagttgctggaagatcgcgggctgattgaggcgcgtccccagtcgggctattacgtgcgcggcgtgttgcccgccgtgacccgccatggtcagcataaaacccgggtacgcgaccccagcagcagcaagctcgacctgatcgataaggtatttgcggcgcagaaccatcccgactacatcaatatttccctggcctgcccccaggatagcgagctgtttcctgcggcgcgtattgcccggattaccacctcactgctgcgccgtcatccgaacatgattgggcgctatgcgcttccgcccggtagtgagcgcttacgggaggagattgcgcgacgggcgctgcacgccggacagacgctcaccgccgatgagatcactcttactcacggctgcatggaggcgcttcagctggcgctgcgggcggtcacgcagcccggcgactgcgtcggactggagtcgccgacctactttttcctcttcccgctgctggcttcactgggccttaaggcgctggaaatccccaccgatccgcagcatgggctgtcgctggatgcgctggagatgctgcttcaggagcagcgaattaaggcgctgattgcgatgccgagcgcgcagaacccgctgggctgcggcatgtcgctggagaacaagaagcggctggcgaagttagtgaatacttaccacgttccgctgatagaagatgggctgtatgacgagttacagttcgactggccgctctcgcccgcggtaaaagcctttgatcgcgacggctgggtgatctactgcaccagcttcaccaaaaccgtggcgcccgatttccgtattggctggaccgccgctggccgttttcatgatgcgattgcccgactgaaagcggtgtcgtcgatggcagaatctgccctgctctctgaaacgctggcggagtttcttgcttccggtggttatgaccaccatctgcgcacgctgcgccgtcgctacgcggccaacctggatgaggcgcgggggctgatcgcccgctacttcccggagggcacccgcgcgacgctgccgcgcggtggcttcgtcttctgggtcgagttaccgggcagcgtaaataccaccgagatgtttgatcggctgctgcaggagcagatttgcgtcacgcccggcgcgctctattcgctgagcgagcgctacaaccatgcactgcgcctctcctgctgctatccgtttgatgcgcgctacagctgggcgatcagacgcgcgggcgaaatcgcctgtgaactggcgggagtatcctgcggcgaggctcagggtgtgccgttgcgaccccagacggtatagccgtggcgttcagtcaggcgttcgtaataggtgcgtaccgccggataatcagggtgttcgagcggcgtttcaaaccagcggttcaccgccagaccaatcggaatgtctgccagcgtgaaattacgtccggcaacgtagcgaccggttttttccagctgctgattgagaatgctcatggtgtgtgcccagcctttgctggccgcggccagcagacgtggatcctgatgagccggtgaatttcgcaccagcgacataaatgcgtagcgccatgaggtgttgagttcagtggactgccagtccatccactgatcgacaggcgcacgcgtttgcggatgatgaggatagagccactcgccgccataggcattcgccagatagcgcaggatggcgttggattcccacatcacaaagtcatcatctttcagtaccggcaccatcgcattggggttgagtgccataaattcgggcaggtgcgttgagcggaatccatcgccccactcttcgcgctggtaatcaaggtcaagctcgtcacacagccataatactttgcgcacgttgattgaggaggcgcgtcccaggatcgttagcattcacagtctccggtaaaatctttaacttattgataacgctgttagctgttataagcaatcatccggcagagaaaaggccgcactgaacccaatcgcaaggagtcaccatgaaagtcgcgtttaagcaagtcgatgtgtttacctcagcagcctttaatggcaatccgctggcggtgattatggatgctcaggggttgagcgacagccagctggcggcgattgcccgctggactaacctgtcggaaaccacctttgtgctgccgccacaacatgaagaggcggactaccgggtgcgtatttttaccgtggaaggcgaactgccgtttgccggtcatccgacgctgggcaccgcacacgcgctgctggaggcgggctggccaacccgtacgccgggtgaaatcgtgcaggagtgcggcgtcggtaacgtgacggtgaagattaatgagacgggcggactggcctttgccgcgccagctgccaccctgatgccatggcaggatgcgctgatgggtaacgccttaaacagcgatgcattcgatctgacgcaaagcccgaccgtggtggatatgggtatccgctggctgctggtgccgatggtcagcgccgaggccgtgctggcgctgcagcccaatgtcagcgatttgcagcgcctgattaaacatgcgggtgtctcgggcgtgatgccctttggccgtttgccctcgggcgagcatgaacagtatgaagtgcgtggcctgctggtggaaaatggcagcctgaccgaagatccggtgaccggcagcgccaacgcctgtctggcgcggtattttgcagccgcaggccataccacctcctatcgcgtgcgtcagggtactgctctgcagcgtgccggtcgggtgaacgtaacctttaatggtgagaccatctggattggcggtaataccgttaccgtcattgatggcaccattacgctgtaaaaggcggcgacgtcgcggggtgctttccgcgacgccaccagcggttaaatcccctgcccgcctgaggcttcaatacgctgagcggtgatccagccggtttcgtcactgaggatcgcgctgatggcgtcgccgatatcatccggcagtccgacccggcccagcgccgtcagcccagcaatctgatggttaatctcgggggtatcgcgcacccggccaccgccaaagtcagtctctatcgcgccaggtgccaggatattaacgcgaatgcgccgtttcgcccagctccttcgcctgatagcgcgtcagtacctccatcgcccctttcattgacgcataggtcgaggagccaggatagatcagccgggtcagaccgctggagatattcaggatgcggccgccgtcgttgatcagcggcagcagcttctgggtcaggaagtaaggccctttgaaatgcacattaaccagcgcatcaaattccgcctcggtggtgtcggtaaatggcttgtagtgtccgtgtccggcgttgttcactaaatagtcaaagcgctcacgctgccattgctgttgcaatgcctctttcacctgcccgacaaagcgatcgaactgaccggtttcgccgacgtccagcgccagcgccactgcacgtcgtcccagcgcctcgatctccttcaccaccgtctgtgcctcatcggcatggctgcggtaagtcaggataatgtctgtccccctggctgccagttttaacgcgccattacggcctaaaccgcggtttgcaccggtaattaacgccactttctgattcatctctcgcacctgttgaaaaattgaacacaggttaaggatattcgcgaattattgatctataaacagtgttaaatgcgcatcactgtttcaataaaaacaacaatcggtgaacaacatggacaaaattcacgcaatgcaggtgtttgtgcgggtggccgaaatgggcagttttactcgcgcggcagagagtttaggtgtccccaaaggcagcgtttcgcggcagatacaggcgctggagaatcaaatggcaacacgtttgctgcatcgcaccacgcgccgggtgcaactaacccaggacgggttggtctattacgatcgctgtctggatttattgtcgatgattgacgatatggacagcctgttccagcacgagcctgcctcgctcagcggtaaactccggattgatatgtctgtggccatggccaccagttttatcctgccacggctgccggaatttttgcagcactaccccggcgtagagattgagctgagcagcagcgaccgtcaggtagatgtgatccgggaagggtttgactgcgtaatccgcgtcggtgagctcaaagattctggcctgattgcgcgaaaaattggtacccataccttgatcaactgcgccagccctggctacctttcgcgtttcggcatgccgatccggctggaagagctgtcgcagcatgcgatggtgcattacagccagcaactgggtcaggcctcaccgggttttgaatattttgatggcaggcagtgtcactatgttcacaccggcggtgtggtcaccgtgaacagcaccgaaacctatcgcgccgcctgtctggcggggttaggcattattcaggtgccagccgccggaattcagacattactggaaagaggcgagctggtagaagtgctgcatcgctttcccgccagaccgatgccgatccacctgctctatccgcaccggcgcaatgtggcacgtcgcgtgcgggtttttatggagtggctgagtcaggtgttacaggagtacgtcacctgagcggctatactttgattttaatgataaacaggacagtgaaggtctatgacagacaagcaggaaaacccgcaggatacgcagccgcaaaagccgcttatcgatattaaaaccggcaacgagacggttgatcattcgatagtgcgcgtgtcgcgttttgccgcctggtttcaggcgatcccggcagtggcgcattttattcgcgcccttgaccgctttaacgatcggctcggcagccagtttggcgcggccattacctatttctcttttttatcgctgatccccattctgatggtgtcgtttgccgccgtgggttttgtgctggcatcgaaccaggatctgctgaccgatatcatcaacaaaatcgtcagcagcatcagcgacccgacgctggctaccacgctgaagaatacggtaaataccgccattcagcagcgtgccaccgtgggtattaccggtttactgctggcgctctactccggtcttaactggatgggtaacctgcgcgaagcgattcgtgcccagtcgcgcgacgtgtgggaaacgcaaaccggatgacaaagagaagatctggaagcgttatattcgcgatttcctgtcgctgaccggtctgatgctggcgctggtgattacgctgtcgctgacctcggtagccggttcggcgcaggcaatgatcgtcagcgcactggggctggacggtatcgactggttacggcccgccctgaccattatcgccacctcgatttccgttatggctaactatctgctgttcctgtggattttctggatcctgccgcgtcataagccgcgtaagaaagcactgttccgcggcacgctgctggcggcaatcggttttgaggtgatcaagtttgtgatgacgctgacgctgccgaagctggcgacctcgccttctggtgcggcctttggttccgtgcttggcctgatggcgtttttctacttcttcgcccgtctgacgctgttctgtgcggcgtggatcgccaccgccaaatataaagacgacccacaaatgcctgaagcgggcagcgcgtcacgacacaaatcatcgtaatccgttaacaacagcggaaaatattacccctcggctattttttaaccagataacaggatgaatagctgaggggtcacttttatttagccctttcgtagagtatcccgccagatatcgtccggattaccccggtatcacccgacattcgtcgcacctcagaaattatcctctttttgcccgctgaagccagacgcggcgcgggttttcttcattgaatgcgctctggcagatgcgtaagattctttgtctgtatttacaaataagaaacagttatgcaagcctccctcacagacacgctcgacaaacagcaggatcccacgccggttaactcacgcagtaaagtggtgattgcctcgctggtcggaacggccatcgagttcttcgacttttatatttatgccactgctgcagtgattgttttcccgcacattttcttcccgcagggtgatgccacggtcgcgacgctacagtcgctggccacctttgctatcgcctttatcgcgcgtccgattggctccgccgtgtttggtcactttggcgatcgcgtgggtcgcaaagccacgctggttgcctcgctgctgaccatggggatctctaccgtggtgattggtctgctgccgggctatgaaaccatcggcgtgatggctccgctgctgctggcgctggcgcgttttggtcagggactgggactgggtggtgaatggggtggcgcagcgctgctggcgacggaaaatgccccggcgaagaagcgtgcgctttacggctccttccctcagctgggtgcgccgattggctttttcttcgctaacggcacttttctgctgctttcgtggctgctgaccgacgagcagtttatgcagtggggctggcgcgtgccgtttattctctctgccgtgctggtgctgattggcctgtatgtgcgcgtttcgctgcatgagagtccggtgtttgccaaagtacagaaagagaagaagcaggttcgggtgcccattgcggcactgctgagcaagcatctgaccgccaccattctcggcacctttatcatgctggcgacctatacgctgttctatatcatgaccgtctattcgatgagctacggcaccacggcagcaccggccggtctgggtattccgcgtaatagtatgttgtggatgctgatgctggcggtgattggctttggagtgatggtgccgattgccggtttgctggctgaccgttttggtcgccgcaagacgatgattaccattacgctgatgattatcgcgttttcgttcctgtttcccggcgatgctcggttccggatcgcaggcgctggtgatggcgtttctgttgctgggtctgagcattatgggcctgacctttggtccgatgggcgccctgctgccggagctgtttccgaccgaagtgcgttataccggcgcatcgttctcttataacctctcatcgattctgggtgcctctgttgcgccttatatcgcgacctggctgaatgcgcattatggtttgcaggcggtgggactttatctggcgtcgatggccgtgctgacgctgattgcattgctcgcttgtaaagagacgcgtaatcagacgctgtatgacgtttaatccggctggatgaaggtcagtgaaaacccggctgctgccgggtttttttatggagcaggctcacagagtacaaccgctctgaagggttaaacaatatcaggcgacaggctcagggagcatacgccttaagcgggttagctttctgtttgaaaaaaccggacctcgctgaaaggcgtattgatattggcagcaataaagaagcttaagggcacagggaatacggtcagaagaggaaagcgtcccgcgccagggacaaaaacgccgggagcgtttttgaacaacgcaaagcgttggcccggaaacgggcgcacctcagggatgaggtgcgtaatcgcgcgggccgagcatgccatggatggcggttttgcgtctttccgatctgaccgtattccatgtgcctgcactgtctcacagcagtgcaggcactaacttacaatcggccttgcctggtatggttcatcaacaaaaaaccccggcaagccggggtttgttttgctgaaaactgtgatgacggtaattagcccgcgacagcgatacgcttcatgtcggtcatgtagccacgcagcttacggccaacggtttcaatcggatgctggcgaaccgcttcgttaacgtcacgcagctgcgcgttatcaacctgcgtgccttctaccgctttacccagatcgcctggctgcagcgtggtcatgaactctttcagcagcggcaccgcggcgaaggagaacaggtagttaccatattcggcggtatcggagatcaccacgttcatttcatacaggcgcttacgggcgatggtgttcgcgatcagcggcagctcatgcagtgattcgtagtaagcagactcttcaatgatgccggcgtctaccatggtttcaaacgccagctcaacgcccgctttaaccatcgcaaccatcaccacacctttgtcgtagtactcctgctcttcgattttgccttcatactgtgaagcggtttcgaacgcggtctggccggtctcttcacgccaggtcagcaggtttttatcatcgttggcccagtccgccatcatgccggaagagaattcgccggagatgatgtcatccatgtgtttctggaacagcggtgccatgatggttttcagctgctctgacagcgcataagcgcgcagtttagccgggttagagaggcgatccatcatcagtgtgatgccgccaaacttcagtgattcggtgatggtttcccagccgaactggatcagtttttctgcgtaagccgggtcagtgccttcagccaccagcttgtcgaagcagagcagtgaaccagcctgcaacatgccgcacaggatggtctgctcacccatcaggtcagatttcacttcagcaacgaaagaggactccagcacgccagcacgatcgccgccagttgctgctgcccaggctttggcaatcgccatgccttcgccttttggatcgttttccgggtgaaccgcgatcagcgtcggtacaccaaagccacgtttgtactcttcacgaaacttctgtacccggacacttcggtgccaccatgaccacggtgatatctttacggatgctttcgcccacttcaacgatgttgaaaccgtgcgagtagcccagcgcagcgccatctttcatcagcggctgaacagcctgaactacagcggagtgctgcttgtctggcgtcaggttaaccaccagatcagcctgcgggatcagttcttcgtaggtgcccactttgaaaccgttatcggtcgctttgcgccatgaagggcgtttttccgcaattgcttcagcacgcagtgcataggccacatccagaccggaatcacgcatgttcagaccctgattcaggccctgcgcaccacagccaacgataacgacttttttgcctttcaggaaactggcaccatccgcgaattcatcgcgtgccatgaaacggcacttgcctaattgcgccagctggttgcgcaggttcaatgtgttgaaatagttagccatgggtactccggtaaggttgtatttgctttttttgttcaggaacggcgtgtcatgcagcgccgcgaatgaccccatcatatgacaggaattctgttgcttaaattgatatattaacaacgtcacattgcaataaatgcaacaccacccagaggcgacgcgcacatggatttacgggatctgaaactgtttcttcatctggcagaaagctgccacttcgggcgcactgcgcgtgctatgcacgtcagcccttccacgctgtcacgccagatccagcggcttgaagaagatgtcggccatgcgctgtttctgcgcgataaccgcaccgtgacgctgacagaagcgggcgaaacgcctgcgccagtttgcccagcagacgctgttgcagtatcagcaactgcgccatgtgatggatcttaacggtccctcgctcagcggcgagctgcgcctgttctgctcagtgacggcggcctacagtcatctgccgcccatcctcgaccgctttcgcgctgaacatccgcaggtcgaaatcaaactggataccggcgatgccgcggatgcggtggaaaaagtgcactccggcgatgccgatctggccattgccggccgtcctgaaacgctgcccgccagcattgattttatgccactggggctgatcccgctggtgctgatcgcgcctgcactgccctgtgccgttcgtactcaggcaacacagtcgcagcccgactggtcaaaaattccgtttatcctgccggtacagggaccggcacggcgacgtatcgatctctggttccgccgccagcgcatcccgaatccggtgatttacgccacggtctcggggcatgaggcgattgtttcgatggtggcgctgggctgcggtattgcacttttaccggatgtggtgctggaaaacagcccggatccggtgcgtaaccgcgtgctgctactggagaatattgactcggttgcgccgttcgaactcggcatctgcgtgcaaaaaaagcggctcggagagccgctgatcagtgctttctggagccagctgtaatcagctgcctgacaggaagaagcggaacgccgggttctggctttcgtcatgaaagtcgtaacccagatcggtgagatgctcttcgaagcgtggctcatcgctgccaagttcaaaagcggccagcacacggccataatcggtgccgtggctgcgataatgaaacagcgagatattccagtgggtgcccagcgtttgcaggaacttcagcaacgcgccgggtgcctccgggaattcaaagctgaagaggcgttcacgcagtggtttagaagggcgtccgcccaccatgtaacgcacgtgcagtttcgccatctcatcatccgagagatcgaccacctgataaccgccgctggtgagctcgctgatgatctcgctgcgctcttccacgccgcgcgtcagtcgtacgccaacaaagatgcaggctttgtccgcatcggcgtagcggtagttgaactcggtaatcgaccgtccacccagcgtctggcagaaacgcaggaaactgccctgctgttccgggatcgttacggccagcagcgcttcacgctgttcgcccagctcgcagcgctcagaaacgtagcgcaggccgtggaaattgacgttggccccggataacacatgcgccagccgctcgcctttgatcccatgctgctggatatactttttcatgcccgccaacgccagcgcgccagagggctccgccacagcacggacatcttcaaacagatctttcattgcggcacaaatggcatcgctgtcgacggtgatgatgtcatcgatgtattcctgacagagccggaaggtttcggtgccaatccgtttcaccgccaccccttcggcaaacagcccgacgcgcggcagatcgaccggatgccccgcctccagcgctgctttcaggcaggctgaatcttctgactccaccgcaatcactttgatttgcggcatcagctgcttgatcagcaccgcgacgccggctgccagacctccaccgccaaccgggacaaagacccggtcgagatgcgcatcctgttgcagcagctccatcgccagcgtgccctgtccggcaatgacggccggatggtcaaacggcggtacgaaggtgtaaccgcgctgttcagagagttctatcgctttggctttcgcctcgtcaaagttggccccgaacaggaaagcctcaccgccaaatgcgcgcaccgcatcaaccttgatgtctgccgtcgccagcggcatcacaatcagtgacttgatgcccagcttagtggcggagagcgccacgccctgcgcatggttaccggctgacgccgtcaccacgccgcgcgctttctgctcttcgttcagaccggcaatcatcgcgtaggcaccgcgcaccttgaaactgtgcaccggctgacgatcttcccgcttcaccagaatggtgttgccgagacgcgatgagattttttccataacctgcagcggcgtcacctgtgccacttcatacaccggtgaacgcaacactgcgcgcaaatactcggcgccacaaggcgcctcgggtagcggttgagactcggccattgttagcctcccagcttgctcttatcgcggacggcgcctttgtcagcactggtcgcgagtaatgcgtaggcacgcagcgcaaaggagacttcacgctgacgattgaccggcgtatacgccgcatcgccacgtgcctgctgctcttcacgacgggcgtgcagttcgttatccggtacggcgagtttgataccgcggttagggatatcgatttcgatggtgtcgccatctttgaccagcgcaatggtgccgccgttggctgcttcaggcgaggcgtgaccgatagagaggcctgacgtaccgccagagaaacgaccatcggtgatcagcgcgcagcttttgcccagccccatcgatttcagataagtggtcggatagagcatctcctgcatgcctggcccgccttttggaccttcgtagcgaatgacgaccacatcgcccgcaacgactttgccgcccagaatcgcttcaacggcgtcatcctggctttcatagactttggccggaccggtgaaggtcaggatctctttgtctacgcccgcagtttttacgatacagccatcttccgcgatgttgccgtagagcacggccagaccgccatcctgcgagtaagcattttcatgggtacggatacagccttcggcacggtcatcatccagcgtgtcccagcggcagtttctgtgagaacgcctgggtggtacgaatacccgccggacccgcgcggaacatatcttttaccgcctgatctttggtcagcatgatgtcgtactgatccagcgtttcacgcatggtctgctgcagaatattacgggcgctgctgtcgaacaggccggcacgatccagctcgccgagaatggcgaacacgccacccgcgcgatgcacatcttccatgtggtatttcggggtacttggcgccactttacagagctgaggcactttgcgtgacaggcgatcgatgtcggagatattaaagtcgatatcgccttcctgtgcggctgccagcaggtggagcacggtgttggtggagccacccatggcgatatccagcatcatggcgttctcaaaagcggccttgttcgcgatgttacgcggcagcatgttgacatcatcctgctcgtaatagcgcttggtcaggcttacgatgcgcttaccggcattgatgaacagctctttgcgatcggcgtgcgtagccagcagtgaaccgttaccaggctgcgacagaccgagtgcttcagtcaggcagttcatcgagttggcggtgaacataccggagcaggagccgcaggtcggacaggcagagcgttcgatctgctcactgtcggcatcgctgacgttcgggttggcaccctgaatcatcgcatctaccagatccagcttgatgatctggtcagaaagcttggttttacccgcttccatcggtccgcctgaaacgaagatcaccggaatattgaggcgcaatgacgccatcagcatacccggggtgattttgtcgcagttagagatgcagaccatggcgtcagcacagtgggcgttgaccatgtactcgaccgagtcagcaatcagctcacgcgacggcagtgaatacagcatgccgccatgacccatggcaataccgtcatccaccgcaatggtgttgaactctttagccacaccgcctgccgcttcgatctgctcggcgacaagtttaccaagatcacgcaggtgaacgtggcccggcacaaattgggtgaatgagttaaccacagcgataatcggcttgccgaaatcgtcgtcggtcattcctgtcgcgcgccataaggcacgggcacccgccatattgcggccgtgggtggtggtggcggaacggtacttaggcatactctatttactccagtaagaataagctcgcggacgtcagatgacgcccgcgctgtatctgattatgggttaaccggatctaaccagccccatttgtcttcggtttcgccggtgaacaggccaaagaatgcctcctggatgcgtttggtcaccgggccacgtttgccttcgccaacctgaatgcggtcaacgctgcgcaccggtgtaatttctgccgcggtgccagacataaagacttcgtcagccagatagagagattcacgcgacagggtctgctcacgcacttcaatgcccatatcacgcgccagcgtgatgatggcatcgcgggtgatgcccggcagtgctgaagaggtaaatggcggggtaaagagcacgccatctttaacttcaaacaggttttcgcctgcaccttctgagatcaggccattagtatccagcgcaatcccttcctgatagccgtgacgacgggcttcgctgcccaccagcagtgaggagaggtagttaccgcccgctttagcggcggttggcagggtgttcggtgctacgcggttccatgaggagaccatggcgtcgatgccgtttctccagggcttcagcgcccaggtatgcgccccacgggaacgccgcaatgatcacatcggtggtgaagccatctggcgggttcacgcccaggcccacatcgccgacaaaggccagcggacggatataagcacttttcagtttgttcacgcggatgacttcgcggcacgcttccatcagctcatcaacgctgcttttaatcgggaagcgatagattttggcggagtcgtgcagacgttgcatgtgttcgcgatggcggaacacaaccggtcctttgtgagagtcgtagcagcgcacgccttcaaataccgacgtaccgtagtgcaacgcgtgggacatgacgctgaccttcgcctcttcccacttaaccatctcgccattgaaccaaataaagtctgctttcttcgtgctcattgttattccctctcgcggctatgcgcggatttgttgtgttgtctgttgttgaatctgaacgcatgcaacgtcgatcaatttgcttaactgcgaagacagtaaatcgacggaacgctgactggcaacggtcatttcaatattaatgttttctgcgttggcgactgaggccatgttcatagaacagacctgaaaaccgcggtgacgcactacgcgtaaaatgcgctccaatatttcagggcggaaacgggcttcgatagacaattgatgctggttcatacagttttctccatcatgtttgcattgctggcacccggcggtaccagtggccagacgttttcatgctcatcaattgcaacatgcaggaagtaaggaccttcgctgttcagcagagcatcaagggcggcgtcgacctgatctttacgggtaatgcgctggccgggaatattgaaagcgctggccagcgtgaggaagtcggggttgtcggacagattggtttcactgtagcggccatcgaaaaacagctgctgccactgacgcaccatgcccagacgctggttatccagcagtacgattttgaccggcagcttgccgcgcttgatagtgcccagctcctggatgttcatcatgatggagccatcgcccgagacacagataaccgtatcttccgggcgtgcaacctgcgcaccgatggcggcgggtaaaccaaagcccatggtgcctaagccgctggaggtgatgaagttctctggcgcgctgaatgccatgtgttgcgccgtccacatctggtgctgaccgacgtcggtggtcactacggtattggctggtttgcgatcggaaagctgcttcagcaacagcggtgcatagatcgcttcgcccggatggtcgtagcgccatgggtgactggccttaagcactttcatctcatcgcgccaggcgttgatatgcagaggctgactcagggcgggcagcagtttcgttgagatcaccctgcagagagacgtgtgcacgacgtaatttgtttaactcagcgggatcgatatcgagatgaatcacgctggcatggggggcaaaggtgtccagcttgccggtcacgcggtcatcgaaacgggcaccgaccgcaatcagtaagtcacaactctgcaccgccaggttggcggctttagtaccgtgcatccccagcatgccgagatacacctcgctgtgggggtctacgctgcccagcccctttaaggtggccactgccgggatgccggtctcttctgccagcgcgcgcagtgccggaacagcctgtgccaggccaacgcctccaccaacatagagcattggttttctggcctgcgccatcagtgcgcgtgcttcctgaatcgcctgatgcggcagcgcgcttccctcttctaccggaaccagatgcggggcaggttctccctgcgcaatctgaatatctttaggaatgtccaccagtaccggacccggacggcccgactgcgccagcgcaaaggcttctgccatgatggcaggcagctcatctaacgattcgaccaggaagctgtgtttggtgcaggccagcgataagcccagcacgtcgatttcctgaaaggcgtcggtgccgatgaaggccgaggtgacctgaccggttactgccacgaccggaaccgaatccatcatggcatctgccaggccggtaatcaggtttgtcgcgccagggccagaggtggcgatacagacgccggttttgccggttgagcgcgcataaccgatcgccgccatcacagcgccctgctcgtgacgacacagtaggtgttccacgccgccgtcgtagagcgcgtcgtataccggcatgattgcgccgccagggtaaccgaatacggtatcaacaccctgcgcgcgtaaagcctgaactacccactgtgcacctgtcatcgctattctcctgtgtcctgaccggaacaacagaattttatgctactgttcattgtttgttccttgtggatttactgatatttcctctggtcgaaaaaaaacccccggacctttcggtgcgggggttttttcggattcgaggcttgatttctaagcctttctttctccaagcgttgccccgcacggtaggttaataaccaccaccacgctaatcacgaccaggctaatcacttgtagaagggctttcatgtgttgttcaattctttcgcttgttcgaagtaatgcctacagagttatcatagtcagggggcatgacacaactttttttacagagtttttttagcaccaggcgctaaatcgcggtctatcaatttgtaatacaagaaataattacataatgataattattcatcactttactgacgtaataatgttttggtgaatttgcgcgcatacacgcagcgttttaacaggtcgtgaaaaaacttctgataggttgtgcaatgacccgaatagtgctgatgatgccctggctttcctttgatgctgtcaccagactgacggtaacaaggagcgagtatgtcattgtcaaaagttctgacccgggcagcgctgggagtggaagccccgctggtgaccatcgaggcacacatcagtaacggactgcctgcgttaacgctggtggggctgcctgaaaccacggtgaaagaggcgcgtgagcgggtacgcagcgccattatcaacagcggttttgccttcccggcaaaacgcgtcaccatcaatctggcacccgcagatttacccaaagagggcgggcggtatgacttacccatggcgattgccattctggtcgcctctgagcagcttcctgccgacaaactgacacactatgagtttctgggtgagctggcactcgacggcgcactgtgcggtgtacagggcgcgattccagcggccatggtagccattcaggctggacgacagctggtcctctccaccgagaatcagtgtgatgccgggctaatccgtcagggctcgtcgctggttgcctctcacctcagcgaagtgtgcgcctttctgcgcaatgaactcacattaccgacagcccaatatcctgagcatcagggcgatgcacctgctgacgatctcgctgatatcattggtcaggaaacagggacgcagagcactggagatcactgcggctggcgggcacaacctgttgctgatcgggccccctggcaccggtaaaaccatgctcgctacccggttgcccggcatcatgccctctttaagcgatcaggaagcactggagtgcgcggcaatcgccagcctggtgaacagcaataccctgcatcgacagtggcgcacccggcctttcagatcacctcaccacagcgcctctctctatgctctgattggcggcggctcactgccacggcccggtgagatctccctggcgcataacggcgtgctgtttctggatgaattaccggaatttgatcgcaaggtgctggactccctgcgcgaaccattagagtcgggcgtcattgctatttcacgcgcccgggcgaaagttacctatccggcacggtttcagctgattgctgcgatgaatccaagtccaaccggacactatcagggacagcataaccgctgctcaccgcagcaggtgctgcgttatctcagtaagctatccggcccttttcttgatcgttttgatctttcgctggaggtgccgctacttcccagcggcatgctcagcggtcagcgcgccagggcggaagcatctgagcaggttcgtcatcgtgtggtcgcagcgcgtgacattcagttggctcgtgcaggaaaaataaatgcgcatttaaacaatgcagagattatgcgctggtgtcagccggctaaagaggatgcggagtggctggagtcagtgctggagaagctgggtttatctgtacgggcatggcagcggattttaaaagtggcccgcaccctggccgatctggctggggaaacagacatcacccggcatcatctgcaggaagctgtcagctatcgcacgatagatcgattaatgatccatctgcataacagcctgcaataaaaaaggggctttcgccccttctctgttaatcgtcgctgtcggtgaagtcttcaacggtgtccatctgcggtttaccgccagacagcgtatgaaaacgtttaggacgcttaatgcgggtcatatacttagaccatacacgttcagcttccgtttgcggctcacgcacgccacgacacacttcaataaacaaacgttcttcttcggttgcaggctcacgctttgataaatccagctcattaaaggcaaaaccgtggcgttcaagaagctgagcttctttaatagtaaagtcaccgtggcgtgagaaaccacgcgggtaatgtttgttatcaaagaaacgattctctgttgagaagctttccgccatgttacacgctcctgattttctaatgccgtgctgttaatggcgcggagtattagataggcttgacagagtgtaaaacaaaacatttaaatctatacgacaaacattttttgggagaacgctgtggatacggaattactgaaaactttcctggaagtgagcagaactcgccatttcgggcgtgctgcagaagcactttacctcacgcaatctgctgtcagttttcgcatccgtcagttagagaatcagcttggcgttaacctttttacacggcatcgcaataacatacgtctgacggcggccggagagcgactgctcccctatgctgaaagcctgatgagcacctggatgatggcgaagaaggaggtctctcacactcagcagcaccatgagctttcaataggtgccagtgcatcactatgggaggcttatctgacgccatggctacagacgctctacgagaatcgggagagcctgcacttagaagcgcgcgtggcacaacgacatctgctggttaagcaactccatgagcgccagctggatctgttgattaccactgaagcacctaagatggatgagttaaccagtcagcagattggtcatatttcactggcgcttttctgcgcccggcagagcgagaagcgtgaaaaatatgattatattaagctggaatggggagcagattttcatcagcatcagagctatctctccggggctgatgatgtaccggtactgaccaccacgtcggcacatgtcacccgtgaaactgctgcataccaccggagcgtgcgcatttctgccggacttctggcagagtgtgtacagtgagttgatggtgattccggatacgcccgtcgccgtgcgtccgctctatgctgtctggttgcagaacagcgatcagcaggcacatatccgtcagttgcttaaattcccgattctggtcaggcaaaatagctgaatttgcaggcaggacagtaggcagggaagatcagaggccagttagatttagctggtttttcttttttgctttttaaaggcaaaaaaaaatcctttgccgaagcaaaggatcgttttctggcaggggcggagggactcgaacccccaacacccggttttggagaccggtgctctaccaattgaactacgcccctaatagggtggcggaacggacggggctcgaacccgcgaccccctgcgtgacaggcaggtattctaaccaactgaactaccgctccaccgattctttcacagctgtcagcaactggctgatggccgtctgttcctgttattttccttgtcaggggaaaaggaacgaatttgatgcctggcagttccctactctcgcatggggagaccccacactaccatcggcgctacggcgtttcacttctgagttcggcatggggtcaggtgggaccaccgcgctaaagccgccaggcaaattctgtctccgcgccgcccgtaaggccgcgcagatatatccggtacaggctgaaaattgtgtctctcaaaaacgcctctggcgttgtaaggttaagcctcacgggtcattagtaccggttagctcaacgcatcgctgcgcttacacacccggcctatcaacgtcgtagtcttcaacgtcccttcaggactctcaaggagtcagggagaactcatctcggggcaagtttcgtgcttagatgctttcagcacttatcttttccgcacttagctaccgggcaatgccattggcatgacaacccgaacaccagtggtgcgttcactccggtcctctcgtactaggagcaacccccctcaattctccagcgcccacggcagatagggaccgaactgtctcacgacgttctaaacccagctcgcgtaccactttaaacggcgaacagccgtacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctgctttcgcacctgctcgagccgtcactctcgcagtcaagccagcttatgccattgcactaacctcacgatgtccgaccgtgattagctgaccttcgtgctcctccgttactctttaggaggagaccgccccagtcaaactacccaccagacactgtccgcagcccgggtaacgggcctacgttagaacatcaaacattaaagggtggtatttcaaggttggctccacgcagactggcgtccgcgcttcaaagcctcccacctatcctacacatcaaggctcaatgttcagtgtcaagctgtagtaaaggttcacggggtctttccgtcttgccgcgggtacactgcatcttcacagcgagttcaatttcactgagtctcgggtggagacagcctggccatcattacgccattcgtgcaggtcggaacttacccgacaaggaatttcgctaccttaggaccgttatagttacggccgccgtttaccggggcttcgatcaagagcttctccttacggataaccccatcaattaaccttccggcaccgggcaggcgtcacaccgtatacgtccactttcgtgtttgcacagtgctgtgtttttaataaacagttgcagccagctggtatcttcgactggcttcggctcggggagcaggtccctccacctacgcgccagcgtgccttctcccgaagttacggcaccattttgcctagttccttcacccgagttctctcaagcgccttggtattctctacctgaccacctgtgtcggtttggggtacgattctgtgttacctgatgcttagaggcttttcctggaagctgggcatttatcacttcagcaccgtagtgcctcgtcgtcacgcctcagcgttaacaagcgtccggatttacctggacactccgcctacacgcttaaaccgggacaaccgtcgcccggctgatatagccttctccgtccccccttcgcagtaacaccgagtacaggaatattaacctgtttcccatcgactacgcctttcggcctcgccttaggggtcgactcaccctgctccgattaacgttgaacaggaacccttggtcttccggcgagcgggcttttcacccgctttatcgttacttatgtcagcattcgcacttctgatacctccagcatgcctcacagcacaccttcgacggcttacagaaacgctcccctacccaacaacgcataagcgtcgctgccgcagcttcggtgcatggtttagccccgttacatcttccgcgcaggccgactcgaccagtgagctattacgctttctttaaatgatggctgcttctaagccaacatcctggctgtctgtgccttcccacatcgtttcccacttaaccatgactttgggaccttagctggcggtctgggttgtttccctcttcacgacggacgttagcacccgccgtgtgtctcccgtgataacattcttcggtattcgcagtttgcatcgggttggtaagccgggatggccccctagccgaaacagtgctctacccccgaagatgagttcacgaggcgctacctaaatagctttcggggagaaccagctatctcccggtttgattggcctttcacccccagccacaggtcatccgctaatttttcaacattagtcggttcggtcctccagttagtgttacccaaccttcaacctgcccatggctagatcaccgggtttcgggtctataccctgcaacttaacgcccagttaagactcggtttccctgcggctcccctatacggttaaccttgctacagaatataagtcgctgacccattatacaaaaggtacgcagtcacccccataaagaaggctcccactgcttgtacgtacacggtttcaggttctgtttcactcccctcgccggggttcttttcgcctttccctcacggtactggttcactatcggtcagtcaggagtatttagccttggaggatggtccccccatattcagacaggataccacgtgtcccgccttactcatcgagctcacagcatgtgtgcttttgtgtacgggagtatcaccctgtaccctgcgactttccagacgcttccactaacacacaagctgattcaggctctgggctgctccccgttcgctcgccgctactgggggaatctcggttgatttcttttcctcggggtacttagatgtttcagttcccccggttcgccttgcagcactatgtattcatgctgcaatgatgcacagagtgcaccgggtttccccattcggacatcgacggctgtagcggttcatatcaccttaccgtcgctttacgcagattagcacgtccttcatcgcctctgactgcctgggcatccaccgtgtacgcttagtcgcttaacctcacaacccacaggcgtttttcaacgctgcgtgttgcaagcatttgagagactcgaacgcatcgctttgtcattccttattacggaggaataacgcgctgcgtcgtttcaattttcagcttgttccggattgttaaagagcataatacgtcgcagcacaccgtcgccggtatgctctgaggtatttcagaaaaaacagataaacggtatggtggagctaagcgggatcgaaccgctgacctcctgcgtgcaaggcaggcgctctcccagctgagctatagccccatacagttactgcagagaccactactaccactcaaccgagttacattcttcaggagaaggatgcaatttcttttcaggcaaggcatgcggaagggacgtttactcaggtaaacgaccgcgcgcataacgcagcatgagaagaaatttggtaggcctgagtggacttgaaccaccgacctcacccttatcaggggtgcgctctaaccacctgagctacaagcctgtagaggttttttctgctcgttactttttatcagacaatctgtgtggacactgcgcgggaaagtatcttcaggtaaggaggtgatccaaccgcaggttcccctacggttaccttgttacgacttcaccccagtcatgaatcacaaagtggtaagcgccctcccgaaggttaagctacctacttcttttgcaacccactcccatggtgtgacgggcggtgtgtacaaggcccgggaacgtattcaccgtggcattctgatccacgattactagcgattccgacttcacggagtcgagttgcagactccgatccggactacgacgcactttgtgaggtccgcttgctctcgcgaggtcgcttctctttgtatgcgccattgtagcacgtgtgtagccctactcgtaagggccatgatgacttgacgtcatccccaccttcctccggtttatcaccggcagtctcctttgagttcccgaccgaatcgctggcaacaaaggataagggttgcgctcgttgcgggacttaacccaacatttcacaacacgagctgacgacagccatgcagcacctgtctcagcgttcccgaaggcaccaaagcatctctgctaagttcgctggatgtcaagagtaggtaaggttcttcgcgttgcatcgaattaaaccacatgctccaccgcttgtgcgggcccccgtcaattcatttgagttttaaccttgcggccgtactccccaggcggtcgacttaacgcgttagctccggaagccactcctcaagggaacaacctccaagtcgacatcgtttacggcgtggactaccagggtatctaatcctgtttgctccccacgctttcgcacctgagcgtcagtctttgtccagggggccgccttcgccaccggtattcctccagatctctacgcatttcaccgctacacctggaattctacccccctctacaagactcaagcctgccagtttcaaatgcagttcccaggttaagcccggggatttcacatctgacttaacagaccgcctgcgtgcgctttacgcccagtaattccgattaacgcttgcaccctccgtattaccgcggctgctggcacggagttagccggtgcttcttctgcgggtaacgtcaatcgacagggttattaaccccatcgccttcctccccgctgaaagtactttacaacccgaaggccttcttcatacacgcggcatggctgcatcaggcttgcgcccattgtgcaatattccccactgctgcctcccgtaggagtctggaccgtgtctcagttccagtgtggctggtcatcctctcagaccagctagggatcgtcgcctaggtgggccattaccccgcctactagctaatcccatctgggttcatccgatagtgagaggcccgaaggtccccctctttggtcttgcgacgttatgcggtattagccaccgtttccagtggttatccccctctatcgggcagatccccagacattactcacccgtccgccactcgtcacccaaggagcaagctcctctgtgctaccgtccgacttgcatgtgttaggcctgccgccagcgttcaatctgagccatgatcaaactcttcaatttaagtttgatttgcttaaacaagttaagcggtgctcatctgtaaaacgtcataatgaatttcattatgtgttcactcgtgagacttgatattttttacgtccggagacgctgatatcaatcctgcgagtgcccacacagattgtctgataaattgttaaagagcatgccgcgatttactgcggcgcgggctgcgtatattacgctttccgcattgtcagtcaagcatttattttcgcttaactcactggttcgtatgatttcgaacctactcaacccggcgcttcgtaagccgttgtgccgtgtcagtggaggcgcattatagggagttctcggagggtgacaagtgctaatttcaaataaaattccgagtgctgattttttcagctaaaagccgctaaagcgccagtttttccagcaacaggaagccataacgccgtaaaacgggtgataattgtaccgcttcgccatccagctccgtacaaaatgcaacgttctgctgcgatgaatgcacttcaggtgcttcatgctccagcagccaggctgtgcgtcgtgcaattgccgcaccggaatcaatcagacgcgtcccttccggtaacacctgctgcaactcttcgcgcagtaaaggaaagtgcgtacagcctaaaacgaccgtgtccggtggtttccgccatccgcagccacggctgaacaatacggcgcacctcattcagagcaacttccgcaccatggagcttcgcttctgccagttcaaccagctccgctgatcccagcatctctatcttgcaggaaccggcaaactgcgacaccagctcatgggtataaggacggcgcaccgtggcacgcgtcgccagcaagcccactacaccatttcgcgtcaggcgcgcggccggtttaatcgccggaaccacccccacgacaggaaaggcaaaacgttcacgtaaagcgggcaatgaaacggtgctggccgtattacaggcgatgatcactaacgagagaggatagctgcgggtaatggcctcaacgatagcgaccacccgatccacaatgaaagtctcgcttttctcaccgtaagggaagccagcgttatcgaaggcgtagagataatgaagatccggcaacagctgacggacctcatcatagacagaaagcccaccgacgccggaatcaaacaccagcacggtgggacgcaaatcagaagttgtagctgccgctgaggtaatactctcgtcctggtgtctgatagccatacactgtctcgtaatctttatcgaacaggttggcaattctaccacgaaccgtgagttgtgaagtgacaggatatgagacggcgagatcccacaggctgacgccccctaacttcacgcgacggctgggagagctgttaaagtccgtatcataacggtcacccagataatggtaggtgactgaccagtcaaactcatacagcgtccagtcgagctggtatttcacctgctgcttagcccggcgtacgagcggctgatcggtgctgccatcccgtgcgtcgacataatcataagagagctgatgcgccagcggcccggtgtcgaatcctgcggtcgcttcaacgcctttaatgcgagcctgcttaatgttgtagtaacggaaagtcgccggatcactatcaatcagattatcgatgtcgttgcgatagcctgaaacacgccagttcaccggtccgctcagcccttcaaagccgccttcccactgcttacttttttcaggatcgaggtcacggttgccataaaacgggctgtaaacctgcgacagattgggcgctttaaaagcggtgccataagaggcgaacgcgcgatagccagagataaactcccatgaggccgccgtctgccaagtgttatgccagccaaactgattgttgtcgtcaccgcgtaccgcaccttcgagggtgacgctgccaaactgctgctggccggtcaggtagagaccggtattacgctgctcataactatctgacaaatagttcgtgcccggctcggtcgtctctttctgccagtcgacacccgtgctgatcgccccctgccccacctgcacggtgttgccccactgcagattgtactgggtgacatcatcaaaggtggacgcggcaccgtagcggccattgcgtggatcgtagttgatgtctttggtatggccataactggcgatgagctgggtagagtagaagtcacgattgaagcgtaacccggtgtcccaggtctggctgtagagctggcgggtatccgccagcccgataatattgaaattattatcgtaggtgtatgaaccgtcgtaggcggtgcggttatcaaacccgtagccgcgcacaaaaccactgagctcatcgctgaactgatgctcaaggttgccatacagggttttgctcatgaagccgtcgcgatcgtgctgcgccgggctaaagtcattgggataacccgccaccacgtcataccctttggtataagtgtagttgcctgccagagtgagctttgtcgcatcgcccagcatctgctgggttgagccgtcgtaggattgatagccgtttgacccgacgcccgccgtcagcgtggtgcccggttgcgatcggcccgtaatgatattcaccacgccgccaatcgcatcggaaaccgtagactgcagaacgcgcaccgcgaatgtattcgatgcgttgcaccagtgacagcgggatctggctgaggtcagacgaaccggtgatgcccgcctgattaagccggatgccatcaatcaggatcagtacatgtctcgattcggtgccccgaataaacagcgaactctgctgccctaacccgccactttgcgcaacatcgacacccggcaggcggcgcatcacatccgtcaggcttttggcctgccagcgatcaatctcatcacgtgtgacaacggtggtgggtgccagcacacctgaaacaggttcagcaaaacggttggcggtgactatttgcgtatcatcattcccctgagcaaaaccgtattgcgcccagagagaaatcgccgttgcgctcagagcgaacagcgaagcagttttttttgtcatttttatcgcatccataagacgaagcaggatgccgcaggccgacaatcaatagcacgcgatgattgtacgagtagcgacgttacaccggcaggtcttcgggctgggaaccataagtgatgatgacttcccatcccacaggacagtgtctgcaattgcactcatcacgacattccttaccgctgcgcgtcagctccagattcacactggattccctattaactcgggcttgaggccggcgtctgcagtctacggagtggagatacggaagtccagactgccaaacatcttctcgctgcaggactggacatcagcaagtgaatgcctacaatcgcccgctggtaagctattaatcaggattgctcatgacacccgaacatctccccattgaagactatgacgcacagctggcggaaaaagtcagtcgtttagagacgatgatgatgccgtttgctgcgcccgacgtggaggtgttccgttcaccggtcagccactatcggatgcgcgccgaattccgcctgtggcacgacggcgatgatatctatcacatcatctttgatcagcagacacgcgagcggatccgtgttgatcagttcccggcggccagccagctgatcaatcagctgatgccaaagatgatcgccgcgatccgtgataaccgtaccctgcgtcataaactgttccagatcgactatctgtcgaccctgagcaatcagattgtgatttcgctgctctatcaccgcaaactggatgatgaatggcagcaggcagccgtggcgctgcgtgaccagcttcgcgcggaagggctggatgtgcagctgattggacgcgccaccaaaaccaaaatctgtctggatcgcgactacgttgatgagtgtctgccggtagcgggtcgcgagattatctatcgtcaggtcgaaaacagttttacccagcctaatgcggcgatgaatattcagatgctggagtgggcgctggatgtgacgcaggactcacagggcgacctgctggaactctactgcggtaatggcaacttctcgctggcgctggcacgcaatttccgccgcgtttctggcgactgagatcgccaagccctctgttgcgtcagcacaatacaatattgccgtgaaccagattgataacgtgcagatcattcgtatggcggcggaagagtttacccaggcgatgaatggcgtgcgcagctttaatcgtctggaaggaattgacctgaccagctacgaatgcgagacgatttttgtcgatccgccgcgcagcggactggatgaagagacggtgaaaatggtgcaggcgtatccgcgcatcctttatatctcctgcaatccgcagaccctgagcgacaatctgcagacgctggcggaaacgcacgatgtgacgcggctggcgctgtttgatcagttcccctatacccaccatatggaatgcggtgtcctgctgacacgtaaagcgtaaacaaaaacgggaaccctgaggttcccgttttttttatcactactgattacgcttgcgcttaaaacgcgtcgcaatccagaacaccagcgctaccatcagaacggtgggaacgaagttggagccaatatccgggtattctgcccgcaccagcgcgctataaaccagaatccccagcaggaaaaacgccgctgccagtcctggcataccgtccggcatattggtgttgaggtaacgctgatgcagacaccaggccgccagacccagcgcaatcagcggaaaaatcgaaaatggaacaaaggcgctgaacagcacagaaaacgagccgttaattgctaagccggtaataaaagccagtaccagtgtgcttttatcgcgagtacctgggtgggtcatggactgatccttactcattgctcttcgggtttttccagggtggccgccagtcgctcttgctcccggcggtaccagtaataagcgcctttggcgatcatacgcagctgtaacaccagccgatcctcaagcttacgtcgctgctcagcatcaacatccagtgcttctgcaccggcgctgaaaacaatggtcaccatcgcttcagcctgcgcttcggtaaaactgcgcggcatgcgattttcgacctcaagataatcggccagttcagcgataaagtgctgaatttcacgcgccacggcggcacgaaaagcggcagaggtgccggaacgttcacgcagtaacaggcggaaagcgttgggattgttgccgataaactccataaaggtcgacaccgacgttttaatgatgctgccgcctttggcaatacgctggcgcgcctggcgcatcagctgtcgcaacatcagcccgctttcatctaccatcgtcaggccaagctcatcaacatccttgaaatgacgataaaaggaggtaggtgcaatccctgcttcacgggcaacctcccgtaaactcagactggcaaaactgcgctcggcgctgagctgactgaaggcggcttcaatcagtgtacgtcgtgtacgttctttttgttgcgctctgacgcccattctctctgcctttagcggtgttaagcaggcactatatcaaaattttcagcgtacagattggcaatctttgtcaccgcctgtgaacctcactctttgtcaaaatgtgatgaaaatcgctgatagaattcagaagtgcgcgacgagatgttagaatctcgttgtaaaaatgtataaataataggacgtatcggtatgcaaaagtcttacgattacgatgccattgtgattggctcagggcccggcggtgaaggggcggcgatggggctggtaaaacagggagcgcgcatcgccgtgatcgaaacgctaccacaacatcggcggcggttgtacgcactggggcaccatcccttctaaagcccttcgccacgccgtcagtcgcattattgaattcaaccaaaatccgctctacagcgatcatacccgactgcttcgctcctcttttgccgacatactcaatcacactgaaaacgtgatcagccagcagacagccatgcgtcagggcttctacgagcgtaaccgttgtgaactttatcagggcgatgcgcattttgttgatgccaacaccattgagattgagcaaccggatggcacgcgtgagacgctgacggcagagaagtttgttatcgcctgtggttcacgaccttaccatcctgacaatgtcgactttactcatccacgcgtttatgactccgactctattctcaatctgcaccacgaaccgggccacgtcattatttatggcgcgggcgtgattggctgtgaatatgcgtcgatttttcgtggcctgaacgtcaaagttgacctgattaacacccgcgatcgcctgctggcgtttcttgatcaggagatgtctgactctctctcttaccacttctggaacagcggcgtggtgattcgtcacaacgaagagtttgagaagatcgaaggggtggaagatggcgtcatcatgcatctgaagtcgggtaagaaagtgaaagccgactgtctgctttacgctaacggccgtaccggcaacaccgattcgctgtcgctggaaaatgtgggcctggaagcggatggtcgtggcctgctgaaagtgaacagcatgtatcagacggctcagccgcacatttatgccgtcggagacgtcattggctatccaagcctggcctcagccgcctacgatcagggccgtattgccgctcaggcgattatcaaaggggaagcgtcagcgcacctgattgaagatatcccaaccgggatttacaccattccggaaatcagctccgtgggtaaaaccgagcagcagctgacggcaatgaaggtgccttacgaagtgggccgcgcgcagttcaaacatctggcgcgagcgcagatcgttggcatgaacgttggcagcctgaagattctgttccatcgggaaaccaaagagattctgggaattcactgctttggtgaacgtgccgccgagattattcacatcggtcaggcgatcatggagcagaaaaacggtggcaacacgattgagtacttcgtgaataccacctttaactatccgaccatggccgaagcctatcgcgttgcggcgttaaacggcttaaaccgcctgttttaacgcggcgtcgaaatagtgctgcatgtgggttttaatcgcctctgccagctgttcataacggctgcgcagaggtgaacccggtcgatagaccagcgcaattgtacgctgtggcaccggtttgtagcaggtgagatagcagacgccatcgcggatacgctccggtgggactgccagcgccggtaacagcgtaatcccgctgcctgccgccaccatattgcgcagcgtctcaagactggtcgcacggaaatgggtatcttcatcggcgcccgcctcaaagcagaaaccccatcgcctggtcacgcagacagtgcccatcttccagcatcagcaatttctcgcctgccagatcggacataggcacccggtcgcgatcgcaccagggatgatcggcatagactgccagcttcatcggctcatcaaacaacggcacttcgataaaggcctggctctctttgaccagcgcgataatcgcgcagtccagcttgccgctatcgagctgtgccagcagctgctgcgtctgcgcttcgtgcagatacatctccagtttcgggaatgtctggtgcagcgtcgggataatctgtggcaataagtagggcgcggtagtcgggatgaggccgatatgcagcggacctgacatcgcttccccttgctgactggccatctctttcagcactttcacttcacgcagcaccgtacgcgcctgatccaccagcagcaaacctgcctgggtgaacagcactttacggctggtgcgctccagcagcatcacacccagctcatcttccagcttacggatctgcccgcttaacgtcggctgactgacatgacacgcatccgcggcacggcggaaatgacggtgttcagcaagcgaaaccagatattcaagatcacgaatattcattattaccctccaagccacgatagcccgtggcgatagatagaatagcaatgaacgattggccctatcaagagtggttgggaataatgcgcacatcaaatggaacgcggtatgtcaggagaaaaaaatgtttgcaagtcaggaaggtaaagctattccgtcagtgacttttcacacacgtcagggcgatcgctgggtcgatgtcaccactgaagcgctgtttaaagacaaaacggtcatcgttttttcactgccgggtgcattcacaccgacctgctcctccagccatctgccgcgttacaacgaattagcgggtctgtttgcccagcagggtgtggacagcattctgtgcatctcggtgaatgacacgtttgtgatgaacgcctggaaagcagaacagcgcgcagacaacattacctttattcctgatggcaacggcgagtttacccgtggcatggagatgctggttgagaaagccgatctcggctttggcccacgttcatggcgctactcgatgctggtgcgtaacggcgtggtagagaaaatgtttgttgagccaaacaagccaggcgacccatttgaggtctccgatgccgacaccatgctgcgctatctggcgcccgagtgtaaagctcaggagtcggtctcaatcttcactaaacctggctgcaccttctgcacccaggcaaaacagatgctgatggatcatggtattcagtacgaagagatcgtgctgggacaggatgcaacaaccgtgagtctgcgcgccgtttcaggccgggcgacggtaccgcagatcttcatgggaggtcgtcacattggcggcagtgaggatctgcagcaatatctgctgtcagcgtaagagaatctgagcgtcggccgggagagcaggcgctttgatgatgtgcctataaaaatgagtaattctgaagctagaggttggcgggcatttaatgtgcccgcttttttttgcctgttaattacgccagacgctgctttgcgtcaccgatggcacgcgcaacctgctgtggcgagacgccgccctgcgcattacgcttatccagacaggattgcagcgccagaatcggatagacatcctcgccaatcaccgcactgaactgctgcagctgtgccagcgacagcgcttccagcgccacgccctgcccgatagcggcaaccaccacttccccgacgatatggtgtgcttcacggaacggcacgcctttggcgaccagatagtcagccagttcagtggagtttgcgtaaccctgctcagccgcttcccggcagcgcgggcgtttaacctgcaggccatccagcaccagaaactgacatgtgcagacagtcgagccaggtgtcgagcgcgtcaaacaacccctctttgtcttcctgcatatctttgttgtacgccagcggcagacctttcagcgtcatcatcatgccggtcagcgcgccctgcacccggccacacttgccgcgaatcagctccagcgcatccgggtttttcttctgcggcatcagcgatgagccggaggtcactttatctgacagttcgataaagcccgcttcaccggtgttgaagaagatcatatcttcggcgaagcgcgacagatgcaccatgccgatggcagcgtcagaaagcagctccagaacgtgatcgcggtctgatacggtatccagactgttgcgcgtggcagaagcaaagcccagccagcctgccagctgctgacgatcgatctcatacgcggtaccggccagtgcgccacagcccagcgggctgacatcgagccgcttcagcgtatcctgcagacggctctcgtcacgcgccagcatttcaacgtaggccaggcaccagtgcgcaaacgtcaccggctgcgcacgctgcaggtgtgtgtagcccggcatcaccgcatcctgattggcttcggcggtgaccaccagcgcctgctgcagatcacgggtggcacccagcagcccttcaatctgcaccttgcaccacagcttaagatcggtcgcgacctgatcgttacggctacgtccggtgtgcagttttttgcccagcgcgcccaccttgtcgatcagctggccttcaacccagctgtggatatcttcggcgtcgctctgcagaatctgctcaggatcctcacggacttcatccagtaacgtattcagggccgcttccagctgctgctgctcatcctgagtcaggacatttaccgtcaccagcgctttggaccaggcaacagagccaatgatgtcctgctctgccaggcggtaatcgaagcgcagcgagtcattgaactgtttaaaacgttgatccgctgcctgagtaaaccgtccaccccaaagtgccatgtgaaaactcctctgaatcgttaaacaaggggcggcataaatgccgcccctgaaatgaaactgtgaggcgaggcgcacctcgcctgaaaattacttcttctgctcgttcagggcgcggatacgcgaagagagcgagaacagacggataaagccgcccgcatgacggtgatcgtacacttcatcttcaccgaaggtggcgaaactcttccgagtagaggctgttcgcggaacgcttctgggtggctgtcgcctggcctttgtagagctgcagcaccacttcaccgttaacctcttccgccagcgattcggcagcggcctgaatcgacttacgcagcggggcgaaccagcgaccgtcataaaccacataggacatctcgtggccgagctgctcacgccatttgaagctatcgcgatccagcaccagctgctcaaccgcacgcagcgcattgaccatgatggtgccgccaggggtttcgtagcagccgcgcgatttaatccctaccagacggttttcaacgatatcaatacggccgacgccatgttttgcgcccagcacgttaagtttttccaggcactggaacggactcagtttttcgccgttaaccgccacgacccgacctttttcaacggttacggtcacttcttcaggctggtcaggcgcttcaagcggatcgacagtccagacccagcaatctttattcggtgcattggccgggctttccagcacgccaccttcggtggagatgtgccaggcgttttcgtcgcggctgtagattttctccagtgacgcggtggtcggaatgttgcgctctttcaggtagtccagcagcgcttcacgtgaacgcaggttccattcacgccacggtgccaccactttcagctgcggtgccagcgcggtgtaggtggtttcgaaacgcacctggtcattccctttaccggtagcgccgtgacacagcgcatccgcacccactttcagcgccagctcaacctgtgctttagcgatgataggacgcgccattgaagtgcccagcagataagtgccttcatagagggcgccagtctgcagcaccggatagacatagtcgctgatgaactcttcacgcaggtcaaccacgtggcattcagatgcgccggactgcagggctttcttctctacaccttccagatcgccgcgctcctgaccgatatctgcgacaaaagcgacgacttcacagccgccgtagttctctttcagccatggaatgatggccgaagtatcaagaccaccggagtaagccagaacgatttttttgatgttttgcgtttgcatttcgtaatccttgaatcagagtcgttaagcgagaatccgggtgccaatcgacacgccgttaaacaggtcaggcagccgctcagcgtgacgccagctggcaatatccaccgggcggcccagggtacgcgctgcatcaagcgcagcgtgcactttcacaatcatgccgtcggtaataatgccctgggtaatcagctgctcagctttgtcggcggtcatctcttcgatgcgctgacctttgccgtcgagaataccactgacgtctgacaacaggaccagatcagcgcccagcgtcgaggccagtgcggtcgccgcctggtcagcgttgacgttcatcaggtcaccgctgtcagttataccaattgagctcaccaccggcatataaccggccgccagcagggtgttcagtaatgccggatcgcccggcattgcgtggccaacgtggccgagtttcttcatcaaacggtgtgacattcacgatgcccgcatcgcccaggcagaggcctaccgcgttaatgcccgatttttttgcccaggccagcagcgttttattcgcggttcccgccagcgcaccggtaataatgtcgatctgatcggctggcgtgacacgcaggccatttttcttcttcaccggcagcgccagctttttcatcagttcatccaccaggcaaccgccgccgtggacaataatcagcggacgctgatgggcgctgcggtaggtcagcagcgcttcaaacaggcgggccagcgcttcttcgctgtctaacaacacaccgcccagcttgataatcaatggattggtcatggtatatttgtccgttaaatcagtgactgcgtttcagggaagccgaaccggatgttcaggcactgtaccgcctgcgatgccgcgcctttcagcagattatcttcggctgccacgacaatcagatgctcgccctgcacttcaaaaccgatatcgcaataaggcagacctacaacggctttcagcgccggtacgccctgttcgtagagccgcaccagtggcttgttgtcataggcgcgatggaaaactgcggcgatatcttcacggctgacacccgctttcagacggcaggtaatcgtcgccaggataccgcgcgggaagttacccagatgcggagtgaagatcaccggcgtaccgaggtgcgcaacgatttccgggtgatgacgatgattgaacaggccgtaaggctgcaggctcacttcgcagaagctggtgccgacattggctttacgtccggcaccgctcacgccgctggtggcgttgattaccggccactgcgcctcgtttaacagtccggcatccaccaggggcttcagcgccagctgcgcagcggtcgggtagcaacctggcacagccaccagctgcgcctgctggattttgtcatgctgatattcggcaaggccgtaaacggctttgtccagccagtcgctatgctgatgggtgaagccataaaagcgggtataaaaatcagcgtcattcacgcggaacgcacccgacaggtcgaacaccacacagccagccttgagaaattccggcgccagatcgtggctgacttcgtgggccgtcgccaggaacaccacatccaccttgtctgcccactcggccgcgctgctcagcggctgcagcggcaaatccaccacacctttcagctgcggatgaagatcggagaggcgcttgccggcatcagggctttgcgccgaaaccgccaaagcggttatgttgatatgtggatggcgattcaggaaggtggcaagctctgtaccagcataaccactggcaccaacgatcagcgtattcaacatcaggctgtaaccctttttacagtcgcacgttccgggtcacggccttgccccgttacccgccctgtcatctgcagtgatttaaggttcccttgcagaggacgttaatgtatttttattcactattactgcatgaatatggatacatcctaacccaaggaccgccaacagtgaagacaaaattaccgccttttattgaactgtaccgccagttaatcgccacaccgtcgatcagcgcaaccgatgccgcactggatcagagtaatgaaactttaatcaatttgctggccggctggttccgcgacctcggcttcagcgttgaagtgcagccggtgcccggcacccgcaataaatttaatatgctggcgcgtaccggaagcggtgcgggcggcctgctgctagcaggtcataccgataccgttccttttgacgatggccgctggacacgcgatccctttaccctgaccgagcacgacaacaagctctatggcctgggcacggcagacatgaaaggcttcttcgcctttattctcgatacgctgcgcgatgtggatgtcagcacgctgagcaagccgctctatatcctcgctacggccgatgaagagaccaccatggctggcgccaaatatttttctgaatcgacgcagctgcgtcccgactgcgccatcatcggtgaaccaacctcacttaaaccggtacgtgcgcacaaaggtcacctgtcgaatgtgatccgtatcgagggaaaatcgggccactccagcgatcccgcgcgtggcgttaacgccattgaactgatgcatgagtcgatcacccatctgatgcaactgcgcaatacactgcaggagcgttatcaccatgacggctttgccatcccctatcccaccatgaattttggccatattcatggcggtgacgccgctaaccgtatctgtgcctgctgtgaactgcatatggatatccgtccgctgccgggtctgtcgctgaacgatctcgatgggctactgaacgaggcgctggcaccggtcagtgcgcgctggccgggccgtgtcacggtggctgaactgcatccgccgattcctggctacgaatgtccggcagatcatgaactggtcagtgtggtcgagaaattgctgggtatacccactgaggtggtgaactactgcaccgaagcgccttttattcagcagctctgcccaacgctggtactgggcccggggtcgattgagcaggcacatcagccagacgaatttattgatactgcatttattaagccgacaagggcgcttatcactcaggttgtgcagcatttttgccactgattaacagcaaatggggcatttcactgcattaacagtaaaatgccccttcattctgcgggatttagcaataagaataacttatcccgcttcggtcccgataaattctacgaatttccgttatttagccacaccttcagcgcactttaacgcatttgacgaacgcaacattacgtggctagataaaagacgatgttatgcccaccgggtgattatccagagcgtttcagaatgtggacaggcggcaacggagccggttccctgtagattagggggaacatggcgttgctgatttttctgctgcctgaaaggtcgggtgtagaagtttttcaagacgataagggtgtcagggtccaatgaacgaacaatattccgcaatgcgaagtaatgtcagtatgctcggcaaactgctcggggatacgattaaggatgcactgggagagaacatcctcgaccaggtggaaaccatccgtaagctctccaagtcatcccgtgcaggaaatgacactcatcgtaaagaactgctcaatacgctgcagaacctctccaatgaggagcttctgccggttgcacgcgcttttagccagtttctgaacctcaccaacgtggctgagcagtatcagaccatctcgcaaagtggcgagggtgagaaccatcccgaactgctgaaaaagacctttgataccctgaagcagcagaaagatatcagcgaaagcgacatccttgcggccattgagtcgctgtcgctggaactggtgctgacggctcacccgactgaaatcacccgccgtacgctgattcacaagctggtcgaagttaacagctgcctgaaacagctcgatcacagcgacgtctccgactacgaaacgtaaccagattatgcgccgtctgcgtcagctggtggcacaggcgtggcacaccgatgagatccgcaaatatcgtccgacccctatcgacgaagccaaatggggctttgccgtggtggaaaacagcctgtgggaaggcgtacccgctttcctgcgtgagctgaacgagcaggtagaagaggcgttcggcattaagctgccggtcgatttcgtgccggttcagttcacctcatggatgggtggcgaccgcgacggtaaccctaacgttacggcggcgattacccgccacgttatgcagctgagtcgctggaaagccactgacctgttcctgcgcgatatcggcgtactgatctctgagttgtcgatgtcagagtgcactgaagagatccgggaactcagcggcgatccggaagcacttgaaccttatcgtatgatcctgaaacgcctgcgcagccagttaatgactacccagtcattcctggaacgccgcctgaaaggtgaacgtctgccgcgcccggccgatctgctggtctccaacgatcagctgtgggatccgctttttaccatctatcagtcactgcaaaagtgcggcatgggcattatcgccaacggtcagttgcttgatacgctgcgccgcgtgaaatgtttcggcgtgccgctggtgcgtatcgatctgcgtcaggagagtacccgtcacaccgaagcgattgctgaagtgacccgctatctgggcctcggcgattatgaaagctggtccgaagcggacaagcaggccttcctgatccgtgaactgaactccaagcgtccgctgctgcctcgcagctgggagcccagcgatgaaacgcgtgaagtgctggagacctgtcgcgtcgcggctgaagcgccacagggttctatcgccgcctatgttatttccatggcgaaaaccccttctgacgtgctggccgtgcatctgctgctgaaagaagcaggcatcggctatgccatgccggttgcaccgctgtttgaaacgcttgatgacctgaataacgccaatgacgtgatgagccagctgctgagcatcgactggtatcgcggcttaattcagggcaaacagatggtgatgattggctattctgactcggcgaaagacgccggtgtgatggccgccagctgggcgcaatatcaggcacaggatgccctgattaaaacgtgtgagaaggccgggatttcactgacgctgttccacggacgcggcggcagcattggccgtggcggcgcacccgcccatgcagcgctgctgtcgcaaccaccaggcagcctgcgcggcggtctgcgcgtgaccgaacagggcgagatgatccgctttaaatatggtttacccgccgtcaccatcgccagcctgtcgctttacaccggcgcaattctggaagcgaacctgatgccgccgccggagccaaaacgcgaatggcgcgacattatggatcagctctccgccgactcctgtgcgatgtatcgcggttatgtgcgtgaaaatgctgacttcgtgccctatttccgctcagcaacaccagagcaggagctgggtaaattaccgctgggctcacgtcccgccaagcgccgacctaccggcggcgtagagtcgctgcgtgcgattccatggattttcgcctggacgcagaaccgtctgatgctgcctgcgtggctgggtgccggtgcggccctgcaacaggcgatggccgccggtcatcaggatcagctggaagcgatgtgccgcgactggccattcttctctacccgtctgggtatgctggagatggtattctcaaaagcggacctgtggctggcggaatattacgatcagcgtctggtcgagaaatcactctggccgctgggcaaacagctgcgcgatcagcttgatgcggatatcaaagcggtactgaccattgccaatgactcacacctgatggccgatcagccgtggattgccgagtcaattgcactgcgtaacgtctataccgatccgctcaacgtactccaggccgaactgctgcatcgttcgcgcgcgcgggaagcgaatggcgatgaaccggatgcccgcgttgagcaggcgctgatggtgaccattgctggtgtcgcggcaggcatgcgcaataccggttaacggtggtgcagtaaaaacaaaaaaagtcgggactctcccgacttttttattggctgaagcagagcggttaagccgcagcagcagcaggacgcacgcccagggtgtgacaaatggcgtaactcatttcggcacggttcagcgtgtagaaatggaaatccttcaccccttcgcgtgacaggattttcaccatatccatcgcgatattggctcccaccattttccgcgtttccggatcatcatccagaccggcgaacatcgcgctcatccagcccggcacgcgcacattggtcagcgtggcaaagcgttgcagctgtttaaagttagagaccggcagaatgcccggcacaatttccacgtcaatgccggtcgcgacacagcgatcgcggaaacgcagataactttcaacgtcgaagaaaaactgggtaatagcccggttggcacctgcatcgatttttcgcttcaggttaatcagatcggcctgggcgcttttcgcttcgggatggacttccggataagccgcaactgaaatatcaaaatcacccacctctttcagcagcgaaaccagatcgctgccgtacatttctggcttaccgctgccaggaggcagatcgccgcgcagcgccacaatgtgacggatgccgttgttccagtaatcctgagcgatggtgcgcagttcatcgcgcgtggcatcgacacaggtcagatggggtgcggcttccagaccggtgcgatctttaatgcctttgataatgctatgggtgcgatcacgctcacctgagttcgcaccgtaggtcacagaaacgaatttcggtttcagactgctcaggcgatcgatagaggtccacagggtctcttccatgtcgctggtacgaggcgggaagaactcaaatgaaacattaatttgcccgttcagctcagccaggctctggtttagcgcttcgcgctgattggcatgaaagaaactcatcctgcaccctcatcgattaacaatcggcctgcgaacatctacacgtttagacgtccagatgttcaaaatgacgtaatctgactgtgccgtcaacttaaaaatggtcaacagtcgtgatcaattttcaatcaacatgaaggcgattcaacaggggagagataacgcattgaaaacaggcgccgaagcgcctgaggaggaggagttacagcagttgtgcgaggcgattaatatctgactggatagcgcctgcggtgacatcccggcctgcgcccggtccgcgaatcaccagcggattatcgcggtaccagcggctctcaatcgcaaagacgttgtcgcacggcagcagtgaggccagcggatgttccggacgcaccgcttcaacacctacgcgcgccttgccgttagcatcaaaccgggcaacgtaacgcagcaccaggtccatctcctgcgcggcttcgagccgttgcagcatctgctcattcagctcttcgccattttcaaagaagtggtcgacagatccctgctgacagttactgggcaccagcgattcaacccgcacctgatccggctcgatgttgtagcctgcctcacgcgccaggataaccagcttgcgcatcacatcctgacccgagagatcggcgcgcgggtcgggctcggttaaaccctgctgccaggcctgatccaccagctcggtaaagggcaccgtgccatcaaactgcaggaacagccaagacagcgtgccggagaagatcccgctgatcgccaggatggtatcgccgctgtcgcgcagatcgcgcaccgtatagttgatcggcaaacctgcgccaacggtggcgttatagagccagtgacgtccggttttggtaaaggcatcgcggatctggcgccaggtctgactgtcagacgctcccgcgactttattggcgctgataacgtgaaaaccgtgactggcgaagtcgagatactgctgcgccagcggagtgctggcagtgacatccagcaccaccaggtcatcaaacgggtgagcacgcatccacaggaacagcgactcttcatcgcgctctaccgcttcatcatcaaagaaggcgagtgcccggctggcttccagcccgtcatagctcagcaggctgcgacggctgtccgcgacgcccgccagcacaaattcaaagccggtacgcgctgacagcgtttcctgatcgcgggcaaacagctccagccagcgtgaaccaatattgcctttgccaaacagcatcagaccgatgcgcttttctgcccggaacagcgactgatgcaatccctgaatcagatgctgagtcgggccgacgcgcagcactgcgaccacgctgatgtgctcttctgactgccagatgaactcaattggctgatcctttaactgctgccagaagcgatgggtatgcagcggattgcgggtaacgcctgcgcccaccagcgccaccagcgccaggccgtcgcgcagctgcagatggcccggtaaaccggcatcctgtagcagcgtaaaggcgctgtttaccacttcggcggtgtaacagagctgcagcaattgacgatcgggatgaacgccaaacgccagcggacgcagctgcgcgcgcttcagcaacaggtcgatctctttgtgcaggatggcgaagtcatgctgctctggcagctgaatctcaatcaggcaaacatcatcatggctggtgacgatacgcgcgcccgtcccggaggccagcacgcgctcaatgcgggttgagccctgctccggctgataactgcagcgcagttgcaggtcgatatcgctgcctgaaaccggctgcagagtacgggtgtggagaaccggtgcagccaggcgcgccagctcgctggcttcatccagccttaacagcggcagcagacaggcatcagagactttgcggggatcggcactgtagacacccgccacatcgctccagatggtcacccgcccgacacccgccagtgcgccaatctgcgtggcagaatagtcggagccgttgcggccaagcaggacggtttcaccggcgtcgttgcggctgataaatccggtcaccacgatgcgcttatgcggatgctgcgccagtaaagtctgtagcagtggccaggacttcccttcatctacctgcggttgtgcggcacgttcagcgcgcagaaactcacgcgcatccagccagcaggcctgaaggtcacgctggctcagtaccgctgacatcaggcgtgccgaccagacttcaccgtgaccgaccacttcggcatagaccgcatcggtgatcggcgcatccagcagtgcggccagcttttccagatcacggataaacgcggtgattaaaggttctgcgacctcagcaggcagcagcgcactgatcagttcgctctggtagcgccgtaaggcctgttgcacctgatgcgcagagagccgatcgctctggctcagcttcagccagctaatcagctggttggtggttgagcctgccgcagagaccaccatcaggtcgcccggctggctgtagtccgccataataccggcaacgcgctgatagcagcgcgcatcggccaggctgctgccgccaaacttatgcaactgcctgatgttcggcgttcccgcgcctgctgaaatcgtcatgcttaaccctcggctgcgacccggaatgcattatccagatcggcaattaaatcttcgtgatcttcaataccgacagaaacccgcagcagcgtatcggaaatgcccgctgccgcgcgtgcttctgccgacatccccgcgtgcgtcatggtggcggtatgggagatcagactctctactccgcccagcgattccgccagcgtaaatagctgcagtgctttcaggaagcgacgcagcagcgcctcatcaccgtcgacctcgaaactcagcatcgcgccaaagccgcgctgctgacgtacggcatgttcgtgtccggcgttttccggcagcgaaggatgatacaactttttcaccagtttctgctgcttcagatactctacaatcgcgagtgcgttgcgttgtgcggctgcaatccgcggtgaaagcgtacgaatcccgcgcagcagcagataactgtcaaacgctgcaccggtcacaccaatgttatttgcccaccaggccaggtcggtagcgagttgcggatctttggcgatgaccgcgcccgccacaacatcggagtggccattgaggtatttggtacaggagtggatcaccaggtccgcacccagcgccagaggattctgcagcgccggactcataaaggtattgtccaccacgctgatggcacccgcagcacgcgcagcggcgcaaatcgcgctgatatctaccacgcgcagcagcggattgctggggctttcaatcaacaccagttttgggttttcatccagagcggcctgcagcgctgccggatcaccctgatcgacaaatttcacccgataggcgccgcgcttgctcaggctgtcaaacagccgatagctgccgccataacagtcatgtggcgcgaccagcagatcgccaggtttcagaaacaccgttgtgaccaggtgaatcgccgacatcccggtattggttaataccgcgcccgctcccccttccagtttctgccagcgtacgctgtacgacatcacgagtggggttgccacgacgggagtagtcatgcgcacgaggctcattgaaatccaggaagttataggtggtagagaggtggattggcgggacaacgcagccatattgctcgtcatcattcaaaccgctgcgcactgcgatggttgccggtttacgcgtcatgagcgaattgttcctgaagagtgaataaaatgtaggccacaggatatcaccctctaattagacgtcaatacatctggacatctaaatgtctttgcgtatagattgagcaaaaccgcaataaccgctaaaattatgcgtcatcgcctggcgttcccctctgtcagacagaggcagtgagcgaagaaaacccgccatatcaggggtcaggcaggaaaaaatcaggcataatccgctgatttcctaacatttaacgtttattaattaaggtaacccatggctgaatggaacggcgaatatatcagcccgtacgctgagcacggtaagaagagcgagcaggtcaagaagatcacagtatctatcccattgagcgtgctgaagattttaacggatgagcgtacccgtcgtcaggtgaacaacctgcgtcacgccaccaacagcgagctgctttgcgaagcctttttacatgcctttacgggccaaccgctgccggatgacgtcgacctgcgcaaagagcgtagtgatgaaattccggaagaagcaaaagcaatcatgcgccagatgggtgtcgatccggatacctgggagtattgatctttcagccataaaaaaacccagccgaagctgggttttttcttgccgccgaacccgcaggttcaggtgccttttaatcttattttttagcgcctggcacgctgaaacgcttgttaaagcggtcaacacggccaccagttgccacttcacgctgcttaccggtatagaaacgggtggcatttgccacaaacgtccaggttcagttcgtgagtcagtgttgaacgggtgtggatctcgttgccgcaggtacatttgatagtaactgcttcgtatttcgggtgaataccttgtttcatgggaaacctcattgaaggccgtgtcgctctccgtgccaggctttaacctgcacagcaccacacgcgattgaacattatagggtgtactccggccagatatttctcaccgaaggcggcatattatacaggtaagtttcgattgctgcaaatatctgctgagatacccgccatcagggtcagcgtgtacactagcttccccgatcattgagccggaaagagagagttatgcccgtagtccaggtcgccctgcccgtccccttgccccgcctgtttgattatctgccgccacagggcgcgcagccggtcattggtggtcgcgtgagtgtgccctttggcaatcgcaggatgatcgggattgtggtcgcctttcgtgagagtagcgatctgccggaagcacaactcaagcgcgtgattgaggtgctggatagtgaatccctctatccagcgtcgctgtggcgcatccttaactgggccgccagctattatcattcgccgcagggagaggtactgagtcacgctattccggtactgctgcgtcagggcaaagcggcgcaggacaatcccttatggcgctgggaaatcaccgagcagggtcgggcgactgcgccagaaagtttaaagcgggcaccgaaacagcagcaggcgctggctgcactgcggcagcaaccgctctatcgtcatcaggtcagtgaacatgacctcacggatgcgacgctgcaggcgctacgcgccaaagggttatgcgaaactgcatgagcatcagccgcagatgcacgactggcgtaccacttatgccgtaaaaggcgaacgtctgcggctgaataccgatcaggcgatggccgtgggtgcgattcgggcagatgatgaacattatgcagcctggctgctggcgggcatcacgggttcaggcaaaaccgaggtttatctcagcgtgctggaaaatgtgctggcacgcggtaaacaggcgctggtgctggtaccggagattggcctgaccccgcaaactatcgcccgttttcgcgaacgttttgatgcgcccattgatgtgctgcactccgcattaaatgacagtgagcggctggcggtctggttacgtgcgcggcgcggcgaaacggcgattgtgattggcacccgatcggcgctgtttacgccactggcccgtcctggcgtaattattatcgatgaagagcatgacagctcctataaacagcaggaaggctggcgctatcaggcgcgcgatctggccgtcttccgcgcacatgaagaggatatcccgattgttatgggatcggcgacccccgctctggagacactgcacaatgtccgcagcggcaagtatcgccagctcgacctgacaaaacgcgccggcaatgccagaccggcactgcaacagcttatcgacttaaaaggcgtgcagctgatcggcggtctggcaccgggcctgattggtaaaatgcgccagcatctgcaggccgataatcaggtgctgctgtttcttaaccgccgcggcttttcgcccgccctgctctgtcatgattgcggctggattgctgagtgtacccgctgtgaccgctactacacgctgcatcagcaccatcgccagctacgctgccaccattgcgacagccagcgtccgctgcctaatcaatgcccgcagtgtggttcaacccatttgctaccggtaggcgtcgggactgagcaactggagcagcagctcggcacacttttccctggcgtgccggtgtcgcgaatcgatcgtgataccaccagccgcaaaggtgcgctggagcagcatctggctgacgttcatcgcggcggtgcaagaatccttgtcggcacccagatgctggccaaaggccaccacttccccgatgttacgctggtgtcgctgctggatgtcgatggtgcgctgttctcagccgattttcgtgcggcggaacgctttgctcagctctacacccaggtcgccggtcgtgctggccgagccggcaaacagggcgaggtgttgctgcagactcaccatccggaacatccgctgctgcagacgctgttgcaccagggctattcggcgttcgcccagcaggccttactggagcgacaggcagtccatctgccgccctggagccgccatgcgctgttccgcgctgaagatatggataaccagcaggcggcggaattcctgcaacaactccgtaatttgctggaggcaagcccgctgaacgataaggcgatgtggtttatgggtccgttgcctgcactgcagccaaaacgcagtggacgctggcgctggcaactgctgctgcagcatccttcccggcagcgtctgcaacagttgctgagcagttcgttgccgttggtttcaacactgcccgcggcgcgcaaagtgaaatggacgctggatatcgaccctaccgagagctgatttaagctgacactgcgagccagatcgaaaaatgtcgcataagtcacaatttttatgcaaattaagtaacaaccagccgggcaatcgttaacaatgttgcccggtttgccttcaggtcaggcagaaacagaattgaacgcgccataacgcgtcaggagcatgtgttggagcagaatcaacaaccgcccgccgccacgatgaaagatgttgcggaacatgcgggcgtctcaaccgccaccgtatcgcgtgcgctgatgaatccggagaaggtttctgcggccacccgccagaaagtcgagcaggcggttgccgccgtcggctacgcggcacatggccccacgcgcaacgcccgtcgtaatgagacgcgtaccatcctggtcattgtccctgacatctgcgatcccttctttagtgaaatgatccgaggcgttgaagttacggcagccgaagagggctatctggtgctgattggtgactgcgcgcatcagaatcagcaggagagaacttttctcaacctgatggtgacgcgacagatcgatggcatggtgctgctcggctcaaagttgccttttgatgccagcattgatgagcaacgcaacttgccgcctatggtaatggcgaatgagtttgcgccggaaatgtcactgcccactgtccacatcgataacctgaccgccgcatttgaagcggtaaatcatttactgcagttgggtcacacacatatcgcctgtatcgccgggccggaagagatgccgctctgccagtatcgtttgcaggggtatgtccaggcgatgcgtcgcagcgggctgacggtcgatcccacctatattgtgcgcggtgacttcacatttgaagcgggcgttgccgccatgaatcagctgatgaccctgccgcaaccgccgcgcgcgctcttctgccacagcgatattatggcacttggggcgatgaatcaggcccggcgctgcggactgcggataccggaggatctctctgtggtcggcttcgatgacattgagctatcacgttactgcgagccgccgctgaccacggtcacgcagccacgttaccagataggccgggaagcgatgcttctgctactggatgagttaaatggcaaacgggtcattagcggatcgcggctgctggatgccggtttaaccattcgtggcagcacggcgcgagcaaaaaagcgtgaaaaataagcgtatttgtctgattttttcagtagattcttaaggcgaacactgctggtcaaagttccgacccttaagtaacatggcggactccttgccgggcgcgtaaaaatcatcatttcgcccatctggcactatttttgaagggtataagaacgagagtggcacaaaaagattacgtaggccgcgggcgttcaacagggacgcgtcgcaaaaaaagccccagccgtggcaagaagagcaaaggcggttcgggaacatctaaattgatgattgtactggcggtcgcagtgttggtgacctttgccggtggtttatggttcctggcgcatcacaaaaaagaggacgtgccggtcattacggatcataaagccaacggcaatggcctgccgccgaagccagaagagcgctggaaatatattaaagagctggagaaaaccgtcaggtcactgtgccgacacctatcgaaccctcttcgggtggcgaagtgaagtcgcagacacagctgaccgacgagcagcgccagttgctggagcagatgcaggcggatatgcgtcagcagccgacgcagctcaacgaagtgccgtggaacgaacagacgccggcgcaacgtcagcagacactgcagcatcagcagcagttgcaacaactgcagcgtcagcagcagcaggttcagcaacaacagcagcagcaacaggttcagcagcaacgtcagcagttgcaggctcagcagcaacagcaacgccagcagcagttgcagcaacaacaacagcgccagcaacagcagcaattacaacaacagcaacgtcagcagcagcagcagcagcagcagcagcagcagcagcaaaacgtacagcgccagacgcagccagcacctgttacgcgtgaaccggaagtgcagccaaaaccgcaggagaccgcgaaagcgaaaccggcggagaaagcctcttcgcagcgctggatggtgcagtgtggttcgtttaagggcactgaccaggctgaatcggtgcgcgctggcttagcctttgaaggatttgaaagccgtattaccaccggtggcggctggaatcgtgtggttatcggtccttataaagaccgcgcctccgctgacagcaccctgaagcgcctgcgcagttccggacactccagctgtattccgctctccgtcgggggttgaaacccgtcaaacccgccccatatctgttgcatgatactccgcgcccggtgcgcggagtccttttccgactgcaacaaggggtctgcccgtgacaacaatagtaagtgtacgacgcaacggccaggtagtgattggcggtgatggccaggctacgctcggcaataccgtgatgaaaggcaacgttaaaaaagtgcgtcgtttatacaacgataaagtgattgccggatttgctggcggcaccgcagacgccttcaccctgtttgaacttttcgaacgtaaactggaaatgcatcagggccatctggtgaaagctgcggtggaactcgccaaagactggcgtactgaccgtatgctgcgtcgccttgaagccttactggccgtcgcagatgaatcagcttcactgatcatcagcggtaacggtgacgtcatccagcctgaaaacgatctgatcgccatcggctccggtgggcctttcgcccaggcagcggcacgtgcgctgctggagaataccgagatgggcgcacgcgacatcgtcgaaaagtcgctgaatatcgcgggtgatatctgcatctacactaaccacaacgttaatttcgaagaattaacgtctaagtcgtaagggtataaatatgtctgagatgactcctcgcgaaatcgtcagcgaactgaaccgctttatcatcggccaggacagcgctaagcgcgccgtggctattgcactgcgtaaccgctggcgccgcatgcagctcgacgaagagctgcgccatgaagtgacccctaaaaatatcctgatgatcggtccgaccggtgtcggtaaaaccgagatcgcgcgtcgtctggctaagctggccaatgcgccgtttatcaaagtagaggcgaccaaatttaccgaagtcggttatgtcggtaaggaagttgactctatcattcgtgacctgaccgattcggccattaagatggtgcgcagtcaggcgattgaaaagaacaaatatcgtgccgaagagatggcggaagagcgcattcttgatgtgctgattccaccagcaaaaaacaactggggccagtcagagcagagcgctgaaccctctgcagcacgccagtcgttccgcaagaagctgcgcgaaggccagctggacgataaagagattgagatcgacctggccgccagcagccctggcgtcgaaatcatggcccctccgggcatggaagagatgaccagccagctgcagtcaatgttccagaatctcggcggccagaagcagaaagcccgcaagctgaagatcaaagaagcgatgaagctgctgatcgaagaagaagcggccaaactggttaacccggaagagcttaagcaggacgcgattgatgccgttgagcagcacggtatcgtgtttatcgatgagatcgacaaaatctgtaagcgcggcggccagaatgccggcggcccggatgtctcacgcgaaggcgttcagcgcgacctgctgccgctggtggaaggctgcaccgtctccaccaagcatggtatggtgaaaacggaccacattctgtttatcgcctcaggcgcgttccaggttgccagcccatccgatctgatcccggaactgcagggtcgtctgcccatccgtgttgagctgcaggcgctgaccgtgaacgatttccagcgcatcctgaccgagccgaatgcctcgattaccgtgcagtacaaagccctgatgaataccgagggagtgaacattgagttcaccgaagagggtattcgccggatcgctgaagccgcatggcaggtcaacgaaaccaccgaaaacatcggtgcgcgccgtctgcacactgtgctggagcgtctgatggaagatatttcgtatgacgccagcgatcgtcatggtgaatccgttaccatcgatgctgactatgtcggtaaacatctggatgaactggtggctgacgaagaccttagccgcttcattctctgatccactgattcagcgcttttcagaagcccagcccacccggctgggcttttttatgcatgttcttgatcgaacgatgcttttttcatactgatgattttgccaacaatctgcatatagcgatatacttacccttcctgtggcaaacagacgaaacccttatgaaatacgatacatctgaactctgcgatatctaccatgaagaagtgaatgttgttgaaccgcttttttcaaattttggtgggcgcacttcattcggtggtcagattaccacagtgaaatgctttgaagacaacggcttactctacgatctgctggaagagaatggccggggtcgggtactggtgattgatggcggcggctcagtgcgccgtgcactggtggatgcgcagctggcacgtctggcggcaaccaacgagtgggaaggtctggtgatttacggttcggtacgccaggttgatgagctggaagagctggagattggcattcaggcgattgccgcgattccggcaggcgctgcgggtgaaggaattggcgaaagcgatgtgcgcgttaatttcggcggcgtcaccttcttctccggcgaccatctctatgcagacaacaccggtataattctgtcagaggatgcgctggacctcgaataggccagacatgaaaacgggtgcctgagcacccgtttttcacatcagctgaggcttcaaacctcttccatttttcccagcaatgcacgcagacgtttcctgccacacgtgttgctcttctttcagatgctgattttcacgcatcagcgcatcgtggttgcccgcgacttgttgcgcatcgttacgcagtgagttgttctgctctttcagctcttcgatttccatctgcaacagggtgatggtatcaatcgcctgctgtactttcgcttccagtttctcaaacacttcaaatgacatctttctgacctctcctaaattcctgcaaggcgttgatgatgccagcttaagccagcaacgttgtcccgattgtatgtagcctcaccccgcaagtccagcaacgcggccgctgcgggcgtagtctgtaacacttttcagccaatccctgaatttacgctgcgctgactgcgacggctttctggtacgggtgcgttatccccgtcctcaggcgcgaatattggctaaggaaagccagaatacgcgaaaacgcgcatttttatgacgcagtacacaaaaaacgatttcgctatttctcgtttatgttcgttaacgataaattcacaccagccctacattaaagctgggtgcctcatggaatgagaacaaaaactgataaaatttaacctcgcttcaggaaccactattatgagtcagacaactaacacgctcaaaggtcagtgtattgccgaatttctggggacaggcttgattattttctttggtgcaggctgtgtggctgcactgaaactcgccggtgccgccttcggtcagtgggagatctgcatcatctggggtcttggcgtttccatggccgcctaccttaccgcaggcatttcgggcgcgcacctgaacccggcaatcaccgttgcactctgcctgtttgctaattttgaaggacgtaaagttctgccttatatcgtatcgcagattgccggtgccttttgtgccgcggcgctggtatacggtctctactacagcctgttttttgattatgagcagagccaccagatggtgcgcggcacggttgaaagtctcgacctggcaggcatcttctcaacctaccctaatccacatatcggtgtcggccaggccttcctggttgagatggtcatcacggcagtattaatggcggtcattatgggtctgacggatgacggcaacggcattccacgtggcccactggctccactgctgattggcctgctggttgcggttatcggtggctccatgggtcctctgaccggcttcgcccttaacccggctcgtgatttcggaccgaagatcttcgcatggctggcaggctggggtaacgttgcctttaccggtggtcgtgacatcccttacttcctcgtgccgatttttggcccgctggtcggtgcctgcctgggtgcagtaggttatcgcacactgattggtcgctacctgccaggtaccgcccaggaaacctgcaagcgttccagcagacaaaccggttgcacgcgctcagcagcgtaaagcgtaagtttcaccttttatcatcaggacagaatttatgactaccacagataaaaaatatattgtcgcgctcgatcagggcacaaccagctcccgcgccgtcgttctcgaccacgactctaatatcgtcgcggtatcacagcgcgaattcacccagatctacccgaaagcgggctgggttgaacatgatccaatggatatttgggcttcacaaagctcaacgctggttgaagtgctggcccatgccgacatccgctctgatgagattgcggcaatcggtatcaccaaccagcgcgaaaccgctatcgtctgggaaaaagagaccggtaagccgatctacaacgccatcgtctggcaggatccccgcaccgccgactactgtcacaaactgaagaaagagggtctggaagagtatatccagcacaccaccggtctggtgattaacccttacttctccggaaccaaagtgaagtggatcctggatcacgttgaaggctcacgtgagcgagcaaaacgtggcgagctgctgtttggtaccgtcgatacctggctggtctggaaaatgacccagggccgcgtgcatatcaccgactataccaacgcctcccgtaccatgatgtttaacatccataagctggagtgggatcagcgtatgctggatatcctggatatcccgcgtgaaatgctgccagaagtgaagtcctcttctgaagtctatggtcagaccaacatcggcggtaaaggcggtacacgtattccaatcgccggtattgccggtgaccagcaggctgcgctgtatggccagctctgtgttcagcctggcatggcgaaaaacacctacggcaccggctgctttatgctgatgaacaccggtactgaagcggtaacctcaacgcacggcctgctgaccactatcgcctgtggcccgcgcggtgaagtgaactatgcactggaaggggctgtgtttatcggtggcgcctctattcagtggctgcgcgatgagatgaagctaatcagtgaagctgctgactctgaatactttgcgatgaaggtgaaagacaccaacggcgtttacatggtgcctgctttcaccggtctgggcgccccttactgggacccgtatgcccgtggtgctatcttcggcctgacccgtggtgctaatgctaaccacatcatccgtgcgacgctggagtctatcgcttatcagacgcgcgacgtgctggaagcgatgcagaaacgatgccaacacccgcctgcaggcgctgcgtgtcgatggtggtgcggtttccaacaacttcctgatgcagttccagtcggacatcctcggcacccgtgttgagcgtccggaagtgcgtgaagtcaccgcgctgggttctgcttatctggcaggtctggctgtcggcttctggcaggatctggatgaagtccgctctaaagcagttattgagcgtgaattccgtccaagcctggaaaccaccgagcgtaacttccgttatgctggctggaaaaaagctgtagcccgcgcccaggcgtgggaagaacaagagtaatatcaatgcccgcgaccgttgctgtcgcgggccttttccccgctccactcccccgctgtgttacactgcctgcctgttttttgtcaggtagatgccatgaaacgagaacttgccattgaattttcccgcgtaaccgaagctgccgccctggcaggctatcactggttaggacgcggcgacaaaaatgcggctgacggcgcggctgtccatgccatgcgtcatgtcctgaactccattgaaatcgacggtcagattgtgatcggtgaaggcgaaatcgacgaagctccgatgctctatatcggtgaaaaagtcggtaccggccgcggcgatgcggtcgacattgcggtcgatccgattgaaggcacccgcatgacggcgcttggccaggctaacgcgctggcggtgatggccgtaggcgataagggcagctttctgcacgcacccgacatgtacatggaaaaactgattgttggccccgcagcgcgtggagagatcgatcttgacctgccgctggaaaccaacctgcgtaacatcgccatcgcgatgaataagccgctatcacagctaaccgtatcgattctggcaaagccgcgtcatgacgcagtgatcagtcagttgcagcaactgggcgtgcgggtgtttaccttcccggatggcgatgtcgccgcctccattctgacctgcatgccggacagcgaagtggatgtgatgtatggcatcggcggcgcaccggaaggcgtggtctctgcggcggtgatccgcgcgctggatggggatatgcagggccggttactggcgcgtcaccacgtgaaaggcgacagcgctgaaaaccgtctgctgggtgagcaggagctgcagcgctgcgcagagatggggattgaagcgggcaaaaagctgatgctgaatgagatggcacgcaatgacaacgtggtgtttgccgccaccggcattaccagtggcgaactactgaaaggcattacgcgtcagggcaatatcgccaccagcgagaccctgctgattcgcggtaaatcacgcaccatccgccgtattcagtcgattcactatctcgaccgtaaagatccggcgctccatccctttatcctgtaaccggctggttgccgcgctccggctgacgtgagagcggcaaccagcagagcagcatcaccagcgccgtgaaaaacatcagcatgccaaggctgaactgatcgcgctgcggcatcatggctgacagccacgccaccaggcccgatcccagattctgcatcccgccaatcagcgcgcccgcgctacccgccagccaggcataaggctccatcgcgcctgaagtcgccagcgggaacagcatgccagccccaaagaagaacagcgcagccgggaccagcagcgtccagatattcatcacgccgaaccatgccgggatccacatcaggatgcccgccagcaggcagctatttacgccccaccacatcagactgtgccatgaaccctgctcgcgaccggcaaaccaggcaccaaaaaacgctgccggaatcggcaggatgaacaggatgctgacggtcaggctgtgcaggccgagcacgccgcccagcagaaacgccacagctcgactcaaataccgcaatcccggccagcgcgccaatcagcagcacaatgtagcgaacgaaattcgcgtcgctgagcaggcgggcgtagcgtttaaagaaaggtgtcacttccgcgctctgcggtcgggtctccggtagccagcgtgccattgagacggttaccgccagacagagcagcagcagaaaggcaaagcaggcgtgccagccaaagagctgagtcagcagtgcaccaattactggcgccagcagcgggctgaccagaatgcccatattaagcaggctgttagcgcgccgcagtgcgtgcccctcgtagagatcgcgcggcatggtgcgggccatcacgccagctacgccggtgcccagtccctgaacagcgctgccgaacaccagcatatcgagcgacgtcgccatcagtgccgtaattgcgccgatcataaagatcatcatgcccgccaggatcaccggacgacgaccgatgctgtctgacagcgggccatagatcagctgggatccgccataggtcatcagataggccgccatcacacgctgcagcgcgccatcccgcacattcagagcatccgccatcaccgacatcgccgggacgtagatagtctgtgccatctgccctactgccaccagcacaatgagcatcaccagcagcgggcgattttcgagtttagtcatcatgattatgcaaaatttctttctgtgaaaggaggttaaaacagcggttcacccgccagtcatcttgttatggcgggcaaaatatcaggattagatgacaaagcgagaggtaagcgaaaaggtcccggcttgcgcctgtcaagtttatgggccagcctgtaaagacaaagcaacagtttgtcgattagagcctttgccccggcgcaggctggcaatctcaccgggcagccgcgaaaatagtgacctgcctgaataatcaacaaccagggagtgattatggctgagtgggtcaatgctgaagtaaaggaagtgaaaaactggacggatgcgctgttcagtctccgggtaaaagcgcccatcgatccctttatcgccgggcaatttgccaagctggcactggaaatcgacggtgagcgggtacagcgcgcttactcttacgtcaatgcgccgaaagatgatctgctggagttttacctggtcaccgtgccagagggcaaactgagtccgcatctgcaggcacttcagcctggcgatcaggtgatggtcaccaaagaagcggcaggattctttgtgctggatgaggtccctgaatgcaaaaccttatggatgctggcaaccggcaccgctattggcccctacctgtcgatgctacagcagggcgaagggctggatcgctttgaaaacatcgtgctggtccatgctgcccgctatgcggccgacctgagctttttgccgctgatgcagcagctgcaacaacattatcaaggcaagctgcacatccagacggtggtgagtcgcgaagagatcgccggttcgctgactggccgggtcccggcgttgatcgaaaacggtgagctggagcgcgccaccgggttaagcctggatgccgacagcagccatgtgatgctgtgcggcaacccgcagatggtgcgtgacactcagcaattactgaaagagacgcgcgagatgcgcaagcacctgaagcgcaagccgggccatatcaccagcgaacattactggtgagccgtttgccggtatctcaccggctgagtcgcggtaccaaaccggttagcgccgggggtaccgcgaaagagaccgagatcgagcagcaggccagccagtaacacaaacggaatggcgcgacccaacagccagggcagtatgccgtccagcatgctccagtttccctgccaccagcagccaggcaacaatcaccagaaatccccagtagccgcggcgattacgatcgtgcaaccgtttaacgataaccgcgctggcgggccacagcaggcagaccacgccaaaggccgccatctgagtatcaagccagtcgttagccgctaacgcgaataacagggttgttgtcagcaaccagaccgcctgccagatccagaaatcacgtcgtcccagccggccgcgccaggaaaaacaccattgttgtaacgtcatgcattatcatccagagagaagagaaccgctgcggttttgacctcgcggataaaaaccgttttaatttgcgcctgagtttacgggttaggatcgacaaaatgaagaatttgcctggcgcactgctgttatcgtttgcgctgacggttccggtctttgccgccgatccgccaccgcaggatcgggccgatgcgttgcccaccgccccctatctgctggcgggcgctcccacctttgatatgactatcggccagttccgcgaaaagtataatcaggccaacggggcgctgatgctgccggaatatcgcgccattgataatcggggtgacaaaagcaccctgacgcgcgccgccagcaaaatcaatgaaactctctatgcgtctaccgcgctggagcccggtaccggcaaaattaagacgctgcagattacctggctaccgttgccaggtccggatcagaacgcctcacagcaaaaagcgctggcctacatgaccgccatgttgcgcttctttgtaccgggactgagcgccgatgagggacgtaaaaagctggagggtttgctgaagcaaggtaaggatttaccctactttgcgcaggtcgagggcgcgttgcgttttgtggtggctgacaacggcgacaaggggctgaccttcgccattgagccggtcaaactggcgctcgccagcccctgatgatgaggccgaaaatgacgaaaagcaaagccatcgctacatttgatctctatactgtctggcagacaacgctgccagctggcagcgatttttcatgtatcgctttatgcggaggatagaatgcgacatccactggttatgggtaactggaagttgaatggcagcaagcagatcacagctgaactgatcgccggtctgcgcaaggaactgtctggcgttgagggttgtggcgtcgccattgcaccgccagctctctatctcgagcaggcaaaacacgccatctccggtagccacatcgcactgggtgcgcagaacgtagacgttaacctgtctggtgcgtttaccggtgaagtttccgcagagatgctgaaagatatcggcgcgaaatatatcattatcggtcactcagagcgccgcacttaccacaaagagagcgacgaattcatcgcgaagaaatacgcagtgctgaagtcagtgggcctggtaccggtgctgtgcattggtgaaaccgaagcggaaaacgaagcgggtaaaaccgaagaggtctgcgctcgtcagctggatgccgttctggaaactcagggcgccgaagcgtttaaagatgcggtcatcgcgtatgagccagtctgggccatcggtaccggcaaatctgccacccctgctcaggctcaggccgttcacaaattcattcgtgaccatatcgcgaagaaagatgcggctatcgcagaacaggtcatcatccagtacggcggctcagttaacgataaaaatgcggctgagctcttcacccagcctgacatcgatggcgcgctggttggcggtgcctcattgaaagcggacgctttcgctgtgatcgttaaagctgctgcggctgcaaaaagcgcctaagcagtaaacgtaccgattaaaggcggcttaagccgccttttttatgggcgctatcagctgacaggcgtgatcctgtacctcctccgccgaaccgctgttcagcagcagccagtttcgctctatcgccatcagcaccagtcgtccatcacttaattcagccagtgccagcccatatttccccatctcactgcgcgcctctggccgctcatcggccagtcggataaacgcactctgccgggtcagctcgtccggggtcaatgcacgcagccagtagcggtgcttacgcagcgtgatgctctgccaccgcccgctaagctgcggcgtcagctgatcaagctgctgacgcacatcgggtcgcaggcaggagatatgaatatggagctgattctgcgtgcggccatactgtgaattgatagccagtgacaggacccgatcatcaataggtgagccgcgtcgctgcgcaagcagagtccgctcatcccatgcaagggcaaagtagttgggcgtagcggattgcagtaaccgcgggctttcgatgccggtgatcctgtcgagcgggatcagcagatactgcaacggcccgtgcatatctttcagcatggcatagcgatgccgctgatcgacgcgctgacagggcgcaggtttctccaccactctgctggtgaggcagacatttctcgctgacgatctgccacagcgcatcactgttctttttgaaatgcagtgcggcagccagcatccccgcaatgaccagtaccagcagaaccgcaaccaggcgggttgcacgacgatgtgtcggcataacaacgcttcctgaatggcttagcagcctgcatcctcgcctggcgagaaaaaaatgtcacggggaattctggcagataacccagcggctgggcggagaaggagaaaaggcgtggttgtgggggataagcggtcagcgcaggaatgcgctgaccgcaacgcattacggtttcatgacctggtcatagctgccgccatcggcgaagtgggctttctgagcctgtgtccagccaccaaacttgtcctgaatggtaaacagcttcactggcgcaaaggtgctggcgaatttcttcgcgacttcagcatcacgcggacggtagtagttctgtgcagcgatagtctggccttctggcgagtagaggtatttcagataagcgtcggcgactttacgcgtccccttttcatctaccactttatcgaccaccgacacggtcggttccgccagaatcgattcgctcggagtgacaatctcgaacttgtctttgcccagcttgttaaccgccagataggcttcgttttcccaggcgatcagcacatcaccaatcccgcgctcaacgaaggtgttggttgcgccgcgtgcgccggaatcctgcacttcaacgtttttaaacagcgctctgacgtaagccagcgctttagcctgatcgccgttgttatgatccagcgcccagccccaggccgccagatagttccagcgtgcgccgccggacgttttcgggttaggggtgataacagatacgcctggcttcgtcaggtcgctccagtcatggatgcctttagggttatctttacgaaccaggaagacaatggtcgaggtgtagggcgcagagttgtccggcagacgctgaatccagtttttatcaatacgaccgcgttctgcaatggcatcaacatccgattgcaacgccagtgtgaccacatccgcccgaatgccgttaatcacggaggttgcctgcttaccggaaccgccatgcgactgacggaccacgacattatcgccggtttcctgtttgtagtgcgcactgaacgctttgttgtactgttcgtacagctcacgcgttggatcgtaggaaacgtttaacagctgaatgtctttcgccagaacgctggttgaggccagcaacagggtaacgccgatactccacttgttcattacgcactctcccaatgtcgttatgggctaagcgtgacataaaccaatacagagctaaaagaattaaaaataagctgttataaccatggggaatatagaggcggggtgccggggcgcgccaggtcgcacaccccgaagaggaattaatagagttttttcgcggtgtcgagccagtcgcgtttgaacggacgcttcatattttcaatggcgtcgacgatgtcgtgatgcaccatcttctcgttctgaatacccacgcaacggccgccgtaaccctgcatcagcagttcaatggagtaggcccccatgcgtgaggccagaatacggtcatacgcacaaggtgcaccgccacgctgaatgtggcccagaacggtagaacgggtttcacgcttggtttctgtttcgatgaaacgcgccagatcgtcgatatcgcagatgtgctcggtaatcgccacgatagcgtgctttttacctttggcgatgcccgctttgatttccgctaccagctcttcacgagtatacgggaactcaggcagcacgatgaactcacagccacccgcaatggcggctgccagtgtcagatcgccacagtagcgacccatcacttccacaatcgaaatacgctgatgcgatgaagaggtatcacgcaggcggtcaatcgcttcaaccacggtttccagtgcagtgaaataaccgatagtgtaatccgttccggcaacgtcgttatcgatggtgcctggcagaccaatgcacgggaagcccatttcagtcaggcgcttagcccccatgtaggaaccgtcaccaccaataacaaccagcgcatcaatgccgcgctttttcatgttctcaatggcaacctgacgcacatcttcattacggaattcagggaagcgtgctgagcccaggaaagtgccgccgcggttaatcatgtcggaaacgctgtagcgatcaagattgatcatgcgatcttcgtacaatcccaggtaaccgtcatagatcccaaaaacttccagtccttcactcagcgcggaacgcaccacgccacgaatagctgcgttcatgcctggggcgtcaccgccgctggttaatacaccaatttttttgatcatgacaacctctggattgttcaaaactaagggttaatcctgcctgtcgatcgctgctgaagctcattttacgactcgcgcgacacgtgatggcagatagtatatcaaaggcttgctgctgaattgattcaggtcagacaacttttcactattttttgcagcaatgttagcgttacgtcatccctgccgtatcgatttgattcatttaagttaaaaacctaaagaatcctctctctcgaacggtaccacagaacagggatcctgatggataattacgtctgagccgggaaattctttgcgtaacgccttctcaacctgatcggctacccgatgcgcctgcaccagtggcagctgatcttccagttccagatgcagctgaataaatttggtcggcccggactgacgggttcgcagatcgtgaacgccctgcacctgcggccagtttgtcgcaagcgtcaggatttgctgccgttcctcttccggtaacgcgcgatccagcaatgactgaaccgcctcgtagcccatacgcagtgcgctgtagagaataaaaataccaatgcccagcgcaaacagggcatccgcccgggcaaagccatagctgctcagcaccagcgcaaccaaaatagcgccattcatgatgacgtcggactgatagtgcagcatgtcagcccggatcgcctggctgcgggttttacgaaccacccagcgctgaaaggccaccagcaccagcgttgagctcagcgccaccacggtcactacaataccgacgccgggcgcccgcaactcattgggcgtcgccagatgctgcaggccggtcagaaacagaaacagcgccgacccggaaataaacatactttgcgccagcgctgccagcgactccgctttgccgtgcccgaaagtatgatcttcgtcagcgggctgcagtgcataacgcaccaccagcagattggtcagcgaggcggcgatatccaccagtgaatccaccagagaggccagtaaactcaccgaaaccggtgtaccaccaggcaaaaattttcacgagcaacagcacagacgcaagaatggtcgcgccgagcgcagcacgctttaccagtcggccataagagggttgcatgccaggttccctgtgcggcatcagtgaagatgcgcaccaaaatgaatgaatggctcaagtttaacatcgggaggcgggcactgcttagcgggtcgatcaacggatcaggcttttttgggaaggcgcgacaggtacaaaaaaacaagccccggcctctgtgggaggtcggggcaaagtgtcatacacatcagtaccaggccacattcaggcccaggtctgggctgagaaaggggcggcgactactttttgccgccttttttcccggcttctgatgctttttcacgatcgtttttgaaatttccgccgccgctactctggccgcctttcttaccggcttcagacgctttttgcggattatctgcgaaattacctgaaccaccacgatgctctgccataacttactccgttaatagattcattcaggactacataatgtggttgctgctccctgagacttcgcaaagacacttaacttccctgcagtgacaggattaagtgtagagggtgcgcctgaaccggcaagcgtaacgcgggggatttatctcattgaaaaatataattaaatctttctatgcctgcctgtaattcattcactttcagtgagttataatatttaacaggcggtaaaacccttaccggtacgcttaaatttaagtcatgacctgaatagtaaggaatcggtgagacttacccataaaagctcaacaagcgctaatcaaacaggggttttattgcggggtgatgattccagtcaaaataaaaaaagtgaaaaaaagataaaaaaaacccccaccatcatggcgggggaagacagggatgtgtctatggcaaggaaaacagggatactatgttactggttactgctggtactactcactgcctgcagcgatgacgctgactgcaaattcgaaaactgtcgcagctcattaagtcgccgctggtaattctgctgtaacgccgactgctgggctggcgttagcagctggaacatttgattctgtacgcgcgccatctcgacctgctgttcaacctgaactctggcgatcacttccgccttctcgcggatggccgcttcgttaaactggtctgcagtcactaactcatgtagtgctgcgatatcgtcaatatggacgaccggacgctcatgtcgggcctgttgcatcaggtctcgcatctgctgacgttgctcttcagtcagttcgatgccatcgaacatgtggctttgcggattttgcgtcatactgcctgtcggcaatccgccatgatgcatctcgtcaatcgtcgtcgcatctttagcacctgcgctggcgacactcagagccatcgctgaggcaaggacgacggcggttaatttgcgcatcgtgtactccagtttcgttccgttttgcgattcaacgagagccagtgtacggcgacagctgcaaacatccgtcagggggtgtaaaactacgtaaagcgatggataggtgcgccaggaacacggtattttgcctgcggagggctacaaaaatgaataaaatcctgttggtagatgacgatcgcgaattaacttcgcttttaaaagaactgttagaaatggaagggtttgaagtggtggtagccagcgatggtgaacaagcgctgaacctgctcgataactcaattgatctgcttttactggatgtcatgatgccgaagaaaaacggtatcgacaccctgaaagaactgcgtcagcaacatcaaacccccgtcatcatgctaacggcgcgcggcagcgagctggatcgcgtactgggcctcgaactgggcgcagatgactatctgcctaaaccgtttaacgatcgtgaactggtggcgcgtatccgcgctattctgcggcgctcaaactggagtgaacagcagcagcaacacgacaatagctcgcctacgctggaagtggactgcctgcgtctcaatcccggccgtcaggaggccagttttgatgatgtgacgctggatttgaccggcacggagttcaccctgctctatctgctggcgcagcatctgggccaggtggtgtcgcgtgagcacctgagtcaggaagtgctgggaaaacgcctgacgccttttgaccgcgctattgatatgcatatctccaatctgcgtcgcaagctgcctgaacgccgtgacggtcatccctggttcaaaactttacgtggccgcggctatctgatggtttcggcatcatgattggaagtctgaccacccgtatcttcgccatcttctggttgacgctggcgctggtgttgatgctggtgctaatggtgcccaagctcgattcacgacagatgacctcgctgctggagagtgaacagcggcagggaatcatgattgagcaacacgtcgaagcagagctgtcacaggatccccctaacgatctgatgtggtggcgtcgtctgtttcgggcagtggaaaagtgggcaccgccgggtcagcggctgctattagtgacgagtgaaggtcgggtgatcggcgcgcaacataacgaaatgcaagttatccgcaattttatcggccagtctgacaatgccgatcatccgcagaagaagaaatatggtcgtgtagagctggtagggcctttcgccgttcgggatggcgaagataactaccagctttacatgattcgtcccgccaacagttcccagctcgatttcgtaaatctgctgtttgaccgtcccctgttactgcttatcgtcaccatgctcatcagctccccgctactgctctggctcgcctggagcctggcacgtccggcacgtaagctgaaatatgctgccgacgaagtcgcaagcggaaacctgcgtcagcatccggaactggaatcgggcccacaggagtttctggcggcgggttccagctttaaccagatggtcagtgcgctggagcggatgatgaccggtcagcaacgtctgttatcagatatcagccatgaacttcgtaccccgctcacccgtctgcaactggctaccgcgctgctgcgtcggcgccagggtgaaggcaaagagctgggccgcattgagatggaagcacagcgtcttgatggcatgattaacgatctgctggtactgtcgcgcacccagcataaaaatgcgctggtcagcgaagcgatgaaggcgaatcagttgtggaatggggtgctggaagatgcccgcttcgaagcggagcagatgggcaagaagatggatattccctatccgcctggcccgtggccgctttatggcaacccccatgcgctggagagtgcgctggaaaatatcgtacgcaatgcgctgcgctattcacacacccatatcagcgtcagcttctccgtcgatatttccggcatcacggtacacgttgatgacgatggtcctggcgtgagtccggaagatcgtgaacagattttccggcctttctaccgtaccgatgaagcacgcgatcgcgaatcaggcggcaccggtcttggcctggcgattgttgaaacggcagtgcagcaacatcgcggctgggttaaagcggatgacagcccattgggcggcctgcggctgaccctctggttgccgctctactcctccgctcgtcaataatttgttatgcttcggcccctgtcatcgggggccttatgcttaacattgtcttgtttgaaccagaaattccgccgaataccggcaatatcatccgcctgtgtgccaatactggctttcagcttcatctgattcagccgcttggttttgcctgggatgacaagcgtttacgccgcgccgggctggattaccacgaatttactgccattaaattccacgccgactatcaggcgtttatcgcctcagagtcgcctgagcgtctgtttgcgctgacgaccaaaggtacgcccgcacacagtgccgtagcgtaccaggctggcgattatctgctgtttggcccggagagccgtggacttccggctgagatcttagcggctttaccggctcagcagaaaatccgtatcccgatgaaagcggaaagccgcagtatgaatttgtcgaacgccgtatcggtggtggtctatgaagcgtggcgccagcttgattatgcgggcgcgctgattaaagactagatgccgtcgccaaactgaaaacccgccaggctgccattaaagtgctgatccatatccatcgacggcttttcactgcctggcttaccaacgattcgcgcgggtacgcctgctgcagtggtgtgcggcggcacgggctgtaacaccacggaaaccggcaccgattttggctcccttgccaacttcaatattgcccaggactttcgcaccggcaccaatcatcaccccttcacggattttcgggtgacgatcgccgctggttttgccggttccgcccagcgtaaccgattgcaggatcgagacatcattctcaaccacggcggtttcaccaatcacaatgcctgtggcatggtcgagcatgatgccgtggccgatgttggcggcgggatgaatatcgacggcaaaggagacggagatttcattctgcagataaaccgccagcgcgcgccggccttcattccacagccagtggccaatgcggtaggcctgtaaggcgtgaaaacctttgaggtagagcagcggcgtggagtatttatcgactgccgggtcacgctggcgcaccgcctgaatatcgtacgccgctgacataatcatcgacggatcttcacggtaggcttcttcaacgatttcacgaatggcgatggcgggcataatcgggttagccagcttgttggccagcatataactcagtgcgctaccgagattttcatgcttgagcaatgtcgcgtggaagaagctggccagcatcggctcacaatcagccagggcgcgcgcttctgctttgatattattccagaccagttctaactcatcagacgacattgctgttttctcccgataaaaaaagcgcctgaatgggcgctgcaggtgatgatgctacgcgtcctgcgttagccagtgctgttttcgtccttccttgttcgtcccagcagactcaatgctgcatctctcgccggcttttcgcaatacagcacctgataaatctgctcggtgatcggcatttccacaccaaaacgggctgccaatgctttgacttctttggtgtttctgtagccttctacaacttgtccgataatgcgttgcgcgctatctacatcctcgccctggcccagcatcatgccaaaacgacggttacgcgactgattatcggtacaggtcagcaccagatcgcccagacccgccatccccataaaggtggtgggatcggcacccagcgcggcacccagccggctcatttcagccagaccgcgggtgatcagtgcggtacgcgcattcgcgccaaaaccaatcccgtcagagatcccggcaccgatagcaatcacgttttttaccgcaccgcccagctgtacgccgatgaagtcagggttgttataaacgcggaagctcttaccgcagtgcagcttctgctgcagatcctcagcaaactgcgcatccgttgcggccagcgcgatagccgtcggtaatccggcagccagctctttcgcaaaggtcggtccggagattacagccagcggaatgtcatcgccgacaatttcccgcgccacatcctgcagcagacggccggtctctttttccagccctttggtcgcccagacaatacgcgagtcggatcgcagatgaggcttgatctgctgcagcacctcgccaaacacatgactcggcaccacgatcaataaatcgcggctggcagcaatagctttagtcagatcaggttcaagagaaagatggtcggggaacgggacatcaggcaggaaagcggtgttgcaacggtcactctgaagctgcgccagatgcgccgggttatgtccccacaacagcaccggatggccgttgcgggccagcgtaatcgccaaagcggtgccgtatgaaccggcaccgatgacgctaatcgaagcgtgagttgtcatcaggcatcctgatgtggttcagcaccttcttcaccttgctgctgctgcaggtagttcatgaacagcgcatcaaagttaaccggtgccaggttcagctgcgggaaggtaccacgtgataccaggctggtaatgcattcgcgtgcgtacgggaacaggatgttcgggcagtatgcgcccaggcaatgtgccatctgcgttccttcgataccgctgatggtgaaaataccggcctgctgaacttcacacaggaaagcggtttcttcgcccacggtggcggttacagtcacacgaagtaccacttcgtaaacttcgtcagccagctgagaagatgcagtgtccagatccagtttaacgtccggttcccactctttctggaaaacctgcggtgcatttggcgcttcaaaagagatgtctttggtgaatacgcgctgaatctggaattgcatttcgttggtgttatgttctgacatgtgaccaaatcctatgtatgagattgtccggcgtaaaattacgcctgcagtaagggatctaaaccttcgcgattatcgagtgcgaataagtcgtcgcagccaccaatgtgctgcgcatcaataaaaatctgaggcacggtggtgcggccgctacgcttgatcatctcttcgcgtttcgccatgtctccatcaatggggatctcctgaaacgatacgcctttttgcgttaacagcgccttcgcccgatggcagtaaggacaggtcgccttggtatacacttcaacatttgccatgatcagcacctctgtaagattatttgccgcgaactaacggcagattttcgccgctccagccactgataccatctttcagcactgaaacccgctcaaagccggccgcgctgagatgcgcagcagaatcacccgcgctttgtccggttgcacacaccacaattatgggctgcgctttatgctttgccagttcgtcgatgttgccttttttaatctcagcggctgcgacattcagcgcacctgaaatatggcctctgcggaaatcgtcgcgcgaaacgcacgtctacaactaccgcgtcctctttgttaatcaggcgggttgcttcaccgcggctgatcgtttttaccttagagaacattcctttaacggtagtcacaatcaccagaacgagtaaaacgacccatgccagactcaggatggggtgattgcttgcaaactgcataatttcttgcatgaggggtaacgactccagaccgggctaataagctaaaacaagggttctgagtatacctgcgccacttcgcatgtacagatgctatgcggccagagtatcgatttgtgcttcattttccaaaaaaagtggctgaatagcaaaaatggcgtaaggcttaatccatgtcattgtgaaagtggacataactggaaaagcaaatgccagtggggagcactggtaagcggcggttcatcgtggaataatcattggcctatgaagggaaaaacaaccgtttcgcacacaaggacccgtcccaacggcgataacctgccgttgttcacacacttgtccagcctctcccttagcctgctttgtgcgggggcactgttattgcctgccgccgccgttagtgcagaagacagcaaatctcagctgcaatctattcagcaaaacatcgctgaaaaagagaaaagcgttaaagcgcaaaagcttcagcgcagcaaattactggatcagttgcagagccaggaaaaaatcatcgctcaggcgagccgtcagttgcgtgacacccgcaatagcctcaacgccctgaatgacgaaatcaaacagcttgccacctccatcgcccgccttgaaaaacagcaaacccaacaggaaaacctgctttcagagcagcttgatgcggcgtttcgtcagggtaagcacaacggtgtacagctgttgatgggcggtgaagagagccagcgcagcgagcgtattctggcctatttcggctatctgaatgcggcgcgccagaaaagtatcgaatcgctgcaacagacgcgtcaggacttagctcagcaacgcgccacgctggagcagaagcaacagcagcagaaaggattattagcgcagcagcagggccagcagcagaagctgcaacaggcgagcgaagcgcggaaaaaaaccctgacgacactggaaagcgcgctggaaaaagatcaggccgatctggtcgagatgcgtcagaacgaaagccgtctgcaggataagatcgcccgtgcggaacgcgaggcgcgcgagcgcgccgcccgtgaggcgcgtgaggcggaaaaagtgcgtcagcgtcaggcgcaggcgaaagccaaaggctccagctatcagccgactcagagcgaacgcgaactggtggcgcgcaccggtggactcggtcgcgccggcgggcaggccttgtggccggtacgcggacgcattgaacatcgctttggtgaacagctgcagggtgaactgcgctggaaaggactggtgattgatgcgcgcgaaggtaccgaggtgaaagctatcgccgatggccgcgtgctgatggccgactggttacagggctacggcctggtggtcgtgctggaacatggtaaaggcgatatgagcctgtatggctacaaccaaagtgcgctggtgagcgtgggtacgcaggtgaaggcaggacagcctatcgcactggtgggcaccagtggtggccgcggtactccgtcgctctattttgaaatccgacgtcagggacaggccgtcaatccactcccgtggttaggaaaataggttttgctgcaacttcgaaaaatccccgttctgttgagcgccctgctgttcagctacgctgcgcaggcgggcaaactggccattgtcatcgatgacgtaggctatcgccctgccgaagagaacaaggtcctgcagatgccgcaggccatttcagtggcggttttgcccaacgcgccacatgcccgtgaaatggccaccaaagcgcaccagagtggtcacgaagtgttgatccatctgcccatggcaccgctgagcaaacagccgctggaaaaagataccttaacgccggagatgagcagcgaagaagttacccgcatcatgcgcaatgcggttaacaacgtgccttatgccgtaggtctgaacaaccatatgggcagcaggatgacctccagcctgcctggcatgcagaaagtgatgcaggcgctgaaccactacaatctctactttctggatagcatgaccatcgctaacagtcaggctgttcctgccgcacagggcacccaggtcagggtattaaaacgccgggtatttctggatgacagccaggatattaatgccatccgccagcagttcagtcgggcggtgaaactggcgcagcgcgacggttacgccattgccattggtcatccccaccctaacactgtgcgggtgctgcagcagatgctacccacattgccagccgacgttacgctggttcgtcccagtcagctgctgaacgaatcactgcacagcaactcacggccgcctgtggcgccggcaaaaccggtgacaccgcgcttccagcctgcagacctgtgtaaaccgaaacagcctctggcgccggtttcctgccacccgagccttaacggtaatagctgaaagtgtgaataacagcccgctgtttaacacgctaaaaaatctgttctgaatttgctatgaatgctaagtgttcagcttagcgttcatttatacgcagaaattactataatcctgggtcgggcgataacgtgctgtgcgggaacagtgatagggatgacgattattaaacaaaaaatcctgctgctggataacggcagagagtggggcggcggcaccaacagtatgctggagctgttgaagcgtatcgatcgtcaaaagtttgatatcacctgctgcttctatcacaactacagccgtggcaacgacgaaaccattgaggccacgctgaatgcgctggctatcccggtcttttttattccgcaaatcaggcagccacgctgggcaaagtttgttaaagaagtcgcgcgggcactgctgttttttaataaaaagctcaagaagcgcgccatcgatcagattgatactcactggcgcattatgcccaatgccagcaaaatcaattcactgctgcagctgggaaagtttgacacgctctatatgaataaccagcccagcaccaatgtggaaggttatctggcggcgcgcagcctggatgttgcggtagtgcaacactgccgtatcgatccggtactggaaccgcggctggtcagcatggtcaatcaggattgccaggcgatcattgccgtgtcacagggcgtgaataacaccctgcgcagccacggtgttgatgcggaacgctgttttaccgtcaataatgctatcgacatccaccagcctctgcccgaccgccttgaagtacgccagcgctttaaactctccccttcgacctttgtgttcggcacgatcggctcgctgatattgcgtaaatctaatcaccatattctgcaggcgctgggccgttttaaacgcgctaatcccgatgccgactggaagatggtggtggtcggagcgggtccggaacttcagcatctgctgcaactcgctaccgcagagaacatccagcagcatgtggtctttacgggctttcagaacaacgcgctggattacctcaccgcctttgatgcgtttattcttgcctcacgcagtgagggcttaccaagggttgtgctggaggcgatgctggtgaataccgccgtagtgggatcccgcgtggtcggcactgccgaattgatcagtcatgacgaaaccgggctgctgtttgactatggcaacgtggtgcaactgacccagcatctgaccgcgctgtggcaggatgcggatttacgtcaacgcctgatcaatgcggcagcgaaacgcgtacgtgaacagtacgctattgaaacttatatcagcggcgtcgagaatattttgcaaagcgtcgtgaaaaagaaacctcatgcttaattttttaaatccccgttatcgtcatatcagggcgagtcataacctgccttattcgcataaagaggttcagggcactgtaccggtcacttctgtcgtgatcccctgcaccggcgcggactatatcgaagaagccctgctcagtgccgattttgcggcgcgctttgcgacagaggctgaagagatcgtaattgtcagcgatcagccggctcacgcctttggcagcctgccagtaaaaacccgcgtggcaacgctggatgtcccgcatcgggaagagagctatcgctacaagcagatctatcgcagtcgtttgattaaattgcaggcgcccttacaggctaaaggcgacggcattctgatgatcgattccgacctcaatctgcttaagatgcccgagattatgatgaagcccggccatctctattccagttttcgtcaggggaaaatgattgccaagctggctgatgccccggaagaggcgattcccgcctactacccgcacagtatccggccctggctggtggatcacgtgaatggggcttacctggcggccacccgtgaggtctggcagcgcatttcgccgctgtggctgacgctgtttaatgatacctggaatttaatgaacgacagccagccgcctactgaccagctgccgctcgcggtgttgctggacatgctggatattaaaaccgtcaatctgggcgaatgggctaactggccggtctcaaagaaaattggcggtcagtcggcggtgatcccgcctgaagtggtaggcgcacatggcggctttccgctgtcggaatggcaaaaatacctcgccgatccgcaacagccgctgaactttaaaggccaggactacacgcgcaaagtgcgctacctgaccgatgaagagaaaaaacaaagctaatcatgcggccgccctggcggccgttgttttaatcccagctcagtatcacctttcccgatcgtcctgaacgcatctcatcaaagccctgctggaaatcgtcgattccatagcgatgggtaataaccggcgttaaatcaagcccggactggatcagcgccgccattttataccaggtttcaaacatctcccggccataaatgcccttgataaaaagccctttgaagattacctgattccagtcgatcgccatttcacccggcgggatgcccagtagtgcaatccgccctccgtggttcattacctccaacaatgaacggaaggcaggcggtgcaccagacatctccagcccgacatcgaatccctccgtcatgcccagcgagtgcatcacgtctcgcagatcctcattcgccacattgaccgcgcgcgtgacgcccattttgcgcgccagtgacagacgatactcattgatgtccgtgatcaccacgttacgtgcgccgacatggcgacagaccgcggcggccatgatgccgataggacccgcgccggagatcagcacatcctcacccaccagatcgaacgatagcgcggtatgcacggcgttgccgaatggatcaaagattgccgccagctcatcggaaatgttgtcgggaattttgaacgcattgaaggccgggataaccagatactccgcaaagcagccctgccgattaacgcctacacccattgtgttccggcataaatgggttcgcccggcacggcaattacggcagtgtccgcaggtaatgtgcccctcgcccgagacccgatcgccaatcgtaaagcctttcacttcctgtcctatcgcaaccacttcccccacatattcatgaccgacaaccatcggtaccggaatggttttgcgcgaccagtcatcccagttgtagatatggacatcggtaccgcagatagcggttttgcgaatcttaatcagcaaatcgttgtggcccggctccggaaccggcgcatcggtcaccatccagatgcccgtttccttcttcagtttggcgagtgctttcatgacggactcctcaggcgataacgcccagttgtttgccgatacgggtaaaggccgccaccgcacgttccagctgttgctgggtatgcgccgcagagatttgggtgcgaatgcgtgcctgaccttttggcaccaccggatagaagaagccggtaacgtagatgccttcctgttgcagcaggcgggcgaactcctgggcgacgctggcttcacccagcatcaccgggataatggcgtgatcggctcccgccagcgtaaagcccgccgccgtcatctgctcccgaaagtaacgggcgttgtcccacagacgctgacgcagcccgtcgccttcgctgagcagatccagcacccgcagcgaggcggcaacaatggccggggccagcgagttagagaacagatagggacgggaacgctggcgcagccactccaccacttctgcttttgcggcggtgtagccaccggaggcgccacccagcgctttacccagcgtgccggtaatgatgtcgacccggcccatcacatcgcaatattcatgggttccgcgtccggcgttcccgacaaagcccaccgcatgggaatcatccaccatcaccagcgcagagaactcgtcggccagatcgcagatagcgggcagattcgcaatcaccccatccattgagaagaccccatcggtggcgatcagaatatgacgcgcgcctttatcgcgcgcttcctgcaagcaggcgcgcagctgcgccatatcgttattggcatagcggtaacgctgcgctttgcacagccggacgccatcgataatggaagcgtggttcagtgcatcagagatgacggcatcctgcgcatcgagcagggtttcaaacagaccgccattggcatcgaaacaggaggagtaaagaatggcatcctccatgccgagaaagtctgccagccgcttttccagctgcttatgactatcctgcgtgccgcaaataaagcgcaccgacgccataccaaaaccatgcgaatccatcccctctttcgccgcctgaatcagcgccggatggttcgctaaacctaagtagttattggcacagaagttaatcaccgccgggttatcgccaaccgcgatctccgtctgctgggcagaggtgatgatccgctcctgtttaaacagtccttcctgacgtgcatcatcaagttgctgacgaagttgttgataaaattgcgcaggcatcattgctctcctcagatggcaaaaatctggcatatcttactgaacaggccgcttcttcacgataaatcgcccaacagaatgtcatttttgcagcatagttcacgccacaaggatgtacgcacaaagcgttacagagtcatctggctgtctgcaccctgatgaaatgttatgatgtgaggtattcgtgtgtgaaacctcctgtttcaccccacaacgttgaaggtaacaacatgattatcgtaactggcggcgcaggaatgattggcagcaacatcgtcaaagcgctgaacgatcgcggtcacaccgacattctggtggtggataatctgaaggatggcaccaagtttgccaatttagtcgacctggatatcgtcgattacatggacaaagaagagttcctgatgagcgtgatggcgggcgatgatttaggcccgatcgaagcggtgttccatcagggcgcctgctcctccaccaccgagtgggatggcaagtacatgatggagaacaactatcagtactccaaagagctgctgcacttctgtcttgagcgcgagatcccgttcctctacgcctcttccgcagcgacctacggcggacgcaacgagaatttcattgaagagcgtcagtatgagcagccgcttaatgtttatggctactctaagatgctgttcgaccattacgtccgtcagatgctgccggaagcgaactcgccggtatgcggcttccgctatttcaacgtctatggaccgcgtgaaggccacaagggcagcatggcaagcgtggcattccatctgaacacgcagatcagcaacgatgaaaatccaaaactgtttgaaggcagcgacggctttaaacgtgatttcatccacgttgatgatgttgcggaagtgaacctgtggtgctgggaaaatggcgtctccgggatttacaactgtggcacaggccgcgccgagtccttccaggaagtggctgacgcagtactgaagttccaccagaaaggtcagatcgagtacatcccgttcccggaaaaactcaaaggacggtaccaggcctatactcaggccgatctcactaagctgcgtgccgccggctacgacaagccatttaaaacggtggcgcagggcgtcgctgactatatggtctggctgaaccgtaacgcataaaggaagctgctccggcgatgaaaattctggtaatcggcccgtcgtgggtcggcgatatgatgatgtcgcaaagtctctatcgcaccctcaaggccgaacatcccgatgcggtgattgacgtgatggcacctgcatggtgccgtccgttgttgtcacgcatgccggaggtgaatcaggcgctggcgatgccgcttgggcatggcgcactggaaatcggtgagcgtcgccggttgggcaaagtgctgcgcgccagtcactacgaccgcgcttatgtgctgcctaactccttcaagtcggcgctggtccccttctttgccggaataaaacgccgcgtcggctggcgcggagaaatgcgctatggcctgctgaatgatttgcgcgtgctggataaagccgcatttccactgatggttgagcgctacgttgcgctgggctacgacacacctgttgcttcggcggcgcagctgccccagccgctgttgtggccaaaactgcaggttgaagagcaggaaaaaattgaaacggccgcacagtttcagctcgccgcgacccgtccggtcatcggtttttgtccgggcgctgaatttggtccggccaaacgctggccgcactatcactacgccacgctggcccgccagttgattgctgaaggctttcagatcgtgctgtttggctccgccaaagatcgcccgaccggcgaagagattatcgcggcgctgcccgaagaggctcgcggccactgccgtaatctggcgggtgaaactcagctggaacaggcggtgattctgctggcacaatgccgtgccgtggtcagcaacgactccggcctgatgcatatcgccgcggcgctggatcgtccactggtggcgctctatggaccaagcagccctgactttacgccgccgctggcaaagcaggcgcgaattattcgcctgattaccggctatcacaaagtgcgcaaaggcgatgccgaacagggctatcaccagagcctgatcgatattcagcctgaacgtgtacatcagacgctgagcgaactgctcgcgccacaggaggtgccatgcacgtcctgattgttaaaacttcgtcaatgggcgatgtgctgcattcgctcccggcactgaccgatgcaatgcatgccattcccggcatccgtttcgactgggtagtggaagagaatttcgcacagatccctggctggcatcccgcagtagataaggtgttaccggttgcgattcgccgctggcgcaaacactggtttggcagtcagcagcgtgaagagcgcgtgctgtttaagcgcgcgttacagtcacgtgattacgatatcgtgattgatgcacagggcctgatcaaaagtgccgcgctggtcacccgcttatcgaaaggggtgaaacatgggcaggacagccgcagcgcgcgtgagccgttcgccagttggtggtatgacatccgccatgaggtcagtaagcgacagcacgcggttgagcggacgcgcgaaactgttcgccaaaagcctgggctatgaaaagccgcaaagtcagggtgactacgccattgccggacacttcctgcatcatctgcccgctgacgcacatcattacctggtctttctgcatgccacaacgcgtgacaacaagcactggccggaatcacactggcgacagctgattgagcagatgcagcccagcgggttgcgggtgaaattgccctggggtgctgaacatgagcatcagcgtgcgcagcgccttgcagaaggatttgagcatgtcgatgtactgcctaagctgacgctggaagcgatagcacaacagctggcgggcgcacgggcggtggtctcagtggataccggattgagccatctgacggcggcactggatcgccccaacctcacgctgtatggtccgaccgatcctggactgattggcggttacgggcagaaccaacaggcactgagcgccccgaatcataatctggcagagctgactgctgacacggtggcagagaaactgcgagccgttattacggaaaacatgccatgaactatgtgctgatctacctgcttctgctgcctttccgggccataatgcggctgttttaccggccaaccggacgcagcctgatcatccagacggcaaagattggtgattttattaatatcaccccgatgctgcgtgcgctgggtcagtctgagttgctgatcagcaaagcggtggagccgctggcgcgtcacgatgacacggtcagccgctatttcctgattgaagaggcgaagcgcagcttttttgccaaactgaagctcgcgttcactctgatgaaccgctatgacaacgtctatctggtgcagccaaacagcgtgaacctgtttttcgccgcgctctgcaacgcatcgaacaagcagtttctgcgcacctatgtgcgtaagtcctaccataagaccttctatcgcagcgccagcggtattgtcgaccacaccaaaacggatttaacgctcgacagctacctgaagctgattaatcgtgactaccgctacaccgatttccctaagcatgcgacctcaccgctctggcagccgcctgcgccgcccgccgcgctgcttaatccgcgcagcggtattaaaattggcatcagtatttctgctggtaaccgggctaaaaccattcctgccagcatctggcagcagctgatggcgtcgctggctgacctgccctgcaccttttatgtgtttggcccaccggctgagcagccgtggctggatgagttactgagcctgaccggcccgaaagacaatatcgtcagtctgattggtgagctaaaactggaagaggttccgtgggccattgcacagatggatttctacatctcctctgactctggcaatgcttatattgcggatgcgcagcagataccggtgatcatgctttacgggccgtgtgaagtcagggaacagcgtccggtcaataacgttttgtttatcggaccggataatattgctgcgtcgacgttcgtttttgccacccgttttcagtttgatcagcctgctgaaaaattattcgggctggatcacgataaactgactagaatacaaacgtttattactcataatctggaatagtgaagcgtaatggcaattacccctcttgctgaggccgttcagcaaagtcagctgctggttaacacgcttgctgacacggatgataatccggttcatgttgcgtttggcatcaactacgcctacgcgcgtggcctgggcattacgttgttttcacttctcagccatcatcctgataccgctttccacgcccatgttttttcagactcgctttgcgaagaggatgtggaaaaactgcgttcactggccacgggccatcgtctggcgatcacgctgcatatctttaaccgtgcctgggttgatcagctgcctgcggtcggacgctatcccaaaagtatccactaccgtttcctgatcccggaaaccgtggcgagctacagcgatcgggtgatctatattgatgctgacaccctggtggtgggcgactactctcccctgttcacgctggatatcactgattacacgctggcggcctgtaatgacacaccgcgagcgcgacataaccagtgcgcaaggctggggctgaagcaccaccactatttcaactccggctttatgctgattaatattccacgctggctcgaaaggcagaccaccgcgcgcattaccgacgtgctggtaacgcggggcgcagagtttggttttcccgatcaggatgcgctgaatatcgtgctggaggatgaggtcctgatcctgccagaccgctataaccacatttacgacatcatcgccaataaagtctgggatcactcgggcgtgcctgaagagacggtaatgattcactacaccggtaaatgcaaaccctggcatgcatgggctggcagcgatctttcccagcgctactatagctattaccagcgctcaccctgggcttcacaaccgcttgatacgccaaagcattataaagaaatgaagcgattcgcccgcgtaaaatggcatcagaaacagtatgctgaaagcctgagctggatgatgaagtatgtcagtctcaagttttttaaacagagtgagcaatagcacactcaggtttatcagattgatgcgggcgctgttatttcagcgcctgactttcccgtcacttatcccgccggctgtttgccacgacctctgtaataacgacgctgacagcaagccagcataataatctgtttacctgcacgaccacattgcgtaaaaaaagcgcatatagcgcattattattgtcgggcgtggtttttagtaaagcagggatgcaacatcgttttataattgtgaactccctgatttcactctgctgatttggaaatgatttatgacgaggcaacgccttttcgcagtgaatacaatgctggtgcagatattgtcatgagtacttctcctctgctgagtatcattaccccgatgtacaatgcgggcagcatgtttgatgagttcatgcagtcactgctggcgcagacgctgactctgcttgagatcattatcgtcgatgacggttcaaccgatggctcaggcgagcgcgccgatcagtatgcacagcagcattctcacattcgtgtgatacatcaggaaaatggcggcgtctcgcgcgcccgcaacgccggactggcgattgcccgcgggaaatatgtcaccttccctgatgcggatgacaccatgcaacccgatatgtatcagacgctggtgacactggcggaggcagataatctggatgcggcacagtgcaacgccgagtggtttttcaaacacagccagcgggtaaagccgctgattccgctggatcgcctgcgcagcacgccggtgctgagcggtgccgactggctgaataccgcgctaaaaacccatcgttatatgcatgtggtctggctgggcatctatcgccgggaactgattgagcagcatcagttgcagtttgaacccggcctgcatcatcaggatattccctggaccaccgagtttatgctgctggcaaaacgcgtgcgttataccgaggcggtactctatcgctactatatgcatgacgcctcaatcagcaatcgcaaacgtaccggcgagcgcaacgtagagtatcagcgtcactacatgaagattgcgcgactgctggaagagctcaatgaccgctatcgtgaccgcgtgaagatctacccgtcgtttcactatcaggtgacccatgaagcgctcagtgtttgccacagtgtaagacgtgagtctgacgcccgcgcacgccaggcaatcattgccgagctgtttcgccacccggacacacctgcgcatgttacgcaacgcccggggaattaagcagtggtatcagttgctgttgtggctggcccggctctatcgctggcgtgataaataacctttgaggctggctttatcctaaaaagggtttgccctacaatcggttcactgaattctgagaactcttgtttatggccagcctgactccagcaaacatctctccaaaaaatatattactgattaagctgcgccatcatggtgacatgctgctcacaacgcccgccatcaatgcgcttcatgagcgttatccgcaggccagcatcgacgtgttgctctatcaggagacgcgtccgatgctggaagcgcatccggctatccgccatttgcacgtcatcgatcgtaaatggaagcaggagggcacctggcgcaagctgggccatgagcgtgcattaattcgcgccatacgtgccgcccattatgatctggtgattaatctggccgatcagtggcgggctgccctgattacgcgtctctccgcggcgccagtacgtatcggtttcgcttttaaaaaacgcgataacgtcctgtggcgatggtgtcacaaccagctagtctccacacacaatcacagcaagctgcataccgttgagcagaatatgtcggcgctggcccccctcggcatcagcagcgacggcgcacgtgtctcaatgcactacagcgacgctgaccagcaaattgtgctgacccgactggcagagcatcaggtcaccgcgccctatattgtggtgcagccgacctcacgctggggctttaaatgctgggaagaggagagcgttgctgccacgctcgatcagctggcgcagccgggccgcaaagtggtgctgaccgccgggccggacaaacaggagctggcgatgatcaaccgcattcgggcactgtgtgcgtcgccggatgtggtttcgctggccggtcagtttactctgccacagctggcggcgcttatcgatcatgcccgactgtttattggtgtcgactctgcaccaatgcacatggccgccgcacttgaaacgccgtgtattgcgctgtttggtccgaccaagctgcagcactggcggccatggggcgacaataatcatgtcatctgggcgggggattatggcccgctgccctcacccgattccatcgacaccaaaacagaccagcgttatctgtcggccattccggtgaaggatgtggtcgcggcagcgaggagctatctgaatgagtaagttacggctggcgattgtccggcagaaatatcgtccggatggcggtgccgagcgttttatctcgcgcgcgctggaagcgctgggcagcgagcagctcgatctcaacatcattacccgcagctggcagggcacacccaatcctgactggcatctgcatatctgtaatcctgcaaagctgggccgggtatcccgtgagcgcggttttgcccgtgcagcacgcgcctgctgggagcgcgaaaagttcgatattgtgcaaagccacgagcgcatcgcgggctgtgatatttttcgcgcgggtgatggtgttcatcgcgtctggctggaacagcgcgcccgcatcgtctcatcgtggcaacgactgagtgctgtgctcagcccttatcatcgctatgtcctgcaggcggaagcggagatgtttaactctccgacgctgaaagcggtgatctgtaattctgagatggtaaagcgcgatatcctgcgctgtttctcgctcgacgccggaaaaatccacgttattcataatgctatcgatgccagccgtttccagcccgccacggaagctgcacgtcgcgccacccgtcagcagctggcgctgcccgatgcggccaccgtactgatttatgtcggctccggctttgaacgcaaggggttgaaagcggcgatacaggcgctggctgccagcgaccgttatctgattgtggtgggtcaggataagcaactgcaacggtatcagcagctggcaaatcagcttaactgtctggatcgcctgcgctttgtcggcgtacagcaggatgtgcagccgttctatcacgcggctgatggcctgctgctgcccaccctctacgatccttttcctaatgtggtactggaggcgatggcctgcggcttaccggtgattaccagcactggctgcggtggcgcagaatttattaccgctggtcaggatggcttcgtctgtgatgctttggatatcaacgggttaaatcaggctgttaatgcaataccggcgctttccgtcgattcacgaatgggcgacgcggcgcggcgcaaaattgaaccttatggtccacaacggctggcgcaggcgctgacttcgctttatcagcaggtcctgagcagcaactgacaatgtgggatgagtgcatgcggggtttctgataacatgccgccatctgattttaatctgcttttagacgcgaatttgctgtaacggtaactatgacgaccttttacaccgcattgctctacttaattcagccactgatttggctgcgcctgtggctgcgcggtcgtaaagcgcctgcctatcgcaaacgctgggcagaacgctatggctattgtgtcggcaaagttaagcccgacggcattgtgctgcactcggtctctgtgggtgaaaccctggccgcgatcccgctggtgcgcgctctgcgtcatcgttacccgaccctgccgattaccgtcaccaccatgacgcctaccggctctgaacgcgcgcaatctgcatttggcaaagatgtgcatcacgtctatctgccttatgatctgccgggttcgattaatcgttttctggatacggtcaacccacgcctggtgatcatcatggaaaccgagctgtggccgaatattatccgcattctgcaccagcgtaatattccgctggtgatcgccaatgcccgcctctcggcccgatcggccaaaggctaccgcaagctgggtaaattcatgcgccgactgttgcagagcatcacgcttatcgcggcgcagaatgcggaagatggcgaccgcttcctgagcctgggcctgaaacgttctcaactaacgattaccggcagcctgaagtttgatatttccgtgacgccagaaactggccgccagagcggtgacgctgcgtcgtcagtgggcgccgcgccgtccggtgtggatcgccaccagcacgcacgaaggtgaagaggccattgtgctggatgcccatcgccgcctgctgcagaccttcccggatctgctgctgattctggtgccccgccatcccgagcgttttaacgatgcccgtgaactgacgcaggaacgcggcttcagttttatcctgcgcagcagcggcgagatcccgtctggctcaacgcaggtggtcatcggagattcaatgggcgaactgatgctgctatacggcattgccgatctggcctttgtcggcggcagcctggttgaacggggtggacacaacccgctggagcctgctgcccatgcgcttccggttctgatgggaccccatatctggaacttcaaagatatctgcagcaagttgcaggaaggccaggggctgatcaccgtcaccgacgtgatttcgctggaaaaagaggtcaccaacctgttacaggatgatgattaccgccgttattacggacgtcatgcggtagacgtgctgcaccagaatcagggtgcgctacagcgtctgctacagttactcgaaccgcatctgccaccacgggcccactaatgtcagcacgccaacgtctttccgtggtgatgatcgccaaaaacgaagcggaactgctgcctgattgcctggcctcggtcagctgggccgatgaaattatcgtgctggactcaggcagccatgacaacagtgtcgacatcgccacacaggctggggcgaaggtctacctcaatgatgactggcagggctatggtatccagcgccagcgcgcgcagcactatgccaccggcgacatgattctgatgatcgatgcggatgaacgcgtgacacctgaactgcgcgccgcgattgagcaggtgctggtcgcgccacccagccgtacggtttatagcctgggccgcagtaatctgtttctcggccgctttatgcgccatagcggctggtatcctgaccgagtaatgcgactctatcctcgcaccttccgctacaatgacaatctggtgcatgaatcactgcagagtgacggcgcgccggtggtggcattacccggcgatctgcagcatctgacctgccgcgatttaatcgcctttcagcgcaagcagctggcttatgccgaagcctgggctacggagcgccatcggcgcggtaagcgttgcagcctgttttctctgttcagccatacgctgggcgcgtttatgaaaaccctgctgctgcgtgccggttttctcgacggaaaacagggctggattctggcggtggtcaatgcgcaatataccttcaataaatattcagccctctgggcgctgaatcatgcttcggcaaaagggcgagtatgatcacgaaagccatctatcccggaacgttcgatcctgtgacgctcggccatctcgacatcgtgacgcgggcagcgcagatgtttgatcaggtcattctggccgttgccgccagccccagcaaaaaaccaatgttcagcctggatgagcgcgtggcgctggccggtgaagtgatagcccatctgcccaacgttgaggtggtcggattcagcgacctgatggcgaatttcgcccgtgaccagcaggcgaatgtgctggttcgtggcttgcgtgcggtgtcagactttgaatatgaaatgcagctggcgcagatgaatcgtcacctgctgccaacgctggagagtgttttcctgatgccgtctgaaggcttctcgtttatctcatcttcgctggtcaaagaggtggcgcgtcacggcggcgatgttaccgccttcctgcccgcgccggtgcatcaggcattgctggctaaactggcttaatgctggcagtttcgggcaccagtaggtgctgcgctgcccgtgtctgccgctgacaatcggcgtaccgcatgcccggcagggttcgcctgctcgcccataaacctgtaactgctgtgcaaaatagccaggtttaccgtcgctctgcaagaagtcacgcagtgtggttccgccctgctcaatggagcgtaacagcaccgctttgatggtattgaccagcagttccgcttcggcctgcgacagactgccggcagcacgatcgggaatgatcccggcggtaaacagtgactcgctggcgtaaatgttgcccacgcccaccaccactttgttatccatcagccactgcttgatgagcgtccgcttgccgcgtgacttctcaaacaggtaagcgccgtcaaactcctcgctaagcggctccggcccgagatgtgccagcacgctgctgcccgccagatcgctgctccagagccaggcaccaaagcggcgcgggtcggtgtagcgcagcactttgccgttgctcatgaccagatcaacatggtcatgcttcgccgctggcagctcttctgacagcacgcgcaggctaccggacatgccaaggtggataatgatccagccatgcggcagctccagcagcagatatttcgcccggcgctgcacactgagcaccggctgatcgcttagcgccaggatctcctgcgaaacaggccagcgcaaacgtgaattacgcaccacggcgtgaaggatggtttcaccgaccaaatgcggttcgataccgcgacggctggtttcaacctctggcaactctggcataccctctcctcagcgttttacacaaacaaaaaacccggccggagccgggtttttagcagaacactaaaattacttaattttagcttctttgtagagcacatgctgacgtacaaccggatcgaactttttcagttccagcttctctggtttagtacgtttgttcttcgtggtggtatagaagtgacctgtaccagcagaggaaaccagcttgatcttctcacgaatacctttagccatgattcagttccttagtaccttagtacttctcaccacgggcacgcatatcggctaacaccgtatcaatgccctttttatcaataatacgcatacctttaacagatacacgcagagtaacgaagcgcttctcgctctcaacccaaaaacggtgtgagtgcaggttcggaaggaaacggcgtttcgtcgcgttcattgcgtgggaacggttgttacccgtcaccggacgctttccagttacctggcagactcgtgacatgtcaatatctccaaaaatcaaatcagctcgagctttaaaaattaggtttgggccgcctcgtcaggcttgcagcccgccaggcgaattccatggaacccgctaagctggcctaaccgccaaacccgagattctcaaaggtggcgtagtatacgccgctcagcccaagtgctcaagtcccgaacagataaagatcccgaatgatcgggcaaaaagccgccacctggcgtgaaatttccccctgtcagagccatccccgctcggcaaaggagacatattcgccatgaccaatcaccagatgatcgagcagacggatgtcgagtagctggcaggcttcgctgactttatgggtcacttcacggtctgcacggctcggctccgccatgcccgacgggtgattatgcgccagtatcagagcggcagcattgagcttcagcgcttcccggacgatctcgcgggggtgaacttccacgctgttaatggaaccagagaacatattttgtgcccgcagcacccgatgctgattatccagaaacagtgccatgaagatctcacgctcctgatgggctaacagactttgcagatactggcgcgtgatttgtggattttccattgcgctttcgcgggccagcttactggcgaaaaaacgcttcgccagtttcggcaatcgcatgaagctgtgccagcttggcatcgccgacccctttgatttcaccgaatgccgctttgtctgacgtcatgagctgataaagcgagccaaaaccgtccagcatctgtccggccagctccaggacgttctgtccaggcgatccggtacggagaaaaatggccagtagttcggtatcgctgagggcatgcgcacccagcttccggagtttttcccgtggtccctttattttcatgtccgctctccctgagatgagcctcagcatggcccatcatgaagagtgcagctatcagtgaagctgcaatctacgagacggctcgcaaacgcagtcagtgaaaaggcgcatccgcgcttttgtgataaagtccgtgcattcgccgccgcgagcggcagagagcttagtgaggccaacatcatgatgggattagccggcaaaaaaattcttcttggcgtgagcggcggtattgctgcttataaagcacctgagctggtgcgccgcctgcgcgatcgcggtgctgatgtccgcgtgatgatgacagagggtgcgaaagcatttattactccgctcagcctgcaggctgtctccggctatccggtatttgacgatctgcttgatccggccgcggaggcagcgatgggtcatattgaactggcaaaatgggccgaccttattgtgctggcaccggccactgctgacctgattgcccgtattactgccggtatggcaaacgatctggtgacgaccgccgtgttagcgacggcctcacccgtggcagtggtgcccgctatgaatcagcagatgtatcgtgcggcggtgacccagcataacctgcagagcctgcaggcgcgtggcgtgctgatttggggaccggacagcggcagccaggcctgcggcgatgtcgggccgggccggatgctcgacccgctggtgattgttgaccatgcggtgcagtgggcctcgcccgtcaacgatctgcaacatctcaacattatgattaccgccggccctacccgtgaggcgctggacccggtgcgctacatcactaaccacagctccggcaaaatgggctttgctattgccgacgccgccgccagacgcggtgcacaggtcacgctggtcagcggcccggtcaccctgtctgcgccagcgggtgtgcggcgaattgatgtgaccagcgcgctggagatgcaggccgccgtcatgagtgagatagataaacaacatattttcattgcaagcgcagccgtggcagactaccggccagccgatattgcggccgataaaatcaagaaacagggcggcgatgataacgtcacgctgaacctggtaaagaatcccgatattgttgccggcgtcgctgcacttcaggaaaaccggccattcgtcgttggatttgctgctgaaacacagaatgtggaagaatacgcccggcaaaaacgggtgcgcaagaatctggatctgatctgcgctaacgacgtcgctaaagccggacaggggtttaatagcgacaccaatgctcttcaccttttttggcaggatggagaaaaacgcttaccgctcagcgataagtctctccttggccaacaattaatagacgagattgtcagccgttatgatgaaaaaaatagacgttaaaatcctggatccgcgcgtcggcaaagagtttccactgccgacctacgcgacttcaggttccgctgggttagatttacgcgcctgcattgatgatgttctcgacatcgcaccaggcaccacaacgctggttccgaccggcctggcaattcatattgccgaccccgatctggccgctgtgatcctgccgcgctcaggccttggccataaacatggcatcgtgctgggcaacctggtgggtctgattgactccgactatcagggacagctgatggtctcggtctggaatcgcggccaggaaagcttctcgctgcagcccggcgatcgcatggcacaactggtctttgtaccggtggtgcaggcggaatttaacctggtcgaagatttcgacgccagcctgcgcggcgaaggcggcttcggccactccggtcgccagtaacccgcattaccgactttcacttacgcccgttattttttcctcatcgccacaggacgcgtttcctgtggcagatgcgtaggtgttgcctgtttttaggtgaatttcaggggtctttaaggtcatggcagaaaaaaaagtcgcgaagcggaatcgtcgcgaagagattttgcaggcgctggcgcagatgctggagtcgggtgatggcagtcagcgcattaccacagccaaactggcagccacggtgggcgtttccgaagcggcgctgtatcgtcacttcccgagtaagacacgaatgttcgatagcctgattgagtttatcgaagacagtctgattacccgcatcaatctgatcctcaaggatgaaaaagagaccatgacgcgtctgcgtctgatcgtgcaactgattctgggatttggtgagcgtaatccgggactgacgcgcattctgaccggccatgcattgatgtttgagcaggaccgactgcagggacgcatcaatcagctgtttgagcggattgaagtgcagctgcgacaggtgatgcgggaacggaaaatgcgcgagggcgaagcctttcaggctgatgaggcgctgctggcaagtcagttgctggcattctgtgagggtttactgtcacggtatgtccgttctgagtttcgtttcagtcctaccgcagactttgaggctcgctggccgctgattgccgcgcagctggcgtaaagcgcaaaagaaggcgggcattgcgcccgcctctgttaaatcccgtacgctttctgataggcacgtacctgagccagatgatcggccatctcaggcttctcttccagccaggcaatcaggtctgccagcgtaataattgcggtcactttgcagccgtaatcacgttccacttcctgaatcgccgacatttctccgcgtccacgctcctgacgatcaagcgagaccagcacgcctgccagagtggcgttgtgcgcaccgataatatccatcgactcacgaattgcggtgcctgcggtgatcacatcgtccaccagcatcactttgccctgcagcggactgccaaccagcaggccaccttcgccgtgatctttcgcttctttacggttaaagcagtaaggcacatcgcggtcatgatgatccgccagcgccaccgccgtggtggtggcaatcggaatgcctttataggccgggccgaacagcagatcaaactcaacagcgccatccaccagcgcctgcgcgtagaagcgtcccagcagcgctaaatcccgtccgctgttaaacagaccagcattaaagaaataggggcttttacgcccggacttcaaagtgaactcaccgaacttcagcacctgcttgttcagggcaaattcaataaactgacgctgccaggctttcatttctcactcctcaaataaagaaaaggcgactctgaggtcgcctgttacatcaattttccagcgctgctttctgcgcctgaattaattcctcaattccgccccgagccagcgccagtagcgtcagcaactcttcatggctgaacggttcgccttcggcagtgccctgcacctcgatcatgcggccatcttccagcatcacgacgttcatgtcggtttctgcggctgagtcttcaacatactccagatcgcacagcgcttcgcctttgacgatgcccactgaaatcgccgcgaccatgcccttcatcgggttcgctttcagtttgccgctggccaccagcttgttcagcgcatcagccagcgccacacaggctccggtgattgatgcggtgcgagtgccgccatcggcctgaattacgtcacagtcgagcgtaatggtaaattcacccagcgctttaagatcaaccgcggcgcgcagtgaacgggcgatcagacgctgaatctccagcgtacgtccgccctgcttgccttttgcagcttcacgcgccatacggctgtgggtcgaacgcggcagcatgccatattcggccgttacccaaccctggccctggcctttgaggaaacgcggaaccccttcgtctaccgaggcagtgcaaagcactttcgtttcgccgaattccaccagaaacggaaccctctgcgtgtttggtgtaattgcgggtcaatgtgactggacgcacctgttgtgcgctacggcctgctggacgcatgggtattctccggcttgctaatgattggctgcgcattatacggacttccttgtccgctgtctcttacgctggtctgacgcaggcatcagatgaaattccccgccagctgtggctaaatgcgcgttcctttctctctgataaaaaagacatatggccgccattcttcatttcctgctggcgctggtggtgatttttgcccttgcgctgctggtcagtcatgaccgtaaacagattcgtctgcgctttattgttcaactgattgtggtggaagccgcgctgggttggttcttccttcactctgccgggggtctggcgctggtcggttcgttcgccggtttctttgaaacgctgctgggttttgccgcacagggcacggagttcgtgtttggcggaatgagcaaacaggggctggcatttatcttccttggcgtgctctgcccgattgtctttatttcggcactgatcggcatattgcagcactggcgcatcctgccgctgctgatccgtattttcgggacgctgctgtcgaagattaacggcatgggcaagctggagtcgttcaacgccgtcagcacgctgattcttgggcagtcggaaaacttcatcgcttataaagggattctgggtgatatcccgccgcgccggctctacaccatggcagcgaccgcgatgtctaccgtttcgctgtcgattgtcggtgcttatatgtcgatgatcgaaccgaaatatgtggttgcggcactgctgcttaacatgttcagcacctttattatcctgtcgatcatcaacccgatgaaaagccaggatgagcagcctatcgcgctggataaactgcatgaagagcagagcttctttgagatgctgggtgagtacatcctggcaggcttcaaagtcgcgatgattattctggccatgctgattggctttattgccctgattgctgccgtcaacgcgctgtttgcggcggtgttcggctacagcttccagcaactgctcggctacctgttctatcctctggcctggctgattggcattcccaaagccgatgccctgcaggcggccagcatcatggcaaccaaactggtggcgaatgagtttgtggcgatgattgaactgcagaaagtcgcggcaggcatgagtgcgcgtggactgggtattctgtcggtgttcctggtctcgttcgctaactttgcctctatcggcattgtggcgggcgcaataaaaggcctgaatgagaaacagggaaatgtggtttcccgttttggctggaagctggtctatggctccacgctggtcagtttgctctccgcagcctttgccggtctgtttatctgattattcaacgggcggcaattctgccgcccgctttcgccttagaatccgacgcagacgggtgcatccacccgcataaccgactcctgaccaaaccgttttttatagaggctgcgtaacgcctcaatatcaacgttggtggcggggtcgatcccgtggatcagtatcaacgccttactgtttctcccgtgccagctgaccgttctcgcccagccattgccctttggcatcatagaccgacaggcccgctttaaaccgtggcgtgacctcattatccacgaagttcatccagtcgagtgaactcaccctgccgccatcaggcttgctcagtccaaaccacaacgtggtctgcatcatcatgtcgccacccgcacagatgggttgcggtttagtgggcggcgagtggcgtgcctggcaacctgccagcagcagagccatcacaacaggaagggcaataacgcgagacatagatcagtcatcctcacaaagggtcaacggccatcataagtggctgtcgctgaaagcggaaatggttcgttattttcctgtgcgacgcttatgcctgttatgccgtggctcgcctcgctatacttcacccatctttccgcaaatgagtaccgcttatgatccgcagtatgaccgcttatgcccgcagcgaagccaaaggcgaatggggcagcgccgcctgggagctgcgttccgtgaaccagcgttatctggaaacctacatccgcctgccggaacagtttcgtgggctggagccggttatccgcgagcgcattcgccagcgtctgacgcgcggtaaaattgagtgcaaccttcgttatgatgccgatcccagcgcacagggcgaactgatgctcaacgaaacgctggcgaaacagctggtgcaggctgccaactgggtaaaaatgcagagcgacgaaggcgcgattaatccgctggatattctgcgctggccgggtgtgatgtctgcgcaggaacaggatctggatgccatcaacacccagttgttgcaggcactggatggtgcgcttgatgactttattgcggcacgtgaaagcgaaggtaccgccctgaaagcgatgattgagcagcgtctggaaggcgtctcgcaggaagtcagcaaagtgcgcgcgcagatgcctgaggtgatcaaatggcagcgtgagcggctggtcgccaaactggaagatgctgaagtccagctggaaaacaatcgccttgagcaggaaactggtgatgatggcgcagcgtgttgatgtttctgaagagctggatcgtctggatgcgcacgttaaagagacttacaacatcctgaaaaagaaagaagcagttggccgccgtctcgactttatgatgcaggagttcaatcgtgagtcgaacacgctggcttcgaagtcgatcaacgccgaaatcacgacttcagctattgaactgaaggtgctgattgagcagatgcgcgagcagattcagaatatcgagtaatttccacacctgcacagtacatcccacaagcccatgttaaatgggcttttttacttttccatgatgcccatattccactgtcaaagttcactggttttgggagtaaagtggggaaatcgtctgcttaaccagctattaatgaatagtcagaatggtgtagtcctgagtctggtttaacaggtcagttatatgggtaacattttttcctgtgaggtcagggatagtcattggtcataatgaaaggtgggacttacactccttcacttttccgaccatgccgtttagtattacatcagtctgcttaatacctgcgactggtagttatatgaacagggctgtagcaaagaagcattggattttacagatatgtcgatattaaaataatttagcattcgattaattacattatttttcaggatgaaacattaatatcacaaggaagtcatcatgccagcattgaagtttcctgccaccatttttcaaacgaagcacaagtttaacgattacagcactgatgatatgaagtgtggagatctcactgaaaaacagctaagaagtgatttagacctggatgatgtttcaaatgtcgtcaatccctggactggaaaggaagtatcaatatttaacgcctttcagaatacccgtcgaaaatccagaacggaaatggctgaacttcttttcaatgagtttcttcgtctttctatgcctgcatattaccctgggcaacatcaaatattcaacaatctcgtaaagcatctttatcacggtaacggaaaaagctattccagtccctttcttgatagtgcatataagacgctaatattaggtggtcaaacatcgccactctcaccacttacagtaatcaaatcttcattagataaaattattgttgatggacaaaaaagcttatcagttacagataaagatttaataacacaagctataggcaattcaatacttcctaagtttaaccgttgggctgacagtttcaatggattaggtatgtcgatacatgatattcatgctacaaacatactgataaaccagctcgatataactgacaatggttatatcgcaaaaataacttttacagggcaggatcatttcggtctcgataaaactgacatccagaatcctaaatttcattttatcagagcctttcgtatatggtttatccttcaaagatgggaatactttgcatttaagccttttttaaccaatatgaaagctgagtttgaaataaatagcaggagaaactaatgcgaattaaaaagattattatttttattgtggcattggcaatgttactattgttttacgtgagcttctttagttctccaaaggtgcttgcaattcatggtcctgaagctaataaagaattattagttaaaaatatgcctttcactgatagcgataaaatcgaatggtgggataataatggagttaaaaccatctcttcccctgaaacttacaatgtttcaatctggaagtttgatgggaagtatcaaaagctcgctcccaggaactcaggggcttttccagaccatgatactgattacttattatgcttcgacgacatgaaaacagaagaaaattgtatagacaagtcaacctggatcatggaaatcactaagacaaaggatggttacacttactaccgtcttgatggaaagtcttactatcgaaaaccatccggtgaactggtcaaaggtgaaagatttacgacaaccatcaagccagtaagctgatgagcttgtagctgtgctcatcggaaactggattgatgagtagaatagtaaatcgtcataaaaaaccaaaataagaagctgatttttataagatttactcaaaatcatcattcatatccagaagatcgagtaatttccactcaacaaagcgctcgcagtagcgctttgttcccctgtcaggcgctgtcagcacttaaagagttagctccttccgtcaattgatcgctttttcagcgcggccagcatcagaatcaggtaaagataaataaataatcatttccagactgttcctgaaacggcctcgcttacaattaaagctgctttcaggcttagattaagcagttgaaaaataatgattttataggattaatgtacttttatagccggtattaacgcctctccatgaaacaggtcaatcctgtagatgccggagtttccctttctttgaaggcactttttgataaaatgttggtcgaaatcagtacagctgtaccgccttaagactcatggaagtgctctttgtgcgatgcatccctctatcccatgaaggttgttaatgaaaaacaccggaaaatttagcagttcgctgctgcatccgcgttattggtttacctggtttggccttggcgtactctggctgctggtccagctcccctatcctgttcttatgcgtctcggtgccggtgccggcaaaatctctcgccatttcctgcagcgccgcgagcgtattacccgtcgtaacatcgaactctgctttccgggcatcagcgaagaaaaaacagaacatatgattgccggcaatttcgcgtcgcttgggatggcgctggctgaaaccggtattgcctggttctggtctgaccgtgcggtaagacgtctgtttaaagtgtcgggaatggaaaacctgcatgctgcgcagaaagaaaagcgaggcgtgatgctgattggtgtgcatttcatgtcactggagctgggcggccgcatcagcggactctgtcagccaatgatggcgatgtatcgcccacacaataaccaggcgatggagtatgtgcagactaaaggccggatgcgctcaaataaagcgatgatcgaccgtcgtgatctacgcggtatggttaatgccctgaaacagggtgaatcggtctggtttgcgcctgaccaggattacggccctaaaggcagcacctttgcgccgctgtttgcggtggaaaaagccgccacgactaacgggacttttgttctgtcgcgtctggcgaagccagcgatggtgccgattatgctgattcgtaatccaggaaatgatggctaccatttgatcatcgaaccgatgctggaaaattatcctcatacggacgaggctgctgctgcagcttatatgaacaaagtaatcgaaaatcagatccttcgcgcacccgaacagtacctttggctgcatcgtcgcttcaaaacccggccaccgggtgaaaagtcgctctacgtctgagttaactgataaagcaggcctcgtgcctgctttgttgttttaatccgctgaacgacatctgctttacgtccactctctcatccccgtttgctgtgctctcatactgcctctgccgttatagctacctctacagtttctgctgttcagcacacctgtctgcttccggcaggctggtatcaaagagataattaaggaatgatgaatccccttacctcgtcaatgccggacaatcttatggatatcaacgatacacagcagtggcagcgtccgctgattgatgatcgccttacgccctatattgaagtggatgcagagcgcctggagcagaaaacctgcagcatatgcagcgcaaagccagtgcggcaggcgtcgcgttgcgaccccatatcaaaacgcataaaagcgtctggattgcgcagcgtcagatcgcgtccggtgcacagggtgttaccgtctctaagcccagcgaaggcatcagctttattcagggcggtgttcgtgatctgctattagcctatccgattgtgcaaccgcaaagcgtggctgaattgctgcgccacgccgtgcttcatcaggcaaagctcaccctgattgcggacaggctgcagggcgtggcggctattgctgatgcctgccagcagcaaccggaatgcgacctggcggtagcgattaaggttgatgttggattacatcggataggtgtcaatcctgatacagatgaagcggtgctgattgctcaggcgctgcaggacaaagggttacgctttgccggattagtgtcacatgctggccacgcttatggtgccgggaatgccgcggccattgcggatgtcgcccggcaggaaacggcattgatgcagcgagtacaggcaaaactgcaggcggctggttttaccgactgccctctctctgtaggttcaacgcctacggcgctggcagcagagattgcaccctgcatgaatgaaatccggccaggaaactatgcactactggacctaatcgcctgccgtctcggattaagtcacgtcgatcagctggcaatgagcgtcattacccgtgtcgtggcggtgaacgatcatttcgcgattgtggatgccgggtcaaaaatgctgagttcggataaagggccacacggcaccaatgccagcggctttggtgtggcagccgacgaagcgggtcagacttatgaagtgacaaaattatctgaggagcacggttttctgctttatcaggatcgccgccctgaagtcggcacgctgctgcgtattttccctaatcacagttgtgccgtgatggcgcagtcggacggctttgttctgcggcacgctaacggccatagcgaagatcatggggtttctgcgcgcggcaatttcatctgagtcagtggcagacagcatcatccgttgtctgccatttgtacgaaaccctttcaacaacacacttctgctgttacagcgttttaacaagcctgaccacatgctttaatgcctttttagcttattcaccggaggttacatgctctcctctcgcactctgagcctgacgattccacgtcactggttagatctttatgaaaccatctggaagccagagtttttcccaaagtgggcttccgggctgacgcacagcgcgttagaaacccgatggcaatcgctggcgtgctaaaggcccccagggcaatgtgaagatccggttctcgccacataatccgtttggggtaatggatcactggattgatagcggctcgggaaaggagatctacgtaccgatgcgcgtgatagcaaacgaacagggcgccgaggtgatggtaacggtttatcgccagccatttacttcagatgaaaaatttaagcaggatattgaatgggttagcaacgatcttgagaaactcaaccagcttcttacacaataaatcaatgacttagcgcgcctttttctctgcatttatcactggccgttaatgaaaaaaaatagaaaaactttcgacgataaagcataaagcgcttatctgattactcatcatccttacgcatttatcaccaaccctgcttaagcatcgctgccaggaaaaatcctggcaaaatcctctgaaaggcaggcgaccccctctgatttcgggcctcctggtttgccgcacaaacaatttctgactgacccatacattaatcattaacaatcgtttattagcaatctgctgaggatttaatatttatcatgcataaagtgaaaccatttatttctgtggtcacgtaatcagacttttcttatggtgttaaattaaataaaacaatgtataaatcattccacacacagcaatacccataatgataaagcaggaaaaaagtcatggaccgctcaacgtatcctttgttatcagaaaaagaatgcgttgagattgccgcaaggatgctggcaggagaatataaaactacaacaggatttattcgtgatctggcggaattcttattcgctgaagggaattccgccatgacacgaaacagcgattttaccagggatatcttttttatccaggcatcatttgattgaatccataataacatggcaagcctgtaaagcgttttcaggacttcggccggaaaaattgcactaactaacggtgttacagcaacctctccttgccgttacacaactatttaattctcacagagtcgatggactctaacgagtatattatggcaatacgtgaaagcagtctgaatggcgcaaaatggtctctgctctcttcaatcaaaattattggcatcggcgtattacaactctcgttgctggcgcagattctgcaggcaaatgagctcaatctgctggcgatcgccgtgatagctttactggctatcgatactctggccgatcggggcttctcaaatacgctgatccgccgctcgattctctctatcaatgacctctccacgatctactggggtaatatgttgatgggggtcgcggtgtttggtctgttatttactggcagccacctgctgaccagcctttttgatcagcctgaactggcattaatgctgcagatggtttcagtggtgtttattatcatcccacagggtcagcattaccgtgcgatattacagcgcgaaaaacaatatacccgtatcgcttttgctgaaacctcctcggtattagccggacttgccgtcaccttatttaccgtctggctgaccccttcagtattgtgtgcgatctggggttatctggccatggcatcgattcgtatgctgatttactgctactatggtcgttcatggttccagccggaataccgttttagcctgaatgcattttctaaaattcgtgcaagaaacaaataataaaataagtctgtatggtgggctctgagcatccgaaacgatgcgttggcgtgctgttaaccagcacgccttttctttttatttagtctgtcgcaatatttacctgatcgattcttttcccgcagcatccagcccttttttatctcctgtataaactggttttcgaccaacggctatctggcgatcgtcgtcagctcaccgcccgccctgggtcggaaaaccccgcgccggaacgcgcaaaccctctgtacgttgtttcctctcaactttttcaatcacctgccgcggtcccttcgcaaaaaagtctttctatgatgacgccagcgctggctggtataaactgcgctcatcccggacgccgattgccagaaaatcttcggcgccgtctctcaagcaatgccgtagtcttgccgccgtcttactggagtctgctatgttactgaccgttctctacattattggtattactgctgaagccatgacgggtgcgctggcggcggggcgtcgcaaaatggatctgttcggtgtcatcattatcgcgtccgtgaccgccattggtggcggtttcggtgcgcgacatcctgctgggtcactatccgctgggctgggtgaaacatcccgaatacatcatgattgttgcagcggcggcggtagtgaccactttcctggcacccctgatgacgcatctgcgcaaagtgtttctggtgctcgatgcgttaggactggtggtcttttctattatcggcgcgcaggttgcgctcgattcaggacacgccatgattattgccgcgataagtgcggtcattaccggcgtctttggcggcgtgctgcgtgacatgttctgtaatcgcattccgctggtgtttcagaaggaactctacgccggtatcgctttcgcctctggctggatgtatatcctgctgctgaaaaccacactggcgcatgaagcggtgattatcattaccctgttgttcggattcttcgcccgtttactggcgctgcgcttccgtcttggtttgccgattttcaactatccccatcccgagcattgaggatgcgggaattccctgctgtctcagaaaagcgatcagcgtctgcaggcgggcatcatggaactgcgcaaccaggcgctttgccagcgccgcaccgacacccggtaaagcttgccagtccctgacatcccgctgcgttaagctctcccactgctgatcgggcagcgcattgagggccttccgcggcagtgaaacacctaaggcatccacccagcgacgaagcggctgctgacgggtgagattaaaacggtgccagagctgacccgcccgctcccgagagaggcccgttgcggcggcgatctgttccggtgttaacgtcagccagccgaacaggtgcgtcatactgccggtttccagtaagtgcagccaggtgctgcgctcaacgccaggaatattcagtaccgttttctgactgagccagcgtaattttgccagtagctgcttctggcattcagcgctgaaggtgtaacaactcagcggcgtgtagcgcgacgcgtcgggaggctgaggatagtgccgctctgccacgcgccagatcacccgctccagccggggaatgccctggcctgccagactcagtgtgatgacatctcccgccacgatatcgctctcctgccagcgacgcagcgatccaacattgacccgcctgaccgtcttatcatccagctgtaccggctgcagattaagtaccgcggctatcttcccggttcggccgactggaaaatcgacggagagcacttcagcgctgacttccggaggctgatatttccaggcaacggcccatgttccctctccaggcagccagtttttgcccgcaggtcgcaggctctgatgaacgacgacaccgtcagtgacaaagggcagctcagcatgaaaccagcgctcccgccacgctgcaacctcctcttcgtctttaacgctgtggctccattttgcggcaacgcccagtccccagcggctgagttgctgaaggcgttccctcatcgtggcggggccatctggccaggcccagataaaaatatcgagcgagtccagcagaggaaacccgctgcttgctcatcatggcgcctgctacctgtgagcgcgcattcctgccgccatgaaccgcctgctgatgaccggtcatcgacagaaacagctcaccctgcagcacaacctcttcaagtccggtctcgatctgcagcggaatcgcagggatccaggcggctttagccagccactcttcaccgcgtaatccatcaccacgactcaacagtgaaaccagtctgccgtggcgataaaccagggaaacggcaatgccatccactttcggctgcacccagagatcgtgccgcccctgcatccagtaagccagggccagcttgtcgcgcatcttttttacgcccgtgtgggcgaccggatgcaggtgctcaccctcacccggcagttgcggtacgtaagcaggctgcggagggttaaagcagtgctgccagtgattcagtcgctgctgcagactgtcataatctgcatcagccaccggactctgcccctgacgatagtaagcatcatcccaatgctgcagctgctgttgcagacgacggatctcttctgtcgcccgggtgggagtccagaccggacaaagggcgctatgcgcaggccataggacgatccacagagcagccgcaaacagcggccagccgaatcctttcatgatctctctcctgacgttttgcagcattcaataccggtgcttcagcgtcagccagaggtgatgttcagctatggaaggaatgccgtcgcaatcaggggataattacagtcgtccgacagagatttgcgcgaagatgcgcaaaagttgggtgttgccgctgcgcaaacgctgcgtggcggcgggaagctgtgtatactgtgcaggaaatcgactccgcttttaatcaattcaagaaaaccatggctcaaggcacgctctatattgtttctgctcccagcggcgcaggtaaatccagcctgattcaggcgctgttaaagacccagccgttgtatgatacgcaggtctctgtttcgcacacgacgcgcggtatgcgtccgggtgaaacccatggcgaacattacttttttgttgagaagcatgaatttgagcagatgatcgcggaagaggctttcctcgaacatgccaaagttttcgacaactattacggtacctcgcgccatgctattgagcaggtgctggcaactggcgttgacgtgtttctcgacatcgactggcagggtgcgcagcaaattcgcaccaaaatgcctggcgcacgcagcatctttgttttgccgccttcgaaagaagagctcgatcgccgtctgcgcggtcgtggccaggacagcgaagaggtgatcacgcgtcgcatggctcaggcggtagcggaaatgagccactacgccgagtatgactatttaattgtgaatgatgatttcgatctggcgctgtccgatctgaaaaccattattcgcgcagaacgtctgcgtatggcgcgtcagaaggcgcgtcacgatgctttaatcagcaaactgttggcagtctgaatacagtttcagtatgatgcgcagtcatttcttcatctgtggagtagcacacctatggcacgcgtaaccgttcaggacgcagtagaaaaagttggtaatcgttttgacctggtgttggtcgctgcacgtcgtgcacgtcagatgcaggtaggcggcaaagatccactggttccggaagagaacgataaacctaccgttatcgccctgcgcgaaatcgaagaaggtttggtcaccaatcagattttagatgtgcgtgatcgtcaggaaacagcaagagcaggaagccgctgagttacaggccgttaccgctatcgctgaaggtcgtcgttaacagccacctgcaggtcgcccttgtatctgtttgaaagtctcaatcaactgattgaaaaatacttgccagaggagcagatcaagcgcctccagcaagcctaccttgtcgcacgtgatgcccacgagggacagacacgctccagcggtgagccttatatcacccacccggttgccgtggcctgtattctggcggaaatgaagctcgaccatgaaactctcatggccgcgctgctgcatgacgtgatcgaagatacgcctgccacttaccaggacatggaacaactgttcggtaaaagcgtggcggaactggtcgaaggcgtttccaagctggataagctgaaattccgcgacaagaaagaagcgcaggcagagaacttccgcaagatgattatggcgatggtgcaggatatccgcgtcattctcatcaagctggctgaccgcacccacaatatgcgcactctcggcgcattacgcccggacaaacgtcgccgcatcgcgctggaaacgttagagatttacagtccgctggcgcaccgcctgggtattcatcatcttaaaacagagctggaagagctcggttttgaggccctctatccgaaccgttatcgggtcattaaagaggtggtgaaagccgcgcgcggtaatcgtaaagagatgatccagaagattctttctgagatcgacggccgtttgcaggaagcgggcattccctgccgcgtcagcgggcgtgaaaagcatctttactcgatttaccgcaaaatgacgctgaaagagcagcgttttcactcgatcatggatatctatgcctttcgcgtcatcgtgaaagatctggatacctgctatcgcgtttctgggccagatgcacagtttgtataaaccgcgtccgggccgcgtcaaagattacatcgccatccccaaagcgaacggctatcaatcgctccatacctcaatgattggtccgcatggcgtgccggtcgaagtacagattcgcaccgaggatatggatcagatggcggaaatgggggtcgctgcgcactgggcttataaacaggcgggcgaaagtggcaccaccgcacagattcgcgctcagcgctggctgcaaagcctgctggagctgcaacagagtgcgggcagttcgtttgaatttattgaaagcgtgaagtccgatctctttcccgatgagatctacgtctttacacctgaaggccgcattgttgagctgccaaccggtgcgacgccggtggatttcgcttatgcggtccacaccgatatcggccatgcctgcgttggcgcacgcgttgaccgccagccttatccgctgtcgcaaaccctgaccagcggtcagacgattgaaatcatcaccgcgccaggcgcccgtcctaacgccgcctggctcaactttgtcgtcagctccaaagcccgcgcaaaaattcgtcagctgctgaaaaacctcaagcgcgaagactccgtcaatctgggtcgccgcctgctcagccatgcgctgggcggcagccgtaaactggctgagattccgcctgagaatatcaggcaggagctggatcgtatgaagctgacctcgcttgacgatctgctggcagaaatcggtctgggcaatgcgatgagcgtggtggtggcgaagaacctgttgcaggctgacagcaacgccatcagcagcaacagcaagcgcggtaaactgccgatcaaaggtgcagatggcgtgttgattaccttcgccaaatgctgccgtccgattcccggtgacccgattgttgcccatgtcagtcccggcaaagggctggtggtgcatcatgaatcctgtcgaaatattcgcggctaccagaaagagcccgaaaaattcatgccggtcgagtgggataaagtcaccgagcaggagttcgtggcggaaatcaaagtcgacatgtttaaccatcagggcgcactggctaacctgacggcggcaatcaacacggccggttccaatattcagagcctgaataccgaagagcgtgatggccgcgtttacagcgcatttatccgcctgaccgcacgtgatcgcgtccatctggcgaatatcatgcgtaaaattcgcgtgatgccggatgtgatcaaagtccatcgtaaccgtaattaggcatgaacgatcaacgatttgcccggattcaggcgatgctggcactgcgccagcacgatctcacggtctgtatggagcaggtgcataagccgcacaatgtttccgcagtgatccgcacggcggacgccgtcggcatccacgaagtgcatgccgtctggccgagccagcggatgcgcactcaggcttccgcatctgccggaagcaacagttgggtgaaagtggtcacccatcccaccatcggcgatgctgtaaaaaagctcaaacaacagaagatgcaggttttagcgacccatctctctgccgatgccgtggatttccgtgagatcgattatacccttccgacctgcatcctgatgggccaggaaaaaaccggcatcaccgaagaagcactggcgctggccgatcggcagattgtgattccgatggtgggtatggtgcagtcgctgaatgtctcggttgcctgcgcgctgatcctgtatgaagcacagcggcagcggcagaaacgcggggttgtacctgcgcgactacagcctgctggacgaagatgagcagcaacgtctgttgttcgaaggcggattcccggtgctggcgcgggtcgcaaaacagaaaggtttaccctatccgcgcatcaatgcgcagggcgaagtcgacgccgatcccagctggtgggcaaccatgcaatcgaccggtaaaagaagatgaaaggccgtctgctggatgccatcccgctcagtaccctgaccggcgtcggtgccagccaggcggcaaagctggccaaaattgacctgcataccattcaggatctcctgcttcatctcccgctacgctacgaagatcgtacccaactctatgccattgatgatctgctgcccggtatctgggccacagtagaaggcgaagtgctgcacacagatatcacctttggtcgccgccggatgatggtgtgccagattagcgatggcagcggcgtactgacgatgcgcttctttaatttcaatgccgggatgaagaacaacctgtcgccgggccggcgcgtcaccgcgtatggtgaaattaaacgcggtcagcgtggcgctgagattatccatcccgaataccgaatccagggcgaacagagcaatgtgacgctggaagagaccttaacgccggtttatcccaccaccgaaggtattcggcaggccacgctgcgtaatctcaccgatcaggcactgacgctgctggagagctgcccgattgccgaactgctgccgcaggaactgagcggcggtttaatcagcctgccagatgcgctccgcacgctgcatcgtcccccacccgatctaaaactcagcgagctggagagtggtcgtcatccggcacaacgcagattgattctggaagagctgctggcacacaacctcagcatgctggcggtacgcgccggtgctcagcactattacgctttaccgatgcttccccggcacaaccttagcgaccagctgctggctgcgctgcccttttcaccgaccaatgcgcagaaacgcgtggtggcggagatagagaaagacctggcaaatgactttccgatgatgcggctggtgcagggtgacgtcggctcgggtaagacactggtcgccgcgctttctgcgctgaacgttatcgcacatggtaagcaggttgctctgatggcgccgaccgaactgctggctgaacagcacgccagtaacttccgccagtggtttgcgccgctgggcattgaagtgggctggctggccggaaaacagaaaggcaaagcccgccaggcacagcaggaagcgatagccagcggtcaggtggcgatggtggtgggcacacatgccctgtttcaggagcaggtgcagttcaacggtctggcactggtcattattgatgagcagcatcggtttcggcgtccaccagcgactggcgctgtgggagaaaggtgaggagcagggcttccatccgcatcagctgatcatgaccgccacaccaattccgcgcaccctggcgatgaccgcttatgccgatctcgatacctcaaccatcgatgagctgccgccgggacgtacaccggtgaccaccgtggctatccccgatacccgacgcgatgagattgtggcgcgggttgagcatgcctgccgcgaagggcgtcaggcctactgggtctgcaccctgattgaagagtcagaattgctggaagcacaggcggcagaagccagctgggaatccctgaaaacggcgctgcccgacttaaacatcgggctggtgcatggccgtatgaagcctgcggaaaaacaggcggtgatgcaggcgtttaaagcgaatgaactgcagctgctggtggcgacgaccgtaattgaggttggcgtggacgtgccgaatgccagcctgatgatcatcgaaaacccggagcggttagggctggcgcagttgcatcagctgcggggccgtgtgggccgtggtgccgtggcatcacactgtgtactgctctacaaagcgccgctgagcaagacggcgcagaagcgtttacaggtgctgcgcgacagcaatgacggcttcgtcattgcccagttcgatctggagattcgcgggccgggtgaactgctgggcacgcgtcagaccggcaatgccgaatttaaagtggccgacctgctgcgcgatgcggcgatggtgcccgaagttcagcgtgtggcgcgccacatccaccagcactatcccgagcaggccagcgcattgattgaacgctggctgccagagaacacccgttataccaacgtctgaatgatccccatctgattcggcttttttatccctgccgggcaaacgattgcttttagcctgcggatgattacaatcgccacattattttttgggaagaacagaagatgtccactaatccgcagccagaacagccttccgccacgcaaagcgaactgatttatcgtcttgaagatcgtcctcccctgccgcaaacgctgtttgccgccggtcagcatctgctggcgatgtttgtcgcggtcattacccccgcgattctgatttgtcaggcgttagggctgcccgcagaggatacccggcacgtgatcagcatgtcgctgtttgcatcgggtgtggcatcactgctgcaaatcaaaacatggggaccggtgggttcgggcctgctgtcgattcagggcaccagcttcaacttcgttacgcccttgattatgggcggcatggcgctaaaaaatggcggcgctgacgtgcctaccatgatggcggcgctgtttggcacgctgatggtcgcctcctgtaccgaaatggtgctgtcacgcgtattgcacctggcgcgccggatcatcacgccgctggtttccggtatcgtggtgatgattatcggcctgtcgctgattcaggtggggctgacctccattggcggcggtttcagcgcgattaacgaccatacttttggtgcgccgaaaaacctgatgctggcaggggctgtgctgctggtgatcgtgctacttaaccggcagaagaacccctacctgcgcgttgcctccctggtcattgccatggcggtgggctatctgctggcctgggcgatgggcatgctgcctgccgccggcatccccaccgatcagccgctgatcgtggtgccgaccccgctctattacgggctgggcttcgactggaatctgctcatcccgctgatgctggtgtttatggtgacctctctggagactatcggcgatatcaccgccacctcggatgtgtcagagcagccggtcagcgggcccctctatatgaaacgcctgaaaggcggcgtgctggcgaatggcctcaactcctttgtctccgcgctgtttaatactttcccgaactcctgcttcggtcagaacaatggcgtgatccagttgaccggtgttgccagccgctacgtcggctttgttgtcgcgctgatgctgattgtgctggggctgtttcccggcggtcagcggactggtgcagatgatccctgaaccggtactcggcggcgccaccattgtgatgttcggcaccatcgccgcttcgggtgtccgcattgtgtcacgcgagccgcttaaccgccgcgccatcatgattattgcgctgtcgctggcggtgggcctgggcgtttcccagcagccgctgatcctgcagtttgcgcctgactggctgaaaaccctgctctcttccggtattgcggcgggcggtattaccgctatcgtactcaacctgatttttccgccagagaagtaaggccagaggcaggcttcggcctgcctgctaattattcggatttacatccaggctgttgagctgtaacggtaattcaggcataacaacctctcaccggatttaactcgggaaggatgctatgaaatttattggaaagtttttcctcaccttacttttgctgctgcttttcaccctggtcgtgatctatgttctgttgcagacacagtggggtgcaggctggtttagccgttgggtgagtgacaaaaccgaatggcatctctccctgagtaaaattgaacacaatttctcctctccctctcatatcattctggatgacttcagctttggtcacgatggacagcctgcagttctggtggcgaaacgggtcgatctcggtctggcactgattcagttcagcgatccgctgcatttcagcagccttgagctgcgagatggagaagtgaatctggccaatctggcgccaggcagcgcgctaccgattcaggccgatcgcctgcaactcaacaatatgcgtatcgacagccccaacagcgcgttaccgctgtttgctcagcaggttaatggcggcattctgccgtggaaacccactgcccttgatatgctgggccgcgatgcccgcttccagatgagcgcaggcagcatgacgctgaataatgtgccgggtgaaaacgtactgatccagggcagtgtctcccagggtcggatgcgctttgacaatattggtgccgacctggcgcgtggctctatgaccggcaacggtgagcgcgatgcccagggcaactggaaaattaatcagctgcgcctgaacgacatccgtctgcagaccaccagcagcctgaaagatttcctgcatagcctgcaggttgtcccctcgatcgccattacgcggctcgacatgaccgatgcccgcctgcaggggcctgactgggcggtaacggatctggatctgacgctgagaaacgttaactggcagggtgatgactggcaaagtaacgatggttcgctggcgctgaatgccagcaattttatcaacggtggattcgaactaaatgaccccatcgttaacctggacttctcaccgcagggcgtggcgctgacgcagttcagttcacgctgggcgaatggggtgattcgggctgacggtgactggtcgcgtagcgataagcgcctgacactgaaaaacctggcggtggcgggactggaatacactctgccgcaggactggcgcgatcgctggcaggcgacactgcccgcgtggctggatagcgtagaggtgacgcgcttcacctctaaccgaaacctgattatcgacatcaatccggcttttcccttccagctgacctcactggatggatccggtgaaaacctgctgctggcgcagcagcaccagtgggggatctggtcgggtaagctcagcctgaacgcggcagaatcaacctttaatcgcaccgacctgcgtcatccgtcgattgcgctgagcgctgaccagcagcagattcaggttacggagctgagtgcgttcagtaataagggtctgctcgaagggacggccaccgtaggccagcagccagcccgtccgctgacgctgcaactgacaggtcgtgctgtaccggtgaatgtgttgcagaaactggggatggcccgcgttgccgttaaccggtgacagtaatatgcagctgcagctgaacggtgcattaaccgcaaatcagccgctgcgcccgacggttaatggcagtttgtcggtgacaaccgacagtcagcaactgcagcagactatgcaggcaggcgaggtacgttaacaacagatcagggccgctgaagcggccctgatgattagttgatacgcgcgccggaccccccctcttccagcggcccgtcaggatcggcgggcaggacgatatagaccccttcaaacaccgcgccacactcatcattgccaaaaagctcaacttcgagctgcacacgcgctttacgcccgcgcgccaggcggtcgagatcgccgcttaatgagcccagatcggcaatcgcgccaggccgtccgctgatggggtggctatagcgaatgtgcgcatccgccagaataatggtgccacccagatgacgctcgcgcagcagcaaccagatcaacccccagccggtcagcgttgccagcgaaaacaggctgccagcgaacagcgtctggtgtggattctggttgcccgcttcaggcatggtggtgataaatttttgcccggtaaactgcagaatacggacgcccatcttttcgctgagcgggatatgatcataccaggcctgttgcagctgaccgcaccagtcggcgcgatgcaggatatcgtcgagcgtgacgaccggtttaatcatcaaaaagtgacgaaccggcgtcgtctgcggcgcggtaatctcgccctgattgatgtagccgagtttagcgaagaaagcgacagcatcttcgcgggcgctgcaggttacccgcttagccccttcctgacgcgccacggattccagcgtcatcgccaccagagtacccagtcccttgccctgaaccgaaggatgaacggccatgaagcggatagcggcctcattgtcggcattaatatagagacggccgatggcgaccggatttccctgctcatcaaccaccatctgatgatgcgccagcgcatcccaggcgtcacgttccgacccctgcggctgacgcagaggtttacgcaacatctcccagcggaactgataatagatatccagctcttccgccgtctgtggcacgcgaaggtgatacatgtaatgtttctcccgctcggatgtgtggccagttccctgccgctcagctgacgctctcacacctgtaaccagaacgtcacaggaccatcattcaccagcgagacctgcatatccgcagcaaaacggccattagccgtggtgatgccctgcttgcgacagcagtcgctgaaatattcatacagccgctcggcttcagcgggctcggcgccacccgaaaaggagggacgcatccctttttgggtatctgcggccagcgtaaactgtgacaccaccagcacgcttccgcccgcctggcgaacactcaggttcattttgccctgctcatcactaaagaggcgatagcccaatacgcgttctgcgagacgttccgcacgcgcgttgtcatcgtccttttccacgcccagcaaaaccagtaaaccggcatcgatttcaccgaccacttcctgattgacgctgacgctggcgcgctgtacgcgttgaatcaatgcaatcatgtttcctcgcgttgctcctctttgtgttgctgctttaactgccgatagtcggctaacgcaacggtgatttcagcgcctaacaacacaatacaccaggtccagtagacccagagaaacagaatggggatcacggccagtacgccgtagatcagctgataagaggggaacatagtaacatagagcgcaaagccctttttgcccagctcaaacagcgcaccggcaaccagcgcgccaatcagcgcatcgcgcggcggcactcgctgggtaggaacgatgctgtagagcaaccagaaggcgagccacgacagcaggagcgggaaaatacgcagcatctgatcgaccaggctggtgacgcctgtcgcgttaatccagcgcagcgacagcagataggagctgatcgccagactggcaccggccagtaacgggccaagtgtcaggatcatccagtagaccgcaaaggaatagaccatcggccgcttcttgttgctgcgccagatggtgtttaacgcggtatcgacggaatgcatcagcagtaaggcggtaacaatcaggccgaccgctccgaccgccgtcatccggtttacgttagccacaaactgctcaagatagcgttgcagcgtgttacctgcagccggcatcagattggtaaagacaaagtgcttcaactgcacactgatatcagagaagaccggaaacgccgcaaacagggcaaacaccaccgcaatcagcggcaccagcgccagcaatgagacataagccagattaccggcctgggtcgtcatgccatcctcatcaatgcgtttccacaacagtttgagccacaaccagaacgcatgcagcccgggacgaaatttacgtgacatcatgaattactgttgacctgcaaaccagttgggtaccgttttactgtcagtaaccagtacactttcaatacccagggcgcgggccgcctcaatattctgtggattatcgtcaaaaaataccgcctgatcggcagccacaccttctgcgtccagcacatgctgataaatccgggcttccggtttacgcatgcccagctcctgggagagatagagcttgtcggctgcctgctgcacgtccggatactgtgttggccagaattcgcaatgcagtttgttggtgttagagaggatcaccacccgatggccctccagccgcagccggttcatcagcgccaggatttccggacgcacgtcaacgaataccgcctgccagccagcggcaaactgttcatagctcagcgcgatttccagcttttcacacagcgccagcgcgaaatcttcatcgctgatctcgccacgttcgtgttgttcaaacgcctcatccatctggaaatggctttgcagcgaggccagcggcacacgactaaggtcactccagacacccagcacgcggttaaagtcgatatcgataatcacattgcccaaatcaaagatatacagcatggtgtgtctccttctgttccctggagtattcactctagcggcaaaagggcaggctgaacaggcactcgcggagagaaaagcgtaaacggcagcgggcaggtaaaaagcgcgacatatcccacaaataatcgctggcccggctgaagaggcaggaatttcaggcaaaaaaaaagccccgcaggcggggctttttatcagttaaaggcgcaattatgcgtctttaggaccacgtgatgcacgtttacggtcattttcagtcaggtgacgtttacggatacgcactgactgtggtgtaacttctaccagttcgtcatcatcgatgaactcgatcgcctgctcaagagtcatcttgattggcggaaccagcgtcgtggcttcatcagtacctgaagcacgcatgttggtcagtttcttaccggtcaggcagttaactgtcaggtcgttagaacggctgtgaataccgatgatctggccttcatagacttctgcaccgtgacccaggaacagcttaccgcggtcctgcaggctgaacagtgcaaacgcaactgctttaccctgaccgttggagatcagtacgccgttctgacgctggcccacttcgcccgcacgaatgtcatcgtagtggctgaaggtagagtagagcagaccggtaccggaagtcatggtcatgaattcgttacggaagccgatcaggccacggcttgggatcacgtagtcgagacgtacgcggcctttgccatccggatccatgtttttcagatcgcccttacgctcacccatggcttgcatgactgaaccctggttgttctcttcgatatccagcgtaacgttctcgaatggctcctgtttacggccatcgatttcgcggaagataactttcggacgggataccgccagttcgaaaccttcacgacgcatgttttcgatcagaactgacaggtgaagctcaccacgacctgatacgcggaacgcgtcagcatcttcggtttcttcaacgcgcagtgccacgttgtgaaccagttctttgttcagacgctcaaggatctgacgtgaagtcacgtacttaccttctttaccgcagaaacggtgaggtgttgacgttaaagaacatggttacggtcggctcatcgacgctcagtgctggcagcgcctgcacgttctgtggatcacagatggtgtcagagatgttcagctcgcccagaccggtgatagcaatgatatcgcccgcttctgccaggtcgctgtcgatacgctcaagacccaggtgagtcaggactttaccgactttaccgttacgggttttgccttcgctatcgatgatagtgacttgctggttaggcttaactttaccgcgcttgatacggccgatgccgatcacgcccaggtagttgttgtagtccagctgagagatttgcatctgcagtggggcgtcagcctcaacctgcggaggcgcaacgtggtcgacgatcgcctgatacagcggggtcatatcgtcagccatgtcggtgtgctcaagacctgcaataccattcagcgcagaggcgaaaatgatagggaagtcgagctgctcatcagtagcatccaggttaacgaacaggtcaaagacctgatcaacaacccaatccggacgcgcaccagggcggtctactttgttgataaccacaatcggcttcagaccatgcgcgaacgcttttttggtcacgaagcgggtttgcggcatagggccatccatcgcatctacaaccagcagcaccgagtccaccatggacatgacgcgctcaacttcaccaccgaagtcggcgtgtcccggggtatcaacgatgttgatacggtagtcattccacttaatggcggtgttttttgcgaggatggtaatcccacgctctttctccaaatcattggagtccatcacgcgctctgttgcttcggtacgggcatcaaaagtaccggattgttgcagcagtttgtcaaccagggtggtctttccatggtcaacgtgcgcgatgatggcgatgttacgcaaattttcgatcacagctttgcctcaggcattagaaatagcgcgttattgtacactgattaagcggaagactgaacacgatcacacttttcactgaaagtttattgcatggaggccaatttgccctgttaccggtgcagaaaatgcactaagttggtctgatgcaccaaaatagtgccatcagacgaccgttaagcaccacactggtgcaataaaacgatcgtggtgcagccgctttatgacaaaaaggtgcaccacaaggcgatttaagcatcatcaaaaaagttggcacagaattcgctttatctaaatcaagcgtaaacgccagacagatgtcggttgaagagcgtgccggaagaggttggtcagggagttgttttcccgcaacgtattccggaaacgacgtttcctcgccatgtagataatgaaagaccatttccaggagagttgagtatgtccgctgaacacgttctctcgatgatgaacgagcatgaagttaagtttgttgacctgcgttttaccgataccaaaggtaaagaacagcacgttacgatccctgctcaccaggttaacgctgacttcttcgaagaaggcaaaatgttcgatggttcgtctatcggcggctggaaaggcattaacgaatcagacatggtgctgatgcctgacgccaccacggcggtcatggatcctttcttcgaagattctacgctgatcatccgttgtgacatcctcgagccaggcaccatgcagggctacgaccgcgatccacgctctatcgctaagcgcgctgaagatttcctgcgctcttccggcatcgctgataccgtactgtttggaccagaaccagaattcttcctgttcgatgacatccgtttcggctcatcgacgtccggttcacacgttgctatcgacgatatcgaagcggcatggaacaccggtaaagagtacgaaggcggtaacaaaggtcaccgtccaggtctgaaaggcggctacttcccggttccaccggttgactcatcacaggacattcgttctgccatgtgtctgaccatggagcagatgggcctggttgttgaagcgcatcaccacgaagtggcgaccgcgggtcagaacgaagtggcaacccgcttcaataccatgaccaaaaaagcggacgaaattcagatttacaaatatgtggttcacaacgttgcgcacgcttacggcaaaaccgcgacctttatgccgaagcctatgtttggcgacaacggttcaggcatgcactgccatatgtcactctccaaaggtggccagaacctgtttgccggcgataagtacggcggcctgtctgaaatggcgctgttctacatcggcggtatcatcaagcacgctaaagcgatcaacgccctggcgaacccgaccaccaactcttacaagcgtctggtcccgggttacgaagcaccggttatgctggcttactctgcccgtaaccgttcagcctcaatccgtattccggttgttgccagcccgaaagcgcgtcgtatcgaagcgcgcttcccggatccagcggctaacccatacctggcgttcaccgcactgctgatggctggcctggatggcatcatcaacaaaatccatcctggcgatgcgatggacaaaaacctgtatgacctgccaccggaagaagaagctgagattccaaaagttgcaggctctctggaagaagcgctgaatgcactgaacgaagaccgcgagttcctgacccgcggcggagtattcactgacgaatcgatcgatgcttacatcgaactgcgtaaagcagagatggatcgcgttcgcatgacgccacacccggttgagttcgagctctactacagcgtttaactggtcagacgttttttgttgccgtggaaacttttagcccatcttcggatgggcttttttctccgcgaattcaccgttcattcgccctcttttcggcttaaagactaaaatgcacctctttagtgcagaggaacgctgtatggcaactggctctctgcccgatgcagggcagattctcaacgcgttaatcaacagtattttgttggtggataacgatctggttattcattacgccaacccggcggcgcagcaattactggcgcaaagctcacgcaaattgttcggcacgccgttaccggaattaaccggctacttttcgctgaatatcgaggtgatgcgcgagagtcttgaggctggccagggatttactgacagtgaggtcacgctggtggtagatggtcgcgcgcacattatgtcgctgaccgcccagcggttacccgatggcttaatcctgatggaaatggcgccgatggataatcagcgtcgtctcagtcaggagcagttacagcacgcccagcaggtggccgctcgcgatctggttcgcggcctggcccatgagattaaaaatccgctgggaggattgcgcggcgcggcacagcttttatcccgcgccctgcccgatccctcgctgaatgaatataccaaagtgattattgaacaggccgaccggttgcggaatctggttgatcgtttgctggggccgcagcagccgggcatgcacatcacgcagagcattcatcaggtggccgaacgggtggttaatctggtgtcgatggagctgccggagaatgtctcgctggtacgggattatgatcccagcctgccggaaactgccgcacgatcccgatcagattgaacaggtgctgcttaacgtggtgcgcaatgcgcttcaggcgctgggcgacgatggcggcaccattattatccgcacccgcacggctttccagctgacgctgcacggcacgcgttatcgcctggtggcacgtattgatattgaagatgatggccccggcattccggcccagctgcaggatacgctgttttatccgatggtcagcggacgcgaaggcggtaccggtttaggcctctccatcgcccgtagcctgattgatcaacattcaggaaaaatagaatttaacagttggccgggacacaccgaattctcggtttacctgcctattcgccagtgaggtttctatgcaacgagggatagtctggatcgtcgatgacgatagctccatccgctgggtgcttgaacgcgcgctcactggagccggtttgagctgtgcgacttttgacagcgcaagcgaggtgctggatgccctctcaaccaagaccccggacgttttactgtcagacattcgcatgcccggtatggatggcctggcgctgctgaaacagattaaacagcgtcatccgatgcttccggtcatcataatgacggcgcattctgatctggacgcagccgtcagcgcctatcagcagggtgcctttgattacctgcctaagccgttcgatattgatgaagcggttgcgctggtcgagcgtgctatcagccactatcaggagcagcagcagccgcgtaatcagccggtcagcggacccaccaccgatatcatcggtgaagcgcccgcgatgcaggatgtgttccgcatcatcgggcgattatcgcgctcgtcgatcagtgtgctgatcaacggcgagtccggtaccggtaaagagctggtggctcatgcgctgcatcgccacagcccgcgcaccaaagcgccctttatcgcgctcaacatggcggcgatccccaaagatttaattgaatcagaactgtttggtcacgaaaaaggcgcctttaccggggcgaaccagatccgtcagggccgttttgagcaggcggatggcggcacgctgtttctggatgagatcggtgatatgccgctggatgtgcagacccgtctgctgcgcgtgctggccgatggccagttttctatcgcgttggtggctatgcgccggtcaaagtggatgtgcgtattatcgcggcgacccaccagaatctggaattacgcgtacaggaaggcaagttccgtgaggatctgtttcaccgcctgaacgtgattcgtgtgcatctgccaccgctgcgtgagcgtcgtgaggatatcccgcgtctggcgcgttatttcctgcaggtggcggcgcgtgagctgggtgtggaagcgaagattctgcatccggaaaccgagacagcgttaacccgactgcactggtcaggtaacgtgcgtcagctggagaacacctgtcgctggctgaccgtgatggctgcgggtcaggaagtcctgattcaggacctgcccggagaactgtttgaatccagtacgccggagaatccggtacagtcgctgcctgacagctgggcaacgctgctggcacagtgggccgatcgcgctctgcgttccggtcatcagaatctgctgtcagaagcccagccagagatggagcgcacgctgctcactactgcgctgcgtcatacgcagggccacaaacaggaagcggcacgtttgctgggctggggacgaaacacgctgacgcgcaagctcaaagagctgggcatggaataagcggttcagtacgggctggtgaagtctgccagcccgtttcttcagataacgcgggagaactgctgctgacgcgctttctgacgcagatagcgatcaaagcacatgcagatattgcggatcagtaaccggccaattcccgtcacctccagccccgtagcggtttgttccaccagcccatcggttatcaacggtttcagcagcgccaggtcctcagcaaaatagtcgctgaagcgaatgccccattgcgcttctgtcgcggcaaaattcagcgagaagttgcaaatcagcgtttttatcacgtcacgacgcaggcaatcatcgtcggttaaggcgatgccacgccacaggccatttccctgctgttccacacaattgtaccaggtattaaggtctttctggttctgcgcataactgtcgccaatcatgctgatggcagagacgccaagccccagcaaatcgctgtcgccctgcgtcgtatatccctggaaattgcgatgcagctgccctttgcgctgcgcgatggccagttcatcctgcggcttcgcaaagtgatccattccaatgaactggtagccctgctgagtcagggttgcgatggtctgctgtaaaatatccagcttttgctgagccgatggcagttcaccctctttgattttacgctgtgccgcgaacatcgccggcagatgcgcatagttaaagacgctaagacgatccgggctcagcgccagtacccgctccagcgtccaggcgaagctggcgggcgtctgcaggggtaaaccatagatgaggtcaatgctggtcgagctgaacccctgttcacgggcacgcgccatcagcccgaaaatcacctcttcatcctgtacccggttaacccgctcctgcaccgatttgttgaagtcctgcacccccatgctcagccggttgaatcccagcgatcgcaggtgatcaatcacatccagcgcaatttcccggggatccacttcgatcgacatttcggcatcatcggccacgctgaaatgctgcttcagtaaacccaccagccgggaaatctgcgcattgtcgaggaaggttggcgtgccgccgccccagtgaagctgcgtgacctgacgctgacgaaacagcggcgcacgctgaataatctcctgctcaagcacatccagatagcgatccgctttgtggcgctgacgcgtcactatcttattgcagccgcagaagtagcagagacgatggcagaagggaatatggacatagagcgacagcggacgatcagggtaacgcgccacggcacgctggaagtcgttttccgcgtactgctcgctgaactccagcgcagtgggataggaggtgtaacgcgggccggcataattgtatttttcaattaacgcctgatcccactcaatctgctgcgatggcatgctcactccttccggtgacgtcgtctgagagaaggtcgcgaagaagaggagataaaaggtgagcgggatgagacccgacgtaaacgttgcttcagacgcgacaggcgtcgtagtttaaacaataaccacagcagataacatgtcgccagcagcgcgaaaattgatccaggccaaaacattgtcgtttacctgttaagcgcggcatgcgggtaacgcatgccgatcaaatttgcttagttgcctttcagcagacggtacatatcttcttcagcctgctcatcttcggcatcatccatcacaatgcctaactgctccatcagtttcgtcgatacgatccagcgaggcatccagccagccctgatcttcagccgacagcgtttcgccattttccagccgatccagcagcgcatccagacgttcgtcattttccagcttcgccagctcttcttctggtgtcagacgcactttcttctctgctgccggtttttctgcgcttttctttggtttaacggcggcggtttttccttcagcgatcagggccaccggttttttactcccgatgcgcggatctttcacgctgtccgcctgacgtccgccattgttttcggacgcagccggattagcacggctgccagatgcatgtccgcgatgctttttatcacgtttgcgatcgcgtgcttcatggttgatatcgtcacgcgatttgcgtttggctttgacggcaggtttgccgttagcagctcgtgcaggttgcttcatagtattcggtcccggctttttttattcagtatagaattgcggcgaaatctagcagaaagtagacaaagaaaaaaggcgacagctcaagctgtcgccttatttcataccttcataagaaggaatcatgttttaaatccttttcggctcgtaacatcccggttaatcccgcgcctgctcaactcctgagctattccttatccctgtctggccgcatccctgaccctgttccattccatcgctcataaccctcctggtatccctgagcgcatcatcctgatgtgtgctgccgtgcactgcacactaatgtagaccaactggtaaaagcctcaagtcagtgtcaaaaatagttagttcaaaaaaagaacgttttaagataagggtttgaattacatatttttttatttttagtaattaaagtaaaaagcgaaataacccgcaccgtgaatggcaaatctcttacaaagtttgttaccgagatgcgattgagcactttcgcgtcataacgcgtataatcgcccgcattgccttaatgcgttttctggagtgtcaccttgtctgaattgaattaccacgttacccactttgtcatgagcgcgccggatatccgccatctgcctgccgataccggaattgaggtggctttcgctggccgctcgaaacgcgggaaaatcgagtgcgctgaatacgttaaccaatcagaagggtctggcgcgtaccagtaaaacgccgggacgtacgcagctgattaacctgtttgaagtgaaagaaggtaagcgtctggtcgacctgcccggttacggttatgccgaagtcccggaagagatgaagctgaagtggcagcgcgcgttaggtgaatacctgcaaaaacgtcaggcgctgaaaggactggttatcctgatggatatccgtcatccgctgaaagatctcgaccggcagatgattcagtggtcagtggaaagtggcattccggtgctgttgcttctcactaaagcagacaaactggcctcaggtgcccgtaaagcgcagctcaatgtcgtgcgtgaagccgcactcgaatttgttggtgatgtgcaggtagagctcttctcatcgctgaagaaaatcggcgtggataaggttcgtcagaagctggacagctggtttaatacgcttgaacctgcggttgaagatcaggacgcggaagagtgagtggcaaccttgtgccggtgatgctgacggtacaaaaagcccaataaaaaacgccccagtcacagaatgactggggcggctaaattcagccaaatccgattacgtgaagtaaaaggtctgaaagatagaacatcttacctctgtaccctacgcgacgaactttacctgattttctgtgcgtgacaaaggcttttttgttgcttacttacatgaaacaggactttttttaccatgcacgtcacaaaaatagcgttgcgatgtagtttaatgacgaaaaaagtgtttagaccataagcagttagaaaagcgttttctctcagtgccagcgttaaccacgctaaaccggtcaactaaacgattttcttatacctgattcagggccggttctgttcttcagaaccgaccacacgcatcgaatcagtgggcttcatcccagttgtcacccacaccgacttcaaccagtaaaggtacgtcgagctgtacgctaccttccatcaacgcacggattttctggctcgcctcttcaaccgccccggctttgacttcgaacaccagttcatcgtgaacctgcatgatcattctgacggcattgtcgttttgctgttccagccagttatccacggcaatcattgcccgcttgatgatatccgctgccgtcccctgcatcggcgcattgatcgcggcacgttcagcggctttccggcgaatggcgttaccggatttaatatcgggcagccacagccgacggccttccagcgtttcgacatagcctttactcgccgccagctggcgtgtgttctccatatagcgcaggacgcccggatagcgttcaaagtagagatccatatactttttcgcttcacccgcaccgatattcagctgacgcgacaggccaaaggcgctcatgccataaatcagaccaaagttgatcgctttggcgctgcgacgctgttcgccgctgaccttatccagcgccacgccaaacacttcggatgccgtcgcgcggtggatatcttcgccctgggcaaaagcgtccagtaatcctttgtcctgagagagatgcgccatgatacgcagttcgatttgtgaatagtctgccgccacaatgcgatggcctttggccgcaacaaatgcctgacggattcggcgtccttcatcattacgcaccggaatgttttgcagattcggatcggcagaggataagcgtccggttgcggtgacggcctgatgataagaggtatgtaccctgccactgatcggattgatcatcagcggtaatttatccgtataagtagacttaagtttggataagccgcgatgctccagaatcactttgggtaacggataatcaagtgccagctcggctaacacctcttcgctggttgacggcgcgccgcctggtgttttctttgtgggcttgatgccctgtttttcaaacaggatcacctgaagctgcttggtggatgagaggttgaagggttcccccgccagctcatgcgctttcaactcaagctcagccagtcgggccgtcagctctttcgaatgctgcgccagaatagactgatcgatcagcacaccgttgcgctctatgcgcgaaatcaccgtcagtaacggcatctcaatctgttcgaagacttttttcggacccgcttctttctccagctctggccacatcttcagatgcagctgcagggtcacatctgcatcttctgcagcgtaatgggatgcctgctctaatgcgatttgattgaacgtcagctgatttttgcctttaccggcgatctcctggaaggtcacggttttatggttaagccagcgagcggccaggctatccatgtcatgtttgcccaccacgctgttgaggatataggactcaagcatggtgtcgaatttgataccggccagttcaatgtcgtagtttttcagcacgccgcgatcgtatttcaggttctggccaactttccatgcgctctcatcttccagcaagggcttgagctgtgccagaaacggtagcgcgatccagttgatcaggcgcatcaagatagtcatgggcaaccggcagataggcggcttcaccgggtgccaccgcgaagctgatgccgacgatgttagcgctcagggtatccagcgcgtcggtctccagatcaaacgcaaagacttcgctgtttttcagcttctccagccagctatcaaagagatcctgatccagaatggtgacataaccctcggtcggtaacacgctgctggtttcaaccaccagggccggttcatcggcctgcgctttttgcgcctgcgtagtgctctttttaccctgcagccatttaccgtcctgcaggtcactcagccagcgtttgaactcgtaacgactgaacagggcctgcaatgcctctgtatcgggctcagtgactgtgagctcttcacagggcagcgccagctcaacgtctgtcttaatggtcgccagctgataagagagaaacgccacatcacgattctgctcaagtttggtcgccatggttttggcaccacgaaagccgagatcggccactttgtccagattgtcatagatcgtctgcatgctgcccagcccctgcagcaacgcctgtgccgttttctcaccgacgcctggcacgccaggaatgttatcggagctatcacccatcatggcaaggaaatcgatgatcaatgcgggtggaacaccatatttctgctcaacctcttctggtcccagaatggtgttgctcatagtgttaatcagcgtgatggcgggcgtgaccagctgcgccatatctttgtcgccggtgctgatcagtactgagagaccctttttctccgcttccagcgccagcgtaccgatgacatcatcagcctcgacgccgctcacagccagcaacggcagccccatcgcccgcaccatctcatgcagcggctcaatttgtgcacggagctcgtcaggcatcgggggacggtgagatttgtaatgctcaaacagctcgtccctgaaggttttgcctttggcatcgaataccacagcaacgtgactcggattgtattgcgccagcaggcttttcagcatgttgagcacgccgtacatggcgccagtgggttcacctgcactgttggtcagcggcggaaacgcgtgatacgcgcgataaagataggatgagccatcgaccagaatcaggggattttctgctatttgcgccataagtctgtgtagtcttcgttgctatgagttgggctataaggatgccacaatcaggcagaaatggtgaactaaggcgtgccacgtctggagtttttcacgcttttggggacaggatcgcaacgatcgttctgtggataactttgtgcgtaaaaattataacgcgctgtttttcaggaaaataaataatcgacgcttgaataaaaaccataaatttcattggtttatttaatttccgtgacccgatcgctatttttaatagcgcgatcccttgtgtggatattaaatttatgccctggagatggacaaaaattggcccgttgttcaaaggcataaaaaaaacgccagcagagctggcgtttaacgggggtgtgaggctgattacttctggcttaccaggaatttaactacgttcgcatagtctgcaacgaaattatccatagagctggtatcaagaccgccgttgttaaccatgtatttgccattcacgaaaatagcaggcacaccacgcagatcaacatcagcagcggctttttgctgctgtgcaaccagcgcttttacggcgaagctgttccaggctgcatcatagtccgccgcagagataccggccgctttgacaaaggtctctttcagactggcaggatcggtgatggtctgcgttttctgaatgccatcgaagatcggtgctgtcactttatcttcaacgcccagcgccatcgcgacagcccaggcctgggtcacgaccggccccaactctccaccgagaaaatcgacgtggtatttcaccatcttagtgtcagcaggcagattctttttcaccgcgtcattgacgtgataaatacgttcaaactgatagcagtgcgggcagaagaaggagaagaaactccatcacctgaggttcgccggccacaggtttaggcagactcacatattgtttaccttcagtgaactgggcagcagatgcgctgaatgccagcactaaacccatcagtgcaaaccaaatttttttcatcgtgaaaaattctcctgactacgtcattaatattgcggtgtcagctgcagaggaggttcctgcaacagcttctcctgctcggtaaagagtgaaatttgcctgcgccagaaatcttcatctgtcatccaggggaaagcgcgcggaaaagcgggatcctgccagcgtcggacaacccaggccagataataaaccatgcgcatggcgcgtaaaggttcaatcagtgacaattcattaatatcaaaatcactgaactcactgtacgcctccagcagtatatcccattgaatacgctgttcctgacgatcgccgctgatcagcatccagagatcctgcacggccgggccattacgggcatcatccagatcgacaaacagcggtccgtcacgccacagaatattacccggatggcagtcgccatgtaatcgtagcggctgccacgtggtgtgccactgttgttgcagcgtgtttcccagcttatcgatagcctgtagcagtgcgactttaagcgatgcaggcactaacagagagtgctccagcacctgccggggttcatgcagatattcatccagaccgatggcaggccgatgcctgaacagcgctttacgcccggtctgatgaatgcggcccaggaagcggcctacccactccatctgatcttcgttgtctgtctcatattgccgtccgcccaggctggggaatacggcaaagaagaagccagcgtgactgtgcagtgtctcaccctttaaccgcagtggcgccgcgatgggcacttcgtcagccagcagatcaagtgcgtactgatgttcttcagcaatctgttcggcacgccagcgctgtgggcgataaaacttcgcaacatagcggcgtttttcgtcgtcgctgaattgataaaccctgtttctcgtagctgttcagggctgtcagacccgattcgacgcgaattcctgtttcccagagcgcatcaagcaacacgtcgggattcaatgtctggaagttaaaagcagcgtcgctcatcatgttacctgtagttgcccttgcaaatagcagccaaggataacactactcgtcctgtttaatgacaccccgtgcgcggagcagtgctgttttgaaatcaacttcataatcttttttcaggcctgggatctcatcatcgctggctgagtcacgcatcttgagatggtaaattaatacatcatcggttaattcacttaacgggccacggaaaccagattcctgagccagtttctgcaaaaatgtgaccagattaagatcaggctctttttgccaggcgggttgcagcaactcgattaactcgtttaaacgatggcatttcattcagatttctcctttcacagtgcgtcatcagcgagggcacagtcatgacaatattaaccggtatcattctggccggtggtcagggccgccgtatgggtggtcaggacaaagggctagtacagctggatggcaggccgctttatcagcatgtccttgaacggctcaggccacaagtcgacattgtcatgattaatgcgaatcgtaatattgatcgctatcagttaagcggatgtcgggttattcaggatgtttttgatgattatcccggtccgctggccgggatctacagtgggttgctcgccatcgacggtgaatgggccgctttttgctcctgcgatacgcctgcaatacctctctacttcgtcgaaaaactggtcgatcaacgcggtgaggcgccggcagtctgggtacgttcacagtcgcgcgatcatcctacgctggcgctgattcatcgggaaatggctgcacctctttatgactatcttcaggctggagaacgacgtcttatgcattttctgcgcgaccacggtggccatgctgtccggatggatgaggatgaggctgccttccgcaatatcaatacgcctgatgacctgaacaacagaggctgacatgtcattacctatacttgccattgtgggctggagtggaaccgggaaaacgacgctattgcagcaggtgataccgattcttggcgataaaggtatccgcgcaggattgattaaacatacccatcatcagatggatgtggatacgccaggcaaagatagctatctgctcagaaaagcgggtgccagtcaggtaatattggccagttcagagcgatgggcattgatgtgtgagacgccggaaaagcagtcgattaatctgccttatctgctcagccgcatggatcacgctacgcttgaggtcgtgctggtcgaaggcttcaaagatgaacccgtacctaaaattgttttatggcgggccgggatcaagggtgggatcgaggaaactgcttgatgagcaggtaatcgctgtcgccagcgaccagaaattaacgctgaacgtgccagttctggatataaatcgtccggacagcgttgcagacttcattgccgactggcttgagaaacgctgaaatggatgttgtgatgcagtttttcacgatctgcagacgtaaaaaagccccgcacttccgtgcggggcttcttcacttatttaatgcctggcagttccctactctcgcatggggagaccccacactaccatcggcgctacggcgtttcacttctgagttcggcatggggtcaggtgggaccaccgcgctaaagccgccaggcaaattctgtctccgcgccgcccgtaaggccgcgcagaatatccggtacaggctgaaaattctgtctctcaaaaacgcctctggcgttgtaaggttaagcctcacgggtcattagtaccggttagctcaacgcatcgctgcgcttacacacccggcctatcaacgtcgtagtcttcaacgtcccttcaggactctcaaggagtcagggagaactcatctcggggcaagtttcgtgcttagatgctttcagcacttatcttttccgcacttagctaccgggcaatgccattggcatgacaacccgaacaccagtggtgcgttcactccggtcctctcgtactaggagcaacccccctcaattctccagcgcccacggcagatagggaccgaactgtctcacgacgttctaaacccagctcgcgtaccactttaaacggcgaacagccgtacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctgctttcgcacctgctcgagccgtcactctcgcagtcaagccagcttatgccattgcactaacctcacgatgtccgaccgtgattagctgaccttcgtgctcctccgttactctttaggaggagaccgccccagtcaaactacccaccagacactgtccgcagcccggattacgggcctacgttagaacatcaaacattaaagggtggtatttcaaggttggctccacgcagactggcgtccgcgcttcaaagcctcccacctatcctacacatcaaggctcaatgttcagtgtcaagctgtagtaaaggttcacggggtctttccgtcttgccgcgggtacactgcatcttcacagcgagttcaatttcactgagtctcgggtggagacagcctggccatcattacgccattcgtgcaggtcggaacttacccgacaaggaatttcgctaccttaggaccgttatagttacggccgccgtttaccggggcttcgatcaagagcttctccttgcggataaccccatcaattaaccttccggcaccgggcaggcgtcacaccgtatacgtccactttcgtgtttgcacagtgctgtgtttttaataaacagttgcagccagctggtatcttcgactggcttcggctcggggagtaaatccctccacctacgcgccagcgtgccttctcccgaagttacggcaccattttgcctagttccttcacccgagttctctcaagcgccttggtattctctacctgaccacctgtgtcggtttggggtacgattctgtgttacctgatgcttagaggcttttcctggaagctgggcatttatcacttcagcaccgtagtgcctcgtcgtcacgcctcagcgttaacaagcgtccggatttacctggacactccgcctacacgcttaaaccgggacaaccgtcgcccggctgatatagccttctccgtccccccttcgcagtaacaccgagtacaggaatattaacctgtttcccatcgactacgcctttcggcctcgccttaggggtcgactcaccctgctccgattaacgttgaacaggaacccttggtcttccggcgagcgggcttttcacccgctttatcgttacttatgtcagcattcgcacttctgatacctccagcatgcctcacagcacaccttcgacggcttacagaaacgctcccctacccaacaacacatagtgtcgctgccgcagcttcggtgcatggtttagccccgttacatcttccgcgcaggccgactcgaccagtgagctattacgctttctttaaatgatggctgcttctaagccaacatcctggctgtctgtgccttcccacatcgtttcccacttaaccatgactttgggaccttagctggcggtctgggttgtttccctcttcacgacggacgttagcacccgccgtgtgtctcccgtgataacattcttcggtattcgcagtttgcatcgggttggtaagccgggatggccccctagccgaaacagtgctctacccccgaagatgagttcacgaggcgctacctaaatagctttcggggagaaccagctatctcccggtttgattggcctttcacccccagccacaggtcatccgctaatttttcaacattagtcggttcggtcctccagttagtgttacccaaccttcaacctgcccatggctagatcaccgggtttcgggtctataccctgcaacttaacgcccagttaagactcggtttccctgcggctcccctatacggttaaccttgctacagaatataagtcgctgacccattatacaaaaggtacgcagtcacccccataaagaaggctcccactgcttgtacgtacacggtttcaggttctgtttcactcccctcgccggggttcttttcgcctttccctcacggtactggttcactatcggtcagtcaggagtatttagccttggaggatggtccccccatattcagacaggataccacgtgtcccgccttactcatcgagctcacagcatgtgtgtttttgtgtacgggagtatcaccctgtaccctgcgactttccagacgcttccactaacacacaagctgattcaggctctgggctgctccccgttcgctcgccgctactgggggaatctcggttgatttcttttcctcggggtacttagatgtttcagttcccccggttcgccttgcagcactatgtattcatgctgcaatgatgcacagagtgcaccgggtttccccattcggacatcgacggctgtagcggttcatatcaccttaccgtcgctttacgcagattagcacgtccttcatcgcctctgactgcctgggcatccaccgtgtacgcttagtcgcttaacctcacaacccacaggcgttttacaacgctgcgaattgcaagcatttgagagactcgaacgcatcgccaaatcattccttattacggaggaatgacgcgctgcgtcgtttcaattttcagcttgttccggattgttaaagagcaatatcttaaacatgactcgtaagtcatctttaagatatgtgggtaacatctttcacctgtcaccaagctttggcgtcccctaggggattcgaacccctgttaccgccgtgaaagggcggtgtcctgggcctctagacgaaggggacaattaagtctgtcttcgaaagacactttgctcgttattttctatcagacaatctgtgtggacactgcgcgggaaggtatcttcaggtaaggaggtgatccaaccgcaggttcccctacggttaccttgttacgacttcaccccagtcatgaatcacaaagtggtaagcgccctcccgaaggttaagctacctacttcttttgcaacccactcccatggtgtgacgggcggtgtgtacaaggcccgggaacgtattcaccgtggcattctgatccacgattactagcgattccgacttcacggagtcgagttgcagactccgatccggactacgacgcactttgtgaggtccgcttgctctcgcgaggtcgcttctctttgtatgcgccattgtagcacgtgtgtagccctactcgtaagggccatgatgacttgacgtcatccccaccttcctccggtttatcaccggcagtctcctttgagttcccgaccgaatcgctggcaacaaaggataagggttgcgctcgttgcgggacttaacccaacatttcacaacacgagctgacgacagccatgcagcacctgtctcagcgttcccgaaggcaccaaagcatctctgctaagttcgctggatgtcaagagtaggtaaggttcttcgcgttgcatcgaattaaaccacatgctccaccgcttgtgcgggcccccgtcaattcatttgagttttaaccttgcggccgtactccccaggcggtcgacttaacgcgttagctccggaagccactcctcaagggaacaacctccaagtcgacatcgtttacggcgtggactaccagggtatctaatcctgtttgctccccacgctttcgcacctgagcgtcagtctttgtccagggggccgccttcgccaccggtattcctccagatctctacgcatttcaccgctacacctggaattctacccccctctacaagactcaagcctgccagtttcaaatgcagttcccaggttaagcccggggatttcacatctgacttaacagaccgcctgcgtgcgctttacgcccagtaattccgattaacgcttgcaccctccgtattaccgcggctgctggcacggagttagccggtgcttcttctgcgggtaacgtcaatcgacagggttattaaccctatcgccttcctccccgctgaaagtactttacaacccgaaggccttcttcatacacgcggcatggctgcatcaggcttgcgcccattgtgcaatattccccactgctgcctcccgtaggagtctggaccgtgtctcagttccagtgtggctggtcatcctctcagaccagctagggatcgtcgcctaggtgggccattaccccgcctactagctaatcccatctgggttcatccgatagtgagaggcccgaaggtccccctctttggtcttgcgacgttatgcggtattagccaccgtttccagtggttatccccctctatcgggcagatccccagacattactcacccgtccgccactcgtcacccaagagcaagctctctgtgctaccgtccgacttgcatgtgttaggcctgccgccagcgttcaatctgagccatgatcaaactcttcaatttaagtttgatttgcttaaacaagttaagcgttgctcatctgtaaaacgtcataatgaatttcattatgtgttcactcgtgaggcttgatatttttttacgtccggagacgctgatatcaatcctgcgagtgcccacacagattgtctgataaattgttaaagagcagtgcgaacagtgcgttagcgtcctgtcgcgaggtggcgtatattacgctttcctcctgcagagtcaacctctatttcagaagtttttctccggcggcgcagtctcctgtgcctctcaacccgcttcgcgttgccggtgtgccgtgttgatggatgcgcattatagggagttgtctgagaggcgcaacccataaattgcataaaaaagagcgttcgctgcattccacagcaaaagcggctgttatacgcagttacacacaatgttatccacattagtcgggccagataaatttaggcgagcatcacgcaaacgttttcgctacaatgccgggcgaagttccggacaccccttttcggggcgttacctgaggtttttgattttttcttcctgtatagagaagagaaaaccgctgtaaagcctgatgtaacgctcttatatacgcgaaacaaagccaagggataaaccaccatgcaacaaactcgtcctgtacgccgcgcattgctcagtgtctctgacaaagccggtatcctcgaatttgctcaggcgctctcaagtcgcggtgtcgaaactgctctccacaggcggaacagctcgcctgctggcggatgcaggtctggctgtcacagaagtctctgactacaccggtttcccggaaatgatggatggacgcgtcaaaaccctgcatccgaaagtgcatggcggcattttaggtcgtcgcggccaggatgatgccataatggcgcagcacgacatcagcccaatcgacatggtggtcgttaacctctatccctttgcacagaccgtcgcccgtgaaggatgttcactggaagatgcagtggaaaatatcgacatcggtggcccgaccatggtgcgctctgctgccaagaaccataaagatgtggcaatcgtggtcagcagcggcgactacgaagcgatcattgccgaaatggatgcccatgaaaatggcctgacgcttgagacccgtttcgatctggcaatcaaagcgttcgaacacaccgccgcgtatgacagcatgatcgctaactactttggcagcctggtgcccgcctatcacggtgatcgtaatcagcccgccggccgtttcccgcgtaccctgaatctgaacttcattaagaagcaggatatgcgctacggtgaaaacagccatcaggatgctgccttctatatagaagagaacatcactgaagcttcagtggcgactgcccggcaggttcagggcaaagcgctctcctataacaacattgctgacacggatgctgcactggagtgcgtaaaagagttcagtgaacccgcctgcgtcatcgtcaaacatgcgaacccttgtggcgtagcgaccggtgactctctgctggcagcctatgagcgtgcttaccagaccgatccgacctccgcatttggcggcatcatcgcctttaaccgcgagctggatgaagcaactgcgcaggccattatcagccgccagtttgttgaggtgtttatcgcgccagcggtttccgaggccgcgctgaaaattaccgccgcgaagcagaatgtccgtgtcctgatctgcggccaatggcaaaaccgtactgctgcactggatttcaaacgcgtcaacgggggtctgctggtacaggatcgcgatctcggcatggttgatgccagccagctgcgcgtcgtcagtaaacgtcagccaaccgaacaggagctgcgtgatgcgctgttctgctggaaagtagcgaagttcgttaagtctaacgccattgtttatgcacgcgacaacatgaccatcggtatcggtgccggacagatgagccgtgtctattccgctaagattgccggcattaaagcagccgatgaagggctggaagtaaaaggatcagccatggcgtcggatgccttcttcccgttccgtgatggtattgatgcggcagccgcgtcaggcgtgagctgcgtcatccagcctggcggctccatccgcgatgaagaggtgattgcggcggctgatgagcacggcattgccatgatcttcaccgacatgcgtcacttccgccattaatcgttctggagagaaacagatgaaaattttagtaatcggcaatggcggacgtgaacatgctctggcctggaaagcagtccagtcgccgctggcggaaaccgtgtttgtggcaccgggtaatgcgggcaccgcattagagcctgcgctgcagaatgtcgcgattagtgcaactgatgttcctgccctgcttgagtttgcccggcgtgaaaagattgatctgacgattgtcggccccgaagcgccgctggtaattggcatcgtggatgccttccgtgaggccgggctggctatctttggtccgactcaggctgctgcgcagctggaaggctctaaagctttcaccaaggatttcctagcgcgtcatcagatcccgagtgcggaataccagaacttcaccgaggttgagcccgctctcgcgtatctgcgtgagaaaggcgcccctatcgtcatcaaagccgacggtctggccgcaggtaaaggcgtaattgtggcgatgacgctgcaggaagctgaggatgcggttcaggatatgctggccggaaacgcctttggcgatgccggacatcgcattgtgattgaagagtttctggatggcgaagaagccagcttcatcgtgatggtggacggcgagcatgtgctgcccatggccaccagccaggatcacaaacgcgtgggcgatggcgataccggtccgaacaccggcggaatgggtgcctactctccggctccggttgtcaccgatgagatccaccagcgcgttatggatcaggttatctggccgaccgtgcgcggcatggcggctgaaggcaacatctataccggttttctctatgccggtctgatgatcgatcacaccgggcagccgaaagtgatcgaattcaactgccgcttcggcgatccggagactcagccgatcatgctgcgtctgcagtcggatctggtcgatctttgcctggccgcctgtgacggtaagctggatcagaaaacgtcacaatgggatccccgccctgcgctgggtgtggtcctggcggcgggcggttatccgggtgactacactcagggcgatcagattcacggtctgccactggaagaagttgctgacggcaaggtattccacgccggaacacggctggaagaggacctggtgctgacaaacagtggccgcgtgttgtgcgtaaccgcgctgggcgacgatgtggccgcggcacaaaagcgggcttatgagctgacacagccaatctcatggcagggcagcttctgtcgccgcgatatcggctaccgcgccattaatcgcaaataagttcagggggcaccaggtgcccccttttcaattcacatatcttcttctgtcggctgctgtgagcagtcatcctgctgactgacccgcaatagctgtatcccttccggcgcttcaagccatgacaccatcagcggtgttgatgcgcggcgttgctgctgtgtcagcatctgcagagcgtcggcgtcaaaagcgggtctgacctgctggccttcgcaactcttcagcacattgtttcccagccagtgtccctgtctgaggaacacctgaccgcttaatagcgcatcgctgaggttacgcatccgctcggcatcaaacttatagagctcaaccgcatccgggctgaccgcttcacgccggcctgaaagctggcgctgcataaagttaagaccgccagcctggtcaaagcgcagggtcacatcatcaggctggttgcccttcacctgacgctggatgctgatcaacgactcttccagccagacataatccgtcacttcaccctcaccgccactgaaacggcgtatagaaggtgcggatatggaccgactggtggtcgctgtttttacgccagatacgaacaacaccacgatcggcaagatagccactggcagaaaaggggggaatatccggagtagagctgcaaccgaaaagaaacagggagagaaacagaacagataaacgctgaaacagcggggtcatgatggctggcctcttaaacaaaaggggcgaaacgccccctgttttaaagcttaaccgcagtgcgacgtcttacttaacggcgtctttcagcgctttaccagacacgaatgccggtacatttgctgcagcgattttgatctctttgccagtctgcgggttacgaccggtacgctcagcgcggtggttcactttaaaagtaccaaaaccaaccagttgtacagcatcaccatctttcagagactcagtgatcgcagccagagtagattccagcgctgcctttgcctgggttttagacaggtcagctttttctgcgatcacatcaatcagttgagtcttgttcataagttatccttaaagtgtatttatcgcttgctaagcaacgagtgcgagggaaaagccatattctggcactcttctgcctgcacgcaccgatagccacaattttcagccccccaaatgtagaccagacagggggccaatgtgaagcctccaggcgcgctaattcgggcctgaagtcacgttttatcgccttactgctggaaatttataccgatgttgctaattcccgcttcacgcaggtcagatcgcagacctttaatcaattcaaggtcgcgctcttcacactccgccagcaggcggaaaatctcccactgaaggtcccactcatcgatgatagccgggttttcacgcagctcttcgtcggtcatttcgcgtccagcctgggtcatttccagtatggcgatagtagtaattgaggtctcgctgacttcaattgcatgctcaagagtttcaccgctcagctgcgcatgtacgacttcgctcaatgccacacaggcatcgatagccggataaacgccgtaaacctcaaacgcatcaccatcaggaatggcggcttcgagcttttccagctggctgtcgaagttaatcttcgcatctttgaccgtcaggttttcccagatcagatcaaggatacggcgatagagtgccggatcggcaaattcagtctgctcgcagaacgcacgatagttgggatacatgcgctcgcacaggcaggccataaaagtaaggtgctgccagctttccagcttcgccagacgcagatgaacgggattttgtaacataaaggtggctcttattcgtttcgctggccgcagtgtaactgcaaaaccgcagcacaaacagtgttaaagcgcgttttgccagcgctggaaagcggttcggttcgaggcaaccgcgtcggcccagcgggtcggtttccggcagccggtaaccacgcgtacagttttcgacccactgcagcgcggtatccaggctgacacgatggccggtggcgacaaacagcggattacaccgcagcttgctgcgccatacccagcctatctgctcgcctttgtcgatcagtggctgacgactgccaggctgcgcatccagatcggcaaaacggccacacaggcgacttttcgcgacaccaatggtgggcacatcgaccagcaggccaaaatgtgacgcgacgccaagtcgtcgtggatgcgaaataccgtgtccatccacaaacagcaggtccggcttttgctccagcatctgccaggcggccatcagcgctggatattcacggaatgagagaaagcccggaatataaggcatggtggtctcaacgcgtgcgatgcggtgctccaccagctttaaggagggatactccagtatcaccatcgccgcccgggtgatggtgccttcctgctcaaatccaacgtccgccccgccgataaagcggggtggcagcacatcaaagtcatcttctcgcaccacatcagcggcgcgttgtaactgctcagcgcgaagtgcggcaatatccatgattactcctgatgccagggacgtgataaacggtgtaccgcctcaacaaagacgcccgcattttccggtggcacatccagatgaataccatgacccagattaaagacatgcccggtgcccgagccaaagcgctccaggatcccagccacttcctgttcgatacgctcaggtgccgcatagagcatagaaggatccatgttgccctgcagggcgactttgtcgcccacgcgacggcgtgcgtcatcaatatcggtggtccagtcgagacccagcgcgtcacaaccggtggcggccatcgcttccagccactgtccgccgcctttggtgaagagcgtcaccggcacgcggcgaccgtcgttttcacgcagcaggccatcgacaattttgtgcatgtaatggagtgagaattcgcggtaatcacgaccggtcagcacgccaccccaggtatcaaacaccataacggactgcgcaccggcgcggatctgagcattgagatagaggatgacgctgtcggccagcttatccagcatcgcgtggagcgtagcgggatcggcatacatcatcttcttaattttggtaaacgccttgctgctcccgccttccaccatataggtggccagcgtccacggactgccggagaagccaatcagcggcaggtcgccgttcaggttcttacggatggtacggacagcattcatcacatagcccagctccatttcgggatcgggtactggcaaacgctcaacgtcagcgcgacaggtcacagggtttgagaaacgcgggccttcgccggtttcaaagtagagacccagtcccatcgcatccggaatggtcaggatgtcactgaagaggatggcggcatccagcggataacggcgcagcggctgcagggtaacttcacaggccagctcggcgtttttacacagcgacataaagtcacccgcctgggcacgtgtcgctttgtactccggcaaatagcgcccggcttgtcgcatcatccagaccggcgtgacatcaaccggctgacgtaacagggcacgcaaataacgatcgttcttcagttcactcatctcaacactctctcaataacaggcgtgtagtgtagcactttcacacttcggcgcggcacagggcgacggtatcttcaatcaggcggcgcgccacggtgcctggcggtggcagcaacggcagctcatcaaaacggaaccaggccgcatccagcagctctttaccatcgtgctgcagatcgccgctgtcatactccgccataaaggctgtcatcagcgattgcgggaagggccacggctgggaggtaacgtaacggacgtttttgacgcggatattgctctcttccatcacttcgcgggcaacggcctgctccagcgtctcgcccacctccacaaaacccgccagcacggtgtagaccttgttgcgatggcgggcatgattcgccagcaggatttcatcaccgcgacggatagccacaatgatgcagggtgcgatctgcggatagtaacgctcgcgacaatggctgcagagacaggcaaattcatgtttgctttggtgcatttcatggccgcaatagccgcaccagcgatgagaaacggtagaattccgccagttgcacaccgcgacccaccagctgaaacagcgccacatcctgatcgatcagctgtcgtactgagaacatatcggcagaacgcggctcacaaatcagccagactttttcgccctgccactcaccgatggtccgggctttactgccggtcaaaccaaatttttcggcgtttccgtggggtaaatcaccttgtggtaaccaaagtttctgttcatggctgacaatccaccatccagcgtctacgcttgagatttcgcattgcatttatttcgtcatccttagcgtcaactcgcacgctgaagtcctgatgttaagtgtgtagataaacaactataactcacatggagttagatatgcttaaccagttagacgtcctggctgaacgcgtaggtggcagtaatgaactggtcgattcgtggcttgaagcccgtcgtcagctactggtgacctattatcacctggtcggacttaaaccaaacaaagaggcgctgacgcgtcttgatgagcaggctctggacaacttctgtcacggtctggtcgattatctttctgcgggtcacttcagtatctatgaacgcgtgatcagtgaaatgagtggcgacagcccgatgattgccgccgcacagatctatccaccgctggaagccaatactgagcgtctgatgcagctgtatgacggccacctgcagcaggcgatcgacgacgagaactgcatgaccttccagcaggcactctccgaagtgggtgaagtgctggaagcacgctttacgctggaagataagctgattcagctggcatgggacaaccagcttgtccccccgccggttgccaatgacagccatatcgcgcgtccggcttaatcatcatctccggcaaaggggttgagattatcccgtagcccttttatgctgaacaggttctgaggagagtgctccaaagaaccttttttatttttgctttgaaatataaggtttttacgcctggctctgttatcagacacccgcgtaaaaacagcttcttgtcggagtgcccaagttgggctgagaccgttaattcgggatccgcggaacctgatcaggttagaacctgcgaagggaacaagagtaaatattctctgtataccagcatgcttacgctgtctatacggttactccttccgaactccggacaagcatcgttcccccttaacaggaagattgctatgtctgaccaaaaaacaacccgtcgtgaacagcgtgcccaggcgcaggaatttattgattccctgcaaagcggcagtgcatttccccagtcccgccgcatctggattaccggcagccgcgaggatattcgcgttcccatgcgtgaaatcgtgctaagcccgactcacatcggcggcagcaaagaacagcctctctatgagcagaaacgaagcggtaccggtctatgacacggcgggtgcctatggcgatcccgcggcacagatcgatgttcatcggggcctggaaaagctgcgcgcccgctggattgctgaacgcgacgacagcgaacttctcgaacagaacagctcaggctatacccagcagcggctggctgacgaggggctggatcatctgcgtttcgatcaactgctgacaccgcgccgtgcccgcgcaggctgctgcgtcacgcaattgcactatgcccgccaggggatcatcaccccggagatggaatttatcgcactgcgggaaaacatgggccgtgagcgaatccgcagtgaggtattgctgcaacagcatcctggccacagttttggcgcgcatctgccagccagtatcacgcccgagtttgtgcgtcaggaggtcgctgccggacgtgccatcatccctgccaatattaatcaccctgaatcagagccgatgatcattggccgcaactttctggttaaggtcaatgccaacatcggtaactcggcggtgacctcttctattgaggaagaggtggaaaaactggtctggtcgactcgctggggtgccgatacggtgatggatctctctaccggtcgttatattcatgaaacgcgcgaatggattttgcgaaacagcccggtgccaatcggtacagtgccgatttatcaggcgctggaaaaagtgaatggcgtggccgaggcgctgaactgggaaatattccgcgatacgctgcttgagcaggcggaacagggtgtcgattacttcactatccacgctggcgtgctgctgcgttatgtcccgatgacggcgaaacgtctgaccggaattgtatcgcggggtggatctatcatggcgaaatggtgcctgtcgcatcatcaggagagcttcctgtatcagcacttccgggagatttgtgaaatctgcgccgcctatgatgtctccctgtcgctgggcgatggccttcgtccgggttccattcaggatgccaacgatgaggcgcagtttgccgaactgcgtaccctgggcgaactgacccgtattgcctgggaatatgacgttcaggtcatgattgaaggcccggggcacgtcccgatgcatatgatccgccgcaacatgaccgaacagctcgacctgtgcgatgaagcccccttctacacccttggcccgctgaccaccgacatcgcgcccggctatgaccatttcacctccggtatcggtgctgccatgattggctggtttggttgcgccatgttgtgttacgtcacgcccaaagagcatctgggtctgccgaacaaagaggatgtgaagcagggattgatcacctacaaaatagcagcgcatgccgccgatctggcgaaaggccatccgggtgcgcagatccgtgataacgccatgtccaaagcgcgctttgagttccgctgggaagatcagtttaatctggcgctggatccccatacggcgcgggctatgcatgatgaaaccctgccgcaggagtcgggcaaagtggcccatttctgctcgatgtgtggccctaagttctgctcgatgaaaatttcacaggaggtgcgcgagttcgcagcacgtcaggatacgcgcgccgagcccgttgaagtgggcatggcgcagatgtcagaccgttttcgtcggcgcggcggtgagctttatcatcccgccgatgccattaaggaggagtaacgatgcccgcatttcccgctaccgccccgcgcctggggctttatccggtggttgatagccccggctggattgaacgcctgctgaagataggcgttcgtacgctgcagctgcgcatcaaagatcagcccgatgaggtcgccgagcccgccatcgctcaggcgattgcactgggtaaacgctatgacgcgcgcctgtttatcaatgactactggcagctggcgataaagtatcaggcttatggcgtgcatctgggtcaggaggatctcgatgttgccgatcttgcccggattcatcaggcaggattgcgtctggggctctccacccatgacgatgctgaactggatcgcgcactggcaatccagccctcttacatcgcgcttggacatattttcccgacgcagaccaaagagatgccttctgcgccgcagggcattgagcagctgaagcggcatctgacgcgcctgacgcatatccccaccgtggcaattggcggtatctcaattgctcgggcacctgacgtgctggcaaccggcgtgggcagtattgcggtggtaagtgcgattacccaggcagatgactggcgtgaagcaacacgtactttgctggcgctggcagagcctcaccaataaggatttgtggaagctgtcccgcatagcggctgcaaaaccagtaatgccagcgtttctgccgggaaagcggtgcgcaaaagcgtaagttgccgctggcgtgctctgatccaaaaccttaacgtggcctccgtcaggttaaggttatctgaccagggccggttccctcctcttgccggccctgcttcttcttttcgctatgcgagagttgaagctgaaatctgcgtctcatgctggcacgagatcatggcgcgttcgacggctgcacccacaagcgccagcgccttttcagtctgctcgttgatcggcagcccgtagtttaagcgcagacagttacggtatttacccgaggccgaaaagagtgagcctacggctatctgaatttttgactcgcgcaattcgcgattgagccggaccgcatcaaacgcttcggggagttctatccacatcagaaaaccgccctgaggacgggaaacgcagatgccgcagggaaagtagtggcgcacccagcagctaaaggtttcatagttacgatgatagatttgccgcatccggcgcagatggggctgataatggccctggcggataaactcggagaccgcatgctgaggctgtgtggcggtggaacctgtgacgatatatttcatgtgcagtacacggtcgcgatagcggccgggtgcaacccagccgacacgcaaacctggcgccagcgttttggaaaaggagctgcacagcagaaaacccggccatcgagatccagcgctttaatggtcgctgggcgcggatattcccaggctaactcaccataaacatcatcttcaatgaccgccgcgtcaaaccgctgcgccagggcaagcaatgcccgcttacgcggctcaggcatgataaatcccagcggattattacagttcggcacaacaacgactgctttaatcggccattgatcaaacgccagttccagcgcttccaggctgatgccggttaccgcatcagtcgggatctcaatggcacgaatgccaaatccgcgcagggtttgcatgatcccgtgaaacgaaggcgactcaacagcaatgatatcgcccggctcgcagaccgcacgcacggctaccgataacgcttcatggcagccggtggtaataacaatgtcatcggcggtgagctggcaaccgctatctatcgccagtcgtgcaacctgttgccgcagtgcgagaacaccatagaggttgtcataattgagcagcgcgatgtcctgcttctgagcctgtcggctgaaggctttccacagcggcttaagcgtcggttgggtcagatcgggcataccgcttcccagctgcaacacatcatcttccagacggctgttaatcagctccagcaccgcatcccactgcgttacctcaaccggccgctgtgcgggacgggtcagcgcaggcatcgggggcgtcgccttacgcgaggccacaaaatagccagagcgcgactgcggcgtaatcatctgcttctcttccagcagatgataagcctgctgcacggtgctgatactgacgccatgttcggcactcagactgcgtaccgagggcaggcgctcaccactgcgatataaaccttgttcgatacgctgagccagcagcgtggccagatgttcatatcgcgtcattgtatttcctctgactcaggagctgagcattaaccggtacagttatgcctcttttttaccattcagatcgccattaccgcaatctgtatgttaaagaaaggtgatttttgcgtctgtatcatacagagcgatccgctgagaatagtcctcagacaattcactgagggcactatcatgggatacgacgagaatcgcgcagctaaaccgtttacaggcacgccttaccagttggttcgctatctttggcgcagttataaacgctggcagctgaggcgtgagacgcgcgtcatcctgtcgaagctgagtgacagtcagctgaaagacattggccttggccgcaacgactggaatgtctgaatcagagacaaaaaaaaaccctgccgaggcagggtttttatcaggtaaaggacgattaatcgtctttgttgccgccgagaccggcgttcaacagttcagccaggctggctgaggcttcatccgcagtaacctgcggtgcaaccggaacttcacctgccgctttacggcgcatacgatcctgatggtacgcataaccggtaccggccgggatcagacgacccacgattacgtttctctttcaggccgcgcagttcatcgcgcttacctgctactgctgcttcggtcaggacacgcgtggtttcctggaacgatgctgcagagatgaacgattcggtagccagtgacgctttggtaatacccagcaggtcacgcatgaaggttgcgccaacttttccgttcgcttccagatcacggttagagatcttgatgcgagagaattcagcctgctcaccttccaggaagtctgcacttcctgcgctcacgatggttgctttacgcagcatctgacgaacgatgacttcgatgtgcttatcgttaatcttaacgccttgcagacggtaaacttcctgcacttcgttagtgatgtaacgggtcaccgcatgcacgccacgcaagcgcaggatgtcatgtggagactctgggccatcggaaaccacgtcaccgcgctcaacacgttcaccttcgaacacgttcagctgacgccatttcggaatcatctcttcgtacggctcactgccatccagcggagtgatgaccagacgacgcttacctttagtctctttaccgaaggagatgatgccgctgatctccgccagaatagctggctctttcggacgacgcgcttcgaacaggtcagcaacgcgtggcagaccaccggtaatatccttggtaccgccagattcctgcggaacacgcgccagtgtgtcaccagcactgatcttcacgccatcttccagctgaacaatcgctttacccggcaggaagtactgagccggcatgtcggtgcccgggatcagaacgtcgttgccgttggcatcaacaattttcagcgcaggacgcagatctttaccgcccgcagtacgttcagcactgtccagaaccaccagcgaagaaagaccggttaagtcatctgtctgacgggtaatggtctggccatcaaccatgtccgtgaagcgaatgaaaccgcccacttcggtgatgactggcatggtatgcggatcccagtttgcgacggtttcgcccgctgcaacctgctcaccatcacctttcgccatggtagaaccataaggaactttatagctctctttggtacgaccaaattcgtcgatcattttcagttcaacgttacgcgaggtgatcaccagcttacctgccgagttcgttaccgacttagcgttggtcagcttgatggtacctttgttcttcacctgaatgctggattcagcagccgcacgtgatgccgcaccaccgatgtggaacgtacgcatcgtcagctgtgtacctggctcaccgatggactgtgccgcgataacaccgatcgcttcacctttgttgatgatgtgaccacgtgccaggtcgcgaccatagcaatgcgcacacacaccaaagtcggtttcacaacctactactgagcggactttcaggctgtcgactgagttcagttccagcacgtcacaccagtgctcatcgagcagcgtgttgcgtggaaccagaatgtcagcagtacccggcttcagaacgtcttcagcggtcacacgacccagtacacgttcacgcagtggctctttaacgtcgccaccttcgatgacaggtgtcatcatgatgccttcgtgtgtaccacagtcatcttcggtaacaaccagatcctgtgcaacgtcaaccagacgacgcgtcagataaccggagttcgccgttttcagtgcggtatccgccagacctttacgagcaccgtgggttgagatgaagtactggagtacgttcaacccttcacggaagttcgccgtgattggtgtttcgatgatggagccatctggcttcgccatcagaccacgcataccggccagctgacgaatctgtgcagcagaaccacgcgcaccggagtcagccatcataaagatgctgttaaaggaaacctgtcgctcttctacgccgtcacggttaataacggtttcggttgagaggttttccatcatcgccttggcaacacgttcgttggctgctgcccagatatcgatgactttgttgtaacgttcgcctgcggttaccagaccagactggaactgctcctggatctcagccacttcagcttccgcttcggtgatgatttccactttcttctctggaataaccatgtcgtcgatgccgacagacgcgcctgaacgggctgcgtaagcgaaaccggtgtacatggtctggtcagcaaagataacggtcggcttcaggcccagaatgcggtaacaggtgttcagcattttggagatagcttttttgcccagcgcctggttaacgatggagaaaggcagaccttttggcacgatcatccacaggatggcacggccaacagtggtatcgatgatgctggttttagcaacccactcatcctgctcatttttctcgtgttcggtgatacgcaccttaacgcgagcatgcagcgatgcgaggccagcgcgataaatacgctcagcttctttcgggccagtcagcaccatgccttcgcctttggcgttaacacagtcacgggtcatgtagtacagacccagtacaacgtcctgagaaggaacgatgattggctcgccgttcgcaggtgacaggatgttgttggtcgacatcatcagcgcacgtgcttccagctgggcttccagcgtcagcggtacgtgaacagccatctggtcaccatcgaagtcggcgttgtatgccgcacaaaccagcgggtgcagctggatcgctttaccttcgatcagaaccggttcaaaggcctgaatacccagacggtgcagcgtaggcgcacggttcagcagaaccgggtgctcacggatcacttcgtcgaggatatcccagacaaccgcttcttcgcgctcaaccattttcttcgcggctttgatggtggtggccaggccacgcagttccagcttgccgtaaatgaacggtttgaacagttcgagtgccattttcttcggcagaccgcactgatgcaggcgcaggtatggacctacggtgataaccgaacgaccagaatagtcgacacgtttacccagcaggttctgacggaaacgaccctgcttacctttgatcatgtcagccagcgatttcagcggacgcttgttggaaccggtgatcgcacgaccgcgacgaccgttgtccagcagtgcatcgaccgcttcctgcaacatacgcttttcgttgcgcacgatgatatccggcgcagccagatccagcaggcgtttcaggcggttgttacggttgatcacgcgacgataaagatcgttcagatccgacgttgcgaaacggccaccatccagcggtaccagcggacgcaaatccggtggcagaacaggcagcacggtcaggatcatccactctggcttgttgccagactgtacgaacgcttccagcagcttgatgcgcttggtcagttttttacgtttggtttcggagttagtttcgttcagctcttcacgcagctgctcgcactcctgctccagatccatgtttttcaacagggcctggatcgcttcggcgcccattttggcgtcgaactcgtcaccgaactcttccagagcgtcaaggtactgctcttcagtcagaatctgacgcttctcgaggttggtcatgccaccttcgattaccacgtaagattcaaagtagagcacgcgctcgatgtcacgcagtggcatatccagcagtaagccgatacgcgatggcagtgacttcaggaaccagatgtgcgcagtcggcgacgccagttcgatgtggcccatacgctcacggcgtactttagtctgggtcacttcaacgccgcacttctcacaaatcacaccacggtgtttcaggcgcttgtatttgccgcacaggcactcatagtcttttaccggcccgaagatacgggcacagaacagaccatcgcgctctggcttaaaagtacggtagttaatggtttctggctttttcacttcaccaaaagaccaggaacggatcatgtctggcgaagccagcgcaattttgatcgcatcaaactcttcggtcttagtttgcgctttcagaaacttaagtaagtctttcacggattagctcccgtcggagtgagactcagagggcgtccaaccgaaattgaacgccccgtaaccagtacaattgcgagcgctttaaaccctgcgctttcaggcggcggcgaaccgcagcctgaaaagggggttactcgtcttccagctcgatgttgatacccagcgagcgaatctctttcaacagtacgttgaaggattccggcatgcccggttccatctgatggttaccgtcaacgatgtttttatacatcttggtacggccgttgacgtcatcagacttaacggtaagcatttcctgcagggtatacgcggcaccatatgcttccagtgcccatacttccatctcaccaaagcgctgaccaccgaactgtgccttaccacccagcggctgctgagtaaccaggctgtaggaaccggttgaacgtgcatgcatcttgtcatcaaccaggtggttgagtttcagcatgtacatgtagccaacggttacctgacgttcgaactgctcaccggtacggccgtcaaacagggtaatctgaccggaagaaggcaagccgccgagctgcagcagctctttgatttcgctctctttcgcgccatcaaacaccggagtggcgattggcatacctttcttcaggttctcagccagacgcaatacttcgtcgtcggagaaggtgttcaggtcaactttctgacgcagatcgctacccaggtcataggcgcgctggatgaattcgcgcagtttcgcgacgtcttcctgctttttgagcatggcgttgatcttctcgccgatgcctttcgctgccatacccaggtgggtttccagaatctgaccgatgttcatacgcgatggtacgcccagcgggttcagaacgatgtcaaccggcgtgccgttttcatcgtaaggcatatcttcgatcgggttgatcttagagataacacctttgttaccgtgacggcctgccattttgtcacccggctgaatctgacgcttaacagccagataaaccttaacgattttcagcacgcctggtgccagatcatcgccctgggtgattttacgacgcttaccttcgagttttttctcaaactcgtgcttcagctcgtcgtactgctctgccagctgctccagctggttttgcttggcttcgtcagtcagacccagttccagccagcgctcgcgcggcagcttgtccagtttgtctgcttcaacgccaccagaaatcaatacgttctggatacggctgaacaggcccgcttccagaatctgcagttcttcagacaggtctttcttggcctgcttcagctgcatctcttcaatttccagcgcacgtttgtctttttccacgccatcgcgggtaaagacctgaacgtcgatcacggtgcctgacacgccattcggtacgcgcagtgacgaatctttcacgtcagaggctttttcaccgaagatagcgcgcagcagtttctcttctggcgtcagctgggtttcacctttcggcgtaaccttaccaaccagaatgtcgccaccggtcacttcagcaccgatgtagacgatgcctgactcatccagtttagagagtgcagcttcacccacgttcgggatatcagcggtaatctcttccggccccagtttggtgtcacgcgacacgcaagccagttcctgaatgtggatagtcgtaaagcgatcttcctgaaccacacgctcggagaccaggatggagtcttcgaagttgtaaccgttccacggcatgaacgctacgcgcatgttctggcccagtgccagttcacccagatcggtggacgggccatctgccagcacgtcgccgcgctcaaccggctcacccagagaaacacatggcatctggttgatgcaggtgttctggttagaacgggtatatttggtcaggttatagatgtcgataccggcttcgccagcatgcatttcgtcttcgttaactttgataacgatacgtgatgcgtcgacgtactgtacggtaccgccacgtttggcaacggcagttacaccggagtcaacggcaacagcacgttccatacccgtaccaaccagcggcttatcagcacgcagagtcggaacggcctgacgttgcatgttcgcacccatcagggcgcggttagcatcatcgtgttccaggaacgggatcagggacgcaccgacagaaacgatctgttgagtcgaaacgtccatgtagtcaacctgatcgcggctgaacagacttgattcgcctttgctacggcaggtgaccaggtcatcaacaaacgcgccgttatcatcaagaggggcgttcgcctgagcgataacgtagttaccctcttcgatagcagagaggtagtgaatctcgtcagaaaccagaccgtcgataacacggcggtaaggcgtctcaaggaaaccgtactcgttggtctgtgcatacacagacaaggagttgatcagaccgatgttcgggccttcaggggtttcgattgggcagacacgaccgtagtgcgttgggtgtacgtcacgcacttcgaagccggcacgctcacgcgtcaaaccacccgggccgagagcagagatacgacgtttgtgcgtaatctctgacagcgggttgttctgatccataaactgagaaagctggctggaaccaaagaaactctttcaccgcggccgaaattggcttcgcgttgatcatgtcctgtggcatcagggtatcaaggtcgcccagtgacagacgctctttcaccgcacgctcaacacgtaccagaccgacacggaactggttctcagccatttcaccgactgaacgaatacgacggttaccgaggtggtcaatatcgtccacttcgcctttaccgttacggatgtcgatcagcttcttcatcacttcgatgatgtcatctttgctcaggatgcctgaaccttcgatttcatcacgcagcaatgaacggttgaacttcatacgacccacagcagaaagatcgtaacgatcttcagagaagaacaggttctcaaacaggttctctgctgcttcgcgtgttggcggctcaccaggacgcatcatgcggtagatctcaaccagtgcgctcagacgatcgctggttgggtcgacacgcagggtctcggacatatatggaccgtggtccagatcgttggtgaacagcgtttcgatgcgcttgtgaccggactggctcagtttggccagcagatccagtgacagttccatgttcgctgcaatgatcagctcaccggtgctctcatcgatgtagtctttagcgaccactttgcccgcgatatattcaaccggaacttcgatgtgctgaatgccatctttttccagctgacggatatggcgcgcagtaatacggcgtgctttttcgacgtagacggtgccgtttcgcttcgatatcgaaggtcgcagtttcaccgcgcaggcgctcaggcaccagctccatctgcagcttgttgtcgcgaatttcaaacaccactttctcgaagaagatatcgagaatctgaggtgtagtgaactgcaacgcacgcaggatgatagtggccggcagcttacgacgacggtcaatacggacaaacaggttatctttcgggtcaaactcaaagtcgagccatgaaccgcggtaagggatgatacgtgcgttgtagagcactttacccgatgagtgggttttacccttatcgctatcaaagaacacgccaggactacggtgcagctgagaaacgataacgcgctcggtaccattgataacaaaggtaccattgtcggtcatgagcggaatttcgcccatgtagacttcttgttctttaatgtcttttacggtgccttctggcgcttcgcgctcatagaccaccagacgcagtttcacgcgcagcggtgccgaataggtcacgccacggatctgacactctttcacgtcaaagacaggttcacccaggcgatagctgacatactgcaactcagagttgccgctgtagctcgcaatagggaatacagagcggaatgcagcttccagtccgtactgaccttctggatcttgctcgataaacttctggaacgagtcgagctggatggaaaggagataaggtatgtccagtacttgcggacgtttaccaaaatccttacgaatacgttttttctcggtataggagtaaaccatagggttcctcagctagctgacaagtcgacccacgctgtccgtcctgacaggacagttcatgcaacacgattttgtttgattcactggctgcgcagcagcagtgcaatacctctttctatcacgcttaaatcatttcatcgctgttgcgagggcagggaaacccgcacaggtagagcggtatattaagtcgtcgatagagaaagatattgaagagtaacaatggacaaacagtgtgaaaccccattgagaccctgtagcgcaaaaaggctggtgaccaaaaagtcaccagccatcagcctgaaactactcagactgcaacccgaaggctgtcttacttaacttcaacttcagcgccagcttctttcagagcagcttcaagtgcagctgcgtcatctttgctgatcgcttctttgattacgccagttgcttcaaccagatctttggcttctttcaggcccagaccagttgcagtacgtacggctttgattactgcaaccttgttcgggccaacagctttcaggactacgtcgaattcagttttttcttcaacagcttcagccgggcccgcagcaacagctacagcagcagcagcagaaacgccgaatttttcttccatagcagaaaccagctcaactacttccattacggacatcgctgcaacagcttccagaatttggtctttagtaatagacatgacaattgttcctaagaatcagaaaaagtttatacgtaagcaagtacgaagaaaagaatatggccttaagccgcttcttttgcatcgcgtacagcagccagagtgcggaccagtttgccggcagcggcttctttcatggtcgacatcagacgtgccagtgcttcttcgtaggtcggcagcgttgccagacggtcaatattggccgccgtgatcagctcaccttcaaaggctgcagctttgacctcaaattttgcattcgctttcgcgaaatctttgaacagacgagcagcagcgcccgggtgttccatagaatatgcaatcagggtcggaccaacaaacgtgtctttcaggcactcaaactgagttccttcaacgacgcggcgcagcagggtgttacgaacaacacgcatgtaaacgccagcttcacggcctgctttacgcagttcggtcattttatcaacggtaacgccacgggaatccgcaacaaccgctgaaagcgcacctttggctacttcgctgacttcagcaacaatcgcttgtttgtcttgaagatttaatgccattagcttttgctcctggatttgaccgggaaaggatttccccggaactcacttcacttactcaccccaaggggaaataagcgctcgaacacggtgagcagaatccagctaagaaaaaattcttttggttctgtcaccgtctacgcagggtattaagcggaatatccggagataagcagctcctgcggtcttggacggaggccaggataaggcctggctccaacctaaattctgtgcgacgcagcagagtcagagggaaaggcgatacacgcaacaatcagttctggctctctggtgtcctgttccgttaataacagaacaacgggcgtaagattctaggtgaatttttcgcccgtttcaagcagcaattagtttgctgttgcgttcagaccagcctggtcaacggcaacgccggcgcccatggtggttgaaaggctaactttcttgatgtacacgcctttcgcctgagatggttttgcttttttcagcgcaaccagcagagattccaggttttctttcagtttgtcagcgtcaaagtccactttaccgatggtagtgtggatgatgccgtttttgtcgttacgataacgaacctgacccgctttagcgttcttaaccgcttcagcaacgttaggcgttacagtaccgactttcgggtttggcatcaggccacgtggacccagaatctggcccagctggccaacaacgcgcattgcatccggagaagcaataacaacgtcaaaattcatttcgcctttcttgatctgatcagccaggtcttccatgcctaccagctcagcgcctgctgctttagcagcttcagcgttggcgccctgggcgaagacagcaacacgtactgaacgaccagtaccgtgtggcagaacggtcgcgccgcgaacgttctgatcagatttacgtgcatcaatgccgaggttgacagcaacgtcaacgctttcaacgaacttggcagtagccagttctttcagcagagcaacagcttcagcaatatcatactgcttggtcgcgtcaactttgtcgcgaattacggtcatgcgcttggtcagcttagccatttcttagtcctctactaccaggcccatggaacgagcagtaccttcgatggagcgagtcatcgcttcaacgtcagaaccagtcatgtccgcagctttggtttctgcgatttcacgtacctgagcacgagtcactttaccgactttatctttgttcggcttaccagaaccagacttgatgcccgctgcttttttcagcagtacggcagccggaggcgttttggtaatgaaggtaaaagaacggtcgctgtatacggtgataacaacaggagtcggcagacctttttccagagattcggtcttagcgttgaacgctttgcagaattccatgatgttaacaccctgctgacccagagctggaccaaccggtggacttgggttcgccataccagctgcaacctgcagcttgacgtaggcttggactttcttagccatgatatttcctcaattgggttatagcgcctgtaaaggctccccgtgataacgatttacacgctgttgccagcgcataaaaacaaaaggcgcgaaattgtagttaaatttcgcgcctgctgcaacagctaatttgtgagcggaaagaggttaacctttctccacctgaccgaagtcgagctcaaccggcgtcgcacgtccaaagatggaaacggataccgtcaggcggctcttctcgtaatccacatcttcaaccacaccgttaaagtcagcaaaaggaccgtcattaacgcgaaccatttcacctggctcaaacagcgttttcggacgaggcttgtcgccgacctgctgcagacggttcatgatcgcatcaacttctttatcgctgataggtgccggacggtcagatgtaccgccgatgaaacccatcacgcgtgggacgctgcgtaccaggtgccagctggcgtcattcatcaccatctgaaccagtacgtatcccgggaaaaacttgcgctcgctcttacgacgctggccaccacgaatttcaacgacttcttcagtcggaaccatgacgtcgccaaacagctcttccatgttgtgcaatttgatatgctcgcgcagcgattgtgctacgcggccttcaaaaccggaaaacgcctgtacgacgtaccagcgtttctttggagcttcagacatctcagaaacctcaggccagtgataaacgataccagacggaccagaataccatccagcccccacaaaatcagtgacatcacggcagtaaccgcggcaacgattaacgtggtgtgcagcgtttcctggcgggttggccagataaccttacgcatttctgttcttgcttcacgagcaaaagccacggtcgctttgcctttggtcgttaaaagcgcaatgccgccagccgctgcaatcagtacaactacggctaaagcacgcagtggcagtgacacatcacgatagaggtagttacctacaatcgctgcaagcagcagtaatacgactactacccactttaccgcttccaggccacgcccgctcccttgagcttcggtattcgcactcataaaccaacctgccacaataattcagaaactattctgccccgcagtgcgaggcgtccaaaccgaatgagcttttggggcgtaactcggtatccaacgccgcataacagagcctgtctcagcaatgattatgattcaaaaaatcactgatgagccaggttctatgaaacagcgtgcaaaaagggcatcaaatgatgccctttccgtgtgcattgcgtcaaacgttatcggtaattatgcgataactttagcaacaacacccgcgccaacggtacggccaccttcgcggattgcgaaacgcagaccttcgtccattgcgattgggtgaatcagggtaacaaccattttgatgttgtcgcctggcatgaccatctcaacgccttctggcagctctactgaaccggttacgtcagttgtacggaagtagaactgtggacgatagcctttgaagaacggagtatggcggccaccttcgtctttagacagaacgtaaacttctgactcgaactgggtgtgcggcttgattgagcctggcttagccagaacctggccacgctggatgtcttcacgcttgataccgcgcagcagaacaccacagttttcgcctgcctgaccctggtccagcagcttacggaacatctcaacaccggtacaggttgatttcgcagtatctttgatacccacgatttcaacttcgtcgccgactttaacgatgccgcgctcaacacgaccggtaacaacggtaccacggccagagattgagaatacgtcttcgattggcagcaggaacggcatgtcgatcgcacggactggatccgggatgtagttgtccaggtgttcagccagctcaacgatttttgcttcccactcaggaacgccttccagcgctttcagagcagaaccacgaacgatcggggtgtcatcgcctgggaagtcgtactgtgacagcaggtcacgaacttccatctctaccagttccagcagctcttcatcatcaaccatgtcacacttgttcaggaaacacgatgatgtaaggaacgccaacctgacgacccagcaggatgtgctcacgggtctgtggcattgggccatcagtcgcagcaacaaccaggatcgcgccgtccatctgcgcagcaccggtgatcatgtttttcacatagtcggcgtggcctgggcagtcaacgtgagcgtagtgacgtgcagcagtctcatactcaacgtgtgcggtgttgatggtgataccgcgggctttttcttcaggcgtgctgtcgatctgatcgaatgcacgagcctggccgccgttggttttagccagtacggtagtgatagctgcagtcagggtggttttaccgtggtcaacgtgaccgatggtgcccacgtttacgtgcagtttgttacgttgaaattgctctttagccatcgctagtccctctaagacacggatatatcaatgatatcatcacattaaccaggcaatgcctgactgcaaggaagttacagagaaaatcaggagggagattaaaggaagtggtgctgatacccagagtcgaactggggacctcacccttaccaagggtgcgctctaccaactgagccatatcagcacatctggagcgggcagcgggaatcgaacccgcatcatcagcttggaaggctgaggtaatagccattatacgatgcccgcatcctggaactcggctacctgttctttctgtagcttgcagataacagagatgtttctctactatctactgcctgtcagcgaagctgaccgactttgacttcgctaacgctcagtctgaattcagggtgataagtgactcacctgacagataaacaggttgtttatctgtgttcccaaccgcgaggttgagatggtggtgggagaaggattcgaaccttcgaagtctgtgacggcagatttacagtctgctccctttggccgctcgggaatcccacctacttgatggtgccggctaccggaatcgaactggtgacctactgattacaagtcagttgctctaccaactgagctaagccggcatcaagtggagcgcattctaggaaggtcgggctctggatgcaactaaaaaatcgcttatttttttctatcgcttactatttgtgcaaatcatcgcattttagtgtttttgtgcagaatatttgtgcaatctagtcctgttttcataggatcagtcggctcgcgctaatgccttaggcctctctctggaccgcttttcagcaggtaaatgatctgcagggagtatttttatttcacacgcctgtaccgaacgatgcttttttgacctcgcctgcgcttttttttcatgtgcaggcacttttctgtagaaaccaggcctgttttgacatgcgtgtcccttatgtcggtacgacgatgaccaggcgtggagcctttcaaaatgactctatgctgttgttcgtttgctgaagtccttatgggacatattgaatctgtaccgcctcagcctctctatatgcccttatggcggcgttttgtcattcagacgttgtcagatgtaaaaagcagataaaagccgcacatgcgctgtgatgtcctgcaatatcataaacaacgataaagcagtaaaaattaaagccaccatgatgttttgtgggtatgccgacgaaagcgagatcacgtttatctttttacttctgttaaaagccatactggtgataccctccagcccattgttctcactgataaaccagcgattcgtgattcacttcacctgtgctgtcctgcttatcggataacacgcggttgatagccatgaatttgcggtcagatgcatgcttatggataaaacgacccccctgacaacgccttatttagagttcactcgtgagcaatgggctgcattacgtgattccgtacctatgacgctgtcagaggaagagatcgcgcagctggagggcatcaacgaggatctctcgctggaggaagtagcggaaatttatctgccactttcacgcctgcttaatttttatataagttctaacgttcgccggcaggctgtactggagcaatttctgggcaccaatggccagaaaatcccctatatcattagtattgcgggtagcgtagcggtcggtaaaagcacgactgcgcgtgtcttgcaggctttgctcagccgctggcctgaacatcgcaaagtcgaattgatcaccactgatggcttccttcatcctaatgccgtgctgaaagagcgtgggttaatgaagaaaaaaggattcccgcaatcctacgatatgcaccggttggtcaatttcgtctccgatttgaagtcgggagccagtcaggttactgctccggtctattcacatctgatttatgatgtcatccctgatggcgataaagtgatacagcagccagatattctgattctggaaggactgaatgtattacagagtggaatggactatccccacgatccccatcatgtctttgtttcagatttcgtcgatttttctatctatgttgatgcagaggaagatctcctgcaaagctggtatatcaatcgattcctgaaattccgccagggcgcatttaccaatccggactcctatttccatcattacgcccagctttcagaagcagaagcggttgaaattgctggtaatttgtggaaagagattaactggcttaacctgcaggaaaatatcctgccgacgcgcgaaacgagccagcctgattatgaccaaaagtggcgatcatgcagtcgataaggttcgcttgcgtaaataactgctgtcataaaaaagcctgcgctgctgcaggctttttttactcagacaggacgcagtgatatttctccacccacccaggcttttatttcgccatcctgttccagtaacaggccaccctggctgtctacgcctcgcgcaataccatggacctcacgttcaccgataagcagcttaaccggccggttaataaagttatccagcgcagcccagcgtgcgacaaacggggttaatccctcctgctcaaagagcggcagagcttcgcgcagactgttgatcagacgtgccgcaagctcattgcggtttaccgttaccccggcctcctgcaggttaatccagccctgattaatctgtgatgcatcggctgttcgcatcgccaggttaatccccgcaccaatcacgatctgcgcagcatcgccggttttacctgtcagttcgaccagaatacccgccagtttacgatcgttcaggtaaatatcattgggccattttacgcggacatcatcggcccctaatgaacgtaatgtctcagccatgataatgccaattaccaggctcagacccatcgccgctgccggcccctgctccagacgccagtacatagacatgtagaggtttgcgccaaagggcgaaaaccactgacggccacgacggccgcgacccgcctgctgatattccgcaatgcaggcagcacccgactccatttcatgcatacgttccagcagatactgatttgtggaatcaatcaccgggattaccgagacgttaccctgcgtaacctgtgagagtatcgcctgctcatccagcagctgtatcggggcagagagactgtaacctttgcctgtcacggtatagacatcaagaccccagctttttaacgtctggatatgcttatttatggctgcgcgactcatgcccagcgtttcacccaactgctcaccggaatggaactcaccatcagataagatatcaaccagctttagcggaacattatggtctttcatgcgatcaccccgacggcattacactcaccctgcgcctgaataaagcgcacttcgggttcaagccagacatcgaatttttcaccaacctgagcgcgcacggtttttgccagcgcaacgatatcgtcgggagtggcattttcagcgttgatcagcaccagagcctgttgctggtgaactgccgcgcccccgatgcgataacctttcagctggcactgatcgataagccatcctgctgccagtttgatttcaccatttggcatcagatagtgtggcatagccggaaaatgcgttagtagtgagctgcactgcgcctcggtgacgacaggatttttaaaaaagctgcctacattaccggtgactttcggatcgggtaatttgctctgccgcatctggcataccgcgtgatagacatcccaggcattggccgtcaccggattgagcgttttcagatcgccgtaggttaataccggttgccattgcttaggcaatattatcccgactgcgacgatgacatagcctgactggtagtgatgtttaaaaatgctgtcacgatagccaaactcacaggcttcacgatcgagacgtttctgtctgaccactgtgcagattaagtacatccacgtattcgcagacgtcttttaattccacgccataagcacctatgttctgaatcggtgccgaaccggtcataccagggatcaacgccagattttccaggcctgtgattcctttttccagcgtgcttttaaccagctgatgccagttctcacctgccccaacgtgcaatttccagcgctcatattcatcctgaattttgatgcctttgatgcggttcagcaccactgtaccggcaaaatcttccaggaagaggacattgctgccttcaccgagcacaaggaaaggcgtttgatcactctggctggcctgccatgctgccagaatggcggctggcgtctcggcgacgatgcgtttctgtgtatgtacttcaagcccaagcgtattgtcggcttttaaggagggatgctggctggacatttgacggcctttactgagttatctggccgtagtttaccgtatcagagaggggttctcaggctgttttcgggggttatgatgaggtttttcacgatctgcagacgtaaaaaagccccgcactttcgtgcggggcttcttcacttatttaatgcctggcagttccctactctcgcatggggagaccccacactaccatcggcgctacggcgtttcacttctgagttcggcatggggtcaggtgggaccaccgcgctaaagccgccaggcaaattctgtctccgcgccgcccgtaaggccgcgcagaatatccggtacaggctgaaaattctgtctctcaaaaacgcctctggcgttgtaaggttaagcctcacgggtcattagtaccggttagctcaacgcatcgctgcgcttacacacccggcctatcaacgtcgtagtcttcaacgtcccttcaggactctcaaggagtcagggagaactcatctcggggcaagtttcgtgcttagatgctttcagcacttatcttttccgcacttagctaccgggcaatgccattggcatgacaacccgaacaccagtggtgcgttcactccggtcctctcgtactaggagcaacccccctcaattctccagcgcccacggcagatagggaccgaactgtctcacgacgttctaaacccagctcgcgtaccactttaaacggcgaacagccgtacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctgctttcgcacctgctcgagccgtcactctcgcagtcaagccagcttatgccattgcactaacctcacgatgtccgaccgtgattagctgaccttcgtgctcctccgttactctttaggaggagaccgccccagtcaaactacccaccagacactgtccgcagcccggattacgggcctacgttagaacatcaaacattaaagggtggtatttcaaggttggctccacgcagactggcgtccgcgcttcaaagcctcccacctatcctacacatcaaggctcaatgttcagtgtcaagctgtagtaaaggttcacggggtctttccgtcttgccgcgggtacactgcatcttcacagcgagttcaatttcactgagtctcgggtggagacagcctggccatcattacgccattcgtgcaggtcggaacttacccgacaaggaatttcgctaccttaggaccgttatagttacggccgccgtttaccggggcttcgatcaagagcttctccttgcggataaccccatcaattaaccttccggcaccgggcaggcgtcacaccgtatacgtccactttcgtgtttgcacagtgctgtgtttttaataaacagttgcagccagctggtatcttcgactggcttcggctcggggagtaaatccctccacctacgcgccagcgtgccttctcccgaagttacggcaccattttgcctagttccttcacccgagttctctcaagcgccttggtattctctacctgaccacctgtgtcggtttggggtacgattctgtgttacctgatgcttagaggcttttcctggaagctgggcatttatcacttcagcaccgtagtgcctcgtcgtcacgcctcagcgttaacaagcgtccggatttacctggacactccgcctacacgcttaaaccgggacaaccgtcgcccggctgatatagccttctccgtccccccttcgcagtaacaccgagtacaggaatattaacctgtttcccatcgactacgcctttcggcctcgccttaggggtcgactcaccctgctccgattaacgttgaacaggaacccttggtcttccggcgagcgggcttttcacccgctttatcgttacttatgtcagcattcgcacttctgatacctccagcatgcctcacagcacaccttcgacggcttacagaacgctcccctacccaacaacacatagtgtcgctgccgcagcttcggtgcatggtttagccccgttacatcttccgcgcaggccgactcgaccagtgagctattacgctttctttaaatgatggctgcttctaagccaacatcctggctgtctgtgccttcccacatcgtttcccacttaaccatgactttgggaccttagctggcggtctgggttgtttccctcttcacgacggacgttagcacccgccgtgtgtctcccgtgataacattcttcggtattcgcagtttgcatcgggttggtaagccgggatggccccctagccgaaacagtgctctacccccgaagatgagttcacgaggcgctacctaaatagctttcggggagaaccagctatctcccggtttgattggcctttcacccccagccacaggtcatccgctaatttttcaacattagtcggttcggtcctccagttagtgttacccaaccttcaacctgcccatggctagatcaccgggtttcgggtctataccctgcaacttaacgcccagttaagactcggtttccctgcggctcccctatacggttaaccttgctacagaatataagtcgctgacccattatacaaaaggtacgcagtcacccccataaagaaggctcccactgcttgtacgtacacggtttcaggttctgtttcactcccctcgccggggttcttttcgcctttccctcacggtactggttcactatcggtcagtcaggagtatttagccttggaggatggtccccccatattcagacaggataccacgtgtcccgccttactcatcgagctcacagcatgtgtgtttttgtgtacgggagtatcaccctgtaccctgcgactttccagacgcttccactaacacacaagctgattcaggctctgggctgctccccgttcgctcgccgctactgggggaatctcggttgatttcttttcctcggggtacttagatgtttcagttcccccggttcgccttgcagcactatgtattcatgctgcaatgatgcacagagtgcaccgggtttccccattcggacatcgacggctgtagcggttcatatcaccttaccgtcgctttacgcagattagcacgtccttcatcgcctctgactgcctgggcatccaccgtgtacgcttagtcgcttaacctcacaacccacaggcgtttttcaacgctgcgtgttgcaagcatttgagagactcgaacgcatcgccaaatcattccttattacggaggaatgacgcgctgcgtcgtttcaattttcagcttgttccggattgttaaagagcaaatatctcaaacgcggcccggctgcttacgcaaccaaatcggttttgagatactgtatggagacacctttcacctgtcaccaagcaggtggcgtcccctaggggattcgaacccctgttgccgccgtgaaagggcggagtcctaaccgctagacgaaggggacacaaaagtgtcacgacttcgcagccgtcctgctcattactttttatcagacaatctgtgtggacactgcgcgggaaggtatcttcaggtaaggaggtgatccaaccgcaggttcccctacggttaccttgttacgacttcaccccagtcatgaatcacaaagtggtaagcgccctcccgaaggttaagctacctacttcttttgcaacccactcccatggtgtgacgggcggtgtgtacaaggcccgggaacgtattcaccgtggcattctgatccacgattactagcgattccgacttcacggagtcgagttgcagactccgatccggactacgacgcactttgtgaggtccgcttgctctcgcgaggtcgcttctctttgtatgcgccattgtagcacgtgtgtagccctactcgtaagggccatgatgacttgacgtcatccccaccttcctccggtttatcaccggcagtctcctttgagttcccgaccgaatcgctggcaacaaaggataagggttgcgctcgttgcgggacttaacccaacatttcacaacacgagctgacgacagccatgcagcacctgtctcagcgttcccgaaggcaccaaagcatctctgctaagttcgctggatgtcaagagtaggtaaggttcttcgcgttgcatcgaattaaaccacatgctccaccgcttgtgcgggcccccgtcaattcatttgagttttaaccttgcggccgtactccccaggcggtcgacttaacgcgttagctccggaagccactcctcaagggaacaacctccaagtcgacatcgtttacggcgtggactaccagggtatctaatcctgtttgctccccacgctttcgcacctgagcgtcagtctttgtccagggggccgccttcgccaccggtattcctccagatctctacgcatttcaccgctacacctggaattctacccccctctacaagactcaagcctgccagtttcaaatgcagttcccaggttaagcccggggatttcacatctgacttaacagaccgcctgcgtgcgctttacgcccagtaattccgattaacgcttgcaccctccgtattaccgcggctgctggcacggagttagccggtgcttcttctgcgggtaacgtcaatcgacagggttattaaccccgtcgccttcctccccgctgaaagtactttacaacccgaaggccttcttcatacacgcggcatggctgcatcaggcttgcgcccattgtgcaatattccccactgctgcctcccgtaggagtctggaccgtgtctcagttccagtgtggctggtcatcctctcagaccagctagggatcgtcgcctaggtgggccattaccccgcctactagctaatcccatctgggttcatccgatagtgagaggcccgaaggtccccctctttggtcttgcgacgttatgcggtattagccaccgtttccagtggttatccccctctatcgggcagatccccagacattactcacccgtccgccactcgtcacccaagagcaagctctctgtgctaccgtccgacttgcatgtgttaggcctgccgccagcgttcaatctgagccatgatcaaactcttcaatttaagtttgatttgcttaaacaagttaagcggtgctcatctgtaaaacgtcataatgaatttcattatgtgttcactcgtgaggcttgatatttttttacgtccggagacgctgatatcaatcctgcgagtgcccacacagattgtctgataaattgttaaagagcagtgcgaacagtgcgttagcgtcctgtcgcgaggtggcgtatattacgctttcctcctgcagagtcaacctctttctcagaagtttttctccggcggcgcagtctcctgtgcctctcaacccgcttcccgttgccggtgttccgtgtcgatggaggcgcattatagggagtttccgcgggctgacaagcgtttctttgaattaatttgctgagcgcatcttttttaaacgaacggcttaaaaagagacgtttcatgacggaataacgcacaaagatcgccattaaacgttgtaaagagacctgccgttgcttaatgcgggtgctattattttgcttcttctcgcaggataaccccaggaaggatactcaatgataaaatccgcgcgcagcatggctggtttgccatggatagctgccatggcctttttcatgcagtcactcgacgccaccatactgaatactgccctgcccgctatcgccaccagcctcgaccgtttctcctctggccatgcaatccgccgtcatcagttacaccctgactgtcgctatgttgattccggtcagcggctggctcgccgatcgctacggcacgcgcaaggtatttatcgttgccgtttcgctgttcaccctgggctcgctggcttgtgcactttctcccacactccaggtactggtcatctcgcgcatcatacagggcgtcggtggcgcaatgatgatgccggtcgcgcgactggcgctgttacgcgcctatccgcgcagtgagctgttgccggtgctcaactttgtcaccatgccgggattagttggcccgatactggggccaatgctgggcggcgtgctggtgacctacgcgacctggcactggattttcctgattaatatcccgattggcattctcggcattatctacgcacgcaaatatatgccggacttcaccacgccgaagcgccgcttcgactttttcggcttcttattgttcggggctggactggtgatgatctcgattgggattgagctgtttggcgagcggattgtttccgcctggctggcgggcgggatattactcagcgggattgtgcttttgcttctttatatagtgcatgcccgaaatcacccttcgccactgatcaatctgccgatgtttaaaacccggacgttctcagtgggcatcggtggcaacatcgcgtcacgtcttggcaccggttgtgtgccctttttgatgccgctcatgttgcaggtcggctttggctattcagcgattatcgcgggctgcatgatggcacctatcgccattggttcaatactggcgaagtcgacggtgacgcaactgctgcgctggctgggttaccgccgcctgctggttggcattaccgccattattggcattctgatcgccagcttctctctgcagtcgcccgctgaaagcatcatcgtgctattacttccgctgtttattctcggcatggccatgtctacgcagtttaccgccatgaatactatcaccctggccgatctgaatgatgataacgccagcggtggtaacagcgtgctggccgtgactcagcagctagcgatcagttttggtgtggccgtcagcgccgcggtgctgcgcttctaccaggagtttgaaaccagcaccatttcacagttccacgccacgtttatgaccatgggcgtggtaacagtactgtcggcgctgacctttatgctgctgaaaaacggcgatggccgtaatctgatcagtaatcgcgacaaaaagaaaaagcgctaaaccgatccacgcaccaccagttccggcgtcagcaccagcgtttgctgactggcgtcgggattgctgagacgatggagcagggtgtctatcgccagttcacccagcgcatctttcggttgatgaatggtactcagtggcggagtgagatagcgcgccagttcgatatcgtcatatcccattaccgccatctgctgcggaacctgcatgccggcctgatagagtgcgtgataaacgcccaccgccatggcatcgttgctggtgaaaaccgcttccggcggcgtttccagcgccagcagttcgaccatcccgttgtagcctccctggaattcaaagtcaccattcaccacatagccgggcagaatcgtcaggccactctttgtcatggcgttgcgataaccttccaggcgcatacgagccggggttttatcctgtggaccggcgatacaggcgatgcgggtataaccactgtcgataagatgctgagtcgccagctccccgcccagcagcgcgttatcctgaataatgtcaccacggccttcaaacggcgcccagtccatcatgacggcaggtatagagggataacggttcagaatgtcggccgagggcaggtgactttccgtacacataatcaataaaccgtcgacgcgcttctgcatcagcgtttccaggctgcggttcatccgctcttcatcacctgccgtgttacagagaatcaggctgtagccacgctgatagcagctctcctccacaccccgcaccacttcggcataaaatgggttactactggtggtcagaagcataccgatcgtgtgcgtctgattgattttcagactgcgcgccagcgcagagggggcgtaattcagatggcggatggcctgctcaactttttcgcgcacgccttcactaacaaagcgattgttattgataacgtgcgagacagtggaggtagagacgcccgccaggcgagcgacatctttcatggtgctcaaatgcttagccctgctgctgcaaaaattcatcgatctccgcgcgccacggcacggagggctgcgcacccgagcgggtaacggcgatagcagcggcggcatgggcaaaccgcaccgcgtcatacatcgttttctgctccagtcgcgcggtgataaaggcgccattaaaggtgtcgcccgccgcgatggtgtcgatagctttaacactgaagccagcaatacgctgaccttctccctgctcgctcagccagacaccgcggcgacccagagtaatcagaaccgtgccgatacctttcgcatgcagtactgccgcagcgcgggcggcatcttcatcgttgctgaccgcaatgccggtcagactctcggcttcggtttcattcggggtaataatgtcgatcaacgccagcagttcatctgagagctgggtggcgggtgcaggattgagaataacctgcgtctgatgctgtcgggcaagcgtcgcggcggccagcacactttccagcggtgattccagctgcattaatagtgcatcggcgtcggcgataacctgctgatggcgcgtcacgcaggcgggtgttaacgccgcgtttgcaccggagtagatgccgatgttgttctcaccgtcaccattgacgaaaatcatcgccacgccggttgactcaccctcgaccacttcgaccggcgtagtatcaatattgtcctgggccagttgctgacgaacacgttcaccaatgtcgtcagcgcccacacaggcgataaatgcgatatcggcaccagcacgaccggcggcgacagcctgattcgcacccttaccgccaaacgcaatctgataattctgcccgatcaccgtttcaccgggacgaggaaagtgcgccagattaaggatgtggtcagcgttaatgctgccaagaacggccagttttgcgtttttgctcattaggggagtccggaataagtgcgccaccaggagggtggcgcagtgccctgcttttctttgagttattgagtgaccagcttcaggtcgaccgggttgatcgccttcactttttcacccttcagcactttatcagcggtatctacgccgatcatgccaattttgtctggcatctgtgccacagtcgcggacagtttgccaccttctaccgctttaacgccatcagcagtaccgtcaaaaccaacgacgatcacaccagttttaccggcggtctgcagcgcacgcagtgcacccagcgccatttcgtcgttctgagcgaatacggcctgaacgtccgggtgtgcctgaagcaggttctgcatgacgttcagacctttggtacggtcaaaatcggctggctggctggcgaggatctggaatttatgcgcatcagcggcctgtttgaagccttcgccacgctcacgggcggcagaagtcccggcaatgccctgcagttcgataattttggcgttttcgccgacttttttggcgatgaagtcgccggccattttaccgccgaaacggttatcggaggcgacgtggctgacaacggtgccctgtgccgcaacgcgatccagcgtgataaccgggatgttcgcctggttagccatcttcaccgcattgcccacagcatcagagtcggttgggttgatcagcagcaatttggtgccgcgaaccgtcagatcctgcacgttagccagctctttcgccgggttgttctgtgaatccagcaccaccaggttgtagcccagcttgtccgcttctttctgcgcgccctctttcagcgaaacaaagaacgggttattcagggttgaaaccaccagcgcgatagtatctttagccatagcgctggtactgagcgttgcgccaaggatcacggccagtgcggttaactttttcatcatgtcatcctgtgtaaggtcagagttatttactgcttttattatctaccagcaccgccagcaggattactaccgccttaacgatcatctggtagtacgaagagacgcccatcaggttcaggccgttgttcaggaagccgaggatcagcgcgccaatcagggtgccgaaaatacggcccttaccgcctgccaggctggttccgcccagcacgaccgcagcaatcgcatccagctcatagccggtacccgctgtcggctgtgccgaagaaaggcgcgccacttcaatggtgcctgccagcgctgccagcatgccactcagtgaatagacgatgattttgacgcgattcacattgatgccggagagacgcgttgccgcttcattaccgccaagcgcatagatatagcgacccagacgggtgtgctgcagcatgtaccaggcagcaataaagaccagcgccatcagccagaccggcgctgggatacccagcggacgaccaataccaaaccagcccagcagatcggcattggcattaaaacccgtgtttaccggactgccatcggtgtagaccatggtgacaccacgcagcagcagcatcatgaccagcgtggcgataaacgcctgcactttgccgcgcgccacaatggtgccggtcagggcaccgattgccgctcccagcgccagcgacgccgccaccgcgaccagggcattgacctccatacccaccagcgacgcacccaccgcgccagtcagggccagcagcgatcccacagagaggtcgataccagaagtcaggatcaccagcgtcatcccgaccgccataatggcgttaaccgaggtctgctgcagaatgttgaacaggttcgccacggtaaagaagttcgggctctggctggccaccacggcgatcagcaccatcagcgcaatcagcgacttctgttccagtagccagcttttgctaaaccagcgacggctggcaggtaaagtttgggtcgtcataccactaaatcctcgctgtgttgcttgcctacggcggctgccatcaggctctcctgagtggcttcttctcgggtaaattcgccgctgatacggccttcatgcatcaccagaatccgatcgctcatgcccagcacttccggcatttccgaggagaccagaatgatgctcagcccttcggctttaaactggttaatcagttgatagatctctttcttcgcgccgacatccacaccgcgtgtcggttcatccagaatcagtacgttaggccgggtcatcagcccgcgggcaatcgccactttctgctggttgccgcccgaaagcagaccaatgggctgctccattgaaggcgttttaacgttaaacagccggataaagtcgcccacggccagctgctctgccgcatgtttcagcgtgccgctgccgtgactgaaatagcctaacgctgtcagcgacatgttctcttttactgacatgcccagcaccaggccatcgcgcttacgatcttcggagatatagacgatgccgttagccagcccatcctgcggtgagcgcgtcaccacttcccgaccattgagccacagtgtgccttcgcgacgcggcagggcgccgtaaagcaccttcatcagttcggtacggcccgcgcccattaagccggaaaccccaaggatttcacctttgcgcaggctgaaactgacgttatccacgcccggtccgctgacgtttctccactttcagccgcacgtcgcctggcgcctgatcaatatggggatattgatcttccagcttacggccgaccatcatttcgatcaggctctcttcggtcagttcgctgaccgggcgttcagcaataaactgaccgtcgcggaacaccgtgacgtcatcgcagatctcaaagatctctttcatgcgatgcgagatatagacgatgccgcagccctgcgctttcagttcgttgatcacccggaacagcgacagcgtttcggtatcggtcagcgcatcggtcggctcatccatgatgatcacctgcgactcaaagctcaggactttggcgatttcgaccatctgctgatcgccaatcgacaaatcccccaccagcttgtggctgttgaagcgcagattaagccgtttaagcagcgcatcggcttcggcatacatgcgcggccactggatacggccaaaacggctgacatattcgcggccgagaaaaatattctccgccacggttaattgagggatcaggttcagttcctgatgaatgatgccaatacccgcttcctgagacgctttcggcccgctgaaacgggtctctttgcccagccagcgcagcgtaccggcatcatattgatagatgccggtcagcactttcatcatggtggacttgcctgcgccgttctcgcccaccagcgccatcacgcgtcctgcccggacattcagcgacgcccccttgagggctttcacacccggaaaagatttttcaatgccgtcgagttgcagtaaaggttgcatagcggcctcagaaggtcacaccggcgctgaggatgacattcgcaaacggagagcactctccgctgcgaatgaccgcctgactacgctgcgtttgttgtttgaattgttcatgactgatgtagctgatggtgatgatattcccctggtgctgttgcaaggcttcgagcacggcgacaagcgcgctatgaagtggcggattatgctgcttaatctcttccgcgatcagggcgctctctacctgcatctccagtgcgacagcattaaccacctgcataaaatcgggcgtacccggcgtgagcgctaaatcgatgcgctgcggtccggccggaatcggcaagcctgcatcagcaatcgtcagcgtatccgtgtgtcccaggcgggcaatcacatgagagagttcagcgtttaacaagcgaccttttttcatcttttcactccacagcgaaacgtttcgctgtcaggagtgtatgaaaagccgccatcaactcaaccggcaaagaagaaatctgtgatcgctatcgaaacgtttcgctcacgcggggagaaatttgtattaagtcggggatcgggcagaaacaagggccgcgaaacgcggccccggaggagaggattaaggcagtttcttaacctgcttaacgtccatctcaatgctgttgaaatctttatccagttcacccgtcagctcgacgttgtctttaggtgagatagtctggccgttccagtgcttgtggtcgatttcgactttcatggtgccggtctggtcgcggaacagataatcttcgttgcctatctgtttctccagcttaccgcgcacggtgacccagctgtcatctttcatctcttcagcctgctttacggtcaccacactggtgtgatcggcactgaaaccaccctgaccggctgctgcctgcgtctgtgcggctggcgcactaggatcaacaaatccaccctgctgtgcagcgaaaaccggggcggaagccagcattacgacggccagaattgcagcgtgctttttcattttgtcacctcttttccatgatgtggttcgtcttgttgagcttagttgaccataaagttcttaacagcttcttaagaggcaaaaataagctattttcgccgaaatcagctgtacaagcaggaagttgcttcgtataaagcgctatcggaacagggagacgtgatgcgtattttactgattgaagatgaccgtttaattggcgacggtatcaaggcggggctgagtaaactgggcttcagcgttgactggtttacctctggtgaggcgggctttaacgcgctggaggccgcgccctgggatgcggtgatcctggatctctcactgcccgagcgggatgggctcgatattctgcggcagtggcgacagcagggcaaagatgtaccggtactgatactgaccgcacgcgatgcgctcgatcagcgggtcgaaggcctgcaaatgggagccgacgactatctgtgtaaaccctttgccttaactgaagtggctgctcgcttacaggcgctgatccgccgccgtcatggccagctgcagcccgaactccggcacggtaatgtggtgctgatccccggcagccatagtgtgatgcgcgaaggtgaggcgattgcgctgaaaagccgtgaactggcgctgctggaactgtttatgcgaaacccgggccgggtgctgacacgcagccagctggaagagaagctctacaactgggacgccgatgtctccagcaatgcggtagaggttcacattcatcatctgcgtaaaaaactgggcagccagtttatccgcacgctgcacggcgtcggttataccctgggagcggctgaatgcgatcaatgagcctgtttctgcggctgggtatcggttttgtgctgctgctcgggatctgctgggccagcgccagcctgagtgcctggcatcagacacgtgaaacccttgatgagctcttcgatacccagcagatgctgctggcaaagcgtctgctgacgctggatttctcctcgctggacaacgccactctgcctaaaaccaaagagatactgcgccaccatcgcggcgatcaggatgacgacgccctggcctttgccgtcttcacgcgtgacggccggcaggtgatgaatgatggtgacaatggccgctacctgccgtttgaggcggagtatcagggatttcatgagggccagctcaccaatgatgacgatcgctggcggtttgtctggctgactacgcccgaccagcagtttccgggtggtggtgggtcaggagtccgaataccgtgacgacatgacgcgggatctgatgaaagccagcatgctgccctggctgatcgcgctgccctttatgttgctgctgctgatcggtctggtctggtctgaactgcgccccctgaagacgctggcacagcagctggcgcagcgcgcacccgatgatgatacgccgctgcaggcagaccgcgtgccgaaagaggtgcaaccgctgatggtcgcgctcaatggtctgttcagccgcatcagcgcaatgatgcagcgtgaacggcgctttacctctgatgccgcacatgagctgcgcagtccgctggcggcgctgcaggtgcaaagcgaggtgatccagctgactgcggatgatgaagtgatgcgaagccatgcgctacagcaactggatgccggcattatccgcgcaacccggctggtggatcagctgctgacgctctcacgggttgaagctgatgatgcacgcagcgccttcgaaacggtggcgctgaaacgcacggtccaggagacgctggctgcacagctgccgctggcggataaaacgggtgtcacgctgcggctgcatgctgacgccgatccgcagattcaggggcatccgctgttactgtcactgctggtgcgtaatctgctggataatgccattcgctatacgccagcgggcagcgaagttgatgtgcggcttcaggcgaatagcctgtcggtagaggataacggcgaaggtctgagtgcagccgatctgcaacggcttggtgaacgtttctggcgaccgccaggtcaggagaaaagcggaagcgggctgggattatcgatagtccgcaatatcgcccagttgcacgggatgcaggtcagcttcagccagcgctcgggcggcggattatgcgttatgctgcgctggtcagcgcccgccctgtaaggcgggcactgcagattaaatctcgacctgggtgcccagctcaatcacccggtttggcgggatctcaaactggtctggcgcacggagcgcattgcgctgcagcgccaggaagagtttgccacgcaggcgcagataccacggccgtttgccgataatcagcgactcatgcgacatgaagaacgatgtctccatcatgcggcagttgagcccttccagcccgcagcggtggaaaatctcctcgacgtttggcgtttcgcgccagccgtagctggccaccacccgccagaaggtgggcgacagctgctcaatcgtcacgcgacgcacgttatgcacgtaaggcgcatcttccgtccgcaacgtcagcagcaccacccgctcatgcaacactttgttgtgtttgaggttatgcagcatggcaaacggaatcacattcagcgcacgcgacatatagaccgccgtacccggcacgcgaaaccggcggcgatttctccagtgacgcgatcatcgcctccagggagttgccatgctcgtgcatgcggcgcagcaggcggaaacgttcgcttttccacgtcgtcataatgataaacatcaccaggccgagacagagcggcagccagccaccggagaagattttcaccaggttggcggtaaacagcggcacatcgatacagagcatcagtaccaggatgacggcaaccgccagcttattccagtgccagtttttaaccgccacggtacaggagagcatcgcggtcagcaccatggtgccggtgacggcgataccgtaggccgcagccagattacttgaatgctcaaagctgataatcacaatcagcacggcgaagtagagtacccagttaatcaccggaatatagatctggcccgattcgcgctcagaggtgtggatgatacgcatccccggcagatagcccagtcgcaccgcctggcgcgtcagcgagaagacgccggagatcaccgcctgtgaggcaatcaccgtggccagcgtcgccagaatcagcatcgggatcagcgcccagtccggcgccagcaggaagaagggatttttaatcgctttgggatcgctgagtaacagcgcgccctgaccaaagtagttcaggaccagcgacggcagcaccaccgagaaccaggccagtcggatcggcactttaccgaagtgacccatatcggcatacagcgcttcaaccccggtaatcgccagtaccacagcgccaagcgcgaagaatgagacagatttatagtgcaggaagaactcgaccgcgtaggcaggattcagcgcatgcagcacttccgggtttttcatgatgccgctgacccccaggatcgccagcaccaggaaccacaccagcatcaccggcgcgaagagtttgcccaccatgccggtgccatgtttctgaatcgcaaacagcagcgtcagcaccgcaatcgacatcggcacaataaagggatccagcgacggcgcggcaatctccagaccttcaatggctgacatcaccgaaatggccggcgtgatcaccacttccccatagaagaagctgccgccaatcaggcccatgatcaccagcactgccgtggcgcgtgcacccgtatggcggcccgccagcgacatcagtgtcagaataccgccttcaccggcattgtcggcgcgcatcacataactgatgtacttcagtgataccaccagcaccagcagccagaaaatcagcgacaaaaagccaaacaccgcttcccgctcaacgccgaagccgaactgtccggagagacattcacgcaaggtatacagcggactggtgccgatatccccgtaaacaacaccaatagcggccagcgttaatccgcgaagtgactgcttattatccgagctcatagagttatcttttgttggagtctaagaggcgcaacaacccctcgctcaggccatcaaaaagcgcacagtatgcacggtttgccgaaaattcctatacccgcttcgcctgtctgccagggtaatagggtggtttcaggcattaaagcgttaatcagcgccgctttcaaagcaggcaaaccttatgaaacaaaaaagctgacagctatcaacgctttcacgcatgatgatctatagagtaaggcgcttgctgaagcgcggcggcccgacgatcgtaaggacattgaagtgattatggctcaaccccatcttttggcagaaagaatttctcgccttagcaatgcgttagaaaaaggattgtatgagcgacatcatgccatccgcctttgcctgctggcagcgctgagcggtgaaagcgtgttcctgctgggaccgcccggcatcgccaagagcctgattgcccgccgcctgaaatatgcctttcagcacgcccgcgcctttgaatatctgatgacccgtttctccacaccggaagaggtgtttggcccgctatctattcaggcactgaaggatgaagggcgctatcagcgcctcactaaaggttatctgcccgacgcggagattgtttttctggatgagatctggaaagccggcccggcgattctgaataccctgctgaccgctatcaacgaacgccgcttccgcaatggcgacagcgaagaggccattccgatgcgtctgctggtcaccgcctctaatgaaatgccggaagcggacagcggccttgaagcgctctatgaccggatgctgatccgcctgtggctggataatgtgcatgagaagcagaactttcgcagcatgctgacccatcagcaggatgagcacaccaatccggtcgcggaatccctgcgcattagtgatgaggagtatgcgcagtggcagctcggcatcagtcaggtcagcctcccggatgcggtgttcgagctgatttatcagctgcgccagcaactggaaagccagcccgccgcgccctatatttccgatcgtcgctggaaaaaagccattcatctgctgcaggccagcgccttttacagtggccgcagcgccattgcgccgatagacctgatcctgctgaaagattgcctctggcacgacgtcgcgtccatgcagctgctggagcgcgaaatcgatcagctgatgacacagcacgcctggcagcagcagccgatgctgctgaaactgcatcagataaaagcgcgtcgcatggctctgcaacagcaacagagcatcgcacaggcgatcaccctggaaaaacacagtgggatgttcagtcgcaaaccccattacgatctgccggaaagcttcactgatgagcaactgacgctgatgctgcaaaagccgctgatgctgcatgacatgcaggtgacacatctggttatcgcgcgtgatgcactgaatcagtggctgcagaaagggggcgaggttcgcggcaagctcaatggaattggctttgcgcagagtctggatttacaggtggatgcgcagcactgcctggctatccgtgatgtcagcctgcaatcgtcgcgtctgacactgcctggcgtcagcaatagcgagccgctgcccggtgagatcaccgaagcgctggatgcactggagagtgaactgcggtcgcagcgtcatctgttcagccagcatcagcgctgcctgtttatcagtgatgactggctggcgcgcgttgaaaccagcctgcaggatgtggcggaacagttgaaacaggcgcgtaaatgatcccactggagacgctcagcacactgctctccgtgggtgaaaccgaactgattgaagagctgattattgccctgctggcgtctccacagctggcgctgttttttgaaaagtttcccgggctgaaaaaagcactgttacgcgatgtgccacgctggcgagcggagatcaacgctgagctcaaagccacgccggttccggccacgctggccgaagagtttcagctgttccagcgggtacaactcctcagcgatcgtgaattcagccaccagctgaatgccacgcttcaggcgcttgaaagcctgccttccccttttctggatgaagccaaccggctgctgcagcacaccgatatcagccatctcagcagcgcgcagcaccagctttttctacagcgctggcggctgagcctgaccttacagaccctgacgctgaatcagacgttgctggaacagcagcgcgaacgcctgctggcggaaactgcagcagcgtatggcgctgagcggtcagctggcaccgattcttggcgacgatgacgaagccgccgctggccggctgtgggacatgagcaaagcgtcactgcagcctggcgactatcaactgatgctgcaatatggcgactttctggcgcagcagccggagctgctgaaactggcccagcagctgggtcgcagccgcgaggcaaaatcggtgccgtcgcaggatgcccctatggaggccttgcaccatatggtgcaggaacctgcggccgtgccggaggaggtcagcggcattcaccagagcgatgacgtgctgcgtctgctgccgccggagttagctgcgctgagtatcagtgaactggagctggagttttaccggcggctggtagagaaacggctgctgacctacaagctgcagggcgatgcctggcatgaaaaggtcacgatgcgtccggccagccaccagcagcatgaagagcagccacgcgggcctttcatcgtctgcgtcgatacctcgggttcgatgggtggcttcaatgagcgctgcgccaaagcgttttgtctggcgctgctgaaagtcgcgctggccgatcgccgtcgctgctacatcatgctgtttgcgcatgaggtgatcggctatgaactgaccggtgatgacgggctggaacaggcgattcgctttctcagtcagcgctttcgcggcggcaccgatctggcagcctgcctctcttccgttgtgacccgaatggaaggcgtcctgtggcaggaagccgatgcggtgatcgtctccgattttattgcccagcgtctgccggaagaggtgatcgggactattaaaacgcgtcagcgaaataatcagcaacgttttcacgccgtggctatgtcggcccacgggaaaccaggcattctgcgcatcttcgaccatatctggcgtttcgataccggcatgaaaagccgtctgctgcgtcactggcggcgttaagtcatcgggcagaaatgcatatttgctatagtaaattaccgtttcacttactcagcaatctggagcttcctgtgacgcttgctcaacctcatcgcgatctgcctgcgccgacgcgaacgctactgctctccggccataacattgaacaaaaacgtgccgaattgctggcctatttccaccagacctgggaacagtatgaaagtctgtttacctgtctggccgattcccaggcctggtttaccaaagccattccgctgcgccatcctttaatcttctattttggccacaccgctaccttctacattaataagctgatggccggacgccttatcgacgcgcgtctggacgatcgtatcgaagcgatgatggcgattggtgtggatgagatgagctgggacgatctcaacgacagccactatgactggcccactgtcgaagaagtccgcgaataccgcgggcgcgttaaagcgctggtcagcgatctgatccagaccctgccgctgactctgccgatcacctgggagagtccggcctgggtgatcctgatgggcattgagcatgagcgtattcatctggaaacgtccagcgtactgatacgccagttaccggtcgggtgggtgaaaccccagcccgcgtggccggtctgcccgatggcgcgccatcagcgcgaggctgttccggccaataccctgctgccgatgcccggcggcaccgtcacgctgggtaaaaccgacgatacctatggctgggatgtcgaatatggccgccagcagatcgcgctgcagccgttcagggcgagcaaaatgctggtcagcaacgcggaattcctggcgttcgttgaggcggggggttatcaggacgctcgctggtgggatgacgaaggctggggctggtgtcagtttgctaaagcggagatgcccaccttctgggtcggcacgcctgcgatgcccgatcagcttaaactgcgtctgatgtgtgaagaagtcgcgatgccgtgggactggccagccgaggttaaccagctggaagcggcggccttctgccgctggaaagcggatcagacgggaatgagtgttcagctcccctgtgaagcggagtgggctcagctgcgcgaacaggtcgcgggcgatcagccggattgggatcgggcaccgggtaacattaacctggcgtactgggcttcctcttcaccggtcgatctcttcgcccagggcgacttcttcgatatcgtcggtaacgtctggcagtggacgaccacgccgaccaacggctttgaaggttttaaagtccacccgctttacgatgatttctctaccccgacctttgatggtaaacattcgctgatcaaaggcggtagctggatatctaccggcaacgaagcgctgaaatcggcacgctatgcgttccgccgccacttcttccagcatgccggtttccgctacgtggtttccagccatcaggaaaccatggcgctgaacccgtatgaatctgacgccatggtgtcgcaatacctcgacttccagtatggcccgcgctatttcggggtggataactatgccgaaagcctggtaaacctggcgctgaactacaccacagcacgcggcgaggcactggatatcggctgtgccaccggacgcgccagttttgaactggcccgccactttgaacgagtcaccggtatggactactcggcgcgcttcatcgatgtggcgcttcagctggccagcggcgaagacttccgttatctcctgccacaggaaggcgatctggtggagtatcgccaggtttcgcctgaaagatttcgcgctggagagcgaactggcgcagcggattcagtttgttcagggcgacgcctgtaaccttaagccgcaacccgcccgttacgatctggtacttgcatccaacctgatcgatcgcctgcgtcagcccgctcgcttcctgcgggatgtcacgccgatgctgcgtcagggcggcattctggtgctctcatcgccctatacctggctggaggatttcacgccgaaggagaactggctgggcggcgtgcgtgaaaacggtgaggcactgacgacgctgcaggcactgcaacgtctgctggcggccgacttcgacctggtcgatgaaccgcaggataaaccgtttgtgatccgcgaaacggcccgcaagttccagcatacgctggcgcaggtcaccgtctggcgcaaacgctaagtgaaccggcagcgacgcccgtcgctgccgggagttgcctgaaccactattttgctgcacattcatccttgtttacttaagcagaccaataacgaggatggccatggccgaacatctgcagctcgataacctggatcgcggcattctgaatgccctgctcgacaatgcgcgcactgcttacgccgagctggcaaaacagtttaacgtcagccccggcaccattcatgtccgcgtggagaagatgaagcaggcgggcattatcctgggcacccgggttgatatcgatccgcgccagctggggtttgatgtctgctgttttatcggcatcatccttaagagcgcgcgtgactatccggcggcgctgagcaaactggatgcgctggatgaagtggttgaagcctggtacaccaccggccactacagcatctttattaaggtgatgtgccggtccattgatgccctgcaacaggtgctgatcaacaagatccagaccatagatgaaattcagtcgacggaaacgctgatctcgctgcaaaacccgatcatgcgcactatcaagccctgatccttctccgccttgtgcataatcttatccctgacgaatgtggcggctggcaacggctgcgttcgcttctcttaatctattaaccctgttgtccacaggtggatcaccgcttgatcacagcgtacaatgctcgccttaatgtccgggagagcaagatggccgatattaccttaatcagtggcagtactctgggtagcgcagagtatgtggctgaacatctggaagaaaaattacaggaagcgggcttctcaacgcagatgctgcatggcccggagctggatgaagtgccacatgagggtatctggctggtggtctgttcaactcacggtgcaggcgatattcccgataacctgctgccgctgtttcgaagccatcacggaaagccagcccgatctctcgcaggtccggtttggtgccatcggactcggcaatcatgaatatgatctcttttgtggcgcgatccgccagattgaggccctgttaattgctcagggtgcccgccagatcggcgatcgtctggagattgatgtgctggagcatgagatccctgaagatcccgcggaagcctggctggaaagctggaaaaaggcgatctgaagggggctggggatcgcgaaatagtgacgatccccagtggaagatgctgattttatccttttccgctcgtttattttgtggataactaccctcttttactgcgtataaccggtagttatccaaagaacaaccgtagaatgaattttgagctgtggataacatgccattttgatcccagcttatacggatcaggatcaccgatcactaacaggtagtgatcctcttcatcctgttgtttctgctgtgcttctggcacatatccacagaaaagcgggatcctaataagagatctaacagaaagatcatatacagatctaagatcctttcttttaaaaccggacgatcccgcggctttcaccccagacggaatttgagtagaatccacgccccaggacgacgatcctgcaagttcatcaaccgaggtaccacttcatgttttatcaggatccttttgacgtcatcgtaattggtggtggtcatgcgggcaccgaagccgcaatggcggcagcccgaatgggtcagcaaaccctgttactcacccataacattgatacgcttggacaaatgtcctgtaacccggcgattggtgggattggcaaaggacatttggtgaaggaagtggatgccctgggtggtctgatggccagtgcgattgaccaggcgggtattcagtttaggatactaaacgccagcaaaggtccggcagtgcgggcaacccgtgctcaggcggatcgcgtgctctatcgccaggcagtgcgtacggcactggagaaccagcccaatctgatgatcttccagcaggcggtcgacgatcttatcgtggaaaacgatcgtgtggtgggtgcagtcacccagatgggactgaagttccgcgcgaaaacagtcgtcctcaccgtcggcacgtttcttgacggcaaaattcatatcggtctggataattacagtggcggtcgcgcaggtgatcccccatccattccgctggcaaaacgactgcgtgcgctgccgctgcgggtagaccgcctcaagactggtacgccaccgcgtatcgatgcgcgcaccatcgatttttcagtgctcagcccgcagcacggcgataacccgatgccggtgttctcgtttatgggcaatgcgtctcagcatccgcagcaggtaccatgctggatcactcacaccaatgagaaaacccatgaggtgatccgcaataatctggatcgcagcccgatgtatgccgggatcatcgaggggatcggtccacgctactgcccgtctatcgaagacaaagtgatgcgctttgccgatcgtaactcgcatcagatcttcctggagccggaagggctgaccagcaatgagatctacccgaatggcatctcaaccagtctgccatttgatgtgcagattcagatcgttcgctccatgcagggcatggagaatgcgaagatcgtgcgtccgggctatgccatcgagtatgacttcttcgatccacgcgatctcaaactgacgctggagagcaaatttattcacggcctgttctttgccggccagatcaacggcacaaccggctacgaagaagccgctgcgcaggggatgctggcgggtctgaatgccgcccgtcagtctgcggacaaagagggctgggcaccacgtcgtgaccaggcttatctgggcgtactggttgatgacctctgcacgctcggtaccaaagagccgtaccggatgtttacctcccgtgctgaatatcgtctgatgctgcgcgaagacaatgccgatctgcgtctgaccgaaaccggtcgtgaactgggtctggtggatgatgcgcgctgggcgcgtttcaatcagaagctggaagcgattgaacaggagcgtcagcgcctgcgcgatatctgggtccatccgaagtcagagcacgtgacggaagtgaatacggtactcagtgcgccactgaccaaagaagcgagcggcgaagatctgctgcgccgtcctgagctgacctatctgaagctgatgacgctggatgcctttggtccggcactggctgatgagcaggccgctgagcaggttgagattcaggtcaaatatgaaggttatatcgcgcgtcagcaggaagagatcgatcgccagctgcgtaacgagaacacactgttaccggtggagctcgactatcgccaggtgaacggcctctcaaatgaggttatcgccaagctgaacgatcacaaaccgagttcgattggtcaggcgacgcgtatctccggtattacgccggcggccatctcaattctgcttatctatctgaaaaaacagggtctgctgcgtaaaagcgcctgatctgaaaacggggcgaggagactcgcccccgctgaatggacttatgctgtgatcaacacactcacgtcgctgctacaggcagccggtatttccctctccgatcaacaaaaacagcagctggttgcctatgtcggcctgctggataagtggaacaaagcctacaatctgacatcagtgcgcgatccgcagcagatgctggtacgccatatcctcgacagcatcgtggtggcgccgcatctgcaaggctcacgtttcattgatgtgggaaaccggaccaggactgcctggcattccgctggctatcgtgatgcctgatgcgcactttacgttgctcgacagcctgggcaagcgggtgcgtttcctgcgtcaggttcagcatgagttaggactcactaacattactccggtgcagagccgggttgaggcgttcccggctgagccgccctttgatggcgtgatcagtcgtgcatttgcctcgctgaccgacatggtgaactggtgtcatcatctgccgggaagagaagggcgctttttcgcgcttaaaggcgtgcgtccggacgatgaaattgcggagttaccggcaggctacgtctctgatgctgtgattaagttgcaggtaccacagctagaaggtgatcgccacctggtcattcttcgtcaccaataggctttcgactggcagagatttagcgtttatctgccagtgattttcgtcagttccgggctgaaaaaagtgcagatgatgcgctatcaataaaagattttgattaagccctggctgaccgaaggttaaaacgctaacggaaattatccgaaaagctctgttacatttaacgtttaattcacattcagttatcagaaatatcacttgtataggcgggtcgctgaataaaagtagtcacggcagaaaatatatcgcggtaataactttgcgtgcgtaatatcaattacacgattcttaagcacagttcgatgtcaatagcgtgttttctgtgaaaatagtcttgcagatgcatttttataatttcaatgctttgattttattgagttaatttgtaatacagattattcttaaatagcgcgaagataaaactcagtgtagtgaaagtgcttattatgtgatctaaagcacgctttaaaagcaagttgcaagggaattttcagtcagattagggtgaatctctgcagggtaatctttggaaaaatagccctccggaaagaaatttaaataattgttcaccttttcgctacttaccgattgaaatcgcaggtgcggcccgtataatttgcacggcttttgctgcttgactcaactgcgcaaaggcagtcttatacgacacgcgacatacccctaacggggcaggagagtatcagcgtcatgtcagtgtctctttacagtgtaaaatacgcccgaaacggtgctgatgattcagctggtgacgatagtcatcatcggtgcactctttgctcttaaagatgtcatctggggtctctctgctcttgctggcggtgcggcagcctggctgccaaacgtattgtttttgtttttagcctggcgcctgcaggggcaaaccccagcttcggggcgagtcgcgtggagcttcgctttgggtgaaatagccaaagtgtttgcgaccatcattttgctcattgtggcgttgggtctattcagagcggttttctggccggtcggaataacctggttatcggtgctggtggtacaaatgctggcaccggcggtaattaacaacaaagggtaagaggcatcatggctgcaggagaaatctctactccgcaagagtacattggtcaccacctgactcatcttcagttggacctgcgtaccttcgagatagtgaatccgcacgacgctcccgcgacgttctgggtattaaatatcgattccatgtttttctctatggtgctgggaatcatcttcctggtgttgttccgtagcgtggcaaaatctgccaccagcggtgtgccagggaaaatgcaggcggctatcgaaactggttgtcggtttcgtcgatagtaacgtgcgcgacatgtatcacggtaagagcaaacttatcgccccgctggctctgacaatctttgtctgggtcttcctgatgaacttcatggatctgctgccaatcgacttgctgccatatattggcgagcacgtattggggttaccggcgctgcgcgtcgtaccgtctgcagacgtgaacatcacgctatctatggcgttgggcgtatttattttgattctgttctacagcatcaaaatgaaaggcattggcggcttcactaaagagctgacgctgcagccttttaaccacccgatcttcatcccgatcaacctgattctggaaggtgtgagcctgctgtctaagcctgtatcactgggtttacgactgttcggtaacatgtatgcgggtgaactgatctttatccttattgccggtctgttgccgtggtggtcgcagtgggtgctgaatgtgccgtgggccattttccacatcctgatcatttcgctacaggctttcattttcatggtcctcacgattgtctatctgtcgatggcatctgaagaacattgatttttttctcaacactactttccctcttgatttcgggttgcagcgcacaccgctgaagcccggaagatgaagggagcatttaactgaaacaaactggagactgtcatggaaaacctgaatatggatctgctgtacatggctgccgctgtgatgatgggcctggcggcaatcggtgctgcgatcggtatcggcatcctcggaggaaaattcctggaaggcgctgctcgtcagcctgacctgattcctctgctgcgtacgcagtttctttgttgtaatgggtctggtggatgcaatcccgatgatcgctgttggtctgggtctgtacgtgatgtttgctgtcgcctaaagccctgtgttcactcagcgcacaatgtgcaagggtgaacggattctgccgcttatcgttgataacggcagaaaagttaaatactcaatctagaggcattgtgctgtgaacattaatgcaacaatcctcggccaggctatcgcgttcatcctgtttgtcgcgttctgcatgaagtacgtatggccgccgctcatggctgctatcgaaaagcgccagaaagaaattgctgaaggccttgcttctgctgaacgtgcaaagaaagatttggatctcgcgcaggctaatgcgaccgaccagctgaaaaaagccaaagaagacgctcaggtcattatcgagcaagcgaacaagcgtcgcgcgcagattctggacgaagccaaaaccgaagctgaaaacgaacgtaatcgcatcgtgacacaagcgcaggctgaaattgacgctgaacgcaaacgtgcgcgtgaagaactgcgtaagcaggtcgcgttgctggctatggctggtgccgagaagatcatcgaacgctccgtggatgaagctgctaacagcgacatcgttgataaactggtcgctgaactgtaaggagggaggggctgatgtctgatctgattactgtagctcgcccctacgccaaagcagcttttgactttgctgttgagcatcaaagtattgaacgctggcaacagatgctggcgtttgccgcagaagtggctcgcaatgaacagatggctgatcttctctcaggtgcattagcacccgaagcgctggcagcgtcgtttaacgcagtctgtggtgatcaactggatgaacccgcgcagaacctgattaaggtgatggcggaaaacggacgtttgacagcgcttccggctgtactggcccaatacatcgaactgcgtgacgctcatgaagctaccgctgaagttgatgttatctccgccagtacgctgagtgacgaccagctgaataaaatcagcgccgcgatggaaaaacgtctgtcacgcaaagttaagctgaattgcaaaattgataagtctgtgatggcaggcgtgatcatccgttcgggtgatctggttattgatggcagcgtacgcggccgtcttgaccgtctggctgacgtcttgcagtcttaaggggactggagcatatgcaactgaattccaccgaaatcagcgaactgatcaagcagcgcattgctcagttcaatgtcgtgagtgaagctcacaacgaaggtacgattgtttctgtaagtgacggtatcatccgcgtacacggcctggccgatgtcatgcagggtgagatgattgccctgccgggcaaccgttacgctatcgccctgaacctcgagcgtgactcggttggtgcagtggtgatgggcccttacgctgacctcgccgaaggcatgaaggttaagtgtactggccgtattcttgaagtaccggtaggccgtggcctgctgggccgcgtagtgaacaccctgggtgctcctatcgacggtaaaggcgcaatcgacaacgacggtttctcaccggttgaagtcattgcacctggcgttatcgaccgtcagtcagtcgaccagccggttcagaccggttataagtcggtcgatgcgatgattccaatcggccgtggccagcgtgagctgatcatcggtgaccgtcagaccggtaaaaccgcaatggcgatcgatgcgatcatcaaccagcgcgactcaggcatcaagtgtgtctacgttgcgattggtcagaaagcctcaaccatctctaacgtggttcgtaagctggaagagcatggcgcactgcagaacaccatcgttgttgtggcgtctgcttctgaatctgctgcactgcagtatctctctccgtacgcaggctgtgcgatgggcgaatacttccgtgaccgtggtgaagacgcgctgatcgtttacgatgacctttctaagcaggctgtcgcgtaccgtcagatttctctgctgctgcgccgtccaccaggtcgtgaagcattccctggcgacgtgttctatctccactcccgtctgctggaacgtgcatcacgcgtaagcgctgattatgtagagcgtttcaccaatggcgcagtgacaggtaaaaccggttcacttaccgcgctgccgatcatcgaaacccaggcgggcgacgtttctgcgttcgttccgaccaacgtaatctcgattactgatggtcagatcttcctggaatcgaacctgttcaactccggtattcgtccggccgttaacccaggtatttcggtatcccgcgtaggtggtgctgcacagaccaagatcatcaagaaactgtccggtggtatccgtaccgcgctggcacagtatcgtgaactggcggcattctcgcagttcgcctctgatctggatgatgcaacccgcaaacagctgagccacggtcagaaagtgaccgagctgctgaagcagaaacagtatgcgccgatgtctgtcgcacagcagggtctggttctgttcgctgcagagcgtggctatctgaacgacgttgaactggcaaaaattggcagcttcgaagctgcactgctggccttcgccgatcgcgaccacgctgagctgatggctgaaatcaaccagtcgggtaactttaataacgatatcgaagccaagctgaaaggcctggtcgagacgtttaaagcaacccagtcctggtaatgtctggcggcttgtctgaaaaggcaggccgcaaggctttgaggagaagctaatggccggcgcaaaagagatacgaagcaagattggaagcgtgaaaaacacgcagaagatcaccaaagcgatggaaatggtcgccgcctccaagatgcgtaaaacgcaggaacgcatggcggccagccgtccgtatgcagaaaccatgcgcaaagtgattggtcaccttgcgttgggtaatctggaatacaagcacccttacctggaagagcgcgacgtgaagcgcgtcggctacctggtcgtttcaactgaccgcgggctttgtggtggtttgaacattaacctgttcaaaaagttactggcggatatgaagtcctggtccgataaaggcgtgcagagcgatctgtcgattatcggttcaaaaggggcgtcattctttaatgctgtgggtggcaacattgtggcgcaagtcagtggcatgggcgataaacctaccctgtctgacctgattggcccggtaaaagtgatgttgcaggcttatgatgaaggccgcatcgacaagctgatgatcgtcaataacaaattcaataacaccatgtctcagactccgaccatcacccaactgctgccgttaccgccagcggaaggtgaagaagagatgaaggcgaagacctgggattacctgtatgaacccgatccgaaagcgctgctggataccctgctgcgtcgttatgtcgaatcgcaggtttatcagggtgtggtggaaaatctggccagtgagcaggccgcacgtatggtagcgatgaaagccgcaaccgataacggcggaaatctgatcaaagagctgcagttggtgtacaacaaagctcgtcaggccagcatcacccaggaacttaccgagattgtcggtggagcctccgcggtttaaccaggtttggaattaggtagaggattcaagatggcaactggaaagattgtccagattatcggcgccgttgttgacgtcgaattccctcaggacgcggtaccgcaagtgtacagcgccctcgaggttatgaatggtgatgcgcgtctggtgctggaagttcagcagcagctcggcggcggcgtagtacgtaccatcgcaatgggtacgtctgacggcctgaagcgtggtctgagcgtcaacgacctgcagaaaccgattcaggtacccgtcggtaaagcgaccctgggccgtatcatgaacgttctcggcgagccaatcgatatgaaaggcgagctgaaagaagaagatggcagcgcagtagagatcgcctctattcaccgcgcagccccttcttatgaagatcagtctaactcgcaggaactgctggaaaccggcatcaaggttatcgacctgatgtgtccgtttgctaaaggcggtaaagtcggtctgttcggtggtgcgggtgtaggtaaaaccgtcaacatgatggaactgatccgtaacatcgcggctgaacactcaggttactcagtgtttgccggtgtgggtgagcgtactcgtgagggtaacgacttctaccacgaaatgactgactctaacgttatcgataaagttgcactggtctatggccagatgaacgagccgccgggtaaccgtctgcgcgtagcactgaccggtctgaccatggcggaaaaattccgtgatgaaggccgcgacgtttctgctgttcatcgataacatctaccgttataccctggccggtacagaagtttctgcactgctgggtcgtatgccatctgcggtaggttaccagccaacgctggcagaagagatgggtgtgttgcaggagcgtattacctccaccaagaccggttcaatcacctccgtacaggccgtttacgtccctgcggatgacctgactgacccatcaccagcaactacctttgcgcacttagactcaacggtaacgctgagccgtcagatcgcctctctgggtatctacccggccgttgacccgctggattctaccagccgtcagctggatccgctggttgtcggtcaggagcactatgatgttgcacgtggcgttcagtcactgctgcagcgttatcaggaactgaaagacatcatcgccatcctcggtatggatgagctgtctgaagaagacaaactgctggtggcacgtgcgcgtaagattcagcgcttcctgtctcagccgttcttcgttgcagaagtattcaccggttcaccgggcaaatacgtgacgctgaaagacactatccgtggctttaaaggcatcatggaaggtgagtttgaccacctgccagagcaggccttctacatggttggcgccatcgaagaagccgtggaaaaagcgaagaaactgtaataacggtttcccgggaggaagattatggctatgacttatcacctggatgtggtcagcgcagaggagcagttgttctctggtctggtacagaaaattcaggtgtcaggtagcgaaggtgaactggggattttccctggccatgcgccgctgctgactgccattaagcctggaatgatccgtatcgtgaaacagcacggcgaagaggagtttatctacctctctggcggcgtgctggaagtgcaaccgggcagcagcaccgtttctggccgataccgctatccgcggtaccgatctggacgaagcgcgcgctctggaagcaaaacgcaaagcagaagaccatatgaacagcagccacggcgacgtggactatgctcaggcctctgccgagctggcgaaagccattgctaaactgcgcgtgatcgaactgaccaaaaaagcgatgtaatccagctttatgcgtcatgaaatgccagccctcgggctggcattttttttgtctgctgcgcctgatctgcctgtccgcctaatttcggcctgagaaaaatgtagtaatctcaatcccaaaccgttttactttcacccgtaaaaattcactcaggatagttatgtctaacagtgcgatgagtgtggtgatccttgctgctggcaagggcacccgtatgtattccgatctgcctaaagttctgcatacgctggcaggcaaacccatggttcagcatgtgattgacgcggctaaagggctgggcgcacagcaggtccatctggtttatggtcacggcggcgatcgcctgaaggcgaccctcactgacagcacactcaactgggtgctgcaggccgagcagctcggcactggccatgcgatgcagcaggcagcgcccgcattcgcggatgatgaagatatcatgatgctttacggtgacgtgccgctcatctctcaggcgacactacagcggctgcgcgaagcaaaaccgcagggcggcattggcttacttaccgtggtactggacgacccaaccggttatggccgcattgtgcgtgagaaacgacaccatcaccggcattatcgaacagaaagatgccagcccggcgcagctcaccattaaagagatcaacaccggcattctgatcgccaacggcggcgatttaaaacgctggctggcgcagctcaccaacaataatgcgcagggtgagtattacatcaccgatattatcgcgctggcgcatcaggaaggtcgggtgatcaacgcggttcatccggcacgcatcagtgaaaccgatggcgtcaataaccggctgcagctggcgacattagagcgcacttaccaggccgaacaggcggaaaaactgctgctggctggcgtgatgctgcgcgatccggcccgttttgacctgcgcgggacgctgacgcacggacgggatgttgaaattgacaccaacgtcattattgaaggccaggtcacgctgggcgcacgcgtcagaatcggcgcgggctgcattatcaaaaacagcgtgattggcgatgactgtgaaatcagcccctattcggtgatcgaggatgcgaatctcgccactgcctgcaccgtcggaccttttgcccgtctgcgtcctggcagcgaactggccgatgccgcccacgtgggcaacttcgtcgaaatgaagaaagcgcgtctgggcagaggatcgaaagcggggcacctctcctatctcggtgatgcggagattggcgacaacgtaaatatcggtgcaggcaccattacctgcaactacgacggtgcgaacaaattcaaaactgtgattggcgatgatgtgtttgtgggctcagatacccagctggtggcgccagtcagcatcgcggcagggaccaccattgcggcgggcacgaccatcatgaaagatgtgacccaggccggtctggtctataaccgtaaagagcagaatcacaaagcggactggcagcgcccacagaagaaaaaataaatttttaacggcccgctttaatgcgggccgatgcagtgcagtgccaaaactataatccccactctctacaaggctcggggaaccggcaaagccggatatcaggtcgcatgacaacagaagtggcgaaaagccatgtagtcaggaaaacatcattatgtgtggaattgttggtgcagtagcgcaacgtgatatcgcagagattctgctggaaggtctgcgtcgtcttgaatatcgcggatatgattcggccggtctggccgtggtcgatcgtcaggggcacgtcacgcgcctgcggcgtttagggaaagtgcagaaactggcggaagccgctgaacagcaaccgctgattggtggcaccggcatcgcgcacacgcgctgggcaacccatggcgagccgtcggaagcgaaacgcgcatccgcacgtctcagagcacatcatcatcgtgcacaacggcatcattgaaaatcatgagccattgcgtgctgaactgatcgcgcgcggttatgtctttgcctctgaaacggacaccgaagtggtggcgcatctggttcactgggagcagaagcagggcggttcgctgcgtgaagtcgtactgcgtgtgattccgcagctgcgcggtgcctatggcatggtgatcatggacagccgcgatccgtcactgctggtggcggcccgttccggcagcccgctggtgattggtcgtggcatgggcgaaaactttatcgcctcggatcagctggccctgctgccggtgacccgtcggttcatctatctggaagagggtgatatcgccgaaatcagccgtcgcgatgtcacggtgatcgaccgtgaaggcaacaccgtgacccgtgccgagatcgagtcgaacctgcaatatgatgccggtgacaaaggcatttaccgtcactacatgcagaaagagatctacgaacagcccatggcgctgaaaagcaccctgagcggtcggttcagccagggtcaggttgatctcagcgaactgggcgcgggcgcagaagcgctgctgagccaggttgagcatatccagattatcgcctgcggcacctcctacaactccggcatggtgtcacgctactggtttgagtcgctggcaaacctgccctgtgatgtcgagattgcctcggaattccgctaccgcaaatcagccgttcgcaaaaacagcctgctgatcaccctgtcgcagtcgggtgaaacggcagatactctggcggcgctgcgtctctctaaagagctgggctacctgggatcgctggcggtctgcaacgtagccggttcgtcactggtgcgggaatctgacctggcactgatgaccaaagcgggcaccgaaatcggcgtcgcctctaccaaagcgttcaccacccagttagcggtgctgctgatgctggtggcgaaactgggccgtctgaaagggatgtcagccgagactgagcatgagatcgttcatgcactgcaggcgttgccgagccggattgagcagatgctggcgcaggataagctgattgagaatctggcggaaggcttctctgacaagcatcacgcgctattcctgggtcgtggcgatcaatatccgattgccatggaaggggcgctgaagctcaaggagatctcctacattcatgcggaagcctacgccgcaggcgagctgaaacatggcccgctggcgctgattgatgcggatatgccggtaatcgtggtggcacctaacaacgaactgctggagaagctcaaatccaacatcgaagaggtacgcgcacgcggcggcctgctttatgtctttgccgatcaggatgcaggcttcagcgacagtgacggcatgaagatcatcccgttgccgcatgtcgaagaggtcattgcgcccatcttctacacggtgccgctacagttactctcctatcacgtcgccctgatcaaagggaccgacgtcgatcagccacgtaacctggcaaaatcggttactgtggaataaccgggtgggccccgtcgcgggcccactttgctctggccctctgtcatataactgtcatatttcgtacatttcactgtcatcaaactgtcctattttccctcctgcagcaatcacagattcttactaaaacggccccaagcctgacttttctcccctggagggaatatgacactgatgcgtagcaccgtagcccgaatcctcgccaccaccttcgccgtaagcgcggtatctgcttttgcggcaaccgatctcactggcgcaggcgggacgtttcccggcgccggtttatgccaagtgggcagcagaatatcaaaaagccaccggtagcaaagttaactaccagggtatcggttcatctggcggcgtgaaacagatcatcgctaaaaccgtcgatttcggtgcgtccgatgcgccaatgaaagatgaagatctgcagaaaaatggcctgttccagttccctaccgtgatcggtggcgtagtactggcggttaacctgccgggtatcaagtcaggtcagctgacgctggatggcaaaaccgtcggtgatatctacctcggcaccatcaaaaagtggaacgacccggcgattgccaaacttaacccaggcgtgaaactgccagagaccaacatcaacgtggtacgtcgcgctgacggttcaggcacctcgttcgtcttcaccagctatctggcgaaagtgaacccggactggaacagcaaaattggtaaaggtaacaccgtcaactggccggtcggtctgggcggcaaaggcaacgacggcgtcgccgcgtttgttcagcgtctgccgggttcaatcggctacgtggagtacgcctacgccaaacagaataacctgacctacaccaaactcatcgatgccgatggcaaagcggtcgccccaagcgaaaccagcttcagtaatgccgcgaaaggtgctgactggagcaaatcgttcgcgcaggatctgaccttccagaagggcgctgatgcctggccaatctcgtcaaccacctttattctgatctacaaggatcaggctaatgcggccaaaggcgctgaagtactgaaattcttcgactgggcttacaaaagcggcagcaaaaccgccacagcgctggattatgctgcgctgccagagagcgtgactgaacagattcgcgccgcctggaaagccaacatcaaagacagttctggtaaagcgctttatcagtaattgaccgaccctgaccggacagcagtccggtcagactcaacgggcggcgtcatgccgtcctgataacttctgaagactgagacttctatggctgcaacgaagccggcattcaaagccccaggcaaacaaggtgacagaatttttggcgcgctggtcaggctggctgcgctgattgtcctgttactgatgggcggcattattgtctccctgatcatctcctcgtggcccagcatccagaagtttggtttcgcctttttgtggaccaaaacctgggatgcgcccaacgaacaatttggtgcactggtaccgatctacggcacccttgtgacctccattattgccctgattatcgcagtaccggtgagttttggtatcgcgctgttcctgaccgaactcgcgccaggctggctgcgtcgcccgctgggcaccgccattgagctgctggcggccattcccagtattgtttatggcatgtggggtctgtttgttttcgcgccgctgtttgccgaatacttccagacaccggtcaatgacgtgatatcgggcattccgattgtcggcgagcttttctccggccccgctttcggtatcggcatcctcgcggcgggtgtgattctggcgatcatgatcatcccttatatcgcctcggtgatgcgcgacgtctttgagcagaccccggtgatgatgaaagagtcagcctacggcatcggctgcaccacctgggaagtgatctggcgcatcgtactgccctttaccaaaaatggcgtgattggcggtgtgatgctcggactgggtcgtgcgctgggtgaaaccatggcggtgacttttattatcggcaacacctaccagctcgacagcccgtcgctgtttatgccgggtaacagcatcacctcggcgctggccaacgagttcgctgaagcggaatcgggcgtgcacgtcgccgcgctgatggagctgggactgatcctgtttgtgattacctttatcgtgctggcgatttcaaagctgatgattatgcggctggcgaaaagtgaaggagcgcgctcatgaccacaattgaaattcaggcgcgcgccgaaactggacgcatcacgccgtaaaatgcagtcctggcgcagcactaaaaataaaattgcgctgacgctgtcgctgctgaccatggcttttggcctgttctggctggtgtggatcctgttcaccaccgtatcgcgcggcgtggatgggctctcctggtccctgttcaccgaatcaacgccaccacccaataccgcgggcggcgggctggctaacgccctggcaggcagcggattactgattttctggtctaccttcttcggcacaccgctgggcatcatggcgggtatctatctggcggaatatgggcgcaagtcgccactggcagaagtgatccgctttattaacgacattctgctttcggcaccctcgattgtggtcggcctgttcgtctacacccttgtggtgtcgcagatgcagcacttctccggctgggccggggtgattgcgctggcgctgctgcaggtgccgattgtgattcgtaccaccgaaaacatgatgcgactggtgccagacagcatgcgtgaagcggcttacgcgctgggtacgcccaagtggaagatgatcgcgtctatcaccctgaaagcgtcggtctccggcatcatcacgggtgtgctgctggcgattgcgcgcattgcaggtgaaacggcaccgctgctgttcacggcgctctcgaaccagttctggagcaccgacatgatgcagccgctggcgaacctgccggtcaccatctttaagttcgccatgagcccgttcgccgaatggcagagcctggcctgggcaggtgtgctgattatcaccctctgcgtgctggtgctgaacatcgtggcgcgggtgattttcgccaaaggtaaacacggttaatttccggcgcggccctgtgcggcgccgtataagagagatgaattatgagtatcgcgacagcatcagccgataaaattcaggtccgtaatctgaacttctattacggcaaatatcatgcgctgaagaacatcaatctggatatcgctaagaatcaggtgactgcgtttatcgggccatcgggctgtggtaagtcgaccctgctgcggaccttcaacaaaatgtactcgctctatccggatcagcgggctgaaggggacattctgctggatggcgaaaacattctggcgactcagcaggatatcgcgctgctgcgcgcccgggtcggcatggtgtttcagaagcctacgccgttcccgatgtcgatctatgacaacatcgcctttggcgttcgcctgtttgaaaagctgtcgcgtgccgatatggatgcgcgcgtgcagtgggcgctgaccaaagccgcgctgtggaatgaaaccaaagacaagctgcatcagagcggttacagtctctccggcggccagcagcagcgtctgtgcattgcccgcggtatcgcgattcgcccggaagtcttactgctggatgagccctgctctgcgcttgatcctatctctactggccgtattgaggagctgatcaccgagctgaaacaggattacaccgtggtgatcgtgacgcacaacatgcaacaggctgcacgctgctctgaccatacggctttcatgtatctgggcgaaactgattgagttcagcgataccgacacgctgttcactaaacccgcccagaagcaaaccgaagattatataactggccgctacggctgatctgacaggagatcgacatggataatcttaatctgaataagcacatctccggtcagttcaatgccgagctggagcatatccgtacccaggtgatgatcatgggcggtatggtcgagcagcagctgaccgatgcaattaccgctatgcataatctggatggcgaactggcgcagcgggtgatcgacggtgaccagaaggtcaatatgatggaagtggagattgatgaagcctgcgtgcgcatcatcgccaaacgtcagccaactgcgatcgatttgcgactggtgatggcgatcatcaaagccatttctgagctggaacggattggcgacgtggcggagaagatcagccgcacggcgctggagaagtttggtcagcaacatctgccgctgctggtcagccttgagtcgctgggtcgtcacaccgtgcagatgctgcatgatgtgctggacgcttttgcacgcatggatctaaatgaagcgatcactatctaccgtgaagataaaaaggtggataaagagtacgaaggcattgtgcgccagctgatgacctacatgatggaagatccgcgcaccattcccagcgtgctgacggcgctgttctgtgcccgcgccattgagcgtatcggcgatcgttgccagaatatctgcgaaatcatcttctatttcgtcaaaggtcaggatttccgtcacgttggcggtgaccggctcgatgaattactgtcgggcgatgacggcagcaacagaccttcctgataaatcttcttcctgcgcctgatcggcgcagggataagccttttcaattggtcacatcctgaactctctctataattgcggcacttttctttatgaggtgcgcaacgatgtccccttctccccaatctaagcccggcgtaacgccaggcaaagcgatgctggctgcggtcagcggttatgccatggatggatttgacctgctgatactcggctttatgctgccggctatcagtgtttcgctggcgctcaatccatcacaggcgggatcgctggtgacctggacgctgattggcgcggttatcggtggcatcgtatttggtcatctcagcgaccgctatggccgcatccgcatgctcaccgtcacgattctggtcttctcggtctttaccggcctgtgcgcggtggcgcagggctactgggatctgctcgcctggcgaacgctggcgggtgtcggtctgggtggcgaatttggtatcggcatggcgctgattgccgaagcctggccggcggagaagcgtaatcgcgcatcagcgtgggttggcatcggctggcaactcggggtgctgatggcggcctttatcacaccgccgctgctgactatcatcggctggcgcggcatgtttttggtcggcttgttgcctgcgctggtctcgtttgccattcgtcgcggcatgggtgaaccggaggcgtatcaacggcaggttaaacatgtgccgtcactctcttttccggcgcgcctgaaactgctggtgcgcgatcgcgccaccgccaaagccagcctgggcatttttatcctctgttcagtacagaactttggttactacgggctgatgatctggatgccgagttacctctcctccagctttggcttcagcctgacgaagtcgggcctctggaccgcggtgaccgtggtcgggatgacctttggcatctggctgtttggcgtactggccgaccgcttcgcacgctggaaaatcttcctgctctatcagtttggcgcagtagtgatggtggtggtttatgctcagctgcgcgacccgaacatcatgttatttactggcgcgatcatggggatgtttgttaacggcatgattggcggttatggcgcgctgatttccgatacttttccgccgcaggtgcgtgccaccgcgcaaaacgtcctgttcaaccttggccgcggtgtgggcggcttcggcccggtggtgattggtctgctggcgagccagttctcatttacggcggcgattaccctgctggcgctgatttatctgctggatattgcggcgacgctgttcctgctgccgaagaaacagggtcaggaagatacgctgggcgcgatcggctgatgctgccgtgatggtatggctggagtaagtatcattccggccattccgggtcagtaatatggctcacgatcacctgttctgccttcattacccctggcattacatggcaggggggatccgttaacaggcgatttaaatccataacagacagagcgttctcgcaggtttacttcatcagcggcaggagctgttgataaagcgtcgcaaaggtctcccgacgcggctggtagtgtgctacccgggccggatccggctggtgtcgctgcaccagaaaccggggtcggcacggtgatctctgcatccagcgcctgctgcgccagcctggcggcccccagcgccgggccaacctccccgccatggcagtaatccagcgtctggccgctgatgtctgccagcatctgacgccacagtgcactgcgtgcgccgccgccgatcaacataatgctctttggctgaacgccacagtcgtgtagcgcgtccatgccctccgccagcgcaaaccctacgccttccagcaccgctctcgccagctcgggacggccatgctggtgggtaaagccaaaaaaagcaccccgggcattcgggttattgtgcggcgtgcgctcaccggaaagatagggcagaaaccacaggtcgggcacgtcatcgcgcgcgcgttcagcttcagccagcagctcaggaacatctctgcaaccggtcagcgtcgctgcccagtccagacaggaggctgcgctgagcatcaccgacatcagatgccagcgctggggtaacgcatgacagaagctgtgtaccgcgcgctgcggattgctgagatagccgtcgctcaccacgaagtagacgcccgacgtacccagcgacagcatgccctggcccggttcggtcatgccgacaccaatcgcacccgcagcattgtcgccaccgcccgccgccagcggcacggcgttcatcttccagcgtgtggccagttcggcatgtaaggtgccggtcagggcattgccctcatagagttgcggcatctgatcgcggctgaggtcgcaggcgcgcagcatcacatcgctccagtcacgccgtgccacatccagccacattgtgcctgctgcatctgacatatcagtggcgaagtcgccactcaatcgccagcgcaggtaatctttgggcaacagcacgtgagcgatctgattgaatattgccggttcatgttgctgaacccacagcagcttaggagccgtgaagccgggcatcatcaggttgccggtgatcgcccgcgaatccggcaccttctgttccagctcacggcactgcgcctcgctgcgcccatcattccagagcatggccggtcgtaatacctggtttgcactgttgagcagcgttgcaccatgcatctgtccgctcagcccgatggcctgcaccgcgcgcagatcctgctgcgcgctcagcgcctgcatggccaaatccagcgcctgccaccagctttcgggatcctgctcgctccacaatggctgcggacgcgaaacctgcagcggcgctgtttccgtcgccaccacgttgccttgtgcatccatcagcaccactttgacgccagaggtgcctaaatcgatcccgataaacatgctctgctcctgaagggttagaaatcaaacaggtagtgattcaccagattttccagctgctcctgacgtccgctctgatgctgcggattgagctgctgctgctgagcatgcgccgccagtgcctccagtgaaaactcacctttcaaaatttgctggccgaactcaccattccagccgctgtagcgctgtgccacacgcttatcgagttcaccatcgctgatcatgcgagcggcgactttcagcgccagcgccatggtatccatcgcgccaatatgaccgtagaagagatcgtatttatcagtgctctgacgacgcactttggcatcaaagtttaagccgcctgtggtaaagccgcccgctttgagaatttcgtacatcaccagcgcattctcttccacgctgaccgggaactgatcggtatcccagccgcactgcggatcgccgcggttggcatccacggaaccaaaaatgcccagcgcaatggccgtcgcaatttcatgatggaaagagtgacccgccagcgtggcgtggttcgcctcaacgttaaccttgatctctttctccagtccgaactgtttcaggaagccataaaccgtcgcgacatcatagtcatactgatgtttggtcggctcctgcggtttcggttcgatcagcagcgttccctggaagccaattttgtgtttgtgctcgaccaccatctgcataaagcggccaatctgctcgcgctcctggcgcagatcggtattcagcagagtttcgtacccttcgcgtccgccccacaacacatagttttcaccgcccagggttttggtcgcctgcatggcgctgcagacctgcgtcgctgcccaggcaaaaacttcaggatcgggattggtggcagccccggctccgtagcgcggatgggtaaagcagttggccgtgccccacagcagtttcacgccggtctcctgctgtttctccagcagtttatcggtcatggcggcaaaattctctttgtagctgtgcagcgaatcgccttctggtgagacatcaatgtcatggaagcagtaccacggcacattcagcttgtggaaaaactcaaaggccacatccgctttcagttttgcctgctgcagcgcatctccgcttttctgccacggacgatcaaaagcgccgacaccaaacatatccgcgccattccagcagaaagtatgccagtaacaggcggcaaagcgcagatgctccgccatggtcttgccgaggatcacctcatcgggattgtagtggcggaaagcgagaggatgagtcgactgggtgccttcataacgaacccgatcgatctgatcgaaataagcgtgcatggtttgctccttagcatcagtacccgaatggcctgcgttgaagcaatatttgatattggctgctgcctcagctcaattacgatatttcactacgggtgtcagataattattatttgtgcgctggctcgcaaaataatgttatttacggggtggtttatcattatcgctctcttgtccgaaaaagatgaaacctcgatcgcgctcataaaaaatgaaataaaccaaaaaacgtaatagccggataaaaatcagtaattgctgtaacaggaaaataagggcaacaattcatccgcctggtttataggcctgaaacgacaatagcctcaacctacaggatgatcacaatgaagatgaaacatgcactgctcgccgcctgtgcggcgctggcgctgttcagccagaccagcgtggcaaaagaagtgaagatcggcatggcgattgacgatttgcgactcgaaacgctggcagaaagaccgcgatattttcgtaaaacaggctgagacgctgggtgcgaaggtgtttgttcagtcagccaacggcaacgaagagacacagatgtcgcagattgaaaatatgatcaatcgcggtgtcgatgtgctggtgattattccttacaacggtcaggtattgagtaatgttgtcgctgaagcgaaacgggaaggcattaaagtgctggcgtatgaccgaatgataaataatgccgatatcgacttttatatctctttcgataatgaaaaagtgggcgagctgcaggccgaaagcattgtgaaacaggtgcctaagggcaactattttttaatgggcggatcgcctgtggataataacgcacgcctgttccgtgccggacagatgaaagtgttaaaaccctatattgataacggcagcattaaaattgttggcgaccagtgggtcgatgcctggctgccggaaaatgccctgaaaattatggaaaatgccctgaccgccaacggcaaccatatcgatgcggtggtggcctctaacgatgccaccgcaggcggcgcgattcaggcgctgagcgcgcaggggctggcaggaaaagtggcgatctccggtcaggatgccgatctggcagccattaagcgtatcaaagcgggcacccagaccatgacggtttacaaaccgatcactgagctcgccaccgaagcggcgaaaattgccgtcgagctgggcgagggcaaaacacctgccagcaacagcacgctgaataatggtctgaaagaggttccgtcacggctgctgaagccgattccggtcaacaaagacaatattgaaagcaccgtggtgaaagacggtttccacaaacagagcgaactctgactgcgcatagcgtgagggagaacagtcgatgctgctggaaatgaaaaatatcaccaagcgtttcggtgccgtgaaggcgctgaatgatgtcagcctgcaacttgaggcgggcgaagtgatgtcgctgtgtggtgagaatggctcgggcaaatcgacgctgatgaaaatcctgtgcggactctatccgcacggcgattttgaagggcagattcacttctctggcgacgacattcaggcgcagaccattcgcgataccgagcgtaaaggcattgtgattattcatcaggagctggcgctggtgcggcaactgacggtgatggagaacattttcctcggtgccgaactgagccgtttcggcatggtggatgatgaaactatgaccctgcgctgccagcaactgctggcgcgggtcgggctgaacgtttctcccgccacccgggtcggtgagttaggccttgggcagcagcaactggtggagattgcccgcgcccttaacaaacaggtccggctgctgattctggatgagccgacctcttccctgacggagcaggaaacggacgtgctgctcggcatcatccgcaatctgcgtgaacacggcattgcctgcatctacatctcgcacaagctgaatgaggttaaggcgatctccgataccatctgcgtgattcgtgacggccagcatattgctacccgtccggcagcgggcctgagcgaagatgacatcatcaccatgatggttggacgcgagctgaccgcgctctatccccacgcgccgcatcagattggcgacgtgatactgaaagttgaaaacctcaccgcctggcatcctgttaaccgccacatccgccgcgttaacaatgtctcgttctcgctcagacgcggtgaaatcctcggcatcgccgggctggtgggcgcgggcaggactgagacagtccaatgtctgtttggcgtctggccaggacgctggcagggcgatatctggatcaatggcaaacaggtcaacatcaccgattgccgcgccgccattgcgcacggcatcgcgatggtgccggaagatcgtaaaaaagatggcatcgtgccgctgatggcggtgggcaaaaatattaccctggcggcgctggaccagttcagccaccggctctcaacgctggatgaagcgcaggagcagcaggcgatcaatgacgcgatcggtcggctgcgggtgaaaacctcctcatcagaactgccgattggccgtttaagcggcggcaaccagcagaaagcgattctggcgaaatgtctgctgctcaatccaaaaatcctgatccttgatgaaccgacgcgcggcattgatgtgggcgcacgtcaggagatctacctgctgatcaatgcactggttcagcagggtatcgcggtgattgtgatttcctctgagctgccggaagtgctgggcctgagcgatcgggtgctggtgatgcatgaagggcagatcaaagccgatttgattaacgataacctgactcaggagcaggtgatggaagctgccctgcggagtgaacattatgcttaaaagtgaaagtacccaaagccgcctctccggcacgccgggcaaaccgtcaccgggcaggttcacactgcctaatctgcaggttctggtgatgctgggcgcaattgtgctgattgcattgttctttacctggaccacagacggcgcgtggctcagcgcgcgtaacgtctccaacctgctgcgtcagaccgccatcaccggcattctggccgtgggtatggtgttcgtgattatctcggcggagatcgacctgtcagtaggttccatgatgggcctgctgggtggcgcggcggcgatatttgacgtctggctcggctggccgctgccgctgaccattgtggtgacgctggtgatgggattactgcttggcacgtggaatggctggtgggtggcctaccgtaaagtgccttcgtttattgtgacgctggcggggatgctggctttccgcggtgttctggtcgggattaccgatggcactacggttgcgccgatcacgccgggcatgtcgcagattggtcagagttatctgccgggcggcgtcggtttcggctttggctttgccggtctggcgttatttatgttgtggcagtggcggctgcggctgcgtcgtcagcagctcggactggcgcagggcgcagccagcggcaccatcgggcgtcaggcgatcaccgccatcttagtgctgggtgccatctggttgctcaacgactatcgcggcgtgccaacgccagtgttactgctggcagtgctgttgctggcgggcatgtttatggcaacccgcaccgcgtttggccgtcgtatctacgccatcggcggcaacattgatgctgcgcgcctgtctggcattaacgtggcgcgtaccaagctggcggtgtttgccatcaacggtgtgatggtggcgattgccgggctgatcctcagttcacggctgggcgcaggttcgccgtcggcgggtaatattgcggaactcgacgctatcgccgcctgtgtcatcggcggcaccagcctggcgggtggcgtgggtttcggttgcgggcgcggtaatgggagcctttattatggcctcgctggataacggcatgagcatgatggatgtgccgactttctggcagtacatcgtcaaaggcgcgattctgctgctggcggtgtggatggatacggcaacgcggcgtcgggtgtaatcgcgcgggcgatcacattgtggcgcaaacaatttttttgcccctttcagccgtgttatgcaatgcgctgaggatttaagggaacgcgccatcatgcatgagaaacgctatcgcattaccctgctgtttaacgccaacaaagtgtatgaccgtcaggttgtggagggcgtcggtgagtatctgcaggcgtcgcagactgactgggatatcttcatcgaagaagatttccgctgccgcatcgacaacatccgggagtggctgggcgatggggtgatcgccgattacgacgatcgctctatcgaaaccctgctgtcgaatgtttccgtgccgattgtcggcgttggcggctcttatcatcggcaggaggattatccgccggtgcactacatcgcgactgacaacgccgcgctggtggagaaagcctttctgcatttgaaagagaagggcattaatcgctttgccttttatggtttaccggcctccagcggcaagcgctgggcacaggagcgtgaacaggcgtttcgccagctggtgggacgtgagcgctatcagggcgtggtctaccagggcatggaaaccgcgccggaaaactggcagcacgcccagaaccgtctcgccgactggctgcagacgctgccgccgcaaaccggcattatcgccgtcacggattcacgggcgcgacacctgctgcaggcgtgcgaacacctgaaaataccggtgccggagaagcttacggtgatcgggattgataatgaggagctgacccgctatctgtcacgcgtggcgctctcgtccgtggcgcagggctcgcgacagatgggctatcaggcggctaaactgctgcatcggctgctggataagcagcccttaccgcttcagcgcatcctggtgccgccggtgaaagtcatcgcccggcgctctaccgacttccgctcgctgcgcgatccggcggtgattcaggcgatgcactacatccgcttcaacgcctgtaaggggatcaaagtggagcaggtgctggatgccgtcgggctgtcgcgttctaatctggaaaaacgctttcgggatgagaccggcgacaccctccatgcgatgatccaccgtgaaaaactggaaaaagcgcgcgaactgctggcctcttcatcgctcaacatcaacgagatctcgcagatgtgcggctatccttcgctgcaatacttctattcggtcttccgcaaaagctacgacaccacgccaaaagagtatcgccagcattttggggagaatgtgttgtagcaggaagcgttcagtctgaggtggatggaaaccggatgaatcagggcggcttgagccactagattatccgctgctcactctgctccagcaccgccagcgccagcccgttggccggatctatccgttgctcaggaaagtgcagcagggtatgtgcggcggtaaaggccagcgcgttgccgtgggcggtagtgcgcaccgccttgcagaagacctcactggcgttccacggacaatcaatgatgatggtggcgggattgagcagcagcataatctgactcagcgccgcacccagatagccacccgcctgcgccatcacctcatccaccacccgtggcgcgctgtcgcggtttctgccagctcaggccaggctgacgctgcgccagctgctgtttaaccgcaggctggctgaccagcgcttccaggcaaccgcggcggccacagctgcaacgcgggccgtcgggctggacaaccagatgtcccgcctcgcccgccgtccagctgtgcccggtaaatacttcgccatgctgtaccagtgcgccgccaattccctcggaaatacgcagataaaagtgaccgctctccacagataatccacgtagctgtaccgccagcagcgcagcggctttgacattattcataatgcggatggggagactgacgtgcttactcagcgcgcccagcaggtcaacatcctgccattcgaggggcaatgaaatatgcatccagccgcgccggggatcgacgataccgggaaaacccaggccaatgccgagcaaatcaggatagcttttcatcagttcccggcacagcatcgccagctcagccagcagtcgggtcgggttactggtatcggtgcgcagcgtcttttcagccagcacctgtgaaaaatagtcgcagacccgccagtggataacgttgcgttccaccatgatgcctgcgctcttgagcttttccggccgcagggtaatcccgattttaggccgtccggcggacgcgacgctgaccggccccagctcctctatcaggccctgctccagcaggtcatcaatgattaatgagacggtatttttgctgagtgtcagcgtctccgccagatcctgacgcgacgtcacgcgcagcttgcgcagctgagtcatcacccgtttctggttattcagtcgcagtagtgccgggcctttgccgttcgttttcattacgggttcactcaacagaggagtaagaattgagtgtatcagcccatacgtattccacatcccacacttttgcgggcggtttcacacaacccgatcgcctgtggctaagatcgtgaccgcgatcagatcgtgggattaacgccgggttttctgctgcaccagtggccggacgtcggaatgatcctgactcagcgcgtccggctgcgccgggcatgggcggaaggtcaaaggcggtgtagcttgtcgttatgaagaggggcttcaggcttgatgagcgcagtgacccggcgctgccgggtcactgtttaatattcgtcgccgcgtacccgactgcgatagctttcccagtcgaagcgcacccacaggctgttgccgaggcgcatacggtccatgacacgttcgcccagcagcgtattcatgcccgcatggtcgaggttagataacatgccggtcgggcgtttcgaggaggatcggcgatcgacaatctggttaataatcactttttcgtagcgcgattcactctgcataccgatctcatcaatcaccagcagatcaacactgctgagatcctgaatcagccgctcttcggtaatgccgctgctgccgctgaaggtgcccttcatgctcgacatcagatcggcaactgtcacgatcagcacgcttttaccgcgcaggatcaggtcgttgccaatcgcggcggccagatggtttttaccggtgccgggacggcctgaaaagacaaaactggcgatgctgccatcaaattcagcggcatactgacgcgccagttccagcgccttgcgctgtccctcattctctacccggtaattatcaaatgagcagttcatatgcagctctcgaatgccggaacggcccattacgcgctgcattttcattgcgcgattctcacgcacaatcgcctctgatcgcagacgaccctgctcctgattccacgccagtagctcttcgccattggcaaatttaggacgggtgcctgcgggcatcatttttttcagacggttaaagagatcgtttggcgttttcatcattcacctcggaaaccatcgggaatggtacggtcaggatcgggcaactgcgtgatatcacgcttcggttgcccgccgtttgcggcacggttcatctgaatgctgcgtgccagtttctgttgccactgtacatgatggaacatccggccttccgcctgccagtaagccacaaaggccgccagctcgctgggggtcaccggttcgcccagcgacacaccccagatcgcggcctggcgcgtaaagtcggcatccggctgccagccctgatacatggcgaacttacctgccggcgtatggatcgcggcgggggaatcgtcatacaggctgtcatccagcgccacatcattcggctgccgggcggcggcttccagcgccagcagctcagccagacgcttaggtgtgatggcgtacatcaccggcgcataattatctaacaccgccagcgtgcccttttccgcctgctgcagggcagtcagcggatcctgtcggaaggcatccaggccaatgagcgttgaagttaagattttagctgacatgaaaagacctgaggttaacgaacaccttgcgccgggaacccgtcgccgacgcagaagtgtttattgtaccttttttaatgatgcggatcgcttaaaaagcaagagtgcggatcagtgcgaggtgaccggagaagtggcgtgacgggccggtgcagattcggtggcgtgcacgctgacggcagcggcggccggacgggtctgccataaatagcgaaccgaggccagccagcacaggccgtaacccagcagtttcggtgccctcttcggccatgtttttcaccacgcggttgtaatctcccagcatcaggtgctgccacaacgcatgaataccaaacagtcgtgagaagaccagcaccactaaaaagccggaggccatcaccggccagctgcggtgctgcagcagcctggccagcgcatgcagggtttttttcggcgttcgcagcgcgacggccagacaaccggccgtcaccgccagggcgaaccagatccagctgccatgctggatggcatcaaacacaaagtcgagctcacggatcagcatacagctatagaagcccgccactaaggtcagcgcgccgcgctgagccggacggcgctgggccgcaataaagaacagggcggcaatcaccgccagtatgatttcctgggtggtttcagtaaaagaagtttcgtgcagcgcatcattcatccaggccacatcaatatagatgggcaatatcatcagagcgagaaagagtgctgccagtatgaagaccgtcatttcacggccaataattgtcaaatcgttgcgcatagtgttaccagtataatgattagcggactcattatattttaaacgcccgattccctttctcttttcatgccccggtcagaagctggcgctgaagccaaaggtataaagttgctgctcctggttattcagcgcttcgctttgtgaaaacgcggcgaaagccgccagattatcgttcagaggcacttgtgcaccgatgctcagatcgatgccttcggactgatcggtgccgtttcgtcgcctcacgccggggattctgcggcgtgtctgccagcagatagtgataactcagctgcgcccagggcgatatccatccctgctgcgaatcgatgcgccagccgacgctggcgctctgctcacgactctgctgatcgctgtagtcacattgaagacagttcatctgctgcggatcaacggcatactgcgccaccggcccggtggtaaatgacggggcaatgggcaggtcaaccccagcccgatagcgttttcccagcggggtggtgcctacgctgccggtttcactgtggacggcgatgggtgacgcggtgggagagttgatggcggcttcaaacagggcgcggctctcatcgctgaaggcgagtggcgtcagggcgatcttctccgccagaatcgtatcgtagtcgggcagaaagtcgggatgttgaggcgcagagatgccgccgcgcgcaaaagtcggttgcgttaagattaacagccatacagcacagcagatccgcagacctttccaaccgcttctcggcaacatcgcttctccaggcaaggctgaagttattatccggcgtttaaattaaatttcggcccgtctctgttatttaaccggtgatcgtttaactatcaaccgattaattctaagatcaagcggaccgctaaaatattcttgttataaaggaacaaagcgatgcaacgatgtggttgggtaacgcaggatcccctctatctggcttatcacgacagggagtggggtgtggcacagagagacaagcgtgcgctgtttgagatgctctgtctggaaggacagcaggcggggttatcctggataaccgtgctgaaaaagcgggaaaactatcgggcggcgtttcaccagtttgatccgcaggccattgcgttgatggatgcggcagagatcgacacgctgatgctcaacagcggcattatccgccacgccggaaaaatcgcggcgattatcgccaatgcccgtgcttatctccagatggaagcgcaaggcgaggatttcagccacttcgtctggcaatttgtcgataacgcgcaaatcgtccaccattatcctgactatagtcaggctcccaccacctcagagcaggccattgcgctctcgaaggcgctaaagcagcgtggtttcaaattcatcggccccacaatctgctactcctttatgcaggcctgcgggctgataaacgatcatcagagcaactgtttttgccatcctgacaaccaaaaggcgtaattcccgctaaatcaggatttttcctcactacattcccggccaccaggcggcataatcgtgccacttatgggaaaggttttcccctgtgtgtcgaatgtaagggaacaaaaatgcagaagaaattaatcgccatcaccttgttattaagcggcagtctggccctgccaggttgtaccaccaatccttacaccggcgaatctcaggcgggtaagtcaggtgtaggcgcaggcctgggtgcgttagtgggtgccggtgtcggcgtactctcctcgtcgaagaaagatcgccgtaaaggtgcgctgattggtgctgctggcggagccgcactgggcggtggcgtgggttactacatggatgtgcaggaagcgaaactgcgcgacaagatgcgcggaacgggcgtcagcgtgacccgtaatggcgataacatcgtcctgaatatgccaaacaatgtcaccttcgactccagcagcagcaatcttaaacctgccggcgcgaacaccctgacaggtgtttcaatggtgctgaaagagtatccgaaaaccgcggtaaacgtagtgggttataccgacagcaccggcacccgcgcgctgaacatgcgtctgtcacagcagcgtgctgaaagcgtcgccagcgcgttgatcgtgcagggtgttgccagcgatcgcctgcgcacccaaggtgcaggcccggataacccggttgccagcaacagcaccgaagcaggcaaagcacaaaatcgtcgtgttgagatcacgctcagcccgctgggataaacgcggtcgcccccgcccgggggcgccttttttctgtaaagcatcgcgttaaaagtatcagtaatgtttctgcgaatagagccagcagaggctttatggtagtctgatcaaaaattgatcaatggacgccttcccatgtctcttaaagccatcgctgcggttttaggtctttccgtaacaaccgtcagccgcgccctcaacggttatcaggatgtcgctccggagacgcgtaaacgcatcgaagaggaagcgcagcggcgtggctaccggcctaatgcggcggcccggcgtctgaaaaccggccgtgctaacgcggtggggtttcgtctacccgatcggtgcctctcccctgaatggcagcgacttcagcgacatgctgctggctctggagcatcaccttgcccgttatgacattaacctgctgttgctggcggataagcagcagagtcaggcgacgctgacacgcctgctgcgcagtggcgccgttgatgccctgatcgtcggccacaccacgccagaagacagtcggcttcatgctctgctccagaccaattttcgttttctggcgctgggccgcagcgatctgccatcgacctatgcgtggtttgatgttgatcaccttgccggttcacagctggcggtgggctggtcgctggcgcagggacggcagcggatagcctggcttggcagcaatgaaaacagtacgcgggtgcgtgaccggcgtcagggttatctgacggcgctgggggaagttacgccttacgcgatggcggcggtggcaccgtcgcgccgcgccggttatcagcaaacccgggagtggctggcagaggggccagtaccggaagtgatcatcaccgactgcgctgcgctggctgaaggcgcggctctggcgctgcaactggcggggcgtgcagcgggcgagggtgccattctgctggcgggctgggaaggattgccgcgagatgcgattctcgatcatcccattgtcgccattcgtcaggcgacgccgcatcaggccggtgaacaggtggctgaaatggtcatccggctgattgatggcgcaccgccggaaacgttacagaccctgtggcaaccctggctgcaattaccggcgtagcgctttttgcgccgggctttgcttgtgctagtctctgccgggtttcttattacgcaggatatctcatgaaaatcaggccgcctcgcgccaccatcagcgatgttgctcacgcggcacgaaccggtaaaaccagcgtttcacgctatctcaatggtgaactgcatctgctctctgccggtctgaaagcgcggatcgaacaggctattgctgatctcagctatcgcccgagtcagatggcgcgcggcctgaagcgcggacgtacccgcctgatcgggctgattatcgccgatatcaccaatccctattctgttgatgtcatgagcggtattgaagccgcctgccgcgagcagggcttcacgctgctgatgtgtaataccaataacgaagtggatctggagcagcactatctgcaattgctgagcagctatcaggttgagggcattgtggttaacgccgtcgggatgcgcgaagaggtgctgaaccatctgcaacaatccctgctgccaatggtgctgattgaccgtaaaatccccgattttccctgcgatgtggtaggcctgaataacgccgaggcagctgaaacggcaacgcggcatctggtcgacaatggctatgatgcgctgctgtttcttagcgagccgctgggaagcgtcaacacgcgccgtgagcgcctgcaggccttccgccagctactggcagagcatccgcaggttgagcatgagaatacggaagtggcgctgcatcagcccgccgcgctggatcaggcgctgctggcctttcatcagcgtcacaccggcaaacgttgcgcagtgatggtcgccaacggggcgctgaccctgcaggtagcgcgatcgctacaaagactcaatctgcactggggccgcgatatcggcctgctcggttttgacgaaactggagtgggcggcgctggccggtgtcggtatcaccacgctgaaacagcccacctggcagattggctacagtgcgctggaacgactgattacgcgcatcgaaggcagcggattgccggttgccgagcaggtcttttctggcgaacttatcgttcgcggctccagccagcctcttaactgaatttcagatttaaccttccgtttacgtgctcgcttcgtgagcacgatcataatttcacagtttgctgctttgctttggaaccggttccatttagggtttttgtattcgttatgggcagaaccctgccatggagtagaacatgaaacctgacatcatcgtggtgaccgccgcatatggccacgcacagatcgccgctctcggcggtcagcgtgcgctgctgccgattatccagcaggcgggcgcagacggggtcgaaatccgccgcgaactgcttgatgacgcggcactggccgatctgccggcactggcccgggcggtggcgcagcatcagctgcacagcagctattcggtgcccgatacgctgttttgtgacggcggcgaaatcaatccccgtataacccactacgttgaagaagcacgccagttaaacgctcagcggctgaaagtggcgctgggagagttcaccggtgcgctgcctcgtgaagcgttgcaggcgctgctggcggatctgccgtttcagctgacggtagaaaacgaccagactgagcatggccgactggctccgtcagtcgcctttttcacggcggtcagggaagcggatctgccgatcagcatgacctttgatatgggtaactggtgctggaccggtgaggatgccgatcaggcggcgcagcagctggctgcgcaggtgggctatgtgcatgtcaaagccgccgtggcgcaccaggatagctaccgcgcgattgcgctggatgaggctgatgaccactggcgcacactgctgcaacagttgcccgcacaggcagcgcgcggtattgaatttccgctggaaggcgacgatctgactgcggtgacacgccactacgtgtcgctgctgcgtaacgtgtaaggagtgaagatgaccacgcatcacactatgcatcacaacggtccgcttgatgttgtcactatcggtgaagcgatggcgatgttcatcgcccgtgaaaccggcgacctggccgcagcagagacctttgttaaacgcgcggcgggcgctgaactcaatgtggcgaccggcctggctcgtcttggcctgaaagtgggctgggtcagtcgtattggcgatgacgcttttggccggtttatctgccagcagctggaaaaagagggtatcgaccacgcccgggtgacggtcgataagcgctatcccaccggttttcagctcaagtcaaaagtcgacgacggctctgatccactggtggaatattttcgtaaaggctcggcggccagccatctgtcggtcgacgattttgacgcggactattttggttcggcgcgacatctgcacctgagcggtgtggcagcggcgctgtcagagagtttcgctggagttgctgaagcacaccgccaaagagatgcgcgcgcgcggtaaaactatctcgtttgaccctaacctgcggccggtactgtggcgcagcgaagaggagatgcgtaagcagctcaatctgctggcggagtatgccgactgggtactgccgggcgaaaaagaggggctgattctgaccggctatcgtcagccagaagcgatcgcggatttctatctcgataagggtgtgaaagcggtcgtgattaaaaccggttgtgacggtgcctggtataaaacggcgcagggcgagcagggccaggttgaggcgataaaagtcgacaacgtggtggatacggtaggcgccggagacggctttgccgttggcgtcatcagcgccctgctggaaggtcagtcgctgccgcaggcgattcgtcgcggcaacaaaattggttcgatggcgattcaggtcattggtgacagcgaaggtctgccgacgcgtcagcaactgggcgacgtgtagttcgcgcccctctacagtcacaggagttcccgatgaaaaagcagacaatcgcgccaaaacgctggtggttcatcatgcccatcgtgtttatcacctacagcctggcgtatctcgatcgtgcaaattttagcttcgcttctgctgccgggattaatgacgatctcggcatcaccaaaggtatgtcctcgctgctgggtgcgctgttcttcctgggttacttctttttccagatcccgggtgcaatttacgccgaacgccgcagcgtcaagaaactgatcttctggtgcctgatcctgtggggcggctgtgcctcactgaccggcgtggtcagcaacattccgatgctggcggccattcgctttattctgggcgtggtggaagccgcggtgatgcccgcgatgctgatctacatcagcaactggtttaccaagtcggaacgttcacgcgccaataccttcctgatcctgggtaatccggtcacggtgttgtggatgtcggtcgtgtcaggctatctgatcgaatcgtttggctggcgtgagatgtttatcttcgaagggattccggcggtggtctgggcgatcgcctggtggttcctggtgcaggataagccggcgcaggcgcgctggatgagcgatgccgagaaagcggcattgcaggctgaactgcagaaagagcaggaaaatattaaagcagtgcgcaactacagcgaagcgttccgcaaccgcaacgtgatcattctctgcctgcaatattttgcctggagcatcggcgtctatggctttgtgctgtggctgccgtcgattctgcgtaatggcacgcagatgggtatggtagaagcgggctggctctctgcggtgccttatctggcggcgaccattgcgatggtggtggtctcctgggcgtcggataaaacccagaaccgtaagctgttcgtctggccgctgctgctggtgggcgcgctggcgttcctcggctcttatctggtgggatcgaacaatttctggatgtcctacaccctgttagtgattgccggtgccgcgatgtatgcgccttacgggccgttcttcgccattattcctgagatgctgccacgcaatgtcgccggtggcgcaatggcgctgatcaacagtatgggtgcgctggggtcgtttatcggttcatggattgtcggctatcttaatggagccaccggcagcccgtccgcgtcctacatctttatgggatcggccctgctggtttcggtgtggctgacgctgattgtgaaaccggcgcagaacaaagcgccgccgctgcagggtgcgaaacccgcctgaaagcgtaaacgttagcctctatttctccgggcggcctgcaagccgcccgctacttattgaccgggagccaccgaatgaaacccgctgtaattctctataaaaaactgcccgacgatctttatgctcgcctggctgaacagtgtgacgtgacggaaatcagcgatctctcgccggaaagccagcaggaacatgctgcggcgttccagcaggcagaaggtctgctgggatcgggcggtaaagtgaatggcgagctgctggcgaagatgcccaatctgcgcgtctgctccagcgtctctgtaggctatgacaattttgatgtggatgcgctgaatcagcgtcacgtggtgctgatgcacacgccgaccgtgctgaccgaaaccgtggcggacaccatgatggcgctggtactgagcaccgcgcgtcgggtgccggaactggatgcctgggtcaaagcgggcaactggcagaagagcatcggtccggcgcagttcggcatcgacgtgcaccataaaacgctgggtattctcggcatgggacgtatcgggatggcgctggcgcagcgcgcccactttggcttcggtatgaaaatcctctataacgcccgccgcgagcatgaagaggcgcagtcgcgctttggcgcacagcgctgtgaacgggaggcgctgctgaagcagagtgatttcgtctgcatcagtttgccgctgactgaagagacgcaccatctgatcggtgccgccgagcttgaactgatgaagccggatgcggtgctgatcaacgccggtcgcgggccggtggtggatgagaatgcgctgatcgccgcattgcaggcgggcaaactgcatgccgccgggctggatgtgtttgagcaggagccggtctctgccgactctccgctgctgtcgctgcccaatgtggtgacgctgccgcatatcggttctgccacccacgaaacccgctacggcatgatgcaggatgcggtagaaaatctcctcgctgcactcggcggaagcgtcgagaaaaactgcgtgaacccgcaggcgctgaagtaatcccctcgcctttccattgcgcccgcccatggcgggcgttatggtggacccccgattcgctatcacaaatatttaaccgctatgtctttttctcagttcggcgacaaatttacccaacattccggcatctcacgtctgatggaagatatgggcgcgggcctgcgaacgcccggcaccatcatgctgggcggcggtaatccggcgcagatcccggccatgaacgactactttcagcaactgctgcagcagatgcatgaggaaggcaaactcagcgaggcgctgtgcaattacgatggcccgcgcggtaaagcgacgctgctggcgtcgctggccgggctgctgagcgatgagcttggctggcccatcaccgcacagaacattgcgctgactaacggcagccagagcgctttcttctatctgttcaatctgttcgccggtcgtcgggccgatggcagcaaaaagcgggtgctgttcccgctggcgcctgagtatcttggctatgcggatgccggcctggaagaggggctgtttgtatcggcgaagccgaacattgagctgctgccggaaggtcagtttaaatatcatgtcgattttgagcatctgccgatgaatgaagaggtcgggctgatctgcgtatcgcgcccgaccaaccccaccggcaacgtgatcaccgatgatgaactgatgcagctcgatgcgctggcacagcagcatgacgtgccgctgctgatcgacaatgcctatggcgtgccgtttccccggcatcatcttcagcgaggtgcgcccgctgtggaaccccaacatcattctctgcatgagtctgtcgaagctcggcctgccgggtgcgcgttgcggcatcattatcgctgacgagaagaccatcaccgcgctgagcaatatgaacggcatcatcagtctggcacccggcagtatcggtccggccattgccaatgagatgatccgtcgcggcgatctgttgcggctctccgaagaggtgattaagccgttctatcagcagaaggtgcagcagaccattgcgatcctgcggcgctatctgccggaagaccgttgcctgatccacaagccggaaggggcgattttcctctggctctggttccgcgatctgccgatcaccaccgaattgctttatcagcggctgaaagcgcgcggcgtgctgatggtgccgggccacttcttcttcccggggctggaacaggcgtggccgcacacccatcaatgtatgcggatgaattacgtgccggatgcagagaatattgagcgggcggtgcagattctggcggaagaggttgagaacgcctggcgcgacagctaatcctgcgtatcggttaacgacagctggcaccactgtgccagctgctgaatcgcctgttccacctctgcattccagccaaaaccggcattcagccggaaacagtgatcgtagcgctggtcggtggcaaaaatgtggcccggcgcaatgccgatgcccgcgttgcgcgctttcagaaacagctcgcgcacgttcagcgcctgtcggggcatctcaacccacagcacatagcctccttccggatcggacacccgggtccccgccggaaattcccgtaacactgactgacgcatttcacggatttgtcgtgccagctcacgccgcagcttacgcaggtgagcatcatagccgccgctgcgcagcagctccgccaccgccgcctgcgacagcaccgaggtgcccatggttgaggtatatttcagtgaggcgattttgcgcatgtagttgacgctgtgaacccagccgatacgaatgcctggcgccacggttttagagaagccgctgcagagaatggcgttggggctgaaggcgcgcatcgggaaagggcggcgttcaccaaaggcagtatcgccaaaaatatcatcctcaataatcaccacgtcgttttcatccgcctgccgcgcaatataggccttatgctcgttgggaatgctttttcccagcggattgttgacgttgcacagggtgagaaagacccgcaccgccttgcgctgaaacagcccggtgagcttcgcgacatcgacatacccttccggcccggcttccacttcaatcacccgtaaattgaggttatgcagcatctgcagcagcacgaaatagcagggtgattccacggcgaccacatcgcccggctgggtcgtggcgcgcagcgacagcgagatcgcctcaatgcagccgttggtgatcagaatatcgtcagcgctgatattgcagccgtaacccactgcccggcgggcaatctctgttttcagcggcgcatagccggtgcccttcaccgtattcccgagcagggccggtttgctgtagcccatctgacgcatcagcaggccgatgcgcttgaccggatagagcgcactgtcaccgttggccagatcgagacgcacccggcagtctgagccaagcatcgccagatggagttctgtctgctcatcaagcggcgcgatggcgcgcggctgttcactgacggcgggcaactgacgggaagagggccgctgcggagcaacaaaaaagcccgatttggggcgggcaacggcgtagtgctcatcttccagcgtgcgcagtgtcttcagggcggtggtgaggctgacattgtactgcgtcgccagcgtgcgcaccgacggcagacggctgtcaggtgccagcgaaaccggcatgaatggcctgcttgatctgttctgcgatctggcggtaacgactgctctgactctccttttccccgataatatcggccatctgttccaccccatatcgcgctgatctgtgcatattcaacagagtacattcaaagtactttaggctgcatctcttaattattcataacgctaaacggcccggcgaccccgtcagccccgggcttcagaccataaagtgattctgttcacctgaggaaaacgtgagaaatgaataatctgcccgccatgatgaaggagatggaagcgtatctgtcacccgccatcattgagtctgctcagcgctgctctcttcgcctgctggcagcgttgccggatcagcagcagctggagaataaccgtgtgctgctcgcctatggcgggggaaaagacagcagctacatggtggcttacgtgcgttacattcagggactgatctggcagcagcagggcagcacctttcatctgcggatcagcaccaatcgccatgcggcgatgaatcagagcgtaatggagaatatccaccgcatttatcagtcgctggcgatgcatgatgatgaacgggtggagtgcctggtggtggatggcctgcttatccggccgtttgaccgcgacctgccgatgccggagagcatgcggcagcagaaccgtaatgatgtgctgatgaatggccaccggtttcgcgccgacgcgcgctcaaccttctgcaacgcctgtaatctcagcatggtgaactcctttggcctggcggcagactacaacggtggcgtggatctgattatcaccggcgactcgccacaggagcaggccgcctatgtcgcctgggcgcggcacctctcacggctgtttgatgcgccagtggcggacaaaacccggggcttcagcgggtttctgcagacgctggatggcgtggcagagcgctacttcagcgatgtttatggcgccgatcagctgacgcctgcgcaccgcatcacccaccagctggcgcgcaatccactgttcttcaacatctatcaggacaccgcctatgaagcgggcgcgcactgggcactgctcagcgaatttatgcgcttccgttttgatgcgctgatgttcagtttttccgaatccgactgcggtaatccgacgctgatggcgcacctgcgcggattgcgggcagaaacgctgctgcagcgccactatgccgaagggatccgcgaatatgtgcgctttgcgctgggactgatggtgaagaaagattttccgcccgcgctaatcgatgagatggcggcgcgctatcaggatgacgccgcgatccagcggcagcggcagcgcgcggcggacttcgccatacaggcgtttgacctcagcgaagatcagctgatctgcatgatctactccccgttcctggcgcagggagagcagctcggacactggctgatgcagcagcagattacgctggatgaggcggccatccgcgacctgcttgagcaacgcagtgaagatcgcgcgctggcacagcagttaacccggctctccggcatgacgctgacgcagatgcggcactgttggcagagcaagccggtcagttcgctgctggagggcaaaagcgccgatccgctgtcgcgcgtgctgcgttttgatccccacaaagcggtgattcaggtcaataacggtgtgctcaatgacatcgtgacagaaatcatttccgggcgataacccggtaaggcgaggcgatgaaaaagatttttctgcaaattggcgccacccgcgacgggcaaaatccttactgcgcggtggcgaagcgcgacggctattttaccgtgctggctgaaatgggtgatttcgtcgattaccagtcgttaagcctggctctgccgtttgatctgatcattcgcctcgatcgccctgagaatccctgggaggtgatgcaggcctatctgcacgccggtttactggcgcatccgctggtggtgctggcgggctttgaagcctacaacgccagcgccggacgactgcgcgagatgctggccgggccggatgcgcccgccgcctttattccgctggataaatatgcgcagcgcatggcgctgaaaaaagcgtggccgcgcttcccgcagccggagttccgctttttcgcctcgccgctcagcattctggatgccggacaggcgctgatctatccctgcgtcgtgaagccggtggatggcggcggcggcctgggtatctggctgattgagcatgccgatcagctgcatagcgtagtgaaacagctggtgcagaccatgaactacggcggacgcggcttcagcggctttattgtggaaagcgcgctgatcggcgatgagttttcattacagggcgtggtgcatcagggacatccccaggcgctgacctgctgccagaaggtgattgagcagcaccgggatgctgagggctgcgtcagcttttatgagtcggggcatgtggcgatggcggcagcggccctgccggtctcgttcagcagcctgatgaccttctgttgcgaaacctttggctaccgtcagggtgcatttcatatcgattttattgtggtcaacggcgtgccacatttcctggagatggggttccggctctccggcatgggcgtggcgacgctggtgcaggaggcgaccggcatcaactgggcggaagtcaccttccggctggaggcgggtggcgcattgcccgcgtttgccttcaccacacccggtgcggtcggccagctgcggttgcggcaaccggcgcagctgcaggctgccgaacgctggatcgatcagcatcagcagggcgcgctgttaccgccactcagattgcctgcgttacaggtttcgtcacgctcatcgctctatgccgacctgacgcgtcacgcgggcattctggccactttcagcctgacggccacagcgcgtgagccgattatgaccacttttcagcaggtgattgccgcgcagccggtggcggccaggagagataaagtatgtgcaggatgattctggcgcatggtcggttcgacagcgcagaaattctggaggcggcgcgcgccatgagctgcggtgaaagcgccgaacacgatggcccgattaaagaacaccccaacggctggggctgtctgtggctcgaagagggtgagattcgtaccctgcacggcaccggcgcgttcgcagaagcgctgcccggtatcgatgtggatcggctgcgcagccggtttctggcggtgcatgtgcggcacgccacgctgagtaaaaatcagggactggcgttttctcatccgctgtggcgcaacagcgccggacatcagtggtacatgatgcataacggctttctgccgacgatttaccgtcagctcggtctggccgaatcgcgcttcgattcagaagagtatctgcgttatctggtagatcagaccacgcctgccgatttcacccgcgactatctgcgcgcaaagatggcgcaggtagagccgggcggcagcgcagggaatgccattttcgtcacccgtgacaaagcctgggcgtggcagtggtatccgcacgacacgccctggcccgactattttacgatgcattttcagcaacaggatggttgcacgctgatcgcctctgaacccgtggcaataccaggcagcgctggcaactggcggcgaatgaacaatcatgaactctatgaaataccgtttagggagtgataaacatggcaattttcaatcagttccgcgtgattaatcccaacatgtttgtggaatcgacctggctggatgacatcgtcaccgcacgggtgccgctgctggtgctgcgtaatttcctgacgccagaggtgcgggaagcggtggtgactgacctgcagagctgccgggaaaagatccgtgtctcccactatcccaatggcgcgctgaccacgctcggcccctatctggcgcgtcatactgcggctcccgataactactttactgagctgcgcgatatccagccggcgttgccgccctcactgaatacgctgcgcgaacagatttaccgctgggttcagcatgcgctgcggctggaaagtttacgcatcgcccacgaaccgggttgtggagactacgccggttctatcgtgcgctttcatgccaatggcgtcgcgaacccgctgcataacgacaatatcgtgcgcgacgccgcagagacttcgctggtggtgacgcaaatcctgcatcagctcagctgcgtggtctgcctgcaggagtgcaacgcgggcggagcactgcgtatctacaacaaaaagtggtcgccagaggatgagcagttcaaaaccgccggggagctgggttatcgcagtggggtgattgaaaacagcgagatctgcgaattttcaccacgcagtggcgatatctatctgtttaatcctgcgttttatcatgagatcgatcgggtcgaaggcgatacccgtatcaccatgggtttctttttcgggctgaccgataaaaaaatgaagcacgctatcgcctggagctaagccgggtcgtgccagaaacaggagaagggaatgacgacgtttgaaaaaatcactgcgctgctggatcagcagcaggccagctaccgtgtggtggaacatgaggcgatagggcagaccgaacagatcagccagatacgcggtaacctgctgggtcaggcggccaaagcgatggtgctggaggtcagcatgccggacggtgcgccatcgcgtcagctgctggcgatagtgccgggcgactgccggatcaatttcaaaagtgcggcgcgcgccatcggcggcaaaaaatcctctttcgccgctccggagctggcgcaggcgttgacgggctgtgtgatgggcgcggtaccgccgtttagttttgatgaccggctggcgctgcgggtggatacccggctgcaacaggtcggaacgttatggtttaacgcgggcgagctggataagtcgatcgcgctggctgtagatgattattttcgcatcgtgggtgaaggctgctgtgccgatatcgcgaccccgattgcggtcaccgcctgacggcaggacaaggagtttctgatgtcggtaaaagatatgctgttagcgctgtgcgtggtggtggcgtggggcgtcaattttgtggtgatcaagctggggctgcagggtatgccgccttttttgctcgccgggctgcgttttaccctggtcgcctttcccgccattttctttgtgcgtcgcccgccgattccgctgcgctggctggtggtttatggcatgaccatcagttttggtcagttcgcctttctgttcctggcgatcaagctcggcatgcctgccggtctggcctcgctggtgctgcaggcgcaggcattctttaccctgttgctgggcgcgctgttgctggcggagaagctgcgctggaatcatatcctcgggattatcatcgctacgctggggatgtttttgctggcgacggctggcatggaagggcagaccagcgccggtattacgctgaccaccatgatgctgacgctgtcggcggcgctctcatggggactgggtaatatcaccaataagattattatgcggaaccgcagcgtgccgatcatgtcactggtggtctggagtgcgctggtgccgatcgttcctttctttgcctgttcgctgctgtttgatggtcaggccgccatcgtttacagcctgctgcatatcggcctgcagaccgtgctggcgctgttctatctggcgtttgtcgccaccattgtgggttacgctatctgggggaatctgctgagtcgctacgaaacctggcgcgtcgcgccgctgtcgctgctggtgccagtggtggggattattaccgccgcgctggtgctggatgagcatctctccgggcagcagatgctgggtgcggtggtgattatactgggactgctggtcaatgtgtttggtggcgtgctgggtcagcgcttagcgatgcgaacgcagtcgtaaggacaagtccgccttcagatataagggcaaaaaaaacgccgctaacgcggcgtttgtcatggttacttcagaatctcaatacggcgtggtttcgcctcttccggcaccagacgttcaagatcgatgctcagcagaccattctcgagacgggcatcgcgcaccacaatgtggtcggcgagctggaatttacgctcgaagttacgctcggcgataccctgatacaggtatttacgctcggtctgctcttcaggatgggcaccccgcacgatcagcacgttatcgtgcgccgtgatatccagttcgctctgagcaaaaccggccaccgcaatagtaatgcgatagtgattttcatcgaccagttcaacgttatagggaggatagccgccattgctctgattctgattagattcgagcaggttaaacaggcgatcaaaaccgatagcagagcgataaagtggggtgagatcaaaattacgcatattaagactcctgaatttcagcaagttttggcaaccttccactactggacaggctggatacggcaccccactgtcccttgcggcaacggtgagtgcgtccgtaaactaaaaatgggtgccacaagaccattttcaagagggcgaagtgcaatttttttcgccaatttgaggaaatgacatacactcaggactacttttgccagacccagacggacttcgccccagagtgttgacgttgtctggcaagcaaactcagccaggcttatgccatgactgaagggatgatgatgatgaaattgatgaagaccttacctctggctggagtggtgtgctgcgcaatggcaacaaccggctgttccagcgtgatgtctcacacaggtgcgagtcagggctactatccaggcacccgtgccagtgctgatatgctgtccgatggtgataccagctgggcgctgaagccgctggcgttaatcgatcttcctttctctgctgtgctggatacgctgctgctgccgtgggactactaccgcagcgacaaagataaatctctcgactctccacgtgaacgcatcctgcagagcgaaaggctggcgcatacgcaggaaagcctggcgcaggcgcagcctatgcctcctatgcggtcactgccgcaaccgtaaagagttgccgccagccattcacctcacgcatataagcaatctgtgtaccatcaggtgaccagaccaccgcgtcacctgatggcgcctcttctgttctgcgggtcagacgctgacacgcgccgctctcaacgtcacatcgcatcacgctgttatcgcagacaaaagcgatcgcctggccgtcaggatgccagctaaaggcggactgaatgctgtggctgagtcgggtgatctgacgcggttcgccgccgttgggggagaccgtccagagctggatcacctctgcggcatccgccatcagaaatgctatctggctgccatccggtgcggtgcgcagccagtggcgaggttgcagagccacaccacggctgtgcgtcaggcgacgctgctgcacgccagccggtggcgcaggtagctgctggctgctgccctccagcggcatctctccggcgcgggcgtaatcctccagcgcatcaggcagatcaacaataaaaacttcaggccgtttttcaccctgcgccgtcagcgtgtcgccaataaaggcgatcgcccagcgctgccagctgccgtccggcttctggtagccacgctcaccgacccagcactcctcacaggcacgattaatctggtcactgcctggcagcggttccgcatgcgtctggctcaccagcaggcaaaaaaaggtgccgtcatattcgcgcggatgctgcttttcaggcgttacagcgcaaaggggcaccgcgatgccgacgttgcgcagatcgagccggctatccagttcgtgcatcacgtggtcattgtaggtaaagctcaggcgagaaccgtcgggactgaagacatgtacatgcgagccgccacgcagcgcgccaggggtaaacggtggcgtgatatcgcaggcatccagattcaccgccgcaccgttctgaacgattaccccgcgccggtggtggaagtcatactgccagctggcatcgggatgttccgggccatgaatgcagacgtagcgcggtggcagatcgggactgaccgtgacgacgccaacatgggcaccatgccgggcctgatagagcacctccacctcaccggtcatcacattgacccgctcaatggtctgactggtaaacgatgcgcccgatggacgaacgtcaaatgccagccactggctgtcggcagtccagacattaatattggtgagctgatgctgacgggcagcaaaggtgatctgtttttctgacatgatgaaacccgcggagaaagagttgcccgacaaattacgcgattctgttttgcggtgcagcatttttgccgggttaggggatccgggccgaagcggcccggcagagaacaggccgttacagcactaactcttcgatggcatgcgcgacgccatcttccatattggttttggtgatgaactgagcaattttcttaacagagtcaatggcattccccattgcgacacccgttcctgcgtattcgatcatcgccaggtcattctcctgatcgccaatcgccatcacttcttcctgcttcaggccgagcttctcagccagcattttgacgccctggcctttattcacccgacgatcgaggatttccaggtaataaggcgcgctcttcaggatggtgtaagtctgctgagcatgcccgggcaggcgggcaatcgctgcgtcgagcagagcgggccggtcgatcatcatcagtttcgggaagcgcatggcacgatccatctcctccaccgcgcggtagcgcaccggaatgccggtcaggctcgcttcatggatggtgtattcgctgatgtctttgttaggggtatagagatgggttttgtcgaatgcctggaaatgtacgccaagctcacgcgccaggttctcgatgtagaggtagtcgtcaaaggtcagcgtcacttccgccacgcactcaccatcttcggcctgatgaaccagcgcaccgttgttgctgatcgcgtactggccgggcgtctgcatatccagttccatgagatagcgctggatacccacaaatggccggccggtggtcagaacaatcgacaccccttgctgacgggcgcgatccagggcggatttcaccgccggtgtgatctcatgttgcgggttgagcagggtgccatccatgtcgatagcgatcaatttaatagccatagagtcctcgtagcgtctgggttttgttcaatgctagcgcgattcagcgcacattgaccagtttcatggcaggcgagaacggccagctgatcgccaggttcaggcggtaaagagatcgcggtggattttaatcacggcttttcggattgttgcgggttcgccaggggcgcagcaggggcgatggatatcgtgcgggaaaaagagcgcgaacatgccgggcatcagcgtaatcacagactcattcaatatcttttgataaaaaacgacgtctcgctgctgggcaaaatcttcggtgatgtgctggtcgggatgggcacgggccacgccaatattttcggtgcctgccagcagatactgaatatcgatgtagttgaagtgggactccgctttgcgtgcgctggccggttcggtcatcatctcctgcaccagacagaacattttgttgtcgggcaggatctcatatttgccggtttccagctggctgaaatctgtgctggcaatccagcttatcgcctgatcgactaccggatgaaaggcgtgacgttctctgtcccagtcgtgacgatcgcaaacaatcatggtgtaactccctgtgtggaatagtgcgcggtaaatgcgcaaagaggggcaagagtaagggagctgaccgggttaaaacgtgatcgggatcgcatcatgcgggcaggaaggcacctccttgcgggttttccgcccggacggcacaaaaaaaaggccatcacctgggtgatggcctttcatctctgatgccggttaaatatcgatattggcggctttcagcgcattttcttcgatgaaggcgcggcgcggtttcgaccgcatcgcccatcagggtagtgaacagctgatcagcgccaatcgcatctttaatggtgacgcgcagcatacgacggctgtctggatccatggtggtttcccacagctgctccgggttcatctcgcccagacctttgtagcgctggaccgagaggccgcgacgtgactctttaatcagccactcaatcgcctgttcgaagcttgccactggctgacgacgctcgccacgctcgatgtaagcatcctcttccagcagaccacgcagtttgctgcccagggcgcagattttgcgatactcaggaccctgaatgaaatcagcatccagcggatagtcagtatctacaccgtgggtacggacgcgcagtaccggctcgaacaggtttgattcgcggttttcacgcacctgtgccagataggtgctgccatgcgcttcgcgttcagtcagatagctcaccagaccattcagccaggttgtaacctctgcttcgctggtcaggtcgctcagcgtgtcgtgataaatcatcgcacgcagcatggccatcggataacggcgctccatacgcttgatcatcttctgggtgctgttgaagtcagtgaccagcgtctccagcggctcaccgcccagcgccggcgcgctggcattggtgtgcagcgtcgcgccatcaagcgcgatagcgatctggtattgatccatcgcttcatcatctttgatgtactgctcctgcttgcctttcttcactttgtagagtggcggctgggcgatataaacgtggccgcgctcaatgatttcaggcatctgacgatagaagaaggtcagcagcagggtacggatgtgcgaaccatcgacgtcggcatcggtcatgatgatgatgctgtgatagcgcagcttgtccgggttgtactcgtcgcgaccaataccgcagcccagcgcggtgatcagcgtggccacttcctgggaggcgagcatcttgtcgaaacgcgctttctcaacgttaagaatcttacctttcagcggcagaatcgcctggtttttacggttacggccctgtttggccgagccgcctgcggagtcaccctccaccaggtagatttcagacagcgccgggtcgcgctcctggcaatccgccagtttgcctggcagacccgccaggtccagcgcgcctttacggcgggtcatttcacgggcgcggcgtgccgcttcacgggcacgggcagcgtcgatgattttgccgactacaattttggcgtctgaaggattttccagcaggtattcagccagcagttcattcatctgctgctcaaccgctgttttcacctcggaggagaccagtttatctttggtctgcgaggagaatttaggatccggcactttcaccgaaaccacagcgatcagaccttcacgggcatcatcaccggtggcgctgactttggccttcttgctgtaaccctctttttccatgtaggcattcagggtacgggtcatcgctgaacggaaaccggcgaggtgtgtaccgccgtcgcgctgtgggatgttgttggtaaagcagtagatattttcctggaagccgtcgttccactgcagcgccacttccacaccaatgccatctttctcggtagagaaatagaacacggtagggtgaatcggggttttgtttttgttgaggtactcaacaaacgcccggatgccgccttcatagtggaagtgatcgcttttgccatcacgcttatcatccagacgaatcgacacgccggagttcaggaatgagagttcacgcaggcgtttcgccaggatgtcatactcaaaatcgcgcacgttggtaaaggtttcgtggctcggccagaaacgcacacgggtcccggtaatgtcggtctcacccgtcaccgccagcggtgcctgcggtacgccatggacgtaaatctgctgatgcactttgccttcgcgacgaatggtcagctccagcttctgcgacagggcgttaaccacggagacgcccacgccgtgcaggccgccggagactttataggagttatcatcgaacttaccgccagcatgcagcacggtcatgatcacttcagcggcagagatgccctcttcttcgtgaataccggtaggaatgccgcgtccatcatcctgcaccgatacggagttatcggcatggatggtgaccacaatgtcactacagtgaccagcgagcgcttcgtcgattgcgttatccacgacctcgaataccatgtgatgcagaccggtaccgtcatcggtatcgccgatatacatgcccgggcgtttgcgtaccgcatcaagtcctttcaggactttaatacttgaggagtcataagaattcgacatcaacgtttctcgctcattttaatcttcaggttgaaccgctattttaccctgttccacgcggaacatcttgcccttttcgtcggtcatgtcgattacatgtccggcagaaattgcgctgacaaacacctgagcctgagtggcttttaaccgttccgccaacaggcgtcggcggctctcatccagctcagaagcaaagtcatcaatgaggtaaatacagcggcgtccgctctggcttgtcaggaactcgccctgtgccagacgcaatgcacacatcagcagttttaactgcccgcgtgagagtaaatcttctaccggcgtcccttcagcccgaatacgaaaatccgctttatgggggccgctggcggtataggtcagtgcgcgatcgcgctcgaagttacgttccagcagttcggcgtagtcgctctctttgtcccagccacgctggaatgagaagcgcagctcaaattccggcagaaactggccacaggtggcggtgatctccgctgaaatcgccgcactgtattccgcccgccactggctgatctgttcagccagcggaaccagctcctgatcccagggacgaatctggctgtaacgtgagacctggcgcagcgccgcgtttccgctgtttaagcaggcggcgcatgttgttccaggcgttaaaaaagccgggggtattatggaagcagccccagtcgacataggctctgcgatatttggggccgccattcagcaaactaaagccttcaggggtgattaactgcatcggcaacagctgcgccagctccgcgaccttgtgaccatcgctgccatcaatgcgcactttgctgtcaccggcacggtttttggtcagcccgactgaaatttcccgctctttgttttccagacgcccatgcagcacaaacgccgcctcgtcgtgacgaatcacgcgtcccgcctgcaggctgcgaaacgaacggccatgccccagggtatgaatcgcctctaaaacgctggttttaccactgccgttggcgccgaccaggaaattaaagccgggtgccagctgcagatcagcctgctcaatattacgaaaatctttgataagaaggcgggttaaagccatgaatcagtccagcgtgaagggcaataaagttttgggcctggcgatccagggcgtcaacggcaaagcaggtttgcccgatacctcagtcaccaggccgtcggcgtcgcagctacgttgcgccccgccagcgcacagccaccggagcgtactgaagtacgtgaggatggcgagcactgccggggcacaacgtagcaagtaagccaggccgatatcttctacaagcgcatgggcatgacgacataggccgctgccggactcgccacatcctcaatctgcacgctcgacaccgaatcggtcagcagcagacggacgttttcgcacttcagcgcgttcagcacatccagcacgtaactgacgttgaagccaatctccagttcagtaccgttgtagctgacatccagcatctcttccgcttcttcctgttcagggttattggcggtgatcttcaactgattttcggtgatatagaggcgaacaccgcggaacttctcgttagagaggatagcggcgcgggcaaaggcctgtttgagcagatcgcagcccgcttccagcgctttgtccggattcttcggcaatacgcgacgataatcggggaaacggccatcaaccagcttagaggtaaagatatagtcgccgacatgcgcacggatattgctgccgccaatctgaacctgcagcggggtatcgccgccatccagcagacgcagcaattcaatcacgcctttacgcggcacaatcaccgaatgactcggcagcgcctgaccaatcggcatggagcagacagccagacggtgaccgtcagtggccacggtgcgcagctcttccccttcggtttcgaacatcataccgttgaggtagtaacgcacatcctgatgcgccatcgaaaactgagtcgcttcaatcagccgtttcagcgttgcctgcggcagggtaaattcaacttcactctgccagtcgtcaagattcgggaagtcactggcgggcagggtcgacagcgaaaaacggctgcggccagagcgcaccagcatgcgatcgccttccagtgccagagtaatttctgcgccatccggcaatccgcgacagatatcgaggaatttacgcgccggaacggtggtggatccaggctcatgtgcctgagtcagcgccacgcgtgcgaccatctccatttccagatcggtaccggtcagcaacagcgaaccttcagttacctgcagcagcaggtttccgaggatcggcagcgtcggacgaccacccagggggccacttacttgttgcagcggcttcagcagctgctcacgttcaacaataaatttcatagcgtcaggaagataatgttctgatgagattagagaaatcttctttgatatcgtggctctcttcacgcagctgctcaatcttgcggcaggcatgaagcaccgtcgtatggtcgcgccccccaaaagcatcgccaatttctggcaagctatggttggttaactctttcgccatcgccatcgccatctggcgcggacgtgccaccgagcgcgaacggcgcttggaaagcagatccgccaccttaattttgtagtactcagccacggtcttctgaatattatcgatggtgaccagcttttcctgcagcgccagcagatcgcgcagcgcttcgcgcacgaagtcgatggtaatcgcccggccagtaaagttggcattggcgatcacgcgattcagcgcgccttccagctcacgtacgttagagcgtaaccgcttggcaataaagaaggcgacttcacccggcagacggatgtcgttctcatccgcttttttcatcaggatcgccacacgcgtttccagctcaggcggctcgatcgccaccgttaaaccccagccgaaacgtgatttaagacgatcttccaccccgttgatctcttttggatagcgatccgaggtgaggatgatctgctggttgccctctaataaggcattaaaggtgtggaagaactcttcctgcgatcgctctttattagcaaagaactgaatgtcatcgatcagcagcgcatctaccgaacggtagtagcgtttgaactcttcaatcgcattgttctgcagtgctttaaccatgtcctgcacgaagcgctcggagtgcatataaaccacttttgcattgggttttcgggcaatgatgccgttgcccaccgcatgcaacaggtgcgttttaccgagaccggtgccgccatacagaaacagcgggttataagcgccgcctggattatccgccacctgacgtgccgccgcgcgcgccagctggttagatttaccctcgacgaagttatcgaagttatgacggttgttcacatttgagcgataggtcacatcggccggtgccgggacattatcccaactgggacgcataatctgcgtcggggccggacgaatatggctctgtacgggcatcacgggcgcgctgacgctggccattacaggctggctgaccgctgccgcctgctgctgaaccgggcgcgttcccacttcaaaacgcagtgcgggcacgtttggaccgcagaattcattcagcagtgcattgatactattaaggtatttgtcccgaacccagtcgagtacgaagcgatttggagcatacaaggcaagcgtattgtcgtttaactcagcctgcagtggacggatccacatgctgaattcggtggcaggaagctcatcctgcaaacgggcaagacactgttgccaaagcgtaagtgacacggcggactccactcgtacaaattcgaaaagaatagtaggcgttactctaagaaacgttcatttttgacacagacgctaagaaagcgcctgcgaccgctatcagcggttttccgtcctgcaatcaccggaggatcgtcagcggaagggcggatcatagcgcaaagcgaggcagagatcttccctttctacacagttttgatcctttttatccacaggccagaggcgcgcaaagaagtttacgccagttgcgggaaaaaccagcagggatctggcgcaatccattaaaatttcgggcgacatctcattttatccccaggatccggcaagccgatcgcaataagatcccgtgcgatccttgcgctttagtgcggagcccgtataattctccacccgacattgagccatcaggcgcaaagtcgggactctgcgggctgtatgcgggttttcaggcactatgacacgcgaagtaaattgactcgggactgtacaattattacaatcccgcctctttattaaagacacattgaggcgtaggtcgattttctggcccgaaacgcgtcacccagtgaaaattttcaagtttaggtagaaaccgccatgaaacgcacttttcaaccgtccgtactgaagcgcaaccgttcacacggtttccgtgctcgtatggcaacaaaaaatggtcgtcaggtttctggcacgtcgtcgtgctaaaggccgttctcgtctgaccgtttctaagtaataaagcaagccctgatgggtaagctcgcatttcccagggagttacgtttgttaactcccactcatttcactttcgtcttccagcagccacaacgggctggcacgccgcaaattactattctcggccgccttaacgcgctggggcatccccgcatcggtctcaccgtcgctaaaaaacatgtgaaacgcgctcatgaacgcaaccggatcaagcgattgacccgcgaaagctttcgtctgcgtcaacatgaactgccgtcgatggacttcgtggtggtcgcgaagaagggggttgccgatctggataaccgtatgctggcggaagcgttggagaaattatggcgtcgtcactgtcgcctggcgcgcggctcctgatcgtcctgatacgcgtctatcaacgcggcatcagtccattactgggaccacactgtcggtttcacccgacctgctctcattacggaattgaggcattacgcaggttcggcctgataaaaggcagttggttgacattaaaacgcgtattaaaatgccaccccttgaacccgggtggtgacgatcctgtgccgccaaaaacctttgataccagagaacattaacgatggattcgcaacgcaatctctttctcatcgcttttctgttcgtgacctttatgatctggcaagcctggcagacggaccacgctccgcagccacagcagacgcagaccacacaaggcacaaacagcgtagcgggtgataccgccagtcagggtgtaccggccagcggtcagggccagacgatcaccgttaagactgatgtcctgtcattgaatatcaacacccgaggcggtgatgttgaacaagcacagctgctgactttcccggacaaactgggttctaaccagccgttccagctgcttgaaacaacgccagcgttcctttatcaggcacagagtggtttgaccggtcgtaatggcccggataacccgaacaacggcgcgcgtccgctgttcaacgctgcgcaggatcacttcgagatggctgatggccagtccgaaactgcgtgtgccgatgacctacaccgctgaaaatggcgtggtttacaccaaaaccttcatcttcaagcgtggcgaatatgccgttaatgtcgattatcatgtcaacaacaccacccagcagccgctggaagtgtcgctgtttggccagctgaagcagaccatcgatctgcctaagcatcgtgataccggcagcaacaactttgctctgcacaccttccgtggcgcggcctactccaccagcgagtcgaaatatgagaagtataaattcgacaccatcgcggataacgagaacctgaacgccaccaccagcaatggctgggttgcgatgctgcagcagtactttgcaacggcatgggttccgcgtaccgaaggcaccaacaccctttacaccagcaacctgggtaatggcgtggcggcgattggctataaatctgcaccggtcaccattgccgcgggcgcacagcagaatctgggtgcaacgctgtgggtcggcccggaaattcaggacaagatggcagcgattgcgccgcaccttgatctgaccgtagattacggctggttgtggtttatctctcagccgctgttcaaactgctgaaatttattcacagcttcatcggtaactggggcttctccattatcgtgatcaccttcatcgtgcgcggcatcatgtacccgctgaccaaagcgcagtacacctcgatggcgaagatgcgcatgctgcagccgaaaattcaggcgatgcgtgagcgtctgggggatgacaagcagaagcagagccaggaaatgatggcgctgtataaagcagagaaagtgaatccgctgggtggctgtctgccgctggtgattcagatgccaatcttcctggcgctttactacatgctgtcaggctcggttgaactgcgtcatgcgccatttattctgtggatccatgacctgtcagcgcaggacccgtactacatcctgccgattctgatgggcatcaccatgttcttcattcagaagatgtcaccgaccaccgtgaccgatccgatgcaacagaagatcatgacgtatatgccggtgattttcaccgtgttcttcctgtggttcccatcaggtctggtgctgtactacatcgtcagcaacctggtcaccattctccagcagcagctgatttatcgcggcctggaaaaacgtggtctgcatagccgcgacaagaagaaagcgtaagcgatccagagcgggagcaatcccgccctaaaatagtctattctcaggcggtcaaagcgaccgcctgtgttttttgtagcgagagaaaatttatgagccacagcgataccattgttgcccaggcgacgccgcccggacgcggcggcgtaggcattctgcgcgtctctggcgcccaggcggcagaggtcgcccgccagctgctgggcaaactgcctaagccgcgttacgccgattatctgccgttcaccgatagcgatggccgcgtgctggatcagggcattgcgctgtggtttcctggtcctaactcctttactggtgaagatgtgctggagctgcagggccacggcggcccggtgatcctggacctgctgctgaagcgcatcgtggcgctgcctggcgtgcgtatcgctcagccgggtgagttttcagagcgtgcgtttctgaatgacaagctcgatctggcgcaggccgaagcgattgctgacctgattgatgccagctctgagcaggcggcgcgttcggcagtgaactccctgcagggcgtcttctccacccgtatcaatcatcttgtggaagcactcactcacctgcggatctatgtcgaagccgctatcgacttcccggatgaggagatcgatttcctctctgacggcagaatcgaagcgcagctgaatacggtgatcggcgatctggatgccgtccgtgccgaagcgcgtcagggcagcctgctgcgtgaagggatgaaagtggtgattgcgggccggcctaatgcgggcaaatcgagcctgctgaatgcgctggcgggccgtgacgccgccatcgtcacggatattgcaggcaccacccgtgacgtactgcgtgagcatattcatattgatggcatgccgctgcatatcatcgacaccgctggtctgcgtgaagccagcgacgaagtggagcgcatcgggattgagcgcgcctggcaggagatcgaacaggctgaccgcgtgctgtttatggtggacggcacgacgaccgatgccaccgaagcggcggcgatctggcccgatttcgtctcccgtctgccgcccgaactgccgattaccgtggtccgcaacaaggcggatgtcaccggggagtctctcggtctgacagaagtaaatggtcactcactgattcgcctgtcggcacgcaccagcgcgggcgtggacgagctgcgcgatcacctgaagcagagcatgggcttcgccggcaatatggaaggcggcttcctggcgcgtcgccgtcatctgcaggcgctggagctggcggcaacgcacttacagcagggtaaagcgcagctgctcggtgcctgggccggtgagctactggcggaagagttacgtcttgcccagcaggcgttaagcgagatcaccggcgagttcacttctgacgatttgctgggtcgcatcttctccagcttctgtatcggtaaataaccgtgctggcctgatagcgtcctgctgtcaggccagatttcctgccacgctgctcccctgttattcccgcctctgcgttgattcttgctgatatgttattttgcggcggaacggcattgccgtataacggttgaagcgccgatctgacgtgcggcgacggattgcggtgagtgatccccgcctcatcccgccgtgccggaccggacgcaaacccactacgtgaacaccgttgggcgaactttttcgcctgaaacaggagagttgcatgagtacaccgctcgacactgccgcactggacacgctgtttaatgacgcccgcacccacagttactggcaggctaagcccgtcgataacgccctgctggagcagctctatgctttaacggcactgggcccgacctcggcgaactgctcgcctgcgcgatttgttttcgtgacctcggcggaaggcaaagagaagctgaaaccggcactctcttccggcaatctggaaaaaaccatgagcgcgccggtcacggtgattgtggcctgggaccgcgagttctatgagcagctgcccgccctgttcccgcatgctgatgcgcgcagctggtttaccggcagcccggaagcggcaaaagagaccgctttccgtaacagcagcctgcaggcgggctacctgattctggcggcgcgtttcgctgggtctggatgccggtccgatgtccgggtttgatccggccaaagtcaatgacgcctttttccccgacggtcagtatcaggttaacctgctgattaacctcggctatggtgacgcgtcaaaactgcatccgcgcctgccgcgactgaactttgagcaggcgagccgtttcgcctgatgctgcccgcgtcgcgattcgaatcgcgacgcggatgaccttataaacagcgtgtcacagcggcgcagcattttctgcaggcgtcccctgatgaaacaccattcgccagttctgaccctcgcacagccagtgtgaggcgcgcagtgcggcccgactgccatcggcatcacagctctggtagtgcagtatcagactcctctcgcccgtgctcaccagctgaaagttactactaagcatatcgggcatcgcatcttcttttatcagcgccgcgatggtctgcgcgcgagtcacaaagcgtcctgaacgggttatctcacaaaagtcaggatggagtatctgctccagccacgccagttcccgtcgcctggcactgtgcaggctgcgctctcgtttcaccatttcgtccagcaacatggctgaccctcctgttattctgtgctgacaggcagcggcaataattcctttaagctgttgaagatgggcatcgtgacgcttttgtccggttagctctcccacgcgactctgcacatcctaatccgaatttaccccaatctgtgcgttgccaggtgcattaaggtaagaaaattcctacaatgcttctgatgattatctgaccattttcacggagcgacagatggctggtcattttgtacgctggacgggcgatcccggcttcccggctaatgatttacgcattccccaggctatcaccgacacggcacagcagtttgctgacaaacgccgtgggcgatttcttgccgcccgtaccctgctggcacaactgatgctacgagtttatggcattggtgagctgccgcgcctgcttatccagagcaacggacgccccgtttttgctgacagcgatctgcccgatttcagcatcgcctatgcgggcaatacggtgggtgtgctgctggccgaagagggtggacgtgccggtctggatatggagattgtgcatgccagaagccgtcagactcaggagcagctgattcagggattaacctcgggcgagatcgcctggatcaatgcccagcaggatgccatggaggcggtgacgcagatctggacattacgccagagcattctcaagctgacgggagagggcgatcggggactggattcgctgcgcctgttgcccggtgcgggtcggctgcgatcttcactctatcccgatattcaggtggtgtgtgatgcggagcccatgctggtctggtcgtgtgcgctgtcgtctgcgactcagcgtctgcatctgtgggagatggataacgcctttcagtggcacgcattacgcgaaatagagatgggtaagcccaacatcgggcctcatgctctgcggctgaccagcctgcccagcgagcgcagcctgcatcctgaaatgtaaaaagccgcaacccggaggttgcggccctgaatgcgcttagtgcgcgtctacaaagacaatcttcagcacaaacagcagagcaacaatcactacgcaggggctgatttcacgccagcggccagtacccagcttcatgacgcagtaagcgatgaatcccagcgcaatgccttcggtgatggaaaagctgaagggcatcatggcggcggtcacaaacgccggaacggcttcggtcaaatcatcccagcgaacgcgcgacaggctggcggtcattaacaccccaacgtaaatcagcgcgcccgcagcggcgtaggacggcaccatcgcggccagcggtgacaggaaggtcaccagcaggaaacagcaggccggtgaccacggccatcaggccggtacggccaccaatcgccacgcccgaggtgctttcgatataggcggtcacggatgaagtgcccgccagcgcgccactcactgaactgatgctgtcgacatagagcgcctgctgcatccgcgggaaagtgccggtttcatcagtcagtcccgctttatcggtgacgccgatcagcgtgccggaggagtcgaacagattgaccagcataaaggagaagatcacgcccgccatgccgatgttgaacgcgcctttaatatccacctggccgaccacagaagtaatggaaggcggcgcagaaaacaggccgacaaacttcacgtcacccagcatccagccgatagcggtagtaaccaccatcgagatcagcactgccgcgtggatattgcgtgatgccagaatggcgatgataaagaagcccagcgcgcccagtagtacgctgtgcgaggtcaggttccccacggccaccagagtatcgggattcggcacgataatgccggcattcttcagccccatcatggcgataaacaggccgataccggcggtaatgccgacgcgcagactcagcgggatattggcaatcatccagtagcgaacccgcagcagcgtcaggatcagcaggccgaccgcaccccagaagatcgcgcccatacccacctgccacgaatagcccatcgcgccaaccaccacaaaggcgaaaaaggcgttcagccccattgcgggcgccagcgccaccggcagattggcaaacagtcccatcagaatgctgccgaaagcggcaatcagacaggtggtcacaaacaccgcctgggtatccatgccggcgacgccgaggatctgcggattgacgaagacgatgtagaccatcgtcagaaaggtggtgatacccgcgatcacttcggtgcgcaccgtggtgccatgttcctgcagcctgaagatgcgctgcaaaacgccttgcttgctcatgccatccatccagaagaaaaaatcatcggcgcgtatcctggcgattttaccggggcaatacaatgatttttcgcaaccgattgccagtctcgcaatctgcgctgagtgcggtagagtgtggagcacacccctgaatcgaaggatagagtctgatgtcagtagaatgcgtcttttttgattgtgatggcacgctggtggacagtgagttgctctgtacccaggcctacgtcaacacctttgcccgttacggcctggaactgtcgctgcagcagatgtttgaaaagtataagggcgtcaaactctacgacattattcgtgacgtcggcgacgcgcatcaggtgacgctaccgatggaagaggtggagaccgcctatcgcgcagaggtcgcgcggctgtttgatcagcaactgaagcccatcccgggcgcgaaagcgctggttgagcagatcaaggtaccgatgtgcgtggtttcaaacgggacggtaaaaaagatgcagcactcgctgggcttaaccggcatgctgccgctgtttgcggagcacctctacagtggctatgacattctgcactggaagcctgatccggaactgatgtaccacgcggcggaacagatgcaggtacctattgagcgctgcattctggtggatgactccgaagcgggcgcccgcgccggtatcgccgccggcattccggtctactactactgcgctgacccgcacaaccctgaactggatcatccgctggtgacgcgcttcgacgatatggcgcaactgcctgcgctgtggcgcgcccgtggctgggatctggtatagcccgggccagcatgacacacaccgtctggtttttaaccctgcccggcgtgatggcgctggatctcaccggcccggccgagacgctgaagctggcgggcgagcactttatgctgcgctacatcggcccgcagccggaggtggtctgctccaccggcatgaccattggcggcatcgaaccgttaccggaacagttgcccgccgggagtctgctggtggtgcctggcgtctatgactcgcaggtctgttacgccacgccgcaggccggagaggctcgcgactggctgatgcgccagcacggcgcgctgcgcgcgcagacctttatgctggtctgcgtctgctcgggtgcgctgctggcggcgcaggcaggcatgctggatgacgtgctctgcaccacccatcatgatgtgattgcccgcctgaaagccgcagccccgcgcgcacgggtgcgggagaaccgggtgtttgtcgggcatgagaatatctggaccagcgcaggcatcacggcgggaatcgatctggcgctgcatctgattaatcagctctgtgatacgcaaaccgcgctggcggtagcgcgggagatggtggtctggttccgccgtgccggtgacgatccgcaactttcgccgtggctgcgttaccgcaaccacatgcatccggccattcaccgggcgcaggatctgatgactgcccatccggagcacggctggaccctgaccgagctggccggacgcacgcatgtcagcagccgccatctggcgcggctgtttcgccagcatctggggattagcgtgcgtgaataccatgagcagctgcgggttggcgtggcacgccagcgtcagcagcagggtgaatctgccgaaaaagcggcgctggcggcggggttttcatcggcgcgccagctacggcgcgcccgccagcgtgaagccaatcagctgacaaagtgacgggtatcgacgcgtttcaatgccatacccagcagcaggctgccgcccagcgtcagcccgaatacccagggcaggtcgagccacggacgcgacatatcatcgtaatgatgcgttcgcaggtagtgaatgaacagcgcatgaaagccgtagatcggcagtgaatagcgcgcaatcaccgttaaaccgggcagggtgcgctggttcaggctgtttttaaacacgatcagcaggctgatcgcggcgataaacaccagcggtccgcagtagagataccaggtgtcattaaacgccccgttgacgatcagcgcctgtttcgtccctaacgtaatgccaatcacacaggtgataaacagcccggcagcgagcggcgtcaggccgcgccgggtcgtttccatcgtgccgatagcccgtcccagcagcgcatagagcaggtagtagatactgtcaccgctgacatagagattaaccggcagaaagtgaaatgaccccagcgactggctgaccgtattggggttggcgagcaccgccagcaccagcaccagcagcgccacgtagcgcgcctgcacggtttttacctggatcaggggcgacagcagatagatgccgatcagcgcaaagaagaaccacaggtgataaaacaccggcttctgcagcatcttcaggattgatcgcccttcgctgatgggggtcagccaggtgatataggccagcgataccgcgctgtagaacagcagacagagcaccagccggagcatatggcgcggctgggcgctgcgtttcgccgaaaaacagatagccggagatcataaagaacagcggaacacagacgcgtgatgctgagttcagcagattagccgcatcccaggtgatgccagtcaccgccatcggcccggtgatataccaggtggtggtgtgaatcacgatcaccatcaggcaggcaaccgcgcgtaaattatcgatccagtaaatcttatgcggcatggcatcctcttgcgcatcgcgtccgtgcgcaaaagggtagccaaatgcgaccagagcaacaactgctgccagcaggattcggagccatctgtatgccagcgccctgaatcaccgcgaaaacgcgccggtagcgccagggatttacggctgcacatcgcgcggtcaaagggtatactgtcggcctctttttttaatctaaccgaagcgcgtgcacactcaacatgcaaaagtttgataccaaaacctttcaggggctgatcctgaccttgcaggattactgggcgcgtcagggctgcaccattgtccaaccgctggacatggaagtgggcgctggcacttcacacccgatgacctgcctgcgcgcactcggcccggagccgatcgccgccgcttacgtgcagccatcacgccgtcctaccgatggccgctacggtgaaaacccgaaccgcctgcaacactactaccagttccaggtgatcatcaaaccctcaccggacaacattcaggagctctatcttggctcgctgaaagagctgggtatggacccgacggtgcatgacattcgcttcgtggaagataactgggaaaacccgacgctgggtgcctggggactcggctgggaagtgtggctcaacggcatggaagtgacgcagttcacctacttccagcaggtgggcggcatggagtgtaagccggtgaccggcgagatcacctacggtctggagcgtctggcgatgtacatccagggcgtcgacagcgtttacgatctggtgtggagcgacggtccgctgggcaaaaccacctacggcgacgtgttccatcagaacgaagtggagcaatccacctataacttcgaatacgccgacgttgatttcctctttacctgcttcgagcagtatgagaaagaggcgcagcatctgctggcgctggaaaaaccgctgccactgcccgcctacgaacgcattcttaaagcggcacacagcttcaacctgctggatgcccgcaaagcgatctcggtaacagagcgtcagcgctatattctgcgcattcgtaccctgaccaaagccgtggctgaagcttactacgcctctcgcgaggcaatgggcttcccgatgtgcaataacaaaaagtaagaggcagccatgactgaacaaaccttcctggtggagatcggcaccgaagagctgccaccaaaagccctgcgcagcctggcagaagcctttgccgcgcaggtcactgctgaactggatgccgctaacctgagccacggcgaggtcagctggtttgctgcgccgcgtcgtctggcgctgaaagtcgcaaacctgagcgcctcacaacccgatcgggaagtagagaagcgcggaccggcgatctctgctgcgtttgacgctgacggcaacgcgaccaaagccgctgaaggctgggcgcgtggcaacggcattaccgtcgatcaggctgaacgtctcgccaccgataaaggcgaatggctggtttatcgcgctcaggtcaaaggcgaagcggcccaggcgctgctgcccgcaatgatcgctaccgcgctcagcaagctgccggtgccaaaactgatgcgctggggcaacagcgatgtgcagttcgttcgtccggttcacaccgtgacgatgctgctgggcgatgagctgatcccaggcaccattctgggcattaagtcagatcgggttattcgtggtcaccgctttatgggtgaaagcgaaatcacgctcgacaacgccgatcagtaccctgatgtgctggaaaaacgcggccaggtcattgccgactatcaggtccgcaaagcgatgattaaagccgatgctgaagcagcagcacgccgtttaggcggcaacgctgatatcagcgacagcctgctggaagaggtaacatcgctggtggagtggccggtggtcctgaccgcgacctttgaagagaaattcctcaaggtgcctgcggaagcgctggtctacaccatgaaaggcgatcagaagtatttcccggtgtatgacaatgacggcaacctgatgccgaacttcattttcgtcaccaacatcgaatccagcgatccgcgccagattatctccggcaacgaaaaagtggtacgtccacgcctggccgatgcggagtttcttctttaataccgaccgcaaaaagcgtctggaagatcacctgccgcgtctggagacggtgctgttccagaaagagctgggcacgctgcgcgataaaaccgatcgcattcaggccctggcgggctggattgccggtgaaattggcgcagatgtgaatcacgccacccgcgcgggcctgctgtcgaagtgtgacctgatgaccaacatggtcttcgagttcaccgacacccagggcgtgatgggcatgcactacgcgcgtcacgacggcgaagccgaagatgtggcggtggcgctgaatgagcagtatcagccgcgctttgccggtgacgatctgccgtccagccctgtcgcctgtgcactggcgattgccgataaaatggatacgctggccggtattttcggcattggtcagcatccaaaaggcgacaaagacccgttcgcactgcgtcgtgcggcgctgggcgtgctgcgtatcatcgttgagaagaacctgccgctcgatctgcagactctgaccgaagaagcggtgcgcctgtatggcagcaagctgagcaacgcccgcgtggtggatgatgtgatcgactttatgctgggtcgcttccgcgcctggtatcaggaagagggtcacagcatcgacacgctgcaggcggttctggcgcgtcgtccgacccgtccggctgactttgatgcacgcatgaaagcggtgtcgcacttccgtacgctggaggccgccgcagcactggcggcggcgaacaagcgcgtctctaacattctggcaaaatcgactgaaacgctgaatgagagcgtgcaggcgtcgctgctgaaagagaacgaagagatccagctggcgacctttgtcactgcgctgagcagcaagctgcagccttacttcgctgaaggtcgttatcaggatgcgctggtcgaactggcacagctgcgtactgcggtagacaacttcttcgataaagtgatggttaacgccgacgatcaggcggtgcgggttaatcgcctgacgctgctgtcaaaactgcgtgagctgttcctgcaggtcgcggatatctcgctgctgcagtaatgctatttgttgtgcgaaaaagggacgagcaatcgtccctttttttatgggattttttggcctgatgtcttcgactcatacctgagtgtgaccgctatagcggccattttttagggtgcaaatgaatacgctaaaatgctcaaactgccattgccggtcatcaggaatcggctgtggtgatgcgccaggttataaatattatgcttatatatcaaaattttaccttttaatttttctccggtcatactctaaggtttttcatcaatccggtggttaagaaaccgccctaaaaatagccagccctcttgtttttcccctcacctgatggataattcgccagaatttacacccggttacatttagtgaaatggaattttcatgaaaaggatttgtttatcgctctggcatccgccagtgcgtctgctcaccatggtggcaggcgcgctgctctgctctgctttcccgctgatggcagccccaccagccgataatccccgcgaagaaggccaggcaattgatgcccgcgagcaactgcgtcagcagacgcgcgagcgcgtgctgcaacagcagaatgcgccgcaggcgaatgaacatcttccccgtcctgatagtcgtctgcccggttatcctgccagtgagcagccctgctttaccatcaatcagatcgccctgactggcgatgaagccagccgttttcagtgggcgctcgacgccgccgcggatgccaccggccgctgcctgggcggacagggcatcgtgctggtcattaacaaagtgcagaatgcaattctcgccaaaggctatgtcaccacccgcgtcatggcacaggagcaggatctgaccaaaggcgtgttaacgctgacgttacagccgggccgtatcagcaggatccgttttgatgaaccggtttcctggcgtggacggctgtggaatgcgattccggcgtcatcgggcgagatattaaatctgcgggatattgagcaggggctggaaaacttcaagcgggtgcccagtgccagtgccgacattaaaatcgtgccgggcgagcaggaagccaccagcgatctgcaggtcaactggcgcgaaggcagaccggtgcggctcagtctgggactggatgacagcggctccagaagtaccgggcgctatctcggttccgccaccctcgcagtggatgcgccctttgcgcagaacgatctgttttacgccaatattggcaaaaatctgtttgagcatgggccgttcggtaaccgctcgcacaccctgaattactttttcccgataggctactgggccgtttccgccaactacaacgactacacctatcaccagaacatccccaatgccaatgaggtgctgcgctacagcggcaagagcgataatttccagctcacggtctcccggttgctctaccgcgatcagtcgaacaaaaccacgcttaatctgcgtggctaccgcaaacactccaccaacgccgtcaacgatatcgacattgtgcagcaaaagcggcgcaccgcgggctgggaactgggcctgaatcagcatagctatctgggcagcagcacgctggacgccagtatcgcctggcggcgcggtactggtgcgtttaatgcgcttcctgcaccagaagagtcgcgtcatcagggcagcgcgcgtaccggcatattgctgggcgacctcggcatcaaccatcctttcgctgtgggcgagcagccctggcgggtctacagcagtgtgcggggccaatggagtccgaatgccctgacgccacaggagcgcatggcgattgccggccgttatacggtacgcggcttcgacggtgaacagatgttgtcgggggaaaaaggactgctatggcgtaatgaaatcggctggaatcttttctctcgcgggcatgagctctatctggctgccgattatggccgggtaagcgggcctgcgactcgcgatcttgtcgggcatcagctggcaggcagtgcaataggcgtacgcggcgcgctctgggggcgcttcagctacgacctgtttgcgggcattccgctctataaacctgcgggttttcatacctcaggcgcgacggcgggtttcagcgttaacctggaaatctgaccaccaaagcgggcgatcccgctatctgaacagagtgactttcacatggatgtgacccatgaataaacattgctatcgcattatcttcagccgcacccatggggaactccgggtggtgtcagaacttgcccgcagttgcagcacggaacccggccagagccgtggcaacggcgcgccgcgtctctgggtcactttacgccgcgcggcgtggctgctgggaatggccctgtttgccgggcctgcaatggcgaacggcattgtggcggatagcaatgctacaccaggacagcggccggacgtcatcgccacccagaacgggttaccacaggttaatatcaccgcccccaatcaggcgggtatctcgcataaccagtatcagcaattcgacgtcgcgcagaaacggcgccgtcctgaataactccgcagtgatgacctcaacacaactggccggaatgattcagggcaacccgaatctcaacccagacaccccagcggcgcgggtgatcatcaacgaagtaaacagcaataatcccagccagctgcgcggttatatggaagtggcgggcggacgggcgcaggtgatcgttgccaacccggccgggattgtctgtaacggatgcggcaccatcaacgccggacggatgacgctgaccaccggcaaaccacagctcaacgctgacggcagtctggcgggttatcaggtcgaacgcggcgtggtgcggattgaaggcggcggactcaacggcgatgcacgtcatgatactgagtatgttgacgtactggcccgcgcggtggagatcaatgcgggcgtctgggccaaaaaagagctgacggtggtggccggtcgcaatcgcgtaagcgcagacgcacagacggtcacaccgctggctgacgacggcagcgccagacctgaactggcgatcgacatggggcagatgggcggcatgtacagcggccagatccgcatgataggcactgaagcgggcgtcggcgtgcgaaatgagaacgctcaggtgcaggcgggcaaaacgctggtggtgagcagcgaaggtaagcttgtctggcagtcggcggcgcaggatggcgtgacgcaggccggaggcgacatcagtcttgcggccagagaggatatcgattatcagggcaagctccacagtggcggtcagctgacggtccggagccgcgaaggcggaatcactcagtccggcaccctggcggcggcaggtgatgtgcggctgacggcggcccgcagcatccagagcagcggacacctgctggcaggcagcgatgccagtagccaggttgtgcaggaagcgaatctgcagctggagagccaggataccattcgcgccagcggcagcctgctgagcaaaaaagaggtcagcgcacgcggacgccgggtcgatctcagtggcgctcaggtcgccgccagccgcgccaccctgacggctcaggatgagggtgttgccgtgcgtcagtcggtgattaatggcacggagctggtgattaacacggcaggtgatatcgaggcgcagcaggcgcagattagcgccgggcgctggcaggtcgatggacgcagcctgttcagccagcaggccggatggtcgcagaccggaagtggcgaaagccgcttcaccctgagtggtgggctggataacagcgacggagcgattgagagccggcaactcagcttccgggccgcctcgctcaataaccagcgtggacgcatgatcgcactcgacaacgccgcccaaaaatggcggattgacggtctgctcgacaataccgcgggtgagctgggtaacaacggcgatctgacgcttgagacaggcagcctgactaaccagggtggcaccgttaaaacccaggccgcgctggctattaatgcccgcgacgcagttaacaacagtcagggcaagctgctggccggtgatgcgctgacgctcagcgcgggcggtgatcttgataatcacgctggcaccctgaacggcggtcagctgtcgctgaccgcgcagcatctgaataatgtgcagggcgagatcgtcagccagcgcgatctcgatctgacgacactacagggcctggacaacagtgatggctggatcgaggcgggtcatcatctctcactcaacagcggcggactctggcagaaccgcgacggtacagcgcagggcggtgagcgagtcacggcgacgacagatcagctcaataacgccagcggccggctgcagtctggcggtgatctggacctgaccagccgtggcgatatcctcaaccagggcggcaaactcacggcgaaaaatgccctcgcggtccatggcaccgcagcgacgctatttgataacgatggcggatcgctgcaaagcggcggcgatctgctgctgcagggcggcgcactgaacaatcgccagtcagggcagattctcagccagcaggcgctgacgctgaacctggcgggcgactgggacaatcagggtggcaccctgaccggtaatagtcgcacgcaggccagcgccgcaaatctgttgaatgctcagggcgcgatcaatgcgctggatacgctggatatgcaggttgctggtcgtctggataacagcaatggccgcatcttcagtcggttaagccagacgcttcaggcgcaggagatgagcaatgcgcagggctggatgggcagccagggacgctggactgccacgactgccggtttcgataacacggcgggcagcgtacaaagtcagcagcaggctgaactctcggcgaactggcttagtaacgccagcggcgtgttgcaatcggctgctggcatggcgttacgcattgagcaggatatcaacaacctggccggtaaagtctctgctcagcagcagcttaccgttcagggtcagaccgaaggcagccgcaccggtaacattcacaatgcgggtggccaatggctggctggtgaggggctgactattaccgctgcgcgactcgataacacccagggcggtctgctctacagtcagcggcagttgaagctgaatctgaccggggatctggataaccaggccggtaagatgcagagcggcgaagcgttccagctggatgcgcagacgctgaacaacgcaggcggcaacatcgacagccagcaacagctgacacttcagctgtcagggcagtttgataacaagggcggcgcggtacgcagtaatggcgggcagcagatcaatgccgcagcgatcaacaaccgtcagggcgtgttcagcagccgtgaagcgattaatctgaccaccgggcagctggagaatgccagcggcacactaatcagccagggcgcgggaagttatcacgtcggcacgctcaataatcagcagggcaaagtccacagcgacgcggcgctgacccttgaagccgcacaactgaacaatcagggcggccagcttgtggccacccaggatttagtgctgaacgccacggcgatcgataacagtacccagggtgtgatcagcagtcaggcggggctctcactgcaggccgatcgccttatcaaccgcgacggcggactgttactcggcaccacctacaccgacattactgcacgtgatatcgataatagcggcggacggctgcagagcgccggaacgctcaggctgcgcggtgttgcacagctggacaaccggcagggacgggtgctggcgaatggcgatctcaccctcaacggtgatctctcaccgactgattcaccgctggtgctgctcaatcagagcggacggctggagagtgctggcgcattaaacatccatgcacactctttcaataatcagggcggcacgctgctgggcctgcaagctctgacgctgagcgcgcaacaggactacaaccgccaggcgagcgaaaccatcagcagtaacggcacggtgactgtctctctgagcggggcgtttactaacctggtggactggctgctgccgggtaatctggtgctgaatgcggcaggcataaccaacccggcgatgctggtgggcaaaacagttcagctcacgaccggtgcgctgctgaacagcgggcgtcttgaagccgacgacctgacgctgagtgtcgactcgctggataaccgtgccgcgttgatgggtgatgaagtcaccgtgcgtggtcgggtaatcgacaaccatggacagcctgcggttatcgcggcaactcaaaacctgaccctgcaggcccgcgagcggctgagcaacacagatggcgcgctgctctatagcggcaatcgcctgtcattgcagagcgatgacctgatcgagaaccgggcgagctttattgaagcggatggtgatatgacgctggaagcgcggcggctagacaacctgcgcgaagggctggtgatagagcgtgaggctgagaccagcgactacaagtggcatcgttataactactactggcgctcgtttggtacgacgataatgcccgataaaggcagtatggcaccgaccactcagcaactgactttccaggatgaggccgcggcgcagagcaatccttacggcacccttctggcgattgacgcggtgggcaaacgcgctcaggtacgggtcatgaacaatcagggcgtgctgaccgatctgtgggttaactatctggcactgaaccccggcgccgatggcacgtatgccatgacgttctatgaaacgcgcggatttaagcagaaaaatgtgccgactccttaccagaacaccgtatggcgtgaacatgaccgtggtcgtatcgaacaatgggaccctgaacaacatatcgatatcaataacgccctctttatcagcgactacagcgctttgcgtgagcgtagcgtaaccggcaccctgacgcgtgacagactgatcaatgaaggtatcggtgcacgtattctggcgggtggcgacatgctcctgcgcatcaccggagcattacttaatgatgccagcgtgatcacggctaacggcaatctgacactggatggcggcggaagcatcgacaaccggggctattcgatcaatgagcggcggcaggaagttattgtcgatcattacgacagaagcacgcgccactggtatccgaccttcaattccgatgagaccaccgccctggcaaccgttgacggcatcattaccggcaacggcaacgtcagcattaacgggaccagcatcagcaataccaccgttaatcaggcgcagataagccagcttgaagcggcgctgcaggcagtggacgctgagcgcgctgagtatgaacgtaacccactggcctttgccgtggacggggtcgcccgccatgacggcgacacagaactgacgacgggtaataacacaacgggtcgcccactgttaccggctgaactggccctgacggcgctacaacagctggagaaagtcgccacaaccatccccaataatggtctgttcagccagcataccgcggcgggcagcccgtatctgatcgtgactgacgagcgttttaccagcaagagcaaatttatcagcagcgactatctgcttgaacgggtgggttacgatccgtcacaggtgcataaacgcctgggcgacggtttttatgagcagcgtctggtacgcgagcaggtcctgaaactgaccggcaggccttccgttaacggctgggatgcgatggcgcagtatcaggagctaatgaacaacggctctaaagtggcgcaggatttccatctggtgccgggcgtggcgttgacgccgcagcagattgcggcgctgcaacaggatatcgtctggctggtcagcgaaacggttgatacggaagacggccctcagacggtgtgggtgccgaaagtttatctggcacagaccacgctgcgcctgactggcgcgggcgcggtgattggcggcggtaatctgcagctctcggcagacagcgtgaccaataccggtaatctgtttgcggaccaggcgctctccatcgacagcgggcagtttcagcacctgggcggtgatatcaaggcgggcagcattgatgtgaaggcggagacgctgacgatcagtaccgatctgcagaatgcactgcgtcaggcgacgatgagcgctgacgatatcagcctcagcggcaccgatatccggctgcagggcgcgaaactcaatgccaccaataacctcagcctgagcgcgcgcaacaaccttgagatcggtgccgcgaaaagcagtcacagcggcagcctgaacgtgatctccggggcgatgggtaaccgcaccagcagcggcatagaagaagcgggcaggcgcatggcgcaggtcagcggcgagtggcagcaggcgcagggcagcgagcttaacgccggtggcaatcttctgctctctgccgggcgtgacctgacgctgaccggtagccaggccagcgcctccggctctgcccgggttcagtcaggcggcgacattcacatcggcgctgaaaccaccaccaataccacccatcttgaggctggcagccggacttcatcggtcagcaacagccgtcaggaagatcgcctggtgctcagcaccctgagcggtgaccagggcgtgacgctggtggcgggtaataacctgctggccgaaggcgcgcaggttgacagtaccgagggccgcattggcgtcagcgcgcagaaacgtcaccattaaagacgcacgcgccagcctggtagctcaggacagcgaaaacaagcgcgagggtaatacccgcacccatcgtgaagaagaaagcgtgcgcgagagcagcaccggcagcaccttcagcgggcagcagggcgtgacggtgatcgggcgcgagggcgacgtcaccgttattggcagtacgctgcacagcgaacagggcgcggtcgggcttcaggcaaaacaggacgtggtgctcaacaccgccaccgaacgtgagtcactctatagtgaagaacgctcagagaataaaagcctgctgaacaaaagtagcagtcacagcgtgacgcgggacgttaccacccgtgagaacggcagcctgctgagcggcgaaagtgtcacggtcattgccgggcgcgacctgacggtgaccggctcggcggtggccgcagaccaggacgtcagtctgcgggccggacgcgacgtggagatcggcgcggcaaccgagaccgacagccactaccagctgaaagaaaagaaaaaaagcgggctgatgagcagcggcggcatcggcttcaccgtcggcaagcagtccacgcggcacgaaattgatgagaaaggcaccacccagagccagagcgtcagcaccatcggcagcagccagggcagcgtggatatcacggcgggcaaccggctgcacgtcggcggcgcagacctggtggcaggtcaggatatgaacctgacgggcgacagcgtaactatcgacccgggctttgattcacgcagccgtaaggaaaccttcgaacagaaacagagcggtctgagcatcgccctgtcaggcacggcaggcagcgcgctcaacacggcagtgagcagcgcgcagcaggcgaggaagtcgggtggcgagcgtgtcagcgcactgcagaacacccaggcggcgctgaacggggtgcaggcggcgcaggcagctcagatggacgggcttaacaccgccgccgcggacgcacacaatgccgccggcgacctgaagccggggcaggacggctatcaggcgggctcgaccaacaccatcggcgtcagcgcctcgtacggcagtcagtcgtcgaaaagcgaaacccgtaccgagagcagtcagtcgaagggcagtacgctgacggtgggccggaatctgaccgtcacggcaaccggcaaaaacggtacggcgcagagcggcgacatcagcatcgccggcagccagctgaaggcgggcggcgacctgagcctgggtgcgtcgcgggacatcctgctgcagtcggcgcagaacacgcagagcaccgatgggaaaaacagcagcaagggcggcagcgtcggcgtaggcatcggcgtgggttcaggcggctacggcatcagcgtgtcggcgagcgtcaacgcggcgaagggcagcgaaaaaggcaacggggtgacgcacagcgagaccacgctggacgcgggcaaccggctcagcctgaccagcgggcgcgacacgacgctcacgggcgcgcaggcaaacggtgagagcgtgaaggtggacgcgggccgcaacctgacgctgacctcagagcaggacagcgaccactacgactcgaagcagcagagcgccagcgcgggcggcagctttaccttcggctcaatgaccgggtcggcgaacgtgaacgtgagccgggataagatgcacagcacctggcagagcgtggccgagcagaccgggatttttgcgggcaagggcggctttgacgtcacggtgggtgagcacacgcagctgaacggggcggttattgcgagtacggcagatgccagcctgaataagctcgacaccggcacgctgggcttcggcaatattgagaaccacgcggaatatgaggtggagcatcagagtgcgggcatgagcactggcggcagcatcggcggtcagttcgccgggaacatggcgaacggcatgctggcggggctgaacgacagcggcagcgcggactccaccacgaaggcggcggtgagcgaaggcacgatagtcatccgcgacccgtcgaagcagaagcaggacgtggcagagctgagtcgcgacgtggcgaacgcgaacccggggctggacgtcatctttgataaggagaaggagcagaaccggctgaaggaggcgcagcttatcggggaaatcggggctcaggcgggagatattgcacggacgcagggcgagatcattgcgacgcgggccgcaaacgagaaaatgtctgaagccagtcaggccgaccgcgacagggcgctggccgggctgaaagcgaaggatccgacgaagcagtacagcgcagacgacgtcagtaaacaggtttacagcaacttttataatcaggcgtttgccgacagcgggttcggtaccggcggtaaggtgcagcaggccatcagcgcggtgacggcggcggtgcaggggctgtctggcgggaacgtggcgcaggcgataagcggcgcgtcggcaccgtacctggcggaaaagatacacgagctgaccacggatgcgaacggtaaggttaatgtccaggcgaacctgatggcgcacgcggtgctgggtgcggtaacctcgtacgcggcgggcaatgctgcgctggcgggcgcctcgggcgcggtgatgggcgagtacatcgcgcagcagatgtatccgggcgttaaacgtgaagacctgtctgaggagcagcggcagacgataagtgcgctggggacgctggcggcgggtcttgcgggcggcgttgtgggtgacagcacggcggatgttgttgcgggggctcaggcgggtaagaacgcggttgagaataatgcgctgcacgccgaaggcgagaagcagcgtcaggatgcgaagtggtcgctgccgtatctggaagccgaaaagaaacagcaggctgagaagttaatcagtgacctgaatgcgaaagataaggcattcgatgcagcgttagactcagcctgtaaagggctttcttcagcagcctgccagggaatgcggcaggaactggcagcgatgtcgaagagttatgaccagcagctcgacggccagtatatcggcacgatgggcagcgtttataaagaaggaaaaggtcaggttgacgcgctgatgtggcagtatgcctcggcggatgcgaaagcggagcgcgaagccaacgttaaccgtatcgctgaaaactggggtgtgagtaaggagacagcagacggcctctataccgcgatggctggcgttcataccacagcggcgattggtggcgcggtttatgggatgaagggaagtagttcggcgcagacaggtaagaatcccgcttatatagaagagccacctttcaatccctcaggcacaggcggagctgcgcaaccgtggtcgactaaaggtcgtatcaactatgttcagctaccgaatgaaggtaaaattcgttatataccgccagaggggtactctgcatctcaacctctgccaagaggcccaaataaaggttacattgacaagtttgggaatgaatgggttaaaggcccatctcgtacagcgggccaggcatttgagtgggatgtccagttatcacgaacaggtaaagctcagttaggttgggcaacgcgagatggctctcaccttaatatctcccttgatggaaaagttacgcataagtgaaaactatgaaaatagatttttatcaagaagtagaaattaaagcggatgctaaaaatagtaagtacgcaaaatgcaagggagtcgttcttggaatcagcgaggaggagaatactgtctttggttactctgtagtaattcatgggaaagaaaacacagtgtacttcgataaagatgatgtttcccccactggtattaccttcagtcgagaagacttttattgataaaaagcccggctataatgtgctgactccataaagttggacatccaacaagtaggggttcacttcattaatagccggtttgttttatcagcccctacgcaaaatgcccgtcatcacgcttaaacttcggcgcgtcactggtgctgtgcatcgcaccaggaaactccgtcagccactgcgccaccttcttccggttgatgggcaccacgcttaagccctcgacgcagccccacagttcgcgggtggcgggcctgaaggtgcagaaagatccggaagcactggcggctgcgagggaagagctggtcaaaaaagggaagctgaacccgacggcagatgaaatagcgaagcaggcttacgacacggcgcagaaaccgttcgggaccggcggtaaggtgcagcgtgccatcagcgcagtgacggcggcagtgcagggcctgtcgggcgggaacgtggcgcaggcgataagcggcgcgtcggcaccgtacctggcggaaaagatacacgagctgacgacggacgcgaacggtaaggttaataccgaagcgaacctgatggcgcacgcggtgctgggtgcggtaacctcgtatgcgtcgggcaatgcggcgctggcgggtgcctcgggcgcggtgatgggcgagtacatcgcgcagcagctgtatccgggggttaaacgtgaagacctgtctgaggagcagcggcagacgataagtgcgctggggacgctggcggcgggacttgcgggcggcgtcgtgggtgacagcacggcggatgcggtggcgggggcgcaggcgggtaagaacgcggttgaaaacaataatcttgcactggttgcgcgtggttgtgccgcactttcaccgtgccggaataaggttgcagagcagttgctggagattggtgcgaaagccggaatcacagggcttgccggactggccattaaagatgtagctgataaaataacctccgacgaactggagcatcttgttaccctgcaaatgatgggtaacgacgagatcaccgggaagtatctcagttcgcttcaggataaatatgctccttcgcataccggtggcaatcaacaggcgggtacagagagtttaggtaagctggaaaatcctgtgcaggacgtgaataagggaactgcgctagttacgccaaatcagacagttaagaatagtccccttataactatatctcctgaaacccagccaggaaaaaatgatggaatattcatcaatcctaaaccgacagagaatactagtactggttatatatctgagtcatctgataaaaacagtcctattagtgcaagtgattttttcaagggcacggcgtacacagataaagtcaaacaacaagctttttctggggacttccattcgttcccagaatcagtagatggtcatgctgatctgggaaaaatatcagtaattacagggggtgatggtgtggagcgtctgaagttagagatatctggcagttatcgcgggaaggaaggtgtgttcgaatatatccgtcaaccaagtggtgccataaatcatcgcctctttgtacctaaataataaatggaaatggtttgaaaaatgataaataaaatattggaattgtattcgcgttgtggaaaaagccttttagataacggacttaatgatgccgtcctaccaatgtctgtagctaatcaggctttggagttatttttagaggctaaatggacggtactgggaggggacgtttatcagtatgaagataataaaatgaagaatttttatgctgactggtactgtaatctaactgattcctctgatagctgcgattacgctaaagaacatttaagtaaattaaagggggataacatctatatctctttcacaataaaaagctgaaataatcccggccaactggccgggattattgctttaagccctgaatctcctcttaccgccgctgcagccgcaacacatctgctgctgcggcaatttcgatctgtcccgcatccgtgataccaaactcggtcagccagctgccgccgataattacctcgccgttctcccgcacccagtccgcgcccagatcctggcactgctggctggcttcgcagagttctttccagcctgcttcatcagtcacggttgtcaccgacagcgtgttatcccgcagcatcagccggatcggcgcgtcggtggtaaatccgagcgcggctagctggccgcctgtgatagtcagctccgggatgggttccggggtaaaaatgatcttcatacattctcctccgtgacgtgcacgatgcggataatcagctggccctgtttcggcgatgatgctgacgggctggcctttaataaatccccactgttccagccatcgtcctttgatggtgagtcgaggcaagggatttggtctgccgccgttggggcggtaaccaacgatgcttttgcgtgcttggggtacagcggcttctgacgtagaatcatctctagccataattaactccaatccagttagttgtggtcagcggctgttgcgggttggcgctcgcttcagccgcgctaaaaatctctcgttacgttcttccttttctgttttctcctgttcaaatatacaccgcccgctttgtaaactcgctgaaagccaggtaataaactgcgaagcgtctctgaaaaaaggattttttccggtctgtcaccattacctctgaaagcgtttaccctggcgctatgtccgtaataagtattcgggaagtaatgttaaaaatagctgattctattcaatgattacctttgagtgggttatttatcagagcttgccattagtgaaatttcagtgagtaacttatatttagcaacctgagttgtcatatcacggcgcatgatgcagtaaggttaatgggaacgataatggctgggtgtttttagcaaaaatccaataagtgatgttaattgaatgatgatcctgcagaacgattaaatattattgtatagcgtaagcgtttcagaatgttgtagaatcacacgattattaaaaggttaatataaataaaagaagattgattcaagtgatctttttgtatcaaatgaatgatctgctcaggaagcaggaagggtgaaatgaataaggatgtgaggatcaccgtatcaaagggacgattcaaaaaaatacgcgaatggaatcgaagaaaaaactactatctcaaagaggtgaaactcgaggcaagaatgtctattgcaaagcttctgtgggataaacggaaaaaagtctcctttgaacctgactccgtgaaaactatactgcttgttcgcaatgaaggaaaagtgggtgatatcatcgtttcgatgccactcatcaggtcacttcatcaggctggctatgcagtagatttgctggtaactgaagcctgttacgacgtaataaaatacagcccttttatcaggcatatttataagtcaggaaattgcagttataaccattacctgaagtctttttatcataccgtttcaaaagcaacgatgaagaagctaaatagaaataagtatgatctgattatcgatccttgcttatccgaaacgccggtgcatcgaatgaaattatttcgggatattaatgccagattcgttattggcctaaataagaaatctgacatcagccattacacagtttcggttccctataaaaatgaaaagcagcatgttacagagttactttctttgataagtaaaagcattggcgttaaagcgacaggcaatttcacttacagtcttcattttcctgatgttgtgcttgatgaggtgaggcactttcttagtccctgggaaagtaagaaaaaaattgttattaatgcttttgctggcacgccggaaaggaacttctcacaacagcaattgctggaaatcattaatatgattaataataacagcagagaggtgaaaatcatcactctggattatcgtaatgaaatagcggtgccgcttcctgaaaatgttgtgaaaaatcccttttatactttgcatcatgtgatggcattaattaaagaatcggatatggtgataacgccagatacatcaattgtacatatctctgctgcgtggaaaaaatctcttatcgccgtttacaaaaatgcgcctaataataatatgtgggcgccaggctatgaaaacgcaagccacatcattgttcatgatgataaaacatccgatgctgagaatatccctgagcgtatttttaaagaggtaatccgcaggaatttattgggcaagcgtgaggtgaaaatccagaaatctgtatcggtgatcgagttgaaagaacctgttcgtacccacggttatcatgctcccgactgctgtatcgcctcctctgatcagctctgctgctgaccagcagataaagcgtcctgccgtgccagacaccattgtccttcttaagtgggctggcttataaagctctcacgccgcagcggcaccatatcttgcagagcagatacatacgccgactatcacgaaaggggctgacggcaaagatgtggtgaaatactgaagtgaacctgattgtgcatgcggtggtgggtatgcaggtgggtaaaaatttgcctgaaaacaataatcttttatccccaaaaaaccaggtaatagattgagaggcgcctctgaaaaacggattgttttttcggcgggttttgtgtgatttttctattcctgaatccctcttcagctcctttaaacagccagctattcaatctttaagtccaggttatgcacattataatctgtatggtttttaccctgtccgataatgacagtgcctgaaccgctgataagatgtgctatcgcgctgttgaaaaccggataccctcgacgacatctgtaagtccccaattctcaggagagagcgactcaacagagtatgaaactgacagctgccagaaaggtgagtatgattaaatcctatcaggcagaagaaagaggttacccatgagaacaacacagcagatgagtatcacgctgcccaatgaaatggcagcacaggttaaggcacgtgttgccagcggcgaatatgcatcggaaagcgaagtgatccgtgaaggattacgtgcgctgatggcacgggatcatgccgtggaacaatggctgcatgaaaaggtagtgcccgcatgggaagcgcttcaaagtggcgaaacacaaagcctgagcgctaacgacctcaggaacagactaaaagcggaacacaggaaggcaaccggggaggagtaatggtttacagggtggtgttcgcaccagaggcgcaggaacaactggcagaactttaccgttatatcgcgcaagcagcgacaccctataccgctttaaactttacggaaaacgtcatcgattattgtgagtctcttgcacagttcccacatagagggaactgtcgtgatgatcttctgccaggactgagaatcaccaattaccgcagacggacaataattgctttcatgctatctgagaaaacagtgagtgttttaggcatatggcatggcgggcaggattatgaaaatgacctgtctggagacgaaattgactgagctgtcagagcagccaggccgattatatttttcctgtgcagcgtaacaaaatgtcgcttccatgcctgcccggggcgctttgatagttatttcgcctgacccatcacgccgcaggcggcgtcgtccttgcaaagctctcgcgctgaaacagagtttctgccagtttcaccagcgcgggtcgttcgacacaccagtttcggcactacgcgacggaaattgaggtagccgatcatgcaaccagtggcgatatccgccagattgagctggccgttgttaagccatttcccctctgccgccttcgcttccagcatgtcgaggctgcgctgaatcttttcacgattgcgcagcagcacctcttccgactgtaaatttcccggacgcatctgctcgcgcacgatcaccagcgcggcatcgctgacgccatccgccagcttctccagctgacggatgttaagcgattcaagcggatcggcaggcagcagagcaggctccacgccacgcagttccagaaactccgcaatgatgctggaatcgaaccagatttgcttatcgtcagcgaccagcgccggaactttgcccagcggattgtagtgcggcacatggctgtcatcgctgtaaggcgatgcgttaacgaattcaaaagtaatgcctttttccagcatgataatcgaaatcttacgcacaaacgggctggtatagctgccaatcagtttcatcgggttctccagagtcagtgactattcgccaggaaacataaagggattgagactgctgcgtgcgaagccttcctgctccattttggcatccagtatcagcgatgccaggtcatctgccaccggttcaatggccggatctttctcctgatagagcatcttcaggtaagtgccgcagtcgccacagctctctgctttcaccgccgcccgttcgctgtcgatcgaccagtaatgcagatcacgggactgttcgcactgggtacatttgctgcgcaccacatgccattcactttcgcacagattacagtgcagatagcgcgcgccttcatgactgcccatatgcaccacgctggcgactggcatactggcgcagaccggacagaactgacgctgatcgcccatctcagcgcgtgctttgcctgggatcatggccgccatctgcgcccagtagagcgaaagcgccgcccagataaagggtgctttgtcgctgctgaccagcgcatactcgccggtaaagagcgcgctggccagcgtttccagctcggtggcggacgccttctccagattctccagcaccgccagtgcctgaccgctcatctctggtttcagctcggcaatcagtgaatgcagcagtcgctgccagtggggatcgcgcggcagggtatgaatattcagcggcggcttgccctcgctggcgctctgcgtcaggcgggcatgcaggtcgatgtgcagcggatggtcatacagcacaatctcctgcgcttcagcgatcaccgccgcaaagcgcaggtagtcgccgagtgggtttttcgccgccaggtcacgcagtcgcgcagcacgacggctgtataaatttttcagccgtggaaaaagtaacggcggaatcatctccgccgttgtcttttcgcctttctccagctgatcttgcgggattatgcgaatactcatcaggggcgtttttcctgttttattggcggattacgctgctcacgataccagcgaggatggtgctgcctggcccattcggcgctgacccagccttccaccatcgcggtcagtgtgcctttgacccacaacgcagcataaatgtgcaccataatgacgatgatcagcgccaccgctgacaccgaatgtaccaccaacgccagacgaatcagcggaatggcgaaggcatcggcaaagtaaggtcgccagatcacgatgccactggcaagcagcaacactaagctgataatagcagcccagaacacacacttctgaccaaagttatatttaccggtatcacccacctcttcattcagcgcaatccggtgaatgtttctggcccagtaaaggtcatcgcgattaatcaggttgtgtttccagtaacgcaaaaacatcagcataaaagcaacgaacatcaccacgccgacaaaaggatgcagaatacgcgccagctgtggtgtgccaaatatctgcatcagccagttgaacgacggaaagaaaaaccctaatccgcttaacgcggccatgacaaagcaaatcgcgacaatccagtgattgatgcgttcgggtgcgcggtaacgcaccagatgatcgggctttttcattatttgcgctcctcagggtgatcgtcgttgtcgtcgtgctcttcagtgacgcgattcgggccaacgccaacatagtgaaaaatagaggcggcgaacgtagcggcaaaacccaccgccgccagcggtttccagatccccttccagaaggtcaccgtcgggctgatgcccgggttagcaggcagtccgtgatagagctgaggcttgtcggcatgatgcagcacatacatcacgtgggtgccgcccacgccttccgggttgtagaggccagcctgcgcaaacccgcgcgacttcagctccgccacgcgttcctccgccagcgtcagcatgtcgcttttgctgccgaaatgaatggcgccggtcggacaggtcttcacacaggcaggctcctggccgacgctgacgcgatccacgcacagggtgcatttgtaggcgcggttatcctctttgttgagccgcggcacgttgaacgggcaacccgcaatgcagtagccgcagccgatacactgctcagactggaaatcgacgatgccgttggcgtactgaataatggcacctgccgacggacaggctttcaggcagccgggatcggcgcagtgcatgcaaccatctttgcgaatcagccaggccagcttgccgttctcttcaacttccgagaagcgcatcaccgtccaggatttggcggtcaaatcggtggggttgtcatagaccccgatgttatgaccgacttcatcgcggatgtcgttccattcggagcaggcgacctgacagcctttgcagccaatacaggtggtgacgtcaatgagcttcgcgacttcacgctggtgatcgcgcgcctgtggcggtggggtaaagccgttggtcgctgagcgacggataatatcttgtgattgataagccattgtcatctaccgttacgctttttccactttcactaaaaatcccttgtactccggggtctgcgagttggcatcgccaaccgacggcgtcagcgtattggcgaggaagcctttacgcgtggtgccttcaaagccccagtgacagggaatacccacggtatcaaccggcttgccgtcaatcatcagacgctgcagacgacgtgttaccaccgctttggctttgatatagccacggcgcgacgagactttgacgctgtctccggccttgatgcctttctcctctgccagttcggtgccgatttcaacaaactgctccggctgcgcaatcgcgttcagcagggcatgtttggtccagtgccggaacagtttcggtgatggagtaggtggtggcgacgcagggatagtcagcggcctcgcccagttgcgcggcgtcgctgctgaacagtcggacgaccggactatgacgctgctgcggattcataggattgtcggcgagcgggctttccatcggttcgtaatgttccgggaaggggccgtcggccatcttatcgagcgcaaacaggtggccaagaccatcgggctgcatgataaacggaccggcctgctgctgcggcgacagcgttaccggataatccggcacgtcaatgccgtgccagcgagtgccatcccactcaatcaggcggcgattcggatcccaggctttaccctgcgcatccgcggaggcgcggttgtagagaatgcggcggttagccggccacgcccaggcccagccggagaccgcgcccagccccgatgggtcggcgttgtcgcgtcgtgccatctggttgccttccggcgtccagctgccgctgtagatccagcaggcgctggctgtggtgccgtcgttacgcagctctgagaagccgttgagctgctggccttttttcagcaacagcttgccgctggcgtcgtaaatgtcggccagcgcctgaccgttgttctcctgcgccacctcttccggctcaggattcgacggatcgcggtagtcccagcgcattgccatcagcggttcagggtttgctccgccttccaggcgatagagcgcgcgcagacgcatgaacagattgccgaggattttaccgtcgtgcagcgcttcagcgggcggctccgcagccgcccagtgccactgcagccagcgtgacgagttggccaccgatcctgactcttcagcgaagcaggaagagggcagacggaacacttcggtctggattttcgagggatcgacatcgttgaactcgtcgtgatgctgccagaagctggcggtttcggtgcgaagcggatcgatcaccaccatatatttgaggcgggacagtgcccggaccgctttatttttgtccgggaaggcggccagcaggttgaagccctgaatcaggcaaccattgagcgcgccctgttccatcatctccgcctgcgccatgcagtcgtagctcttatcccacttcggcagccagtcgtagccccactggttttccgctgtggccttatcgccgtagaaactcttcatcaggctgacgaaaaatttgtcggtgttctgccagtagttgacctgatccggcagtgccgcaaccggcgtggcctgctgcaggtaggttgccagcgtggtcatcttctctgagggcagtggcagatagcccggcagactctgcgccagcaggccgagatcggtgtagccctgcacgttggagtggccgcgcagcgcgttaataccgccgcctggcatcccgatattacccagcagcagctgaatcatcgccgccgtgcggataatctgcgaaccgttggtgtggtgagtccagcccagcgcatagagaatagtcgcggtgcgattcggcacacaggtggaggccagctgcctgcacaccgcaataaaggattcctgcgaggtcccgcacaggcgcgtcaccatttccggggtgtaacggctggcatgggttttcagcagattcagcacgcagcgtgggtgagtgaagctctcatcgcgtttcgcatggccgttttcatccagctcatagtgccagctctgacgatcgtactgacgggtttcagcattgtaaccgctgaacaacccgtcgctgaagctgaagccttcgctgacaatcagtgcggcattggtgaaggcgcgaacatactcctgctgaatctgattgtgttgcagcagatagttgatcacccccatcaggaaaaccacatcgctgccggcacgcagtggcgcgtagagatcggcgaccgccgcagagcggttaaagcgtggatcgaccacgatgacctgcgcattgttatgagttttggcttcaatcacccatttaaagccaaccggatgcgcctcggcggggttgccgcccatgatcatcaccacattggcgtttttgatgtcgttccagttattggtcattgcaccacgaccaaagctgggggccagcgcggccacggtcgggccgtgacacaggcgcgcctgattttccagcgccagaatacccagcgagcgggcaaatttctgatcgagcaggccggtttcattactggcggcggaagagcagagcatggcggtagtcggccagcggtttaccgtgacgccagcggcattggtggcctggaaattggcatcgcgatcctgcttcatcaggcgggctatgcggtcaaatgcctcatcccagctgatgcgctgccatttatccgagcctggcgcgcggtattccgggtatttcaggcgctgttcactgtgaataaagtcgagcacgcccgcgcctttggggcagagcgatccacgactgaccggatggtcaggatcgccttcaatatggtaaatcgaggcgcgggcatttttagcgccatcacccaggctgtaaatcagcatgccgcagccgactgagcagtaggtgcagttattacgtgtctctctggcgcgaatgagtttgaactctctgacgctggctaaggctgtggtgggggcaaaaccgagtaacgccgcgctggtgcccgccaacccgccagcacagattttgaaaaaactccgtctgttaatttgcattttatcgttcttctttattggctccattgcgaagccttgcaaaatagcagccctatctgcctgtaagttgaccagggtcaacaggttagtcattagtaattctttttctaaattttgttaaaaatcctcggcaacggatccccggcgcaagcagatttcccgtagcggcagataattactgttgttttatgcttaccgatgttaaagcctgaaagatacccattctcattctgcccgccagcaggcgtggctgcgcctttcccggtgagaaaaccgcatgaattgccccgctgtttatttgcgccgcaccgggccagaaggcaaaattagtctgcgtctgatagccgttgtgcagccgcactgactgtcgcatttcattatttattaacaacaggtcgtactttttgaaagctattcagcctgactcaggcgaagatttaacaattcaggccggcgtcagcagaaacgcaggtatggcagcgtgccgatttgaccgcagcagagtctgactggctggcggacgaggtgccggtggcgctggtttacaacggcatctctcacgtggtgatgatgaccacgcccaaagatctggaggcgtttgcgctgggtttttcgctgtcagagggcattatcgacgcggcaggcgacattttcggcatggacatcgtgccgggctgtcacggcattgaggttcagattgagctttccagccgccgttttatggcgctgaaagagcagcgtcgtgcgctggcaggccgtaccggctgcggcgtatgcggtgttgaacagctggaccagattggcaagccgctctctccgttgccgtttacccagacctttgcgctggagcaactggatcgggcgctgggccagctgaaagcgtatcagccggtcggacagaaaaccggctgcacccatgctgccgcgtggatccagcccgatggtcagctggccggtggctgcgaagatgtgggtcgccatgtggcactggataagctgctgggctatcgcagccaggctgagtgggggccaggcgcggtgctggtctccagccgtgccagctatgagatggtgcagaagtccgccatgtgcggggttgagatcctgttcgcagtctcggcagcaacccgcctggcggttgaggtggctgagcgctgcaatctgacgctggtcgggttcagtaaacctggacgcgccacggtttacagccatcctcagcgactgcgttaaaccaccatcacctctggcagcgtctgctgcaacgcctcaagggcggcactgttgtcgccgccactatccgtaatcagcaggttgatcgccggtgacggcgcgtaaaccgtgcggctgactacgcccagtttagtgtgatcggccagcagatagcaggaagtggattgctgcaccatcgccctggcgatggccgcttcgtgcggatgaaaactgctggcaccacaacccgcctcaatgccgaccggtgacagcagcgccacatcggcgcgatagcggataatctcacctacagtgatttcgccacgcgtctgttgcgcacccgccgacatcatcccgcccagcaaaatgatctgattattcagcggctgatcttcttctccggcgctcagcgccagcgcggcctgcaggctgttggtcacaatcgtcaggccggaaagggcgtgcaactcctctgccagcagcgtggtggtgctgcccgcatccaggaacagcgtctgtccgggctgcagcaactgcgcagcggcgcgggcgatggcgcgcttctcccgggcctgattactgcggcgttccgttagcggcggttcagcccgcgtttcaatcgccaccagcccgccgtgaacgcggcgcgccagacccagcgcttccagctcaatgatatcgcggcgcgcggtttcgcgtgagacccccagctccctgataatgcgctcggtactcacctggttaagccgggtcagtaaggcacggatgcgatgaaggcgcgtttcctgcagcatagaggtttccttttaaagcgcgaagatcacggatgatacgccagtgaagcgaaagattccgtctgaatcagtgagcaagcttagcgcggcgatctgcctgcgtcatgtgtattttattgtatttgtgtatttggttgcattttagattcaggcaggcatgataaaggcgtcagctcttcctccttcatccttgtaacgggagtcattatggccacgcgttccaccattatggataccaacagtttccgtgccgaacatgccgatgcgctcgacagcgagacgcgcaaactgaccgataaacgcagcaaagtgcttggcgaatcttatcgcctgttctatcgcaaaccggtgcatctggtgcggggtgaagggcaatatctgtgggatgcggcgggcgataaatatctcgacgtctacaacaacgtggcgagcatcgggcactgccatccggccgtgactgaggcggtgacgcagcagatgaaaatgctgaatacccacacccgttacctgcatgaaaatattctggactacagcgaagcgctgctggcgaccacgcctgaggcgatcgatcgcgcgatgtatatgtgcaccggatcggaagctaacgacctggcgattcgcgtggcgcgcgcctttagcggcggcagcgggattattgtcagtaaagaggcctatcatggcaccagtgagctgacatccggcgcttctccggcgctgggcagtggacagccgctggcgcccaccacgcggctggtgatgccaccggatgcgtatcgtgtggacgcgcctgacctgggtgactggttcgctggccagattcagcagcagattgatgatatggcggcgcacggcattaaatttgccggcttcctggcggactcaatcttctcctcggacggcgtgttgcccgatccgcgcggcttcctgaaaaaagcggtcgaggtggtgcatgccaacggcggcatctttattgccgatgaagtgcagcctggttttggccgtaccggcgacgcgtttctggggctttggccgccacgatgtggtgcctgacatcattaccaccggcaagccaatgggcaacggcattccggtttccggcctgctggcaaaaagtgaagtgctggccgccttcagcgactcaattccctacttcaatacctttggtggtaatccggtcgcgatggcggcggcgcaggcggtactgaaagtgatcaccgaagaggggttacaggaacacagccgcgtggtcggcgcgaagctgctggcggagctgcgaaccctgatggatcgctatgagtgcgtgggggatgtgcgcggtgccggactgtttatcggttttgagctggtcaccgatcgtcacagcaaaacgccggacaaaacgctggcgctggatttaatcgagaagctgcgtgaacatcgcgtgctgacctcggtcgccggcccgtatgggaatgtgctgaaactgcgtccgccactggcgttccaggaaggggatatcgactggctggtcggcgcgctcgacagcgggctgcgcgaactgggcaggtaacgcgcagggcagggcagatgcggcgttcgggcgggatgagtgcctgctggtggtgctggctgagtgcttcgctctccctgtctgataaagctaaaaaggcggagtcagcagcagcatgctgtaaaaacaacgggttgcttttgccagatttctcaaatccttatggttaatagggcattgattacccttttacgctacatgaatttaactataatgattcgactgcttacgcggcacgtcccgaattcgtcgtgctgctcaaactaaatggagaggaagaacatgagttattcactgccatccctgccttacgcatacgacgcactggaaccgcatttcgacaagcagacgatggaaatccatcacaccaaacatcaccagacctacgtgaacaacgctaacgcggcgctggaaggcactgaatttgccaatctgccggtagaagagctgatcaccaaactggatcagctgccagcagacaaaaaaggcccactgcgtaacaacgcaggcggccacgctaaccacagcctgtttctggaaaggcctgaaaaccggcaccacgctgcagggcgacctgaaagcggctatcgagaaagatttcggtagcgtggaaaaattccaggaagagttcgagaaagcggctgcgacccgtttcggctcaggctgggcgtggctggttaaaaaaggcgacaaactggctgtggtatctaccgcaaaccaggacaacccgctgatgggtgaagcggttgctggcgtttctggcttcccaatcatcggtctggacgtgtgggaacacgcctactacctgaagtatcagaacaaacgtcctgactacatcaaagcattctggaacgtggtcaactgggacgaagcagcagcccgcttcgcagctgcccagtaagttaacccagtgttaacgtgataacgataaaccggtggaatttatttcgccggtttttttatctttaaattctgttgtcccagattaaaccaaaaataaacggatctcgctttttaaccgccgcgcttttaaccttctgccacattaacacgccgttgatactcgttgtcttatgctcagtgacattcctgctcactgtgtgtcgatgactatgtcaattataactactcacgaaactacgaccgattcttctgcatcgcttttttttcagttaattagcggaaaatacgttccgaataaactctggataagtaaacgtttccggctgaaatttgtgttaagaaccttaatatcgccactgactacgctgcgttatctggatgagctgtcgcatttaccgcaactccctctgttgatgagtactcagggattgctgccagccaagctgcaccggccctatctgcgctcagggttgagcattgctgcgcgcgcgcaggcgatacttgatcattacagtctgatgaataatctggaaaaccctgcgctgcgtcagctgctgcaaagcgccacggataatccgctggctacgctgaccggtaaaaatggcgaatcctttttactttcctgcagttccggttatttcgatcgggaaggggaagtgacgctggtattacgttataacgacgaaattattgcttcactttcattttcaattctcaatgaaaataaccagcgcacattattaattggcggattacagggtccgcgaaaacatatcaataatgaggtgatccgcgaggcgaccaaagcggcgcagggtctctttccgaaacgcctgttaatggaagcggtatttattgtggcgaagcagtgcggcgtggagaatattctggcggtaggcgatgagactcatgtcttccgcagcctgcgctatcgccacagcaaaggggataagttctttgccagctacagtgaattctggctgtcgctgagtggggaggcgcgcagggatgggatgtttatcctgccgctgagcctgccgcgcaaaacgctggaggagattgccagtaagaagcgggctgaatatcgtcgccgctatgaattgctggatgcgctggcggagcaggtctatgccgccgccggcgaaacgcaaagccgatgtcgatcaggctgctgcctgatcgacccgtcagaatgcggttttggcgaagccggtcattgctgtcagccccatctcacgtcccagcgcggtcattggatgcaccacgaccaggccgcgcacgcttttcttcaacgcgcccagatttgcctgctctttcttagtaatttcgcggctgaagcccattttttgcagcttctgcgcctcggcactgagtttttcaacccgctgaccgcgcagacgctcaatctcaatgaccagcgcttctttctctttcagcaacgcgcccagtttctcgacatcacccgattccagtaactgcggctctttgcggttcaatgcgtccagcttatcgctgagaagtttgatttcgttcttttcttgctctttcatgacaacaactcgttgaggaaaacaggccaaggatacaccaaatctggcgcatattcccgctcaggttaagacgaaaaaggcgccgtgatggcgcctgacaggattagctgccggactttttaaacgcctgcttcatactgatgcgggcgatcagctcggttagcgacaggaccatggtggatcgcaccatctgcagatagcgctgctgctgcatgctgcgcagctctgcatcttcggtgtgaaacaccggtgcgggcggccaggcggtgacgcagtgcagttcaccaaacgggccaaggatctcatcgtcggtaaaacgataatcaccgctgtcgtgattcagctcttcgcgcagcgccagcagcagttcaccatcttcatattcgtgccggctgataacaccaagaccgtaaatcagcttcagacgaaccgagagttcgcccaaaggaccatcgcccagcagcagcggttctacggcatatttcaccgcgtagtcatctttgcggaagacctgcagcaccagcagattgacggcttcagccaatagctcaacggcggcgatcagaaagcttctcaccgaacgaccggcgttcaggcgctcaagcacccggttttcaaaagcctgcttctcttccattattgcctgcatgggttcaataccgccgttgggcgcaggcgaaactgcgcccggcttgcgtcactaacacgcgcgcattatgccatagcgtgccaggcgctcaccaccgaagccaccacttcgctgtcagcatccagccctgaaacctcagccagcgtcgcctgtgggcctttttctgccagcagcgtagccagctcctgcgcctgtgggtcctggtcgctgcgatagtgcatcgcggcggcaatgccctgcaccaggctggcgtgcggtaaaccatactccagcgtgcccagcgtcggcttgatcaggcgatcgcccgcgctgagtttacgcagcggctgacgacccacacgctcaacatcatctttcagataagggttctcaaaacggccaagaattttctggatgtaggccgcatgtttatccgcctcaaaaccgtagcgcttaatcagcaccgcaccgctctcttccatcgcccctttcaccacggcccggattttttcatcgaggatggcgtcacgaatggtctggtggccggccaactggccaagataggcggtaatcgcgtgaccggtgttcagggtaaagagtttacgctcaacaaatgccatcaggttatcggtcagttccatacccggaatcgcaggcaggtcgcctttaaactgagttttatcgacgatccattcgctgaaggtttcaacggtcacttccagcggatcggtgctgcccgcttcagacggtggcacgatgcgatcgacagcggaatccacaaagccgacatgctgctccagccaggcgtgatactgctccggcagcgccttcagcacatgctgtttcagctggctggtgccgcgcaccatattctcacaggcgataatatttagcgggcgggtattgccgttgtcgctgcgttttgccagccctttagccacactgccagcaatacgctccagaatctgcgggcccacggcggtggtaacgagatcgacttcagaaaccagggtgatgatctcatcgctggtgctgtttaccgcgctgacgcctttaacggtttctgttttggcctgctcgccaaccacatgaacgggatactcatgacgcgcgttcagtgcatccagcaccgtctgattcacatcagcaaaaaccagttcgatacctgcatctgccagtaacttgccgataaagccgcgaccaatgtttcctgctccgaaatgtaacgctttcataatttttgacccatatcaaatgacgatggggcgggcaaacccgccccaggaaatcgggacgggcatgaccgccccagggaaaataattgctataaattacgcgattgcaggcttacctgacagcagatccagcacttcctgcacgctggtggtgttcgccagcttctcaatcacgctgtcatcatccagcgcattggtcaggctggtgatcacctggatgtgctcgttgttacgggcagcaataccaatcaccaggcgcgccacatcgtccggctcttcaccgaacaggacgcctgccggatactgacagaacaccacgccggttttcagcacgcgatctttcgcttcgacggtaccgtgcggcacggcaatcgactcaccgagataggtcggcgtcagtttttcacgcgccagcatcgcctcaacgtattcaggctcaacgtaaccgcctttcaccagctgttcacccgcaaagcgaatcgcctgctctttgttactggcggtcaggccgaggaagacgttatccgcacccagtttaaacaggtgtgcgttgccttcatcgtagctgtcagagagcgcggtattcaccgtttgacgatgcacgtcgctgcggttagccgccaccagacgctcggtcagagtgctgtagagcgcgctgtcgaggaagttgttcagcgagatatgctgcgcatgcggagcctggcggatggcgcgttcagtcagatcacgatgggtaatcaccagatcgacatcacccggcagggcgttgatcgcggtattggtcaccgacacattgctcagcccggcgtcctgcactttcttacgcagtacgcctgcacccatcgcgctggaacccataccggcatcacaggcgacgatgattttacgcacgtgatgcagttcaacgctcatggcatcgctggcgactggggcacccgcgccgctctggcctttagactgcgctttcatctcatgcatgcgctgggtcgcggcttcgatatcgtcatcttctttgactttgctggttttcagcaggatagcggacaccacgaaggagacggcgaaggccgcagcgatagcggcgatgttcgcgaagtaggccccttttggcgtcattgccagcaccgccaggattgaacccggtgaggcaggagagaccaggccaccgttcagcaccgtcagcgtgaagacgccggtcataccgccaaggataaccgccagcagcaggcgaggagccatcagcacatacgggaagtagatctcatggatgccgccaaggaagtggatgattgccgcaccgcccgcagactgtttagcactgccacgaccaaagaacatataggccatcagcacgcccatacccggacccgggttggcttcgatcaggaagaaaatggatttgccggcttcactagcctgctggataccgagcggcgagaagataccgtggttaatggcgttgttcaggaacaggattttcgcgggttcgacgaagatcgaagtcagtggcagcaggttgttctgcaccatcagattcacgcccgcggcgagaatgtgtgacagaccttctaccagcggaccgatcgccaggaacgccagcagtgccagtatcatcccgataataccggccgagaagttgttgaccagcatctcgaagccgcttttgattttgccgtcaatcgcccggtcaaacgacttgattgcccagccgcccagcggaccggcaatcatcgcaccgaggaacatcggcatatccgcaccgacaatcacacccatggtggtaatggcaccgaccacgccgccgcgatcgccgcccaccagacgcccaccggtgaaaccgatcagcagtggcagcaggtaggtgatcatcgggccaaccagtttggccagcgtttcgttagggatccagccagttggaataaacagtgcggtgatgataccccaggcgataaacgccccgatgtttggcatcaccatattactcagaaagcgaccaaagctttgtactttgaccttcactgatgaggacataaacccaccccttattgagacgcgctgcaataggagagcgcgcttgtttttgtttagccaccccgacccaaagccggtggtattactgtatgcacgcggactctatcacgcgaatttgacgctgcgtagcgtgcggggtaagtgtgatctacatcactgattaagggtggtggcaggggtgattagcgtgattttgatcacactttaaggcgtagctcaggctcagttggctgatttttagacggggtggccggttatctgtgaggtgaatcacacttgtttgacgttgatttgttatatatctgtgacttagatcacaaactatttttggtcgaaaatgcgccagatcacacttcattcagcgggtgattgggtgggaggagaaaagagagtgggacgggcagacgattagcgcctgcccgtaaagcgggtttactgcagaccaccctggacggcagcctgtgcctgaggaagcgcctgcgaattggcggataaagtgctcatcagcgcgttatattgcgaagcctgatcctgagtcgggaaactgtacgccgccatcattgaagctgacacgggttccctgcgtttgcaggaaatcgccggtctgcactgcaccctgactcagcgcctggagttttggcagcagaggaatcagctgattggcaggcaccgtcactactttgttataggcggtgtcgtagacttttttcaggtcatccggctgcttcagggtcgccttgctgctgtccgcctgcattttggcgctttcaatctgctgggtgacgatcaccagtgcgctggtcgcctgacgcagggaatcacgacggctgagataatcctgcggaacgcgaatagcagaaagctcatccaccaccggacgcataccctgttcaaccgctttgttcgcctgctgcgagaagccatacataatggcgtaatcgctggcgaagttgccaaagctctgcttctggttttcgctgaggctgggcagatgctcgccgctgcgcatcacagtgttctggagaaaatcgataaatgctttgcgctgctcgccttctttatcaccgcatgcggtgagttgcagcacgatcagcgcgccagcgagcataatgccgccacgtgccataaggcgtgtaagtcctgaagccatagggtcaactcctgtcggtgatactgtcagatgtccaggtaggaatggcctaaagaatagaacaaacccgagccacggcacaacgtgaaaccacctgtgaaacagatgctttctgaaacgccggttacagaatgggaccgcctgcgcctcagggcgtgctgcattccctgccatcgcaggcttcagcgcgcagagatgaaggaggggctaagcagtctgacgctcactgccgcgaccttaaaacaccaccgcctgaccatctttgcgactctcactggccgcaatgtagaagccctgcggatcgcgcactatcgcctgcgcgccaccaaaattgtaattactcaggggatcttccagtaccacgttgtggcccatacggcgcagtgtgctcagggtattgcgatcaagtgtggattcaaacaccacctcgcgtccctgcaccacgcgccagcgcggcgcatcaatcgcggcctgcggattctgctggtgcagcataatccgcagcgccagctggaggtgtccctgcgcctgcatcgggccacccatcacgccaaacgccatcagcggctggccctgctgatcccgcgcaaaggccggaatgatggtatgaaacggccgcttaccgcccgccacgacgttgggatggtctggatcgagtgaaaagcccgcgccccggttttctgcaggctgatgccggtatcgggtaccaccacgccggaaccaaatcccatgtagttagactgaatgaatgagaccatcatgccgctggcatcaccggcggcgacatacactgtgccgctctgctgcggtgatccaaagcggaaatctcccgccttgtcaggatcaattaacgctgcccgctggcgaatatagtcgttgctgagcaggtgttccgccggaaattcgagatgatcttcatcggtgacataacggtccagatcaaccagcgccagtttcatcgcctcgatggagagatgcagccactgcggcgaatccggtgcatagcggttgatttcccactcttccagaatgccaagtgcaattaaggtcgcaatgccctgaccattcggcggcagctcctgcaccgatcctccggcaaacggacgcgacagcagggtaacccagtcggcacgatggtttttcaaatcctccagcgtcagggctgcgccatgctcacgggcgaaggctgtcatcttttgcgccagtgcgccgcggtaaaagctttcgccctgagtctcagcgatttcctgcaaggtgcgggcctgagccggattgcggaatagctcgccagcacgaggaggacgaccctgcggcgcaaagcagtcgctaaagccaggttgatcccgcagcttgtcatagccgcgctgccacagctgaccaatcagcggtgaaaccggaaaaccatggcgcgcatagtcaattgccggttgtgccagggtggtcagcggtaaggtgccaaagcgctgtgccagtgtgacccatgccgagacggcccctggcacagtgacggattcccagccggtttcaggcatcgcactaaaatcggcaaagcgttcgggatgccacgcggctggcgatcggcctgaggcgtttaacccatgcagctcgctgccatcccagacaatggcaaacgcatcgctaccgatgccgtttccggttggctccagcacggttaaggcgatggcggtggcgatagccgcatccacggcgtttccaccctgttgcagcatccgtaaacccgcctgcgccgccagcggttgagaggttgcgacggcattacgacccatcatcggtacacgatgagaagggtatccgacgttaaaatctgtttctcgcatcgcttttccttacagaggtcaggtatgggttttgcccgtcgtcagtgcgttatcacggggctgcacttttaccgcgcatcaggtcgatagttgccgggtaactgcaccggcatgaggcgccagccgtttcgttaagacgactgttgattaatctggcgacagagcgccgttaagaataaaagatttacccgctctgcactgtgagccgccgcgcgccaggcctcaggccccaaccaggactattcttaatttaataagatcagtgaatatatgtgttcaggaagtaaaccattggcgtatattttgcaatcactacctgaagaggtgtattgcctcacagaaatgagaatatgccagcaaaaagcttgatggcatccacataaatagcaaacaccatttgatttttctgcccacaccgaaggcacaaaactcaactgcctcagcgggttagaggcgctggaacttttccggcaaaccatagttaaaaaaataattataaattgcgcggcaaatagtcaggtctctatccatacttagtctcccggcatttgttgcattgacctgacatctttaaagcagtgcaccgcaggctgtgtcccgtaatggtttctctcataacaaaaataaacccttgcgggatccagcctgaaacaggcccggtttcagagtcctgacttcaggctcgtacctctctactttcacgtgcttcatagcgagtttttaaggagttctctatggaattaaaagacccgatgtttgaattgctcagcagccttgagcagattgttttgacacgtgatgatcgcgccgccgagttacttattcagcgtcagcaacccgcccagccagagccgcagcgtctgcgtgaaatgaccggcatgcaggttgatgagtttgcaaaagtaatgggcgtgagcgtttcttccgtgaaaagctgggaagcccggcgtacccgtccttccgcgacagcgcagaaattgatgaagttattacatgccaatccctatctgggacggcagttgcttgaataaactgatatcacgaaaagaacccgccgctggcgggttttttattagcgtaattcgctgtatttagccgcctgtctggcaaaccagctctccggcacgctatagggcggctcccgcaactgtgcgagtccgctttcaataatcattgaagcctgctgccataactgcgcatctccctgcttcagcaactcaatctgtatctgcttttcaaccaggtagacccgcgcaaagtcgggatcaaaacgcacaatcgcgcgggtgttatcgatgatgtcagccagtttgatggtttgtgcctcaggactggcgctggctgtatggcggaagtgcgccagtttacgggccgtccgattttttgccccagcgggcgcgctgttggtcagcatctctaccaggcttgccacgcgcgtaccaaagtgggtttcgatatcgctctgtgtggttgcggtatcttccacggtatcgtgcagccaggccgccgctaacaacgcgtcgtcatggctgacgctgcgcaccagttccaccaccgctgccggatgaacaatataaggctcatcggtatatttgcggcgctgtccggcactggcatgtgcctcggtggcgaagcgacgcgcctgttcttccagtgaatcctgcatgcctttccccctgacaaaaagtttgcttgcaattatctagcgcgctatctatattattaaccatgaactgtgatcaagatgacaaaaaagtgaaaacgatgccactgttggtcgatcagcacctctgctttgcgctttattctgccaacctggcgatgaataaagtctatcgtcagttgctgagccagctcgacatcacctatcctcaatatctggtcatgctggtgttgtggcagaaagatgatgtcacggtgtcagagattggcgagcagctttttttagactcggcaacattaacgccacttctgaagcgactggaaagtgcaggcctgattaaccggcagcgaacccgtcaggatgaacgccaggttgcggtgacgctgaccgaagccgggcaggcgttacgggccagggctgaagccattcctgaagcggtcaagtgtgccacagcctgtgatgatgacgctttgctggcgctgaaattacagctggatgggttgcgagataacctgaataagtcacgataaatattgctgacgggtgcgcggcacccgttaaacctcaccgcctgattacagctgtataagtagtgggcgattaaatagcgtaacggagaaatgtcatgtctttagaacaagtggtttaccgcgccaaagccaaagcaaccggtggtcgtgatggtcgtgcaacctcttctgacggtgtactggacgtgaaactgggcgtgccaaaagagatgggcggtgcaggcggcgaagtgactaaccctgagcagctgtttgctgcgggctattctgcctgcttcctgggcgcgatgaagtttgtggcgggccgtgacaagatcaccatgccaaaagacgcctggatcgaaggtgaagtgggtatcggccctatccctgatggttttggtattgaagcgaccctgaacattcacctgccagagatggatgaagcagaagcgcagaagctggttgatgcggcacacatcgtttgtccttactcaaacgccacccgcaacaacatcgatgtcacgctgaacattattcgctaagcgtgctgcgggcctgaaactatcaggcccgcacttttttccctctctcattttcgctctcctgctgctgtctgcgacagcccacctggccgttcctgtccgctgtgtacaaaaaatgtgctaatcaggtcgacaacgattattttctggtctatcaaacgcgaccatgttttactgagccacctcgcgttatagcctgtaaatccgttcagaattttccttcatcttgtccggtccgcttattcagcgaactctgccgcgtttcggcagtcacataaaagatttggtcaagcgcttcacaccggagaaacaccttttttcatgaattacattaaaaccctgactcagcagaagttatcgctcttgctggcgctctatctcggtatcttattgaatttgccgattttctatcgtcgttttgacggttttctcaggcactctacggttacgaaactggctgactgccgtcaccgaggtagtggccattgtggtgctgactttcttcctgatgcgtctgctgtcgctgggaggaaagtggttttatcgcgtgctggccacgctgattgttctgatttcggttgccgccgcctattacatggcgttttttaacgtggtgattggctacggcattgtggcttcggtgatgacgactgacaccgatctctctaaagaggtgattggttaccatttcattctgtggatggtgctggtcagcgcgctgccactgctgatgatctggcgcaataagctgagcatgacgctgaacgaacagctgcgtacgccgggacagcgcctgaaacccaccctgatcatgctgctctgcgtggcgctggtctggctgccgattcggtttttcgacaagctgcagaagcataacgaagagatcactaacatcgatctgccgagttacggcggtgtggtggcgcactcttatcttccttcgaactggctggcggctgtgggcctgtttgcctggacccgtgtggatgagtcgctgaacagccaggaactgctggatccggcgaagaagtttacctacgtcgcgcctgccgggcttgatgatacctatgtggtgtttgtgattggcgaaaccacgcgctgggatcacatggggatgctgggctatgagcgtgacactacgccgaagctgtcgaaagagaagaacctggtggcattccggggcgagtcctgtgataccgcgactaagctgtcactgcgctgcatgttcgtgcgcgaaggcggcaccatggataatccgggccgcacgctgaaagagcagaatgtgtttgcggtgatgaaagagctgggcttcacctctgagctatttgcgatgcagagcgaagtctggttctacgacaacatcaatgccaacaattttgccttccgtgagcagatcggttcagagaagcgtaatcagggcaaagcggtggatgacatgctgctggtgccggagatgaaagcgtcactggatcgtttcccgaaaggtaaacatctgattgtgttgcacaccaaaggttcgcactacctctattcacagcgttatccgcgcagcttcgcgaaatatcagccggagtgtatgggcgtggatgagacctgcagcaaagcgcagttgatcaacgcttatgacaactcggtgctgtatgtcgatagcatgctggatagcgtgctggatcagctgcgtgataagaaggcgattgtcttctatgccgccgaccatggtgagtcgattagcgagaatatgcacctgcacggcacgccgcgtgagatggctccgcctgagcagtttccgtgtgccgatgatggtctgggcgtcagataagtatctggaagacagtcagaaccgcagcaactttgagcgtctgcaggcgcagcagcgcgtgggccggacccatcgccacgttgagttgttcgataccatcctgggctgtctgggttacacctcgccagatggcggcattaacccggccaacaactggtgtcaggcaccgggtaatggtcaggctaaaccgctgtaatagtggtcgaaaagggtaaagcaggcggctgattcccggtaaccgcgtgctttccaggcgattggcgtcaaaagcataaaaagcggttgacgctgatcgggggtagcagtaacatgcgcccccatcggcgagtagcgcagcttggtagcgcaactggtttgggaccagtgggtcggaggttcgaatcctctctcgccgaccatatttaagaaacctgtctgaaaagacaggttttttttcgtctttagaaaagaggatgagaacctccgaaggaggtttgagccgagcgtagcgagacaacgttgcttcagcaacggcccgaagggcgctgctcgcagagcagagtaatcctctctcgccgaccatatttaagaaacctgtctgaaaagacaggtttttttcgtctgaagaaaagaggatgaaaggtacggatttaccgttgagcgggcttcagggagcatacgtctggcagacgcatcaggtacttacagaagcatctcagacaactgacagatccaaacccgagtgacgctgacagcaatcaacaatcttaaggcgaagggaacacgggcagaggaggaaagcgtcccacgccatggacggcgtgggccgagcgtccatggatggtttaagcgcctttccgatctgaccgtgttcccgaagcagtctcgatctggccgctaagcattaacattattaccgctgagtgggcttcagggagcatacgccttccgcaaagacgcaaaaacaccatccctggcaggctcaacgcaggcgattacgcacctcatccctgaggtgagcccgtagccgggccaacgctttgcgttgttcaaaaacgctcccggcgtttttatccgggcggcgcgatgctttgctacaggcgtatgctcccttcgcttcacgtctggcagacgcatcaggtacttacctgggagcctcagacggctgacagatctaaacccggatacatctgaccgcagcgcataaactcaaggcgcagggaaacaggggcagaggaggaaagcgtcccacgccatggacggcgtgggccgagcgtccatggatggtttaagcgcctttccgatctgaccgtgttcccgaagcagtctcgatctgaccgctaagcattcacattcttaccactgagcgtccagggatggtttaagcgcctttccgatctgcccgtgttcccaaagcaatctcgatcttaacgccactcccgcttgccatcttcgctatcttccagaaagttccagtaaaccccatccaccgcgcattctgtttaccagccgttgttatcatcacttacccgctggcaggccttgccatataagagatgcgatcataattcgcgacacattcttcttatgaccgaaagcggcaacatgctgatttcttatgcttctttaccagcatattccgctggatgaacgtcataacgcacggtgaatcgttcagttattcaacatttgccggtaaaagttttaagttttttagcggtgagaatcactagcgatagaacagccatccagcacaatgcacggaaatcagaccagcagcgctgtgcattgtatggcttttaggccgaaagggtttttattaccgttgcatgctatccctcacactctgtgtaaataagtaaccgttgtattgacgttctttgcaactgttgacaaattgatgcgtcaataaacgcacagttacggaattttctgaatgcaccatctgcataagaaaaaacaaaaaaaacgtagcgtgctttaaccacctgttcggtggtacgcctgaaccgcataaaaaaatcagaggtcgggcaatacacacaacatcacatcacaatggagcaaaagcatgatcaactccctggctaaatccgggatgctgaaggtcggtctgagcctgattgctatgactgtcgccgccggtgttcaggcaaaaaccctggtctactgttctgaaggttctccggaaggctttaacccgcagttgttcacctcgggcaccacctacgatgccagctcacgtcagatctacaaccgactggttgagttcactatcggcaccaccgaaactgcacgctgcgctggcagagaagtgggatgtcagtgaagacggtaaaacttacaccttccacctgcgcaaaggcgtgaagtggcagaccaccaaagatttcaaaccgacgcgcgacttcaatgcggatgatgtggtgttcacctttgagcgccagctggataaaaacaacgcctatcacggcgtctccggcggcagctacgaatatttcgaaggcatggacatgccgaagctgatcagcaaaattgaaaaagtggacgagaacaccgtgcgctttgtgctgacgcgtcctgaatcgccgttccttgcagacctcggcatggacttcgcctcgattctgtcgaaagagtacgctgacaacatgctgaaagcgggcaccccgcaaaacgtcgacctgaacccggtcggtaccggtccgttccagctgctgcagtaccagaaagattcgcgcatcctttacaaagctaacccgaattactggggcaccaagccgagaatcgatcgcttagtcttctctattaccccggatgcttcagtgcgttacgccaagctgcagaagggcgaatgtcaggtcatgccctatccaaacccggctgacatcgcgcgtatgaagcaggacaaaaacatcaacctgtatgagcaggctggcctgaacgtcggctatctgtcgtacaacgttgagaaaaaaccgctggataacctgaaagtgcgtcaggcactgaccatggcggtcaacaaaaaggcgattatcgaagccgtttatcagggtgcaggtcagcctgctaaaaacctgatcccaccaacgatgtggggctataacgacgacgtgaaagattacgcctacgatcctgagaaagccaaagcgctgctgaaagaagcgggcatggcagacggcttctcaatcgacctgtgggcaatgccggttcagcgtccgtacaacccgaatgcgcgccgcatggctgagatgatccagagcgactgggcgaagattggcgtcaaagccaaaatcgtcacctacgagtggggcgaatatctgaagcgcgccaaagcaggtgagcaccagaccgtcatgatgggctggaccggtgacaatggggatccggataacttcctggccaccctgttcagctgttcagcggcaaaagatggctctaactactcgcgctggtgtgataaatcctttgaggatcagattcagccagctcgcgccaccgccgatcaggcgaagcgcatcgagtactacaagcaggcacaggttgtgatgcatgaccaggtaccggcgctgatgatcgcgcactcaacggtatacgaaccggtcagcaagaaagtctccgggtacaaagtcgatccgctgggcggacactactttgctcaggtagacattaaagaataattgtcgccttttccggggtggctgcgcgtcgccccggctttatctccctgttttactggaaacggtagaggcgcagcctgtctgcgtcgcggtcgggcctacccgatcgtcagatgtaagcaataactaccctcgcggcgacggtcgcgcggacaagagagaaacccggattatgctgcagttcatactccgacgtctgggccttgtcatcccaacgtttatcggtattacattactcaccttcgcatttgttcacatgatccccggcgatccggtactgatcatggcgggcgaacgcggtatttctcctgaacgccatgcacagttaatggcgctgttaggtctggatcagccgctgtggaaacagtacctgaactacattaacggcgtattacatggcgacctgggcatttcactcaagagccgcatcccggtctgggatgagtttgttccgcgcttcaaagcgacgctggaactcggcttctgcgccatgatatttgccgtggccattggtatcccggttggggtcatggccgccgtgaagcgggggtcgattttcgatcacaccgccgtggggatctcactgaccggctactccatgccgatcttctggtggggcatcatgctgatcatgctggtctcggtacagctcaacctgacgccggtttccgggcgggtcggcgacaccgtcttcctggatgacaccatgccgctgaccggctttatgctgatcgataccttcttctggggtgagccgggcgacttccacgatgcggtgatgcacatgattctgcctgccatcgtgctcggcaccattccgctggcggtgattgtgcgaatgacgcgatcggcgatgctcgaagtgctgggtgaagattacatccgtactgcgcgtgccaaaggcctgacgcggatgcgcgtgatcgtagtgcatgcgctgcgaaacgccatgctgccggtggtgacggtgatcggcctgcaggtcggcaccttgctggccggggcgattctgaccgaaaccatcttctcgtggccgggcctgggtcgctggctgattgaagcgttgcagcgccgtgactatccggtggtgcagggcggggtgctgctgacagcagtactgattattgtggtcaacctgctggttgacctgctgtatggcgtggttaacccgcgcatacgtcataagaaataagggggcatcatgtctgttgttgatcccggcagcgttaccgttgcacccaagccgatgaccccgtttcaggaattctggcactactttaaacgtaacaagggcgccgttgtgggcctggtctacatcatcattgtgttgctgtgtgccatttttgccgatgtgctggccccgcatgcccctgctgaacagttccgcgatgcgctgctgcatccgccggtctggcaggaaggcggcagctggagctacattctgggcaccgacgatgtaggccgcgatgtgctgtcgcgtctgatgtacggcgcgcgcctgtcgctgctggtgggctgcctggtggtggtgctgtcactgatttttggcgtgatatttggcctgctggccggttatctcggcggcgtggtcgatgccatcatcatgcgtgtcgtcgatatcatgctggcgctgcccagcctgctgctggcgctggtgctggtcgccatctttggcccttcgatcgttaacgcctctatcgcgctgacctttgtggcgctgccgcactatatccgtctgacccgcgcggcggtgctggtggaagtgaaccgcgactatgtgaccgcctccggcgtggccggcgccggtatgctgcgccagatgtttgtgaatattctgcctaactgccttgcaccgctgatcgtgcaggcttcattaggtttctccaacgccattctcgatatggcggcgctgggctttctcggtatgggtgcgcaaccgccaacgccggagtggggcacgatgctctccgacgtcctgcagtatgcgcaaagtgcctggtgggtagtgaccttccctggattggtcattctgcttaccgtgctggcatttaacctgatgggcgatggtttgcgtgatgcactcgacccgaaactcaagcagtaaagaggcaccgagatggcgttattaaatgtagacaaactatcggtgcatttcggcgacgataaagcaccgtttccgcgcggttgaccgcatcagttatcaggttgagcagggccaggtcgtgggtatcgtgggcgagtccggctccggtaaatcggtgagttccctggcgatcatggggctaatcgatttccccggcaaggtgatggctgagaagctggagtttaaccagcgcgacctgcagaacatctccgaacgtgagcgccgccagctggtgggcgccgaagtggcgatgatttttcaggacccgatgaccagcctgaatccctgctacaccgtaggtttccagatcatggaagcgatcaaggtgcatcagggcggcaataaacgcacccggcgtcagcgggcgatcgacctgctgaatcaggtcggtattcccgaccctgcgtcacggctcgatgtctatccgcaccagctgtcgggcggcatgagccagcgtgtgatgattgccatggcgatcgcctgtcggcctaagctgttaatcgccgatgagccgaccacggcgctcgacgtgaccattcaggcgcagatcatcgaactgctgctggagttgcagcggcaggagaacatggcgctgatcctgattactcacgatctggcgttagtggcagaagcggcgcaccacattatcgtgatgtatgccggtcaggtggtggagagcgggaaagcgaccgatatctttaaggcgccgcgccatccttatacgcaggcgctgctgcgtgcgctgccggagtttgcggccgataaagcacgcctggcctcgctgcctggcgtggtaccgggcaagtatgaccgcccgattggctgtctgcttaatccacgctgcccctatgcgactgacctttgtcgtcaggaagaacctgaactgcgcaccatcccaggacgccagtccaagtgtcactatccgctggacgatgccgggagaccaacttatgagtcatgaaaccacgaaagatcagttcctgctgcaggcgattgatctgaagaagcactacccggtgaagaaggggctgtttggtcaggagcgtctggtcaaagcgctggatggcgtctcttttaatctggaacgcggcaaaacgctggcggtggtaggcgagtcaggctgtggtaaatccacgctgggccgcctgctgacgatgattgaaaccccgaccgaagggcagctttactggcacggtcaggatctgctgaaacatgatccccaggcgcagaagctgcgtcgccagaaaatccagatcgtgttccagaacccgtacggctcactcaatccacgcaaaaaagtaagccagattctggaagagccgctggtgattaatacccagctgacccgcgcggaacgccgcgagaagacgctggagatgatggcaaaagtcggcctgaaaaccgagcactacgaccgctacccgcacatgttctcaggcgggcagcgtcagcgtatcgccatcgcgcgtgggctgatgctcgatccggacgtcctgattgccgatgagccggtttcggcgctcgacgtgtcggtgcgtgcccaggtgcttaacctgatgatggatctgcagcaggatatggggctttcttatgtctttatctcgcacgatttgtcggtggtggaacacattgccgatgaggtgatggtgatgtatctcggccggtgcgtagagaagggcagtaaagaggcgatttttgccaacccgcggcatccttatacccaggctttgctgtcggcgacgccgcggcttaatccagacgaccgtcgtgagcgcattaagctgaccggcgagctgccgagcccgctcaatccaccgccgggctgcgcctttaatgcgcgctgccaccgacgttttggcacctgcgtgcagctgcagccgaagctgaaaaactatggcggacaggagattgcctgcttcgcggttgatcaggatgagaatcaaccggtcggcgtggcagaaaaggtcaactgaggattggcagcgcattctggtgtttacagaccgcacaaaattgaaagcgatgggagcataggcctgtagcaaaacattgcgctccccggacaaaaacgccgggagcgtttttgaacaacgcaacgcgttggcccggctacgggcgcccctcagggatgaggtgcgtaatcgcccgcgctgagcctgccagggatggcgtcttttgcgtctttgcgtaaggcgtatgcccccctgagcctgttcgcgatcttaactccccagccgaaggctcttttctggagcctttttttatctcaactcagctgcaagccgcactgctggcaggtcagcgagcactttctggttattcctcctctttttccgttatcagtcttaacctgttttccttctggcgatatttgcagtgaaaaaagataaatagcctcaatcacttatggcagaaatgcgattgttttgcgcctgcggcagcctgaacgctctttgaaacgctgtttacaggagtcagcctggtagtgccagaggttgtaagagcggtattttctgaaaaattattaaaacagtgctaatgaatttaacttaagtattacttattaattatcagcggtaatgactcagcaaaggctttcttccgccactattgaatctttatgattaaacaatttgattgaaattgctttttttgtaatcaggtttttctgactgatattaaagggatgtgttatattccaggaaaattcccaccttgttgcaggccatggccaatgaagaataattacgatgatttgcagcgttttaaagagaaaacgcaaacgctcgacatcgactttaaagatatgtctggccagacgcaggaagcggcggaacacagtaaatgggcattgattcgccagctggcgaaagaagaacatcagacaccgtttggcggcggcgagcgtattgacctgccgcaacctcagccgctgcgtggtgatgagtttacggctccaccgcctggggcaccggcacgacatgccgcactcactgcgcaaccggcaatggcagctcgcacctcgattctcgatagcctgtcaggcagcaacctgccagcaaccagcacgactgcacgcggcccttcatcactctttccgccaccgccaccactgcaaaaagcggccgtggctgagcctgcgaccccgctgcgtgctgagccggtccggcctgccgccgtggcggaacttcagcccgtcgtcgcacccaccgccacccattctgagccaggacgatttggtgcgctgttccgctcgcgcgagattaatctgccgaaagaaaccttactcaaaccgttactggagaagattgcgctatgccattagtttgtgtgtgctcgccgaaggggggtgtggggaaaaccacgctggcggcgaatctggcctggagtctggcgcgtttccggtagcaaagttctggcgattgattttgatgtgcagaatgcactgcgtcttcactttggcgtgccgcttcatgatggccgcggatttgtggcgcgctcagaagagcaggcggactggagccagtcgattcttaccactggcggcaatatctttgtgctgccctatggcgacgtcacggagccgcagcgcgaacggttcgaagagaacctgatgaaagatccccactttattaagcgcggtctggatactgtgctcaattatcctggtctggtgatcgtggctgatttcccgccgggcccgggccccgcccttaaagcaatgacgacgctggccgatatgcatttagtggtgatgttagccgataccgcatcagtatcgttattaccgcagattgaagagaaccggatgatcggtaagccgctcaataacaagcagggtcactattttatccttaaccagtgtgacaaccgccggaatatcaatcgcgatgtcaccgcgtttatgcagcagcgcctgggcgataatttactgggcgtggttcaccgtgatgaaagtgtgggtgaagccaatgcttcgcagcagtctgtttacgatttcagtcccgcctccgcagcggcatttgatattgaactgatcgcgaaaagggtcagcagcattctgaatatcaccgtgggtaatggcgaagttcaggctcccatccgcacaaaccacttttagtcggcttccgccaggcgactgacttacacagctcttctcagggtgaatcatgagtaaaatcgggttttacctgctgctgctggtgcttgcacccgttgcggcggtgatcatcattacgccaatggacagccagaaacagtatatttttggtctgatcagcatcggcatgatgtttttattgggtttcagcaagagccgcaaaataacggtggtgatggtggttctctctgcgctgatgtccagccgctatatctggtggcggaccaccgagacgctgcactttaattccgaagttgaagctatcttaggcattggcttatatctggcggagctgtacgtctggctgatcttaattcttggcttcctgcaaaccacctggccattaaaacgcaccatcgaacccttaccggacgacaccagcctgtggccgacggtcgatatttatgtgccttcctataatgaaagtcttgatgtggtgcgcgacaccgtactcgcggcgcagtgtatcgactacccgcgtgacaaaatcagggtctatctgctggatgatggcaagcgcagcgagtttgcccgctttgcggcggatgtcggcgtgggttatatcacccgtgacgacaataaacatgccaaagccgggaacctcaaccatgcgatgaaaatcaccaaaggtgagctgatttgcatcttcgactgcgaccacgtggcgacgcgcaccttcctgcaggcgacggtcggaccgttcctgaaagatccgaagctggcgctgctacagacgccgcactacttctattctcccgatccctttgagcgtaacctgcgcgcagcacgcagcattccaaacgaaggctcgctgttttatggcccggtgcagcagggtaatgataactggaatgccactttcttctgtggctcctgtgcggtgatccgtcgttcagcgctggaagagattggcggttttgccgttgaaaccgtgaccgaagatgcacacaccgccctgaaaatgcagcgactgggctggggctcagcctttttgtcgatcccgctggctgccggtctggcaacagaaacgtctgggcctgcatatcattcagcgtacccgctgggcgcgtggcatgacacagattttccgcgtcgataacccgctgtttggccgtggcctgaagtggcagcagcgtctttgctatctcaacgccatgctgcatttccagtttggcctgccccgcgttgccttcctgaccgcaccgctggcttacctgctgtttaacctgaatattattcactcatcggcctcgctgatctttgcctatgtgctgccccatctggtgatgtcgctctacgttaactcacgaatgaatggccgtttccgttacaccttctggggtgaaatttatgagacggtgatgtgcttccatctggtgatcccgaccattctgaccctgttgtcgccaaaacatggcaagtttaacgtgaccgataaaggcggcgtgctggatcagggcttcttcgatttccacatcgtgcgtccgcatgtgattgtggcgctgctgctgggcattggcattgtagccggcgtggtgcgcgccgtgatgcatgactattttggcgtcgatccttacgttatcgcgctcaacgtcggctgggcgatcttcagcctgatcattctgatggcggcaattgccgtggcgcgcgaaaccaagcaggtgcgtaaaaccatccgtgttgaagtgcaaatcccggcgattattcattacgccagcggcatttcatcgcgcacccagaccagcaacctttcgatgggcggcgcgcagcttgatgcacccgatggacgtcatgaaactgatgagattgaagagattgatctgctgctgaaatccggcgcgatcactatcccggtcagtcagatttccggcgatgatgagagcatccgtctgcgctttgaggcgatgccgctggcgcgtcgtcgcgagctggtccgtgtggtgctggctcgtgctgatgcctggattcagccggagtataagcaggacaacccgctgatttcgctaggcactattatccgtaccgtctttgagctgttctggctgacctggaaaggccgccacgataaacgtaaaaatgtcgacccggttgccgcggcggcgaaagaggatggggcggcatgaagatcctgacgcaaactctgctggccagttcactgaccgcagcgttatggctgacgcccgctggcgcggaaacgccggttactgctgataacagcagtgctgcgccggtaaacagttcagctccgacgccgtctgatgctgcttccaccacgcagcctgccagtgcgccggtaaacagtccggctccgacgccgcctgatgctgcttccagcacgcagcctgccgatgccaccgtcattgcacccgcgacaaatcaggctccggccagcgatgcggcatctgtggtgcccatgaataatggttccacccagacggcaggttcagaccaggtagcggtcccggtcagcggtggagagtctgcaatgccgtcagtgtcaccagcggcaaatgcgccatctgcgacaccgtccgcagaatctgcaccggcatcggcgccacagagtgcatcacccaatgccatggcacccccggtgaacgcctcttacgccccaggtagcgaggcgacatcacaaactcagccatcttcagtgaccggtgacgcgacctcaacgcctcagaccgcgtcatcgaccggtgaggcggcggcttctgcccagaccaccgcgccgatggccgccaccggcgcggtgacccaagacagcagcgcgctgtccgcggtgcccctgccgcagggcctgagcagtgccgatcccgcgctggaagcggccgccagtgcgctgccctacgcgccaggtcaggtagctgcaccggttgcagaagcgcagccgccgatcgcggctgccatcaatcagccaatcagtagtgttatttcagtggcccagatgggccagtcgcgcggcatcacgctgaccggcggccagcttcagtcgggcatcacctttaccctgcccggcgatgaagtcatcaccaatgcgcgacttaatctgacgctgcgcgtctcagctgcgctggcggcacgcaatacgtcgctgcaactgatgctgaatggtcagccgctcggcacgctgccgctgggtgcgacggacagcgatgtcagcgactatgagctggatattccggcggcgatggtggtgtcggcgaacaatctgagttttaaaatcaatgatgcggacaagttgctgtgtgaaagagagagcgcacagcagtatcaggtcaccattctgccgaacacatcgctgcaccttgagggtcagaagctcaatatcggcaccagcctgcgtaatttcccgcgccccttcctggatcctcagcggatgacggcgtccaccgtgacggtgggctttgccagtcatgtttcagccgatgctgtcagcgcggcggcactggtgacatcctggctcggcattcagagtgattatcgcggcatccgtttcccggtggtgcgcggcgaactgccggaacacaacggcatcctgtttggtcatcctggtgaccggatcggcaccctgactttcccggccagtaacggtccgatgttgcaggtggtggataatcccaataatccggtttacaaattgctgctggtcagtggcaacaatgaggagcagttgcgtcaggcggcgaaccgtctgacgacgcagccactgacgacggatgagagtcatctgcaggtccccgcacagactattgcaaaccgcaaaccttacgatgccccgcgctggattaacactgaccgtccggtacgactgagcgaactgctgcgtaaagatcagagtctgaccagtagcggcatctggcatgatgcgctgcgtgttaacttccgcgccgcgcctgatttgttcctgtgggatggcgacacagtgccggtcaatctgcactatcgcttcccgtccgaaagctggatcgatgaggataattccttccttaacgtcatgctcaacggtacttttctgcgcaatctgacggtgaacaaagtcggcctgctggagaacgcctggcaccgtctgggcggtgatgcgcgtcaggagcagtatcagcttaatctcgaaccctacctgatctatggcgataaccagctggcgctctacttcaatatcaaaccgcgggctgatgcgccctgcggtgtgttactgaacaacaacatcaagagccggattgaagaggattcatggatcgatctgagccatacccgtcacttcagcatgctgccgaacctctcttactttgtgggtgcctctttcccgttctcacgtctggccgatttcagccagaccacgctgctgctgccggaaacgcccagcgatgctgaactgtcaacgctgctggatctggcggcgcgggctggtaaagccaccggtctggcgctgacacagaatcaggtactgtttggcctgccgactggcggaacccatctggcgcgcatacagcagagcgatctgctggcggtgagcaccaccggcaacagcgcctttaaccaggcgatgctggcggcttccccttatgacgcgactggcagcacctttggggtgaaagagcccgatacgctggaaaaattacgcggctggctgaccggtgactggagtcgtcagcagctggatgccgatcgttatttctcctccaacgaagcgtggcgaggcttcctcagctatcgatcgccatggaaccgcgatcggctggtggtgatgacggtggcaaccagcgacgatcagctgttgcgactgcataacgatttgagttcagcgcagattaacgccggcattcgtggcgataccgcgattattaccgatgaaaacggcattcgcagtttccgcgtcggcgcgcagtttccccagcggtgagttgccctggtacatgatggtggtgtggtatgccaaccagcactcggtgctgctggcggtggcggcgatgctgctctccgcgctggtgggcagtgcggcctgggtgatgctgaagcgtcacgcctggcgacgtctgaaccctaagcaggaccgtgattccggcaggaagtaaggataataataatgaaaaaaaatctgttaagtgccggtatccgtaaggcgttgctgctgggcagtgcgctggccctgtcacagccgctgctggcggcggaaagcgccaacccggcgttgcaggcgctgttcgatcaggcctcttactggcatcagaaagcgcatgacgacctggcgacagcttcactgcaaaaggtgctgatggttgaacccaacaacactcaggcgctctacctgctggcgctctattcacagcagggtggcgacactgcggcggcggcgcagtatcgcgcccgtctgagtcaggtctcccccaacgatccgcatcttggcgagctggataacgctcgccagatgcagaccattccgcaggcgcagcttgcgctggcgcgtcagcaggcgcgcagcggcaacattccggcggcgttacagacctggcgcaacaccttcagcggcaatgcgccaccacccagcgtcgcggcagaatattatctcaccatggcgggcgaccgtacgctgctgccccaggcggttgaagcgctgcgccagtttgcggctcagcatccgcaggacaccggcgcacggctggcgctgggtaaagcgctgacctatcaggaaacaacccgtcgcgaaggcattgaggtgctgagttcgctggcgagcggtaatcaggatgccgatcgatcgctgcgtcaggcgctgctgtggctcggtccgcagccgtcagatgcggcgctctatcagacctggcagcagcgtcatccgcaggactccgccgtcatcgactactaccgtaaaaacgtcggcggcgcagaaaaaggggccggattcagcgcgctgaacagcggtgacgtcggcggtgcgcagtccagctttgaaaaagtactgagtgcgaatccgcaggatgccgatgcgttagcgggcatgggctatgtggcccagcgagccggacgttatcaggaagcggcggattatctgcagcggtctgctcagctcggcggcgatcagggttcatcgcgtcagcagcaggctgacgatgcgcgtttttatgcacagctggccagcgcccagcaggcactgaaaagcggagacacggcgcaggcgctgacattaagcgaaccgctggtgcaggctgacggcgaaaaagggctggccgccagactgttccgcgccgacgtgctgcgccgcaccaatcagccacagcaggcggagcaactctatcgcactattctgcaaagcgatgcggataaccgcagcgccaaagaggggctgttctacgttctgcgtcagcagaatcggggtgccgaagccagtacgctgctgggtgcattgccggacagcgttcgccagagcgtcacgccacgggccaatgaagccgatgcgctgcgtcagcaggcgaagcgtcaactggcggctggtaacaatgccgctgccatcgcgacgctgcagcagggcattcagcgctatcctacggatggctggctgcggctcgatttagcccggctctatcgtcagcagggcgacacgctgctggcggctaacgtgatgcagccggtgatgcgcaacggggccagcaccagcgagctttatgcaggggcacttaacgccagcgaaagcggcggctggcagcaggccagcacgttgctgtcgcgtattcccgctaacgcgaagacggcggcgatgcgtgaactggcgcagcgggttaatttcaatctgcagatgagcacggcagaccagtatctggcgcagggcgcgacggctgccgccgccaataccctgaaggcgctcacggttaatccacccaccaacccggttgatgccggaaacctggcgcagaagctggcgcaggcgggcgatctcaccagcgccgtttcggtggtgcggactaacctgcagcgtggcgtgcagggcaatgcgggcgattatgccgcgcagatgacggtactgaatcaggcgggcctcggcagtgaggcgcagcgcttcctcagcaacccggaactgcaggcgcgcagtacaccaacgcaactggccggtattcgcaatggctatctgattaacgaagtggatcgtctgcggcagcagcgtcagtacgcggtggcgtatgacaagctgattggtgcactgcagcaggatccgcagaaccgcgatctgatgttcgcgatggcccgtctctaccaggacggcaagatgaaccgggatgcgggcgtggtctatgactacctgatgacccaggatacgccgacgcaggatgcgcgcgtcggggccatcaacgtcgcgctggcgcagaacaatgtgcagcgcgctaatgagctgagtcgcggccttaacagtacgactcagacaccggatcgtctgctgctgctggcgcgggtcgcggaagccaatggcgagcattctcaggcgatgacttatctgcgttcagcgcgcggtcagctgattggcctgcagggcgcgcagcctggcagcgtgccgaccgtgggcggactggcgctggcggataatccgtttatcaaccgtgatacttcgccggtgggacgttcaccatccagctacggcaccgtgctgccgtggcaggcggcaccggcgggcgttgccgctggcgtgacaacgcagggcgaaccggccgcgggcagcgaaaccgttgctcaacagtcacagattctgcacgacgtcgacaccatgatggattcgctgcaggaaaaaaccggcagctggagtcagggcatggtgcaggtgcgcgggcgtgatggcgagtcgggcctgagcaagctgacggaagccaaagcgccgctgaccttctctaccgtgccgtttgaaacggcgcgcctcgactttaccgccacgccggtctcacttacggcgggcagtggcgcagccgatgcctggcgccgtttcggcaccaatgcgctgagtcagggcagggtggtggctgcaggcggtgcaacggtgaatgacctgccgaacgccaccaccgattcgcaaaccgcctcaggtgtggagctgaatctggcgctgaagggcgacaggtataaagtggatatcggcagtacgccgctgggccaggatctcagtactctggtcgggggcgtacagtggtcaccgaaactcaccgacttcctgacgctaatcctgaccggtgagcgccgcgcgattaccgacagcctgctctcttacgtcggcgcagaagataaagccagcggcaaacgctggggacgcgtcaccaaaaacggcgctaacgcactgttaagctacgacaatggcgatgcgggcttctacgccggcgcgggcgcttacagctatctcggcgagaatgtcgccagcaacaacaacctgcaggcaactgccggtgcctacgttcgtccgttccacactgacgatcgcgagctgaaagtgggcatgagcctgtcgtggatggacttctcgaaaaacctcagctatttcagctacggtcagggcggctacttcagcccgcagaactatgcgtcggtctcgttcccgatagagttctcacgcaagtttgacgatttaaaagtcaatattggcggtgcagccggttatcagacctacagtcaggataagagcgcgtacttcccgtcggatgccagcctgcagtcagagctggaatcccttgccgccagcggcagcgtgaaagacgcttactactccggcggcagtaaaaacggcatcggctacaacctgcacgccggggcggactacaaactcaataaagatgtgacgattggcggccagctgggttatgacacctttggtgactacaacgaaagcagcgcgcagctctatgtccgttacctgttcggagagaagtaatgagtgagcattcggggttatcgcatccttatcagccaggctggtttgacctggtcagcgtgctgattgacgggatgatcgccaacgccggtcatcaggaggcggaagcctttctctataagatgggggaatcgctggcgacccgctatcctttgccagagtcgcgtaccgtgcaggatctggagcgcgagtgcaatctgcaactggcgcgttttaactggggctttgtgcagcttcagccggaagagaaggcgctgctgattgcgtatcacgccttaccggcaggcgacaacatccactctccggctgactggcaggcggcgtttggtgcggtgatggccggacttttttcgggctggttgcagggccagggcggcagcagcattgtgccggttacgcttgaactcaacgatggcagcacgctgcactatcgatatcaataggatcggaaatgaaacgtaatccactctggcgggtctggctctgctctgttttactgctggcctgcagcgcgcaggcgagtgccagcggctgggagacttttaaaagtcgctttgtgacctcagaagggcggatcactgataccgccaataacaacgtcagtcataccgaaggccagggttatggcatgttgctggcggtggccaacgacgatcgcgccaccttcgatcggttgtggcagtggacgcgcagccagctgcgtaatccgcagaccgagctcttctactggcgctacgtgccgggcagtgacaacccggtcgccgacaagaataacgcctccgatggtgatgtactgctggcctgggcactacagcgtgctgcacagaaatggcaggtggagagctaccagcaggaatctgaccgtattcagcgcgccattatcaggctggatgtcacgagctttggcggccacaccgtgatgctgccgggtgcgcagggctttaacaaagtcagttatgtggtgctcaatccctcttacttcctgtttcaggcgtggcgcgagtttggtgaacacagccatcttcagatctgggataagctgattaacgatggctttgatctgctgggtaagctgagctttggcaaaaccgggctgccaatggactgggtcgcactgaatgccgacggttcggttgccccggccgtcggctactcgaaccgcttcagttacgatgcgattcgcgtgccgctgaacatctggtggtatgacccgcacagtctggcactggtgccgtttcagcgcgtctggcagggttacagccgcatgctgacacccgcctggttcgacgtgctggcgaatgccccagcaccttaccatcttgagggcgggctgctggcggtacgtgacctgacgctgaatgaaaccggctatctgagcgataagctggctgcggatcagaactacttttctgccagtctgcagttgctgacctggcaggcgtttcaggagaagcgctgataactggcagaatggcggcactggccgctattctgccatcgacagccacgcgctcaacagggagcaggcgccgcgcctgacccgcctttaactgccgggtcacggctctgcaacccggcggttacgcgttactgcggataggcgacccagtcgccgccgttcagcctgatccagggtttgccctgatacattatcaccactgcaccgtcattttccgacaccaccggcgtctgtggcagcttgtcagtcagcaccgacatattcacattcggggcattaaatacctgcccatctacgacgcgcgacacaatctctgacaaggccagcaggctggtcggcgcatcaatgttcaatggctgagcctgatgcggcgccttcattccgacgaacttaatgcccaccggtacgtgagtaatatccgggctgggaatatcgcgcaggccggacatctgcattttgtctccctgcagcgcggcaccgtgctcgggcactaccagtaccatgacgcggcggcccgacttctccagctgcgtcataaaggcatcaagctgatcgaatagtagttgcgcgcgcggtttccacggtgccgttttggtgctgccgagttcacgggtgccgtcgtgcagcgggatcagattgtagaaggtggcgctgcgtgcatcgctgcttttgctgcggtcgtccagccagcgctgcatcagttgcgcatcgttgaataccggcgagccgtcgaatgatgtcagtttctggtgcgatacccgcctgtgacatcagcggtgcctgaatatcgccgccctcgcgcacctccttcaggtagttaccgaataccccagtgtgatccatcatcaactgctctttaaagcccagcttcgccagattgtcgaacagatagcaacgcggatcggcaggtttatagagatcgctatgcgaggtctggccacaactggcacgcagcagtcggatacccgccggtccgctgtagctggttgcggcgttgtaattgctcagcatgatgtcgaaatgctgccacagcggatggttacgcagctgagaagcatccatatcagaccaggcgagcgaacagatattgatcaccaggatgtcgaaaggctgcgaatctgcgggcagattgtcgggaaaatgcgtcacgcgctggcgttcactttcatgaaagcggttcagccaggcggtgagattcgcgctggtcggcggcgcagactgctccagtccatccggcgtggcggctggctggccgccgctgggtgtctgattcaatacgacctgtggcgtagccgtccgggtcggcagcagcgacatcgccgggccagcaatcgtcagcacgttaagccagatcagcatcagggaaaccagcactgtgatgcgaacccattgtgaaacaaacagatagagaaccagcagcacaaaggcggcccccaccatttgccagttaataaagcgatcggccaggtcgagcagataggccgcagagaagcccgccagctgatcgccctggctgagtatgctgctgagccctggcagccaggtgtcgtgccagaacagcgcgatgccaaccggaatcgagatcaactggcggatgcgatgcaggcgcgccgagggtaacggaaaaagcagccaggcgagaaacaccagattgctcagggcgtgaaaattgagatagccataccacagcaggccgaatttcagtaaaaagtagaaattccagccgcccagtccgcgccaggaggaccagaagcgggaagaggaggccgccgcgggttgatcagtattcattaattttttctatccgtttcagaggattgacgctgccagtgaccttccgatttaagcgcgcgcgctggcaacaaacgattcatgatgccgttccagcgatggggtagccatttttgatataatggctttaaaaacagcaagataaccagaataagtagcgcaatttgtacccagtccatcagattcatcaggctttgttctccggcagtaaagtgatgggctgcggtgcagcgcgttcatgtgtttcaggccggctctcaacggcggcgcgggccgtttctgataccggagccagatcctgaattgccatcggcgtcagtttcttaatattgctgacttccgcgaggatctgattatcttcaaaccagaccatccggttagcaaacagctcgtcgtgaggcagagaaaagatatatttcaatgccttatcaaggtcgttatagcggcaggaagagaggaaaaggatgacacgatcttccagtaccgtgaccaggtcgccaaagcggcgcggtttacagagcgtcaggatttgctgaggcttaagctgtggcacaggccgcaacgcgaccagcaggcccttatcattttccggcagcagggtattgctgatcaactggccgactgactgacagaaggcatcgagacgcaggtagcctttctcatgcagaggctgcaacgaagcggttaacgcctcaagactggcgggaacgcgacggttaaacacctgtccctgaaggccctccagcgtggtcagaaagcgcgacagtgtggcgttggtcgggacgatggcgtttacaccgcaggccagcagcagacgtttcgtcgctataacgcaggcttgcacccatctcgcgcaccacaattttcagtccgttgccgcgtgtacgacgcaggctgtgcaccatcttcgccagttcgttgatatattcgctgcgggtcaggctgaaaatcaccgttgcggcattggcctgctgcgcccgcaaccagacctgctcattatcctcgaacagttgccactggcgtgaaagcggcggcgcgccctccagcacgatgttgtccgcaagataatgctgctcgtcgttgaggctcagcggttcctgcttttcatttaaggtaaaaaagcgttcattttcacagcccagacgtattgcccgatcggcaagcaggcgttccgcggcataccaccagttaattcgatactgccagctatcctgctgaaagctcaaatgcgcaacgccatccagctgacgaaaataacgctgaagatgattactcagatttattattgtggtgccggaggtcacgattaaaagggtgagctttcttttatgcagcgtctgacgcatgccctttatccagcgggataattctgcgtcatcaagcttatcccattgcgctgcgttgctattaaatatcactaacccatttttactgccgagcgtgcgcagaaaatcactttccagctgcaacaaactgcctttgcttttggaaagagaaaacagcggaatacgatcgggtccgccaggtgggtcgggcgtcagcaaatcacgcggcggctggtcagcgctgatcagcgttacggcctgctgatgtgaaattacctgtcgaataaaagtgcgggcgtcatcctgccgcgcacaggtcacccaataacagccaggcgtttgcaatgccgttaattcaggctgaacatgcaacagccccagcgaaaaagaatttttcatattgaattcgttatttttccagtccaggctagcttattatagacaggccgggatgtaacctgagaaatttaaacattgctaatcacaggccggctcacattgttctgcaattgccgcgtttctggaaatatttttcaactttcctttacgcgtacgcgcagtcggtcatcctgagtgtgacgttgttttatttttggcgaacagtaatgaaaaaccacaatctctataaccctgttgccgctgatggcgatcgtcaggatgatattagcgcgttgcgcgatgcgttttctttgcactctttccgctatgtcgacattgcgcgtgaagagcgcctgaaagcgatcgtgtcgcgctggccgctattagcggaaacccttgccagccagtctgagaccgatcgctgatgccacagatcgcgcttcagggcgtacggggcggcgtcggcacgacttctctttgtgccggattaggctgggcgctggcggcactcggcgaacgagtattgttgatcgatggctccccggtcagccagctcggcgtgcattttaatctgcccgctcagcaggataatggctggatgaaagcactgtgtgagggcggtgactggcagcacagcgggcttcgctatcccgatggtcctgatttgctgcctcacggggtgctttcccatcagcatgctttgactattgccagacagaatgaggcgatcgccgcgccgctgctccaggcattaccggacctgcgggcgcgctatcagtggattattttcgatctgcctgccgataccctgccctggcatgaaacgctctatccgacgctggacagcctgttgtgcgtcactcagccagacgcgaattgccatttacggcttagccagcgccagtttccggcgcgcactcgttttattatcaatcagtttaatgccaacagtcgtctgcagcaggatctgcatcagctctggatggcctcgctgaatccgctgataccgctgctgatccaccgggatgaggcgctggcagaagcgctgatgatgaagcagccggtcggtgaataccggccacatgcgttggtcagtgaagagatcatcacgctggcaagctggctgctgctcaatctgaatggagtgagctcttgaatccgttgtgctggctgttaacggcgcccgcctggcaatcgctgcacaggggctataccaccgcgcgaggcaatggcgcgtcccgcttcgccagtgcgctccatctgttctggtcggtgctgggcctgatgctgcttcgcttcgaaacgccaggctggcagcggattattcagcagcgccgccggctctatccgcacatttcgccggagcggccgcgaccgctggatatcctgcgttatctgatccagacgctgtggcttttggtgatcctgccgcagagcgatcgcgctcgtggcggtttccgtggcctcggtgcgctgtctggctggcgccaccatggctaccgctggctggacaaggccgttgcccactcacagacccagggaatcgatgtgcgcatcgaacactggctgaagcggctgtcgccgctggtgcgacgcagcctcttcgccgtcactgccctgtttgccacgttgctggcgctgctctgtatcagccagccgtttggcctgatgacgcagtttatctttgtggtactgctctggagtctggcgatgctggtacgacgcatcccggggcgtttcccgaccatgatgctgattgtgctgtcgctgaccgtatcgtgccgctacctctggtggcgctatacctcgacgctgaaactgggacgatccgctgagtctggtgtttggtctgctgcttattgcggcagagacctacgcctgggtggtgctggtgctgggctattttcagacgctctggccgcttaatcgtcagccagtatcgatgcctgtcgatcgggatcagtggccaggcatcgatctgctggtgccaacctacaacgaaccgctcagcgtggtcagacccaccatctacgctgccatgggcatcgactggccgaaagaccgcctgaatatctatctgctcgacgacggcgaccggccggaattccgcgactttgccgccagcgtgggtatcaactatgtcgtccgtcccacccatgagcacgccaaggccggcaatatcaatcacgcgctgaaaaagtactgccgcagcgaatttgtggtgattttcgactgtgaccatgtgccgacgcgcgcctttttgcagatgaccatgggctggtttattaaagatccccggctggcgatgatgcagacgccgcatcacttcttctcgcctgatccgtttgagcgcaatctcgggcggtttcgtcgtacgcccaatgagggttcgctcttttatgggctggtgcaggacggtaatgatacctgggatgccacctttttctgcggctcctgcgccgtgctgcgccgcagcgcgctggatgaaattggcggtattgcggtggaaaccgttaccgaagatgcccatacctcgctgcggctgcaccggcgcggctacacctcggcctacatccgcattcctcaggcggccggactggcgaccgaaagtctgtcagcgcatatcggacagcgcatccgctgggcacgcggtatggtgcagatcttccgccttgataacccgctgtttggtaaggggctgaagtgggtacagcggctctgttatgccaacgccatgctgcactttctctctggcattccgcggctggtcttcctgctggcgccgctggcgtttctgctctgtcatgcctacatcatctacgcacctgcgctggcgatcgccatttatgttttgccccatatgctgcataccagcctcaccaactcgcgtattcagggacgctggcgacactctttctggagcgaggtctacgagacggtgctggcctggtatatcgcccgacctaccaccgtggcgctgttcaatcctcataaagggaagtttaacgtcaccgcaaaaggcgggctggtagaggaggagcatctggactgggtgataaccaagccctatatgctgctggtgctgctcaacctcgcaggggttttgatggcgtttctggcgcatgcagcacggtccggccaatgaggtactgacggtatgggtgagcctgatttgggtgctctataacatgattattcttggcggtgcggtagcggtttcggttgaagcacggcagatccgtgaggcgcaccgggtggagatcgccatgccggccgccattgcacgcgaagatggtcacatgctgccctgtacgctgcgtgactactctgacggcggcgtcgggctggagatgcgcgagccggatgcgctgcgggagaatgaaaaagtgtggctgctgctgcgtcgtggacagcaggagttcagcttcccgtgccaggtgcagcgggtctttggccaccgggctggcgtgcgtctccatcagttgaccactcagcagcatattgaatttatccagtgtaccttcgcccgcgccgatacctgggcgctgtggcaggacggttttccggaagataaaccggtccagagcctcgccgatatcatgatcctcggtttcaaaggttacctgcgcctggcggaatatggcccgccgcagttacgtcggctgtttaacctgcttaccgttggggtgagctggctggcttcgctgttgccgcaaggcatcggacgtgtgccagcttcaaaaaacgcattgagttgatgatatgacgataccgagagtaaacaggtggtttgccgctctgctgctgggcagtgcaacgttaagctgtgccgccgcgcaggaggacgcgcccgcaaacatcaatggtgtaacgcctgtgcaatctttaccgcaggataacggcgcaccgctgcggaacagccaactgagctttgcccagctggcaccgccgcctggcagcatgacgctgcgtggcacccgcactaccggacagattgagttcggtgtgcgcagcgatgaggtggtgacgcgcgcgttgctgaacctcagctttcggccttcgcccgcactgctgccaacgctgtcgcagctgaagatttatctcaatgatgagctggtcggtctgattaccctgacgccggaacagctgggcaaagagatccagacgcagctgtcgatcgatccgcgttacatcgccgactttaaccgcgtgcgtttcgagctggtgggccactacgccaacgtctgtgaaaatcctgccaatagcgcaatctggctggatatcggcaaacagagcggcatcgatctgacgctgcaaaaactgcccctgaaaaatgacctctcccacttcccggaacccttttttgattcgcgggatacgcgaccgctgaccctgccgatggtgttcagcgcccagccggatgtcacgcagcagcgggctgccgccattcttgcttcctggtttggcagcaaaacgggctggcgcgggcagcgtttcccggtgctgtataaccagctaccgcaacagcagcatgcggtggtgtttgccaccaacgatgcgcgcccggatttcctgaaagatctgccgccggtggcgaaacccacagtagagattgtcagccagcccgataatccgtatgaaaaaatgctgctgattctgggacgcaacgatgaggacctgctgacggcggttcagggtatcgcccagggtgagctgctgctgcgcggcgatatctcaaccatcgacagcgttaagctgctctccccgcgccaggcctatgacgcacctaactgggtgcggaccgatcgccgcaccactttcgccgaattgacgcaatatgagaatcagttgcagtctgatggggtgcagcctaatcccgtcagcctgaccctcaatctgccgcccgatctcttcctggttcgcgcgcgcggtatcgacatggatctgagctatcgctataccgcgcctttccagtcggatggctcacggctggcggtcaacctgaataatcagttcattcaggattatccgctgccgccgaaaaatacgacgggtcagcagctgctgcatattccgctgattcagggaatgctggacaagagccatgagctgctgattccggcgctgcgcctcggggtggtgaatcagctgcgcttcgattttgattacgccaacatcaccatcagcggcaacgcggatggacgctgcgaaactgtaacgccgattacgcatcatgtggtggtggacgacaattccagcatcgatttttccggctatcgccactacatcgaaatgccgtcgctgcgcgcctgggcgaatgcgggctttccgttcagccgctacgccgatctggcgcaaaccctggtactgatgccgccaaaacccgatgcagagcaggtcagtacgctgctgaatacgttgggcaatatgggggcgcaaaccggctatccggcgctgcgcgttcagttgaccgatgactgggccacggcgaagaagcaggatgtggatctgctgatgatcggcgtcatccccaaagatcttcaggatgaccagcggatcccggcgctcgttgacgccaccgccagctggctgaaagagcctgtgcgacaaatcactccggaggtgaacccgcaaagtcagcgcgagcaggcggcagaaagcacgacgactatcagctcccgcggcccgctggcaacggtgattggcttccagtcacctttttacgatcagcgcagcgttgtcgcgttgctcgccgatggtacgccgcgcagctggcagttgctcaacgaggcgatgggtgacagcggcaagcgtggcacgatgtctggctccaccgtggtgatccgcgagtcaggggttaacagtctgcgcgtgggagagagctactacgttggtcatctgccgtggtgggagcgtctctggtcgctactctccgtccatcccttctggctggcactctgcgcactctttgtagtggtgctgtttgcgctgatgacctggcgtctgatgcgaattattacccgtcgtcgtttactggatgaagatgaataacgcacaggtgctgcgggcaggcatgctgctcggcgcactgagtgcgctgccggggctggctgcaccggtcgacggatcggaggtgtcgccggtcgaatggttgctgtcacaggtacgcaccggcgagtcgaccaacaaatatgatctggtgcagcaatcgctctaccggcttgagaagatcgatcccgataatccgcaggtgctggcggctcgcctgcggctggcgctgcgtcagggcgatatccctaaagcgcagatgctgctggagcagctgaaaaaggttgcgcccgactccgccgcgacgcgtgaatccgccgtcggcctgacgctgatgtcgtcggatgggcgtcagcagctgcagcaggcgcgcctgctcgccacctcggggcgcctgacggaggcgaaaagtgcttacgatgcattgttcggaggggtttttccggatgcaaacacggcgctggaatactggcggctgctggcacgcattcccggtcaggagagcgtcgcttaccagcagctgcaggcgctggagcagcgctacccgggcaatatcggggttgagttgcaaattgcacgcatggcatttgatcaacagcagccggaacaggcgatagcgcagttgaaaaagctggcaaacagcaatggcggacgcgccgctgccgccgatctctggctgcagcagatcaacgatcagccggtcagtgacagcagcgtggcgcagttaaatgcctacctggctgtttttaccgacggcgacgcacaccagcagggcgcggatgtgctggcgaagcagcaggcgcagctcgccgatcccgcctatcgcgagcggatgcgtggcctggcgctggtcgaggcgggcgatgtgaataatgcgatggcagcgcttagccgggcactgaaggataaccccaacgacgccgaaactgatgggtgcaatggggcagactcaggcacgcgccggccatcgtgacacggcggtgctctggctggaacgcgccgttgaggcgggcaagcagagcacgctgatcggcaaatggcagtcactgctgcagactaaccgttactggctggcggtcgaacagggcgacaaggcgctggcgcagcatgacgttgagggggccgaacgcgcctaccgcgccgcacagaaaattgatagcaccgacagctatgccctgattggcctgggcgatgtggcgatggcgcgcaaagatgcggcaggtgccgaactgttctggcagcatgcgctgcggctggacgcgaccaacaccaccaccgtgcgtcgcctggccgggctttatcaggccgagtcgcctgcccgcgtcatgcagtttatcagtacgctacccgccgggcagcagcgcgagatggcgggaacgttgcgcgcgctgcgcagtgacagcctgcgcgccgaggccgatgcactcgcccggcagaataaatggccgcaggcggcagagaagtatcgggcggcgctggcgctgcagccggatgacgtctggctcagttatcggctggcgagcgcgctacgcgacggtggggccaccaaacaggcggatgcgcagatcgcgacgctgcaacagcagcatcccggcgatgcgaccgcgctctacgccgccgcgctctacctttccagccgggataatgatgacgccgcactggcaacgctgcatcgcctgcctgaaacgcagtggaacagcaatatgcatgagctggctgaccggctcgggcaggataaaatttttgccagcgccgaagcgcttcgtgcggcagggcaggagcgggcagcggtgacgctgctttaccagcagccggtttccagccgacgcgacctgacgctggccgactgggcgctggctcgcggggacgcacagcaggctctggagatctatcagcaggtgctgtcaggtgaagctgacaacagcgacgcagcgctgggacgaatcgaagcgctggtcgcgctccagcgcaacagcgaagcacgacaggcacttgagcagcagccagcccagcccaacactcttaatgccgatcgccgcgccgcgctggcatggcaggcggtgggcgaaaccacgcaggctgccgtgcgctttgccagcctgaagcagcgcgctgcgtcactgccgccttcgcaggataaggcactggtgtttcgtgatgcggcacggctggagcgcgcgcagcagcagccagagatcgcgctggcggattatcgtcaggcgatgacggccagcggtatcggcagcggcgaaagtatcagccgcgcgacacgctctcaggaacaggatgactggctgaagcgcagtattcgcagcgacaccgcagatctctatcgtcagcgtgagaccacgctgacggtgcagcaggattattcgcgcaataagggtacggctggggtctccgactttactgcccataccaccatgctgcaggcggaaagtccgtttgccgacggacgcggctttttccgtctcgaccgggtggacgtctcggcagggagttttaccacccgtaacggcagcttcgacgagcagtttggtagctgtgacgacgccagtttccggcggatgcagccgcgatgccagtcagcgcgccgagggcactgcgctgggcgtcggctggcataatgaccgctggtcagcggatctgggtaccacgccgctgggctttgaggtgaccaactggaccggcggcctgagctggaaaactgacgtcagggatctgggcgtgacgctgaccgcctcgcgacggccgatcgccagttcgctgctttcctatgcgggcgcgcgcgatccatcagccaacggtggaaaaagctggggcggcgtagtggcaacgggtggcagcatcgggctgagttacgatcagggcggcgcacacggtgtctggggcgacatcagtgcgcatcagatcaccggtaaaaacgttgcggataacagtcgcgagcgcttaatggccggctactactacaagctcattaatagcgataatcgccgggccaccgtcgggcttaacagtatgctctggcactatcagaaggatctcagcgattacaccttcggtcagggcggctactacagtccgcagcagtatctctccttttccgtgccggtcacctggcgacagcggacagaaaactggtcgttcgacctgggcggctcggtttcctggtcacattcgaaaaccgatgcgcagcagcgctatccggtcaatcccggctttacccttgccagcaatcccgtttccgccagcagcaccggcagcggcacggggtatacgctgcagggcgtggttgaacgtcgtatcacgcccgactggtttatcggggtgggcgtcgatattcaacaggcgaaagactataccccaagtcatgggcttatctacgtgcgttactctgccgctggctgggaaggggatctggatatgccgccacagccgctgaccccttacgcggatttcaaataatcccggcctggaaaaagccggacttttcagacggtaaaaaagtcagtttatgggatatactggcgggcattgtactgtctgctatctgggcttttttcatcgtcaggagaatatttttgcgcgtaagccggtcacttacgataaagcagatggcgacagtttcgctggttgcggttatcaccatcagcatctttatcgtcatccaactgtttcattttgtgcagcagcgcaggattgactacgcccagcagatggagaatatcgcacataccgtccgccagccgctgtcggaagcggtactgcgcgccgatatttctcaggccgaacgcattctccattcactgaaacctgccggtattttatcgcgcgccgatgtggtgctgccgaatgcgtttcaggctctgcatgctgacttcgaaacggagaaaccggtgccgcgtctggtggcgcgactgtttgagctgccggtgcagattaccctgccgctctattcagtggaaaataccgggatgccgaaaccgctggcctatctggtgctgcaggctaactcgacgcgcgtctaccagtttattctcagcacgctctcgaccatgattatcacctatctgctgctggcactgatcctgtcagtggcgatcagctggtgtatcaaccggctggtggtgcatccgctgcgcaatctctcgcgggagctgcaggaactgccgccgcagtcgattctgacgcataagctgtcactgccgcagagccaccgcgatgatgaaatcggcatgctgatccgcagctacaaccgcaatcagcaggtgctggagtcgatacatgatgagatgagccggctgaccacccattttcccgtgaccgatctgcccaaccgtaccctgtttctggcgctggtcgagcagttcatgagcagcccggaacagccgctggggctgatggtgatccgcattgaaaccctgcaggaagccaatggcgtattgagcgatgagcagcgcgatacgctgatgctgacgctggtggagaagatccgtaatacgctggatgaccatactctgctggcgcagaccgggaccagcgactttgttctgttaatgaagcgcgccattaatccgtttccgcgccctgcgtctggcccgtaacctgatgattcgccttaatcagccggtcaacctttatcagctgcagctgcgtcctaacgtcagcattggtctggcgctgcgcgatgatcagccgctgagcgccagtgatctgcttggccgcgcgacctcagcgatgatgtcggcccgtcatcagggcaaaaatcagattctgttctttgacgccgcgttaaccgagcgcgcgcaaaaacgtctgacccaggagcatgacattctgcaggggctgcacaatgagcagttcgccctctatctgcaaccgcaggtcgatatgcgcaccggcacgttagtcggcgcggaagcgctgctgcgtatgcgccagccagacggcagctacggtctgaccgaagagtttattgccagtgccgaagagattggcgtgattagcgcgattggccgctgggtgtttgaagaggcgtgccgcattctggcaggctggcagcgacagggcattatgttgccgctgagtgtgaatatttccgctgtgcaactgcgtgacacgggcgtggtctctcatctgcaatccctgctgacgcgccaccgcatcgcacctggcaccttcgtgctggaagtgacagagacggctcagcttgatgatgctgaacaggcgatatcgatgctgcggatgttgcagcagaccggcgtagccgtggctctggacgatttcggcatgggctactccaaccttaactacctccatcagctgaaagcgttgccggttaacaagctgaagatggatcgcagcttcgtggcggcgctgccgcatgacgacaccatggtctgcatcgtggcggccatcgccgagattatccatctggaggtgattgccgaaggcgtggagacagcagaacaacgtgactggctgctggcgcgcggcatctctatcggacagggctatctgtatgctgaagcgctgcctctgacccgattcaatcaggcatggatcgaaaactcctcactaccgcaataattgcctgattcattgattttgcgagaattttagttacaaaaccccttgctgaagcgtttcagttcagaattacgatccccgggtttactgggcgtttgtcaccctgtattaatcacgtaaacagagtgttattttcgggttactgtcaggcgccacctctgttgcccgccagtcacaataacgaatccgacaacatcacctcacggcgttagtggacacctgtttatgaaaacctcactttttaaaagcctttatttccaggtgctgatggcgattggcatcggcgttttgttaggccatttttacccggagttagggacccagatgaagccgctgggagatggctttgttaagttaatcaagatgattatcgccccggtgattttctgtaccgtggtgaccggcatcgctggcatggaaagcatgaaagcggtaggacggaccggcgcggttgcactgctctattttgaaattgtcagcaccatcgcgctgattatcggcctgatcgtggtgaacgtggtgcagccaggtgccgggatgaacgttgatcctgccacgctggatgccaaagccgtggcgatttatgcgcaacaggcagaacagcagggcatcgttgctttcctgctggatgtcatccccaacagcgtgattggcgcctttgccagcggcaatattctgcaggtgctgctgtttgccattctgtttggttttgccctgcatcgtctgggtaacactggcacgctgattttcaacgtgattgaaagcttctcaaaagtgattttcggcatcatcaacatgatcatgcgtctggcaccgataggggcatttggcgcgatggcgttcactatcggcaagtatggcgtgggctcactggtgcagctcggccagctgattatctgcttctacatcacctgtattctgtttgtggtgatcgtgctggggctgattgcacgcctgtttcgccggattcagcatctttaagttcatcgcctatatcaaagaagagctgctgattgtgctgggcacttcctcttccgagtctgcgctgccgcgcatgctggataagatggagaagctgggctgcaagaaatcggtggtagggctggtgatccccaccggttactcctttaacctggacggcacctcgatttacctgaccatggcggcagtatttatcgctcaggcgaccaatgcgcacatggatattttccatcagattacgctgctggtggtgctgctgctctcctccaaaggcgcggcgggggtaaccgggagcggatttatcgtgctggcggcgacgctctctgcggtgggacatctgccggtggcgggtctggcgctcattctcggtatcgaccgctttatgtccgaagcccgtgcgctgaccaacctgatcggtaacggtgtggcgaccgtggtggtggcgaagtgggtcgatcagctggatcataaacagctgaccgacacgctggcaggccggaataaggagaataaagcgtctgaatcttcaatttaatcattgaatttcacttaaatccccacaaatgcccgctgtcgcttgccctgacagcgggcatttgcataataaaccccacttgttttttttgacgtttttcacttcgttacgcgacatcctgagcttcctgtggtcaaacactttgttgttggataacagcgcgattcggcgccagccgaatcgttaataacagcggcaatatgcgccagtgataacgatatttgaattatttgagtaggggttcacatgcagggcaccagaattcggcttttggttggtggattagtgctggcaagcagctttggtctccaggcagaaacgctgcaaccggatccggcctggcaggaaggcaagctggataatggatttaactggcagttactggccacaccgcaacgccccagtgaccgtattgaactgcggctggtggtgaataccggctcgctggtagagagtgcgcaacaggccggcttcagccatctgctgccgcgtctggcgatggtgcacaacaccgcgcttgataaccatcagcagcgcgcgctatggcaacaggcgatggatcctcagcatccgctgccacctgtgatcacctcctatgattccacccaatataatctgagcctgccgaataaccgccccgagttgctgaaagaagcgctgaactggctggcggccacggcaggcaatatggccatcaccgaacaggtggtcaataccgcgctggcggcatcggatccggtggcgacctggccgaaagatacccaggatgtctggtggcgctaccgcctgaaaggctccgcgctgctggcgcatgaccccgcagcgcaaccacgcgcgccggttgatttaacccagctcaatgatttttatcatcagtggtacaccccggatgcgatgacgctctacgtggtggggaatgttgacagccgcaacctctctgagcagatcaataaaaccttctcggcgttaaccggtaaacgagaaacgcctgcaccactgcccaccctgtcgccgctgccacacgagccggtaaatctggtcagcagcaacatgacgcaggatcgcctctcgctggtgtgggatacgccgtggcaaccgattcgtgactcccagaatctgcagcgttactggcagggcgatctggcacgtgaagcgctgttctggcatgtccagcgtgcgctcagtgacagcaaggcacagggcatacaggtgggatttgattgccgtgtgctctatcagcgtgcgcagtgctccatcaacctggatggacgcaacgaaaatctggcgcagaatatgaatctggtggcgcgtgagctggcaaacgtgcgtgacaaaggcttgccgcaggaggagtttgatgcgctaatggcgcagaagctgctggagctgaacaagctgtttaccacctatgcccgcaccgatacggatgtgctgatgagccagcgcctgcgctcccagcagaaacgccgtagtcgatatcgcacctgagcagtatcagaagctgcgtcagactttcctggccggcctgacccgcgaacagttaaaccaggagctgcgtcagcagctgacgcaggaactgatgatggtactgattcagccggaaggcgaagcggaaaccaacgtgaagagcctgcaaaacaactgggacaaagtgatggcaccaccagcggcaccggcgaccagcaatgaagccagtccgccggatagcaacgtcaaagacgttccgccagccgcataaagtcaggtttttgccctgagccactcggtcactaacatcggccagctggcgaggggcaaatctgccacgccgcggataccaaatccgtgcccgcctttctgatagaaatgcacctctgccgggaccttatgctcacgcagcgcgccaaaaaacgccatgctgtgattcactgatacatcatcatcgtcggctgcgtggatcaacagcgttggcggcaccagcggatgaacccgggtttccattgaataagcgtcaatggttttctgatcgggccaggcacccaacaggcgggttctggctccttcatgggcgatgccgtcccgcatgctgattaccggatagaccagtaccatcgcatccgggcgcggcgagaagttttctgcgccatcctgcaccggatagagtttctctgcgaaacgcgtacccagactggcagccacgtgaccacccgccgaaaagcccatcatgacgatatatttaccattcaggccgcgctgcgcccgttcacgcaggacgcgtaccgcgcgctgagcatcggccagcggcgcgtcggggccttcgtgatgtccatcatagggcaggcgataggtcatcaccgccagggtgtaacccattgaggtaaaaaatgtcgccagggcgctgccttcacgatcgatcatcacgcgctgatagccaccgcccggtgcgaccagcagggtaatcccgtttgattcgaccggatgccagatcgccatctccgggcaacgtacgccggtagcgccccgatcgtaaggctcatactcttttgccatgtcgacaatctgcggctgtgcgcgcgaatcgctggcgcctggcgcatcaccgtgtggccagatattaataatttctgtgtgcataaatagatcctgatgcggggaatattttaattgttttgttcgcggccggagagaacagcgtcctgctgtcttttgattaaaagatggtcttttttcaggcagtcgtccatccgaaaaggggggatctgaccagattcggactatgcctggtggtggatctgtttgtttaacttattaattttaatcaataaattataagagagattgaagggggcgaccgcaggggatctgttattaaccacaatttttccgcttaaggtaaatagctggcacggcccgctttattagccgcaatttaccggatatcacgctgtgcgttcttaaggcgacataatgattttagcgtcaggatcacaccgccacgctgcaggggctaacgtgccagtctcatctgggaacggatagcatcggttacagtcacgcagccagacattaccagcagcctaaaaaaatgcgccctcgggcgcattttctggcatcggcacgatcagtgcctgtatcaacgacgctggctgccgctctgtcagtcaggcatcgcctctgccggaataattgcgccgcgatgctgaatcacggtgctggcagtcaggtgtccgcgctgcgcggcgacctctgcagaggcgccggtcagacggcgagccagataaccggcactgaacgaatcaccggctgcggtggtatcgatcactttctctttcgccagacgtaccgcaggtacatcaatcagcggtgcgtcgccggtgaccaccaggcaggagtctgcaccgcgcttaatcacgatttcgctggcacccgcctgacgggtacgcgcgataacgtcatccagcggctcttcgccccagagcagatgttcatcatccagtgtcaggaaggcgatatcggtgcagttgagcatggcgcgataagcggcctgcgtgctggcccgatcggcccataaacgcgggcggtagttgttatcgaaaatcaccttgccgccattagcccggcagcgcgccagcagcaccatcagcttttcacgactggcaggcggcagaatcgccaggctgatgccgctaagatagagataatcgtagtgcgacagctgttcagctatctctgctgattgcggactgtcgagccagtaacgcgcggcggcatcactgcgccagtaccagaaggtgcgctcaccgtcggcatcggtttcaatgaaatacaggcccggcattttattatcgagccgctgaatcaggtcagtattgaccttctcctgctgccaggccgcgatcatttgatcgctgaacgaatccgtacccagcgcagtgacataatcgacccgtaactgctgctcatcaacctggcgggcgagataaacggccgtattgagcgtatcgccgccaaagccacgtttaatgttctcacccttttcggacagctcaatcatgcattcgccgatgatggcgatttttttctgcgtcatggtttcagacctgtagtgaaatatcgccttagtctcgcgtctggtatggcagacgtcaatggttttaaaacagtgttttaatttaccttttaaggcggccattagtcccggtctcggggataaacgccgggaatgtcggctttttttaccgcttatgctaacgaaatggctgagaaacccctttttctgaattgaatcatcttactatcccgcttccctgatgccgttgcccgcggtctcgactatctttaacgcagaccgtgaatgtgcaaggagaaagcgtaatgtcgcgtaccgggaaaatagtcagctgggtagcaggaattctggtgttgttgatcgtggtgattatcgtcgtcatcgcgacctttgactggaatcgcctgaagcccaccatcaatcaaaaagtttcaaccgagttaaaccgtccctttgcgatacgcggggatctgggtatcgactgggcgcgaaatcgcgacgaggcaggctggcggcgctgggtgccgtggccgcagatccatgcagaagatatcatgctggggaatccgcctgacattgccgacgtcaccatggtacatctgcagcgggtcgatgccacattgtcaccgctgtcgctgctgcacaaagaactgttcatcccgtggattaaattgcagcggccggatgcgcgtctgatccagaccgcggataaaaagaacaactggacctttacccttgccaatagcggcaaggatgagaagagtgctgcgccatcggcctggtcattccgtctggataatattctgttcgatcagggccagattcgttatcgcgatgccattaaccgcgcagatgtcacggtgcaggttaatccgctgggtaaaccggtgccgtatacgcagattgccggaggcaatgaccagcagaagggcgcaggcgacttcgtctttggctggcaggcgaagggcacttataacaatgagtcactcagcggcgacggtaagattggcggcatgctgtcactgcgcagtcagaacaccccgtttcccgattcaggccgatctgcgcaacggcaccacccgcgttcaggtgaccggcggtctgcaggatccgatgaacctcggcgggcttaacgtgcgactgcgcttctcgggcgatacgctggccaatctctatggcctgaccggcgtcctgctgcctgacacgccaccttatgaaaccgacggccatctgattgctaaattcagcggcgaaaagggcacggtctaccgctatgagaaattcaacggacatattggcgacagcgatattcatgggtcgctgatctacagtcaggttaaaccccgcccgacactcagcggcgagctgacctctgagcaactgcgcatggccgatctggggccgctgattggcgtcgactctggcaaaggcagtgaaaaaactgcgcaggccaaagcccggcgcggggagaaatcgaatcagcccgcagaccgcgtgctgccacacgataaattcgaaaccaaaaactgggacgtgatggatgccgacgtgaagttcagcggcaaacggatcgaacacagcaattcactgccgttaagcgatctctatacccatttacagctgaaaaacggtgatctgctgctggacccgctgcgttttggtgtggcgggcggcaatctcaacagcactatccggctggagggcgatcgctcgccgatgcgtggtcgggttgatcttcatgtccgtaagctgcagctgcgtcagctcttcccgaatgtggaggcgatgaagaacagccgtggccagctcaatggcgatgccagctttaccggcaccggtaactccgtagccgatctgctggcgaccagcaacgggcaacttaagctgctgatgaatgatggtctgattagccgcagcctgatggaaattgccggactcaacgtcggtaactacgtggtgggcaaactgtttggcgatgaccaggtgcgtatcaactgcgccgccaccgatctcaaactgcagaacggtgtggcgacgcctaacctgtttgtgtttgataccgagaacgcgattatcaacgtgtcaggcaacgcgaacttcgccagtgagcggctggatctgtcggtgaatccggagagtaagggcgtccgcatcgtaacgctgcgctccccgctctacgtgcgtggcacctttaaaaatcctgatgcgggcgtgaaaacggggccactgctggcacgtggtgctgctgcagtggcactgggcgcagtagtcggcccggcggcggcgctgctggcactgatctctcctagtgataacgaagacaaccagtgcagcaccgtcctgcagcagatgaagcagaagaagtaactagttgcgatagagtactttgataatgtgataaccaaagccggtctttaccggcccgtaaggcgtcagcagcgggcaggtaaagaccgctttatcaaaggccggcaccatctgtccctgccggaaactcgcccagatcgccgccattccggccggaaggacaggttgagtgcttctttgccagcagctggaaattgccacccttcgccagttttgccagtatctcttttgccagcgcttcctctttgacgaggatgtgtaaagccgccgcggttttcgccatgttggtatctcggttgtgtataattgccgcccagtataaacccctttcttttgattcaatcaggcgatttctcctatgcgtttaaaccccagccaacaacgtgccgtcgaatttgttaccggtccctgtctggtgctggcgggcgcgggatcgggcaaaacccgcgtgattaccaataaaatcgcccatctgatccgtgaatgcggctatcaggcgcgccacatcgccgcagtgacctttaccaataaagcctcgcgcgaaatgaaagagcgtgtggcgcagacgctgggccgcaaagaggcgcgcggtctgctcatctccaccttccatacgctggggctggagatcatcaaacgcgaaaccgcggcgctgggcatgaagtcaaacttctcgctgttcgacgatcaggatcagctcgccctgctgaaagagctgacaaaagagtggctggaagaggataagacgctgctacagcagctcatctccaccatctcgaactggaaaaatgatctgatcgatccgcagggcgccgccgcgctggcgcgatcacagcaggataatatttttgctcactgctacgccctctacagccagcatcttaagtcgtgcaacgtgctcgatttcgacgatttgattctgctgccgacgctgctgctgcagcgtaatcaggaggtgcgtgaacgctggcagcagcgtatccgctatctgctggtggatgagtatcaggataccaacaccagccagtatgaactggttaagctgctggtgggggcgcgggcgcgcttcacggtggtgggcgatgatgatcagtctatctactcctggcgcggcgcacgcccgcagaatctggtgctgctgaatcaggatttcccggcgctggaggtggtgaagctggagcagaactaccgctcttcgcagcgcatactgaaagcggcaaatatcctgattgccaataacccgcacgtctttgagaagcggctcttttcggagctcgggcagggcagcgagctgaaggtgcttactgccaacagcgaagagcatgaagcggagcgggtcactggcgagctcatcgcgcatcactttatcaaccggacgcagtacaaagattacgcgattctttatcgtggcaaccatcagtcccggacctttgaaaagtttctgatgcagaaccgcatcccttatcgcatctctggcggtacttcgttcttctcacggcccgagatcaaagatctgctcgcctatctgcgcgtgctgaccaatcctgaggatgacagcgcgtttctgcgcatcgtcaatacgccgcgccgtgagattggcccggctacgctgcagaagctcggtgagtgggccaacctgcgcagcaagagcctgtttaacgccagttttgatgtcggtctggggcagacgctgagtggccgtggtctggagcatctgcagcgcttcacccactggctgaatgagattatccagctgaccgaacgtgagccggtgaacgcagtgcgtgatttgattcgcggcatcgactacgaaagctggctgttcgaaacctccggcagcccgaaagccgcagagatgcggatgaagaacgtcaacacgctgtttcagtggatgacagaaatgctggagggcagcgatattgatgagccgatgacgctggcgcaggtggtgacgcgctttaccctgcgcgacatgatggagcgcggtgaaagcgatgaagagctggatcaggtgcagctgatgacgctgcacgcctccaaagggctggagttcccctatgtattcctggtgggcatggaggaggggctgttaccgcatcagagcagcatcgatgagaataatatcgaagaggagcgtcgcctggcctatgtggggatcacacgggcgcagaaagagctgacctttaccctgtgccgcgaaacgccggcaatatggcgaattaatccggccggagccgagccgttttctgctggaactgccgcaggacgatctgcaatgggagaccgagcgcaaagtggtcagtgcggaggagcggatgaaaaccggtcagagccgggtggccggtctgagagcgatgctggataaggcgaaaaagagttaaaccagtgcaggaggcgaaagagattcgcctcacgctacggcaattacgacagggttaataaccagtggacgtaagactgataatggctttcctgctccagcagctcactgcgcaacggatgggcctccagccagcccgcgggcagggtcagatgcagggcatcatcgtctgcctgtagccgcaccgcaggcagggtgtcatcgcgacggcgggtggagaaaataatcgccagccgcagcagacggcacatccgttctgccagccgcggcggcagggcgttctgctgcgtcagcaaagccagatcgatgctgccgctctggttttgcagtaaacaggccagcagcttcttctgcgccggtgtgaaaccaggaagatcgaggtgacgcaccagatacgccgcatgctgcggcgcatgacggaagtcaacgctcaggccgatttcgtggatcgcgcaggcgctgagcagcaactcacgacagcgctgatccagcttccacaacgtggaaacctgacggaaaaagctctccgccagctgacgcacgcgatccgcctgctcgacatcaatgctgaaacggcgctggacgttgtgtagcgtgcgggttcggatatcccggtcgatgggcagatgcagcatgccgtagaccagtccttcgcgcagtgcgccgcccgccagcgtcatgctatcgatactgagctcctggaagatggcgatcagaatcgacaggccgctggggaacaccagcgcccgctccagcgtcagcccttcgatttccagctcttccagtttgccgcactgaatggcgcgctgcttcagctgctgtagcttattcagcgtgatgcgctcatccatgccctgcgccaccatgatctcctgcagcgcctgaaccgtgccagaggcaccaacacaggcctgccagccctgctcacgcagttgcgctgcaatgggctggatcatttcacgcgccgccagctcggcctggtcaaagttctcttttgccagatgacgatcgctgaagaagcgctccagccacgtcacacagcccatcgacagactgaacaacaccgacgcatgcgatccgtcgccagtggccagctcggtgctgccgccgccgatatcgaccactaaacgctggtcggaaccgccggtggtgtgggccacgccctgataaatcaggcgcgcctcttcttcaccgctgatgacgttgatggtacagccaaggatctgttgggcggtgtcgaggaaggtctgcgcattggcagccagacgcagcgtggcggtcgccaccacgcgaatttgatcggggggaatatcctgcagttgttcagagaacagtctgaggcagtgccagccccgcgacatcgcgtcggctgacaacaggttatttttatccagaccggcagcaaggcgaaccttgcgcttaatttttgcaacggtctggatactgccagagacctcgcgcaccaccaacatatgaaagctgttagaccctaaatcaatcgctgcataaagtgacgatgcgcttagcatggtggccttaacctgaacgtttacggttgttgttgcgtggagcaccgcgacgattggcgttattccctccgcgacgtgggccattgccggaacggctgcgttgcagacgcttaggcggcggtaaatccgttaacaacgcttcgctgctgtacttgctgaccgggatgctgtggccgatgtactcttcaatcgaaggcagattcagcgcgtattcttcacaggccaggctgattgaatgaccgctggcgcctgcacgaccggtacggccaatacggtgaacgtaatcttcacagtcatctggcagatcgtagttaaagacgtgggtaacagccgggatgtgcagaccgcgagcagccacgtcagtggcgaccagaatatccacatcacctttggtgaagtcatccagaatgcgcaggcgcttcttctgagcaacgtcgccggtcagcaggccgacacgatgtccatcggcagccaggtggccccagatatcttcacagcggtgcttggtgttggcgaaaataatggcgcgatcgggccactcttcttccagcagggtctgcaacaggcgcattttctcttcgttagacggatagaaaagctcttcctgaatgcgatggccggttttctgttccggttccacttccacatattcagcactgttcatgtgctcaaacgccagttcacggacgcggtaagagagggtcgccgagaacagcatgctcagacgctgagtcgccggcggcatgcgacggaacagccagcgaatatctttaataaagccgagatcgaacatacgatcggcttcgtccagcaccatgacctgaatagcaccgaggttgacgtgattctgtttcgcgtagtcgatcaggcgaccggtggtagccaccagaatatcaacgccctgctccagcactttaagctgtttgtcataaccgtctccgccataggcgagacccagtttcaggccggttgaggcggtaaggggttctgcatctgcatgaatctgcacagcaagttcacgcgtcggcgcaagaattaatgcccgtggctggttaacctgacgaccttccgccgcaggatgagagagaagatgatgaaacgttgacgtcagaaacgccatcgttttgccggtaccggtttgcgcctggcctgcaacatcacgccctgaaagcgtaaaaggcagagctaacgcctgaatcggcgtgcagtattgaaagcctttagtatcaagggcttccaccacttttgggtgcagggcgaagtcggaaaacttctgttcagttaagtgtgttttgctcatagtgtggtagaatatcagcttactatcgctttacgaaagcgtatccgatgaaataaagtcaaccaacattggtatattttacgccaattcgccaggcataatcttgtggagtaaaacatgagcagcgataaaatcgttcatctgactgatgacagtttcgacaccgacgtgctgaaagccgacggcgttacactggtagatttctgggctgaatggtgcggtccttgcaaaatgatcgcgccaatccttgatgaagttgcagaagagtatgatggcaagctgaccatcgctaagctgaatattgatgataacccaggcacggcaccgaagtatggcattcgtggtatcccgacgctgctgctgtttaaaaatggcgaagtcgccgcgaccaaagtgggcgcgctgtctaaaggccagctgaaagagtttcctgaacgccaatctggcgtaattcagggctgaatgtccggcagtggtgaatttatctcctgctgctggacgttcgctttcaggcgtgctaatttaccagcactgcattacgaacttaccttgtagttagcatctaaaagttttcccttgttgaaccctgtcgccctgtaccttataaagatagaacggttcagcaatcttacggttagctccaactctggcatcacattcggacatctccctgcataccgatcgccattccatacgatgatcgtcaggaagagccgaaaagagccattaacggcatggattagttgccataccattcacgacaaacattccgagtattaccccgagtttaagaacccatcactatgaatcttaccgaattaaagaatacgccggttgctgagctggttactctcggcgaaaatatgggactggaaaaccaggctcgtatgcgcaagcaggacattatcttttcaatcctgaagcagcacgcgaaaagcggcgaagacatcttcggtgatggcgtgctggagatccttcaggatggatttggattcctccgttccggagacagctcctacctcgccggccctgatgatatctacgtttcccctagtcaaatccgccgcttcaacctccgcactggtgacaccatctctggcaaaatccgtccaccgaaagagggtgaacgttattttgcgctgctgaaagttaacgaagttaactacgacaagccggaaaatgcgcgtaataagattctgttcgaaaacctcacgccgctgcacgcaaataaacgtctgcgtatggagcggggtaatggctcaacggaagatttaaccgctcgcgtactggatctggcatcgccaattggtcgtggccagcgtggtctgattgttgcgccaccgaaagccggtaaaaccatgctgctgcagaacatcgcgcagagcctggcgcacaactatccggactgtaccctgatggtactgctgatcgatgagcgcccggaagaagtcaccgagatgcagcgtctggtgaaaggtgaagttatcgcctcaaccttcgatgagccagcttcacgccacgttcaggttgctgaaatggtgatcgagaaggccaagcgtctggttgagcacaaaaaagatgtcatcatcctgctcgactccattacacgtctggcacgtgcttacaacaccgtggttcctgcttcaggtaaagtcctgaccggtggtgtggatgccaacgccctgcatcgtccaaagcgtttctttggtgctgcacgtaacgtggaagagggcggtagcctgaccatcatcgcgaccgcgctggttgataccggttcgaagatggatgaagtgatttacgaagagtttaaaggtaccggtaacatggaactgcatctcgcccgtaaaatcgctgaaaaacgcgtcttcccggcgattgattacaaccgctctggtacgcgtaaagaagagctgctcacctctcaggaagagctgcagaagatgtggatcctgcgtaagattattcacccgatgggcgaaatcgacgcaatggaattcctcatcaacaagctggcgatgaccaaaactaatgatgaattcttcgatatgatgaagcgttcttaatccgatactgcctggccgaaccacagattcggcttttttagtccagatgcgcagaaaatcgacctcacgccacgtctcaacgtggcgtttttcatttgtgagctataggattgaacactggcaggagcatttataatgactgtggtagcgatggcgaacttttgaccgttcgtctgtctctttatgcagaattcggaatccgacacagcgataggcgcgttttttcgcgtattgttgtgcgggatgttagctgagagcgtttaacgtgaatttactcactatgagtactgagcttggtttaatttttctcttttccctggctttcctcttttttgctcgaaaagcagctaaaaaaattggtttagttgataagcctaactcacgtaaacgccatcatggcgcgattccgttggtgggcggcatttctgtgttcgcaggtatctgctttacgtttgccattaccaactactatctgcctcacgcgctgctctatctgggctgcgccggtgttctggtgctggttggcgcactggatgaccgtttcgatatcagcgtcaagatccgcgcggtggtgcaggccattgtcgcgctggtgatgatgtttggcgcaaaactctatctgcttagcctgggctttatcgtcggcccgtttcgagcttatcgtggggcccttcggctatgtgctgacgctgtttgccgtctgggccgcgatcaacgcctttaatatggtggatgggatcgacggtctgctgggcgggctctcctcggtcacttttgccgccatggggatcatcctctacttcgacggccagaccagcctcgcgatgtggtgttttgcgatgattgccgccacgctgccctatatcctgcttaacctcggcttccttggccgtcgcttcaaagtctttatgggcgatgccggcagcaccatgatcgggttcaccattatctggattctgctggaaacgacgcagggtctgagccatcccatcacgcccgttaccgcactgtggcttattgccattcctctgatggatatggtggcgattatgtatcgtcgcctgcgtaaaggcatgagtccattctcggctgaccgtcagcacatccatcatctgattatgcgtgccggctttacctcccgtcaggcctttgtactgattaccgttgcggcggccattctcgccggtatcggtgtgctgggtgaatatctggcatttatcccggagtgggtgatgctgctgctattcctgggcgcgtttatggtttacggctactgcctcaaacatgcatggcgcgtggcgcgacgtgtccgccgcattaagcgccgtctgagccatcatcgcgaagcaaaaaacaaattaccctgaaaagagctgataaaggatacctctgccatgccttctgacgttgtggacaacgaactggatattcgcagcttttgctgccgtttatggcgtggcaagcgctggattatcgggctggcgctgctgtttgctctggtcgcctggctggccacgctgctgctgaaacaggtctggagcaccacggcgatcaccgatcgtccgacggtgaacatgctgggttcttactatgcacagcagcaatttctgaccaatctggatgtgcgcaacaacgccttaaccctggccgcaccttcacctacggtgatggatcaggtttatcaggagttcaccatgcaactcgcctcctgggatacgcgtcgtgagttctggcagcaaacggattattacaagagtcgtaaaaccggcaatgcgcataatgatgccgcgctgctcgacgatatgatcggcaatatcctgttcacgcccgctgacgcggcacataacctgcccgataacgtcaaactgaaagcggaaaccgctggcgacgccaataatctgctgcgtcagtacatcgcctatgccagtgagcgcgccgcgcgtcatctgaatgacgagctaaaaggtgcctggcgggcgcgtaccgaccagttgcaggcgcaggtgaaacgtcaggaagatgtggctaatgcggtgtttcagcgccagcagcatcggctggagcaggcgctgaagatcgccagccagcagggcatcaatgagaaacagacgcgtgaagcgggtgaaaatctggcagacagcgacctgtttcctgctgggccagcccgttttacagggacagctggatacgctgcgcgctaccggtccggagtttgatatcagctatgatcagaacagagcaatgctgaccacgctgcagaccgggccaaaactgaacagccagttccagacctaccgttatctgcgtacgccggaagagccggtatcacgtgacagtccgcgacgtctgttcatgatgattatgtggggtgccattggggcattaacaggcgcgggagtggcgctggcacgtcgtccgcgtctgatgtcagacacgcatgagtgagagaaacagtgtgaaagttctgacggtatttggtactcgtcccgaagcgatcaaaatggcaccgctggttcaggcgctggcgcaggatcccgctttcgaatcgcgactgtgcgtcaccgcacagcatcgtgaaatgctcgatcaggtgctgcgcctgttcaagctgcagccggactatgatctcaatattatgcgccccgagcaggggctgaccgagatcacctgccgcattttagagggcatgaaaaccgtcctgctcgacttcaaaccggacatcgtgctggtgcatggtgacaccaccaccacactggcggcgagcctggcggcattttatcatcagattccggtcgggcatgtggaggccggtctgcgtaccggcgatctcgcctcgccatggccggaagagggtaaccgtaaacttaccggtcatcttgcccatctgcacttcacccccacctcccgatcgcgtcagaatctgttgcaggaaaatctgcccgatgcgcgcattatcgtgaccggcaatacggtcattgatgcgctgctgtgggtccgcgacagggtgctggatgacagcaatctgaatgcacaactggcggcgcgctatccgtttctcgacccggataagaaactggtgctggtcaccggacatcgtcgcgaaagctttggtggcggctttgaacgtatctgcagcgcgctggcgcagattgcccgccagcatcccgaggcgcagattgtctatccggtgcaccttaatcccaatgtcagcgagccggtaaaccggattctcagcggcattgagaatatcattctgattgaaccacaggagtatctgccttttgtctggctgatgaaccgcgcctggctcatcctcactgactccggtggcattcaggaggaagcgccttcgctgggtaaaccggtgctggtgatgcgtgacaccaccgagcggccggaagcggtcgacgccggcaccgtcaaactggtggggaccgatatcgcccgaatcgtggcggaggtcagcagcttgctgactgacgacgctgcctggcaggcgatgagccacgcccataatccgtatggcgatggcaaagcctgtggtcgtattttacaagccttaaaagataaccgagccgaattatgagttttgaaaccatctccgtgattggactgggatacattgggctgccgacggcagccgtttttgcctcaaagggaaaaaaagtggtgggcgtggatatcaacgcgcgcgccgttgaaaccatcaatcgtggcgcgatccatatcgtggaacccgatttagatcaggtggtgcatgcggccgttacgcgtggcgatctgcgcgccaccacgcagccggaagccgccgacgcttttcttatcgccgtaccgaccccttttaaagatgagcatcagcccgatctgcgctttgtgaaagccgcggcggagtcgattgcgccggtactgaaaaagggcgacctggtgattctggagtcgacctcaccggtgggcagcaccgaacagatggccgactggctggcggcggcgcgtcccgacctgcgctttcctcagcacggtgatacgcccgatatttttgtggcctactgtccggagcgcgtgctgcctggtcaggtgatggttgagctgattaacaacgaccgggtgattggcggcatgacgccagcctgttccgcccgcgccagcgagctttatcggctgtttttaaaaggcgaatgcgttgaaaccaacgcccgaaccgccgagatgtgtaagctgacagaaaacagcttccgtgacgtgaatatcgcctttgccaatgagctgtcgctgatttgtgccgatcaggggattaacgtctgggagctgattgcgctggcgaatcgccatccgcgcgtcaacattctgcagccgggcccaggcgtcggcggtcactgtatcgccgtcgatccctggttcatcgtggcgcagaatcctgaattagcccgcctgatccgcaccgcgcgcgaggtcaatgacgccaagcctcagtgggtgctggaccaggtgaaaaccgcgctggcggactgcctgacacagaccggcaagcgcgccagcgatatcaccatcgcctgctttggcctggcctttaaacccaatattgacgacctgcgcgaaagcccggcggtgggcgtggcacagaaaattgcagagtggcacagcggcactacctgggtggttgaaccccatattgagcagcttgctgacgcactggccgacaaagccgtgctggtctctgccgggcaggcgctggaacaggccgatattctggtgatgctggtcgatcaccgcgccttccgcgccattgatggtgccagcgttcagcagaactggattgtcgacaccaaaggtgtgtggcgatgaggcgttttctgatcacgggcggtgccgggtttatcggtttctgcactggtgcgctttaccgtataaacggcttacatgtgtgggtgcctggcgtaacagctggctgagtgatgaccagctgcgggccgcgggtgaagcgctgacaaaaaccggctacggccaatacctgctggatttattacatgcccgtccacgtcaatattaatccccttagctgggagagcgcattcttcggtgttgataccgtgcggctggagccgcaaggtgacattccgctggaacaggcgctgcgtcatccctgtgcgctgatgcagataaaagtcgctgccagcgagacggcgctgattgatacgctgcagcagcatcagttccggctggcagaaggcgaagcagatctgacgctggcgctgaaacagactgaacggcaggcgggaattcgcattgcgcgcgaagcccagatcccgctactgcgcgatgctgcctcacagctcttcagccagagtcgttttcgcgcgccctggtatgcgccggacgccagcggacgcttctatgcgcagtggattgaaaatgcggtacgcggggcgtttgacgatcagtgtctggtggcaagcgatgccgcgggtcagctgcagggatttgtttcgctgcgcgcggtggatggcgatgcccgcattggcctgctgggcgtactgcccgacgcgcagggccaggggctgggtcagcgactgatgctggcggcggcagactgggcgcgggtacgacagctggctcagcttcgggttgctacccagctcagcaatctcacggcgatgcgcctctatttacgcagcggtgcccggctcgacagcaccgcgtactggttttacaggaaaggtcatgattccatttaatgcgcccccgattgtgggcacagaaattgagtatatgcagtcggcgatgaacagcggcaagctgtgcggcgatggtggatttacccgtcgctgtcagcagtggatggagcagcgttttggcagcaaaaaagtgctgctgaccccctcctgtaccgcttcgctggagatggcggcgctgttaatcgatctgcagcccggcgatgaagtgattatgccgagctacacctttgtctctaccgccaacgcctttgtgctgcgcggcgcccgcattgtgtttgtcgatgtgcgcccggacaccatgaacattgatgaaacgctgatcgaagcggccatcactgaaaaaacccgcgccattgtgccggtgcattacgcaggcgtggcctgtgaaatggacaccattatggcgctggcggcaaagcataagctgtttgtgattgaagatgcggcgcagggcgtgatgtcacgctacaaaggtcgtgcgctcggcaccatcggtcatattggctgcttcagtttccacgaaaccaagaactacaccgccggcggcgaaggtggcgcgacgctcattaacgacgccagcctggtcgagcgcgccgagatcgtgcgggaaaaaggcaccaaccgcagccagttcttccggggtcaggtcgataaatacacctggcgcgatatgggatcgagctatctgatggccgatctgcaggcagcctatctctgggcgcagctggaagccgctgaaggtatcaaccagcagcggttacgcatctggcagcgttattacgatgcgctgcagccgctggcggctcagggacgcatcagcctgccggtgatccccgccagctgtgaacacaatgcgcacatgttctacatcaaactgcgcgatcaggacgatcgtcaggcgctgataaactggatgaaagaagccgagatactgacggtgtttcactatattccgctgcacagttcgcccgccggtgagcggttctcgcagtttgtcggggacgatcgctttaccacgcgggaaagtgaacgcctgctgcgtctgccgctgttttataacctgtcggataacaatcagagcacggttatcagctcactgctgagcttcttttcctgatgtcattagccagagcctcagtgtggaccgcatcgtccacgctggtaaaaattgtggccggcctgctggtcgtcaaactgctggcggtcagcttcggacccgagggtgtcggccaggcggggaacttccgtcagttgatcaccgtgctgggcgtgctggcgggcgcaggcatctttaatggcgttaccacctatgtggcgcagtatcagcagcagcccgaacagttgcgggcgatggtgggcacggcatcaaccatggtgctgggcttttccggtgtgctggcgctgctgtttctgctggcggcggcacccatcagtatcgcgctgtttggtcacgaccgctatcagggcgtcatccgcgtggtggcctttcttcagctcggcatcgcctgggccaactttaccctggcgctgctgaagggctatcgcgacgcgcgcggtaatgcgctggcgctgattctcggcagcctgattggcgtggcaggctatctgctctgctggtggctgggcggctatcagggcgcgctgacgggtctggcgctggtgccggctttgctgctgctgcctgcgctgatgatgctgaaacgccgcgcgccgctgccgcttagctggctgcgaccgcaatggcatcctgagctggcccgtaatctggcaaaatatacgctgatggcgctgatcaccgccgtgaccctgccggtcgcctgggtgttgatgcgtaatctgctggcggagcagcagggctgggcacaggtcggattgtggcagggcgttaccagcatttccgatgcctatctgcagtttattaccgcgacgtttagcgtctggctgctgccgacgctggcgcggctggataacaaacgcgacatcgcgcgcgagattggccgtgcactgcgctttgtcctgcccgccgtagcggttgccagcctgggtgtctgggtactgcgcgatttcgccatcagcctgctgttctctgaagcgtttcgcgggatgcgcgatctctttgtctggcagctgtgcggcgatgtttttaaggtcggcgcctatgttttcggatatctggttatcgccaaagcctcgctgcgcttttatgttctgactgagatcagccagttcctgttgctgaccctgttttcacgctggttgatcccgttacatggcgcgacgggtgcggcgcaggcctatatgtttacctatatggcttactttgccctgtgttgtggcgcttttattgtttactgccggaaaaaatgactttaattcacgttttgggatcggacattccccaccacaatcttacggtgctgcgctttttcaacgacgtactcagcgttgagcagcctgcggctgcgccacgccattttatggtggtgacgcagcagcccgagaacctggcgccgttcagtgcgttgcagatcgagtgctttaccagcaagaaagcgctggcgcaggcggtactgcagcgcgccagaaatcgtcagcagcgttttttctgccacggacagtttaacccgtggatctggctggcgttactcagcggtaagctgcgtcgttcacagctcttctggcacgtctggggtgccgatctttatgaagattcgcgcagcctgaagttccgtctgttctatctggtccgccggatagcgcaggggcgtgttgcacaggtttttgcgacccgtggcgatctgcatcactatcagcagcgccatcggcgcgtacccggttcactgctctattttcccaccagaatgcccgccgcagccgttgaatctgtcccgtcggagccttttacgctgttgctgggcaactcgggcgatccgagtaaccggcatatcgaaggtttaaaagcgattcacgcgcagtttggcgagcaggtgcgtatcgaggtccctttgggctatccgccaggtaatgaggcttatatcagccagattcaggcagctgccgatgcgctgttcccgaacaggcaggtgaatctgatgcgtgaaaacctggcgtttgatgattacttagccctgctggcgcgctgccatgtcggctattttatgtttgaacgtcagcaaggggtgggaacactctgcctgctgattcaggccaacgtgccgtttgtcctgacccgcaaaaatccattctggcgtgatgtggcagagcagcagcttccggtattgttcagcgaagatacgctgtcgcctgcggtgatcgccgaggcacgtcgtcagctgatgagctgtgataaacaggctatcgcctttttttcgccgggttatctggcgggctggcgagccgcgttacagctcagcgaaggggagttgtcatgagtcttatgcagtttggcggcctgctggtggtctatctgctgtcgctggtttttattctgaccctgacctggcgggagtttaagcgcgtccgttttaactttcatctgttcttcacgctgctgttcttactgaccttttacttcggcttcccgctgacctccgtgctggtgtttcgctttaatgttgaagtggtgccggttgagaacctgctggaggcgctgctgtcggccacggcgttttacgccatttattacgtcagctataaagtgcggctgaaacccgccagcgcgtctccggcgaagccctggctgcagatgaatcgcgtcgaaacccatctgacctgcgtgatactggcgctggtggcgctgggtaccgtgacggtgttcttcattcataacggttttctgctgttccgcctgaccgcctataaccagattttctccagtgaagtgtcgggtgtagcgcttaagcgcttcttctatttctttattccggcgatgctgatcccctactttttgagcccgacgcgccgcaactggctgctgtttcctggtggtgaccgttgcctttggtttactgacctacgcgctggtgggtggtacccgcgccaatatcattattgcgtttgccctgttcctgtttatcgggattacccgtggctggatcactttgtggatgctggcaacggcgggcgtgctggcgattgcaggaatgttctggctggcactgcgccgctataacctcgacgttatgggcgatgaagcgttttatactttcctctatctgacgcgtgataccttctcgccgtgggagaatctcgccttgctgctggataactacgccagaattgagtttcaggggctggcaccgctgtggcgtgatttctacgttttcattccgacctggctctggccggatcggccgctggcagtgttaaacagtgctaactacttcacctgggaagtgctgaacaaccattctggcctggcgatttcacccacgctgatagggtcgctggtggtgatgggcggcgtctgggcgattccgatcggtgcggtcgcggtagggatgattataaaagcctttgatgcaatctatcagcgtggctgtcttgagaccaaccgttacaccggcgccatcctgcaaagcttctgttttggcgcggtctttaacatgatcgtgctggcacgcgaaggccttgatgcgttcggttcacgcgtggtgtttttctgcatcatttttgctgcctgtctgggcatggctaaattacttttctggttactggatcgcgcaggtttgattcgcgaccgcagcaggcgggtgttgcacagcccgctctgagtagcctctgggattgacggaagatatgacaaagttaactgagacgccgcagtaccggatccgtggcgttgagttgtatggcttcgaaaacatgccgtcggcggtgaattttctgatgccgccgcagagcgtacgcagcggtattttagtggcgattaatgcggagaagatcctgaccgctgagcgggatgagggattacgtacgctgttagcgcaggcggaatatgcatacgccgatggcatcagcattgtgcgctcgattcgtaaaaagtatccacacgcgtcggtgcagcgcattgcgggtgctgatttatgggaagcgctgatggaacgcgccgggcgggaagggacgcctgtatttcttatcggtggtcgtcagcaggtgctggatgaaacctgcgataagctacgtcgtcagtggaatgtgaatattgtcggggcgcaggacggctattttgcgccagccgatcaggatgcgctgtttgcccggattgcggccagcggcgcgaagctggtgactgtagcgctggggtcgccccgtcaggagctattgatgctggcgtgccgtgcgcactggcctgatgcgctctatatgggcgtgggtggaacgtacgatgttttcaccggccatgtgaagcgagcgcctgagatctggcagcggctgggtctggagtggctctatcgtctgattcggcaacctggccgcctgcgccggcaattaaaactgcttaaatatttgcgctatcactggcgtggcgatctctgatattgctgataaatgccgcatttttacgcgttgtgagagaggaaatgcactatttgtcgacaaaatgcacaaagcgtaatcaaacgcgtctttttatttaaaaagcactagacacgatgggcgcttatctctagtatgcacatccgcaacggcgctacgcgcccgtagctcagctggatagagcgctgccctccggaggcagaggtctcaggttcgaatcctgtcgggcgcgccatatcgtttgtgcgcatgagcttcggtggttgatttaccgcggttggcagtagagatttaaatgctgcaggtttttaacttgtgacattaagtattgtggtggctatagctcagttggtagagccctggattgtgattccagttgtcgtgggttcgagtcccattagccaccccagattttgctgggaaacgcgaaggtggcggaattggtagacgcgctagcttcaggtgttagtgtcttaacggacgtgagggttcaagtccctctcttcgcaccaggcaaaacagttaaaaaaatcggcgagtagcgcagcttggtagcgcaactggtttgggaccagtgggtcggaggttcgaatcctctctcgccgaccattttagaaacctgtctgaaaagacaggttttttttcgtctgcagaaaagaggatgagaatttctgcgggagatttgggtagggtgcagaggggcagcgtagctgtaaatccgagcctgcgaaggaaatacggtcagatcggaaaggcgctaatgccatccatggccgctcggcccgcgccgtccctggcgcgggacgctttcctcctctgaccgtattccctgcgcgttgagcttatgcattgcggccagattgactctggcttgggctatcagccgtcttaagcgctaatgtaagtacctgatgcgtgtgccagacgtgaagcgaagggagcatacgcctgtggtcagagcatcgcgccgcccggataaaaacgccgggagcgtttatgaacaacgcaaagcgttggcccggctacgggcgcacctcagggatgaggtgcgtaatcgcccgcgctgagcccgccagggatggcgtcttttgcgtctttgcgaaaggcgtatgctccctgaagcccgcacagcggtgagagcgggcagcgtgtgagcttatccgttgcaaccagagttactatgctttgattccgttcgcaatataagcaggagcaacagcgtcgtgaattgccgacaaataagtcattgttattgttgagttcacagagagattggctttgctgtctccattcagagacagagaaaatgccagctgtcgctggataccgacatttcccgacaggcctgttgaatgaagctttgagctaattctttaacctgctgatttattgtgattttaaaaataatcataaacctggcacggcttgtgcaatagttcagctgtagatgctcattccacctcttatgtctgctgatgctacataaacctgggaatgatgcagagccaattttaggtacctgttgtctgcctgcctgtatcgcgaaagccttacagggttaacagacaccacgttgagtcaggtacctcccggttgtcttaccgacctgatcttgcacctgccactggcaggtgtttttttttgcctgcgaaagcgtgctggcagattgcgggcacaaaaaagccgggcaagcccggctttatcaggtatgaaaagaggatcaggcgttgggattgttcttcaaggtgagcagcaacccttcacgacgcatcttcgccgcttcttccgggcgacgcagacgatcataaacatccgccagccatgcataatcaaacgcgtcaggacgctgtgccagcgcctgctgcagtgcctcagcagcctgctgccattcaccatgccgcatcagcaactgccccagcgtactgtgcagcagcggtgttgcgccgtgttgtttgatttgctggcgtagaactttctccagcgcttccggattaccgcttttgatacgaggcatcagcagtaccagacgatcgtcataatgacgcttgaggccctccagcacgatcgattgcgcggtgtcgtgatcgttgcattcaatcagatgatccgccatggccacctgcagcgtcgtttcctgacgggttttgcggctcagatcgttccaccagcgcttcagcccatcgctgccctggtcagccatcgcctgattcatcagacccagccaggcttgctgctgtaatgcatcacgatgcagctcatcgccgacctgcgccttctgcatggcgggcagaatatccagcaatgcactccaggcaccagtacggacatacgcctgtttcggccaggcgcagcacttcaggatgacgcggtgccacttccagcagacggtcaatgctatgacgcgcagcatgatcttcgttacgtgccagctgaatacgtgcgcgggcaatttctaccggaatggtgttgctctccgacagctctgcagcacgttcaagatgctgattggcacggatttcatcaccacgctgttgcgcagcttctgctgccagcaggtagttcgccactggcacatcagcgtgatcggcatctttagaaagcagtttttccacctgacggtgatcgccttctgccagcttcatcagtgccgactgagtatgacgctgggcgcgacggcgtttacgtccggtaaaccagccacgggtacgcgcgccggtgtgcagcacgcggcgcagcagccattccacggccagaatcaccagcaggctgaggatgaggataatgaccaggccggtgacgctggtttcgatgttccagttatcggtctgaatcagcacgtaaccctgatgaccggcaatcatcggtcccagcaccacgccagcaatcagcaggataaagaggataaataccttaagcatgcttagcctccctgctgattagcagcggcagaaggttgcgctaacaggttccggacgcgggtctgcatcagctgttccagcaacggctgactttccaggttatccggcaggtccatattgatgttctgctggctcagctcatccagctgggcaaggaaggctttggtagcggcatcattggtgtcgtaccaggcgcgaacccatgcggacacggtgtcgatagattgtttataaatctcatcctgatgacgcggtaccgcctgagcagcaatcagcagacgcgagcggatattctcacgcaggtaaacatcctgattaggtgccagcagcggctgggcggtgttatcgcggcggcggatggtaataaaatcatccataaagttatgccagcttttcaccagattctgacgccattcgcgcacggaacctgacagttcaccgccatcgctgtccatcggcgcatcatcgctgtcattatcggccagacgcagattatcaacgttgttcgacagctggttcagtttgaggatcacgccgtcataatcgacctgcgtaaccgaagagaggttactgatatcctgggtcagcgcacgacgcacattcatgacgctgggatcattcatgtcggccaggctggcatcggcgcttttcagcagtgcagctgcggtggtgacatcctggtcgctccagagtttgcggccagccagtttcaccagatagtccgcctgtgccagcaaccagctgcgcacgtcgttgccagaaatcacggccactttttcacgcagggtttccagctcttttgctgacgcgtttctgctgtgtctgggctgtctgcaacgcggtttcagcgccgctcagttgctgagtcagctgctgtttgtcgctgctggcctgctgttgcaacgcgcttaattgttcgctcagcttctgattggtttgtgcctgtaaatcagcctgatgtttcccgttaaggtataaacccgcaccaatcgccagcgcaatgacaatcgcaactgcacccaacaccatgccaccatttttcgcattacgcggtggtgtgctgttgctggaaggagagcggtcgaccgctggggtggtttcttcaaccatggcggaggagtctttttgttccgtcatatgtggcacatcccattgttaaagttcagcgtaacgcgcgcagcagcgcatcgttatcggcaccatcggctacctgaatatcctgccaacccaatcctgcggccagggtagccaaacgttcactgacgacaaccagtcggcagttgagcagccattcctcgcgatcaactgcggggaacagcgaaaaaagctgttgtaacatttcaccgctggtcaccaccagcacggagacaccgcgatcgcgccagcggcgtccttcaacgggtccatcataatacttctggcagcgctgataacaggctgcaaacgacacctcagcacctcgccgggttaacgtctgagccagcaactcgcgtccgggatcgccacgcaggatcagcgcacgtttaccggcaacctgctgaagggtattcagccggatcaattcttcactggtttcatgcgcatgaggccaggtcacctgctgtccgctggcggtatgaaacgccagtgcggtgctgcgaccaattgcataatagtccagctcagcgggccatgctgtgacggtgtgttgtgcgtaatgtataacctgctgagaaaggataaaaaccaggtcgccagggcgaagtgcggcgagcttttgtggcagagaggtgagatcagcgcccggcgcaaattcgatcagcggcaggctccacgcctgtttgccaagggcatgcaggcgtgacaccagctctgccgctgcgggttccgggcgcgtcaccagaatggtcatgccggcggctgcccctggtaaacttcctgcaggatttcacgcgcgccgccattcagcagttcatcggccagtgaaatacccatctgttcagcctgagcgcggggaccacggcgtttcgccgctgaccatgacccggccatccggtgcgccgaccatgccgcgcagccagaggtcatcgccttccagcaccgcgaaactgccgattggcacctggcagccaccctctaaacgggtattcatggcgcgctccgctcggacacagacttcggtatcatcgtgattcagcgcctgcaacaggccaattaaggtggtgtcgtccagacggcattcaatgccgaccgcaccctgacccacggcgggcagggaaacttcggcaggcatcgcctgacgaatgcgatcttccagtcccaggcgtttcagcccggcgacagcaagaataatcgcgtcatactctccggcatcaagcttgccgaggcgggtgccgacattgcctcgcagcgagcggataaccaggtccggacggcgcgcactaatctggcactgacggcgcaggctggacgtgccgacaatggcaccctgtggcagcgcgtcgatagagtcataatgatgagaaacgaacgcatcgcgcggatcgtcgcgctcgcagatggttaccaggcccagaccttccgggaaattgaccggcacatccttcatcgagtgcaccgccatatcggcacggccatcctgcatcgccagctcaagctctttgacaaacagccctttgccacccacttttgccagcggcgtatcaaggatgatgtcacctttcgtgaccataggcaccagctcaacgcgcagtcccggatgggcactcatgagtcgttgctgtacataatgtgcctgccataatgcgagcgggctttgtcttgtagcaattctgaaaattttgtctaacatgctgttaaccatttttatcgttcactgaatatcctatcatctctgggtgaagactgtcagtttcaacggattgaaaacggcctgcgtgcggtttcaggccggtttattaagccataacgtgggaaccagagctgaaaaggcgggaagctggtaagaacgtgctaaactgtcaggtagcgcaactttctttacggtcaatctgcagggtgttagattgatcacgtttccagcaattatctgcccacttttttactttataagcggcagagtgtggaaacagggtgcttaaacactgggacaatcaggcgaaacgtcttgtacctctacattgagacactgaaacagagactggatgcaatcaaccagctgcgcgttgatcgtgcgctggctgctatgggacccgcttttcagcgcgtctacagtctgctgccaaccttattacattatcaacatccgcagatgccgggttaccttgaaggtagcgttccacatggcatcagcttcttcacgcctgatgaaaatcagcgtcagctgctggccgatctcaccggcgacagcgatctgcgtcatgccgatgcgccgaaaggcgaaatgccgattacggcgatctattctatgggcagcacctcatctgtcggccagaacagcgtctcggatctcgatatctgggtctgccatcaatcctggcttgataatgaagagcgtctgaatctgcagcgcaaatgtacgctgctgcagaagtggtgcgtttcaatgggcgtagaggtgagtttctttctgattgatgagaaccgcttccgccacaacgaaagcggcagtctgggcggtgaagattgcggttcaacacaacacattttactgctggatgagttttaccgtaccgcggtttcgtatggcgggtaaacgcatcctgtggaatatggtgccgggcgaagaagagcacaattacgacgactacgtaatgtcgctctatgccaaaggcgtgctgacccctaatgagtggctcgatcttggcggcctcggcacgctgtcggcggaagagtatttcggcgccagcctgtggcagctttataaaagcatcgactccccgtataaagccgtactgaaaacgctgctgctggaagcctacagctgggaatacccgaatacgcaactgctggcgatggatatcaaacagcgcctgcatgacggtgaaatcatctgcttcgggcttgatccttactgcatgatgctggagcgcgttacgcactatctgaccagcgttgacgatcagccgcgtcttgatctggtgcgtcgctgcttctacctcaaagtgtgtgaaaagctcagcaccgaagatcatcagcatcgcaccggctggcgtcgcgaaattttatcgcagctggtcaaagagtggggctggaacgaagagaagattgccattctggataaccgcgctgagtggaaaatcgagcgggtgcgcgaagcccataatgaattgctggatgcgatgatgcagagttatcgcaacctgatccgctttgcccgccgcaataacttaagcgtcagcgccagcccgcaggatatcggtgtgttgacccgtaaactgtatgctgcgtttgaagcgctgccgggcaaagtgacgctggtgaatccgcagatttcgcccgatctctccgaacccaatctgacctttattcatgtgccgcctggccgcgccaaccgttccggctggtatctctataaccaggcgccggacatggattcgattatcagccatcagccgctggaatataaccgttacctgaacaagctggtggcgtgggcgtggttcaatgggctgctgacccgtaaaacccggctgcatattaaaggcaatgaggtttgcgatctggcgcgtctgcaggagctggttaacgatgtttccagccacttcccgctgcgtctgccttcgccgacgccaaaagcgctctacagtccgtgcgaaatccggcaccttgcgattattgttaaccttgaacacgatccgacggcggccttccgcaatcaggtggtgcacttcgacttccgtaagctggatgtctttagttttggtcagcaacagcagtgcctgattggcagcatcgatctgctttatcgcaactcctggaatgaggtgcgtacgctgcacttcagcggcgaaacaggcgatgatcgaagggctgaaaaccattctcggcaagatgcatcaggatgctgcaccgcccgatacggtggaagtgttctgctacagccagcatctgcgcggtctgattcggacgcgggtacagcaactggtctcagaatgcattgagcttcgcctctccagcacacgtcaggagccgggtcgctttaaagcgctgcgtatggcgggcgagacctggggcctgttctttgaacgcatgagcgtttcagtgcagaagctggaaaacgcggttgagttttatggcgcgatctccaacaacaagctgcacggactgtcgatcaaagtcgaaacgaatcagacgccgctgccacccgtggtcaacggttatgccagcgaaggcattattcagttcttctttgaaaacaccactgatgagcgcggcttcaatatctacatccttgatgagaccaatcgggttgaggtctatcatcactgtgaaggcagcaaagaggagctggtgcgcgatgtcagccggttctactcctcatcgcacgatcgctttacctatggttcgagctttatcaacttcaacctgccgcagttctaccagattgtgaacaccggtgagcgattccaggtgattccgttccgtagccagacgctgacgcagctgtgtacctcgcagcctgacaacgacaacagcgactatcagccacgctatcaggtgcactgatgctgacgggctgcctgcgctctgcaggtggccgctatcttcccggcttgtcacccgcttcacgctatttgcgggcatttcctgttgcttttccaccttcaactgcgatgataagcatccaggtaaaggacatgaagagcataaagaatgaagaaagtaataagcctgttggccatgacactggcagtaatcagccttgcaggttgtggtctgaaaggaccgctctacttcccgccgaaggatcagccgaagaaacaacaagccccaaccgaccgccagaaagcggatgcctctaaagccgatgtcggcgggctggttaccggcaattcaggcgtaaaagcgaactaatctgatggcttatccggcggagcaaaaaatgcagttctccaaaatgcacggtctcggcaacgattttatggttgtggatgcggtgacacaaaacgtcttcttttcgccggaattgatccgccggctggccgatcgtcatctggggatcggttttgatcaactgctgattgttgaaccgccttacgatcccgatctcgatttccactatcgcattttcaacgccgacggcagtgaagtcgcacagtgcggcaacggtgcgcgctgctttgcccgctttgttcagctgaaagggctgaccaacaaaagtgacatccgggtcagtacgcagaatggccgcatggtgttgaccgtcacgcctgacgaccaggtgcgcgtgaacatgggcgagccaaactttgagcctcagcaggtgccgttccgcgccaacaaggccgaaaatctctatctgctgcgcgtggccgaacagacggtgatgctgggtgcggtgtcgatgggcaacccgcactgcgttatccaggtcgaaagtgtcaaaaccgcgcaggttgaactgctgggtccgattctggagagtcatgaacgcttcccggatcgcgtcaatgtcggttttatggagatcatcaatcccgaacatatccgcctgcgcgtctacgaaacgcggagcgggtgaaacgcaggcgtgcggcagcggcgcctgtgctgccgttgcatgtggcattcagcagggcattctggcacccaaagtccgtgtcgacctgcctggcggaacgctgcacatcacctggaaaggcgccggtcagccgctctatatgaccgggcctgcgacacacgtctacgatgggtttattcatctatgaaaaatatcgaagagcaggctgacagttcggttctgctggacgatcaggccgtcagtgattatctgcggcagaatcccgatttctttatccgcaatgcccgtgcagttgaacagatggccgtgccgcatccggtgcgtggcagcgtctctctggtcgaatggcatatggcgcggcaacgcaaccatattcagcggctggaagaagagatcacgctgctgatggagcaggccagcgctaaccacgaactgtttgatcgtctgctgtcgctggagagccatctggccgcggctgactcgctgcaggatatgctcaaccgcctgcatcgctgggcgcgtgagctgggcctggcgggtgccaatgtgcggctgttcagtgataaatggctgctgggcgcgccctccgatttctttcagctgagcctctcgcgtcaggcgtttgaaccgctgcgtatccagcgcttcggtaaccagcatcactatcttggcaacattaacgggccggaactgctgctgctgctgccgcaggccaaagcgatcgggtcggttgccatgtcgctaatgggtgaggagggcgatctcggcgtgctggtgttcagcagtcgtgacagccagcactatcaatcgggcatggggacactgctgttgcagcatctgtcgcagatgatgcctgatctgctctcccgctgggttgaacgcgcatgagcagcgcgctgcaggaggccgtcgacggatttctgcgctacctgaaagtggagcgccagctcagtccgttaacccagagcagctatgcgcgccagcttgccgcgctggtggcgattgctgatgagatgaagctcagcagctgggcgcagctggaaccggcgcaggtgcgcagcatggcggcgcgcagccggcgcgccggactggccgccagcagcctcgcgctgcggctctccgccctgcgcagttttctcgactggcaggtgagccagggtttgctttctgccaacccggccaaaggggtgatgacgccgcgtaaagcgcgccatctgcctaaaaacattgatgttgatgaagtaaaccagctgctggagatcgaccttagcgatccgctggcggtgcgcgaccgggcgatgctggaagtgatgtatggcggcggtttgcgtctctctgaactggtgaatatggattgtcgccacgtcgatctcgattcaggcgaagtgtgggtagtcggtaagggcagcaaagagcgccggataccgattggtcgcacggcggtcgcctggatccagcactggctgccgctgcgtgaaacctttggcggccaggatgatgcgctgtttctttcgacgcgcggcaaccgcatctcgccacgcaacgtgcagaaacgctttgccgaatggggcatccgacagggcgtggccagccatatccatccgcataagctacgacactcatttgccacgcatctgctggaatccagtggtgacctgcgcgccgtgcaggagttgctgggccatgcaaacctgtcgacgacccagatctatacccatctcgatttccagcatctggcttcggtgtatgacgctgcgcatccccgcgccaaacgaggaaagaacgaatgaaattttatcgtccgctgtcggccataaaagccatgaccttcgaccttgatgacacactctacgataactacccggtcatccgtcgtaccaccctggagtcccatgccgcgttacaggcttttcatccggcgctgcgtgacttcacgccgcaggattatcagcagttgcgcgatgagctgctgcagcgcgaacctgatatctatcatgatgtttcggagtggcgacgccgttcggttgagctggcgatgctgaatatcggcctctctgccgctgaagcctccgcgggtgcggcagaagtgatggcggtcttccatcagtggcggagtcaggtcgagatgccggatgagacgcaccagacgctgaaagccctggcggagaaaatcccgctggtggcggtcaccaacggcaacgcctgcccggaaaaaatgggcattgcagaatacttccgcttcacgctgcgggccgggccagacggtcgcgccaagccgtggcaggatatgtatcagcttgcagcgcaacgccttgatatcgcgccacaccatattctgcacgtgggtgatgacctgaccaccgacgtggcgggctcactgcgctgcgggctgcaggcctgctggattaacctgcggcagggcaatctgatgcatatcccggatgcgcgcctgttgccgcatgtcgaaatttcgcggttggcatcactcacctcactgctataatggctgtaaatttatccagtcgtctcctcttttctgttttgccgccgtcccttatccggcgtctgtggcgccgcctgactggcagcgataatgccttacggcaggcggaataatcagtgtgacgacggcgtttttttctttggtaatcggtgcttatggacgtttctgaactgctcgatggtttgaatgacaatcagcgcgctgccgttgcggcaccgcgcagtaacctgctggtgctggcaggcgcgggcagtggtaaaacgcgggtgctggtgcatcgcattgcctggctgatgtcggtggagaactgctcaccctattcgattatggcggtgacctttaccaacaaagcggcagcggagatgcgtcaccgtatcgagcatctgatcggcacca

SEQ ID NO: 20 - DNA, 613237 bp, Pantoea agglomerans NY130
ttttcaatctcaactatgatgaagatcgcgatactgacaatcagcgaaatcagccagtagttaatcggcagtggacgggtaccaaacagcgtgttcattaatggcacataaataatgatcgcctgaaggacaatcagtaccagcgtcaccagccagataccgcgatttttcagcagaccgcgatccagtgagaagccatccgagttacggcagttaagcatgtaggcccactgcgcagtcaccagcatctgcagcagcacggtacggataaactcggcactgtagccacgcggttgcagccaggcttccagcacaaaggcactgattgaaatcagcagaccgacaaacaccacgcgccagatggcgtaagcgtccatcacgtgtgctttgacattgcgcggtggccggcgcatcgcattcgcttcagcaggctcaaacgccagaccaaacgacagcgtggcggatgttgccatgttcatccacagaatctgtaccggggttaacggcagcagattgcccatcagaatcgcgataataatcagcagaccctgcgccaggttggtgggcataataaacaggatggttttcttgagattgtcgtagacccgacgtccctctttgactgctgcagcgatggtggcaaagttatcgtcggccagaatcatatcggccgcctcttttgtcacctcggtgcctttaatacccattgcaataccgacgttggcctgtttcagcgccggagcatcattgacgccgtcgccggtcatgccaacgatctcgccgctcgcttccagcgctttcaccagacgcagtttatgttccgggctggtgcgggcaaaaatatcataggtttttgccgcgtccgccagttcggcgtcgctcatgtgttcaagctggtagccagtgatagcagcctggctgttgccgattcccagcatctgaccaatcgccatcgcggtttcctgatggtcgccggtgatcattttgacgcgaatgcccgctttctggcactcgtcaatggcggcaatcgcctcgggacgggggggatccatcatgcaggccagacccagcagcaccatgtcacttttcagatcggcatgatccagcgcggtaacgggtgcagaggttctcttccatgcggcggcaacggtgcgcagcccttcgctggcgtaggtggtgatggcggcatcccagtacgcacggtctatcggctctgcaccctccggcgtttgctgctgttgacacagcgtcagcagcacgtctggcgcaccggtcagcagcacataagattcgccgttggcaacacagctgaccgacatatatttatagagggaatcgaaacggcagcttgctcaccacctcaaccggctgaggtgtcgtctggcccttcgccgccagcaccttcagcgcgccttcagtcgggccgccaacaatcgtccagtgaccctgactttcctgacgcagctggctttcattacaggtgtctaccgcatgcaggaactgctgaaacagcggatcctgtgccgcagagagtccacttgcgtcgccctgctcagcaacaatctcccctttgggttcatagctgtttccgctgacacgccagcggctcttcgccagcaccaccgctttcaccgtcatctcattcatggtgagcgtgccggttttatcggagcagatcaccgacatcgcgcccagtgtttcaacaatcggcagcttacggataatcgcctgggtgcgtgccatcgactgcacgcccagcgacaggatgatagagataatggcaggcagaccttccggaaccgcagcaaccgccaggctgatgacggacagcgacaactcgcccagtggaatgtcacgcagcagatagccgaagataaacagggcgaccatcatcagcaggatgatgaaaaagatcgctttaccgagtttgtcgatctgcaccagcagcggggttttaacctcttttatgccgctgatcatttcgttgatatggcccagctcagtatcaccgccgctggcgatcaccacgcctgcggcggtgccggaactgacggtagtgcctgaaaaagccaggttcagacggtcgcccagcgatttttcaccgctcagcgtatcggtgttcttcgacaccaccgtcgactccccggtgagaatcgcctcttcaacccgaagattattgacctcaaacagtcgcagatcagccgggattttatcgccggggcgtaacatcaccacatcaccgaccacaatatcgcgcgtcgcgaccgtgacctgtttgccatcccgcaccaacatcgcttcactggcaagcatgttctgaatacttttcagtgacttctcggcattattctcctgaataaagccgattagggcgttaatgacggccacgccgataatgacaaaggtatcgacccagtgacccatgatcgcggtgatcaccgccgcggccagcagaatatagatcagcacatctttaaaatgcgcgatgaatttgagcagagccgatttctcagctttttgcggaagggcattgggaccgtgtttctgcaggcgtttcctgcgcagtggcggtggataatcctgctgatgagctctgcagttcggagaatatctctgccacactacgctgataccaggggcgctcagataaagctaacgctttatcctgcttatcattatttagcatatataaacctcgtgccatttagcgatgaaataaaggcgcaattaaaagacatgcattttgcaggcagcccctcctgcaggtaatgaccgatatcatatttacgtaagaaacgtctgacgaataacataaaatggctaaattaaatctaacctatattatgagaatgacaacgttgtttttgtttagctaaggtttaagtatgctgatgcagtgtgcatcggtttatactctggctcgcaaaaggaaactctgatgaaaaaacagagcattatcatgctttgcggtttcgttattctcgcggtcgccgcaacgactctggtgggcttactgacctggctggtggtctctcagatggcggcgtaagccgattcaggcgaagcggccctgccgcttcgttaaacttatatgacgaagattaaaaataagtttatcccggtcgcgataagcatcagggtttattacgccttaatgcttatcaaaccgcagtttaaaagctgatgttaaggcgaagaaaatgattaaacgcaaggttatcctcattttgctctgttgtttttttatgacagcgtgcgatgaaaaaaaagaaccggatgctcccccgccccgcgtaattaaagttttcacccttgagtcggacatcgctcaaaatatccggatatttcctgcgcgtattcaggcgggtgataataccgatcttgcgtttaaacgggcaggccagctggtacagcttgatattcgtgacggaaacgcccgtgaaagcgggacagcttctcgctaccctgaatgatgcagatgcgaaactacgggtacgcgaccgccagactgcactgcaactggcggagcgacaatttcagcgcttcaatacgctggcccagcgcagcgccgtttcaaagtctgaaatggatgtgcagcgtgctaatcgcgatgccgccgcgactgcgctgaaaatcgcacaggaggagttacagtttcttagccttcgcgcgccgtttgatggcgtgattgcaagggtacaggcgcgtaatcatcaggtcgtggccgccggacagcccattgcgctgctgacccgtgccgatctgctcgacgtcatctttacgctgcccgaaaccctcttcaccagcctcgatatccagaatattgactatcagcctgaggtgcagtttaacgccctgccaggccgctttttcaccgcacaatacaaagagcacaccagccagacggatgccgccacgctgacctatcaggtggtgctgaccatgccgcgtccggctgatctccctggcgttgccggcctcagcggatcggtgcgcgtcaggctgcataacctgccgaatgcccctgcccagccgcgtctggtcgtgcctgcggcggcggtgttcaatcccgatcgcagccccaccaatcaaccgcacgtctggctggttgagcaggatggtgaggcgctgcgcatcaaagatcgacctgtcgaagtgggccgtctcaccgcccagggcatagaaatcatcagcgggctgaagccgggcgaccgtatcgttgccgccggtgtgggtgagttgcgtgacggtgaagcggtgcgcatctggcagcgcgagcggggtttataatgcgtattcaggagcattttcttgataaacccattcgcatctggatggtcattctgctgctgggcgtgggcggcatctatgcgctgctcaacattggccgcctcgaagatccgctgtttaccattaagtcggcggttattgtcacccactatcccggcgcgtccgcacagcaggttgaagaggaggtaacgctgccgctggagaatgcgctgcagcgcctgccgtcgctggacaatgtcacgtccatttctggcaatggcctgtcgcagattaccgttaatattcatacccgctatctggccgatcagctgccgcaaatctgggatgagttacgtcgtcgggtcggcgatgcggcccggcagttcccgcctggcgttcaggccccgctggttaacgatgatttcggcgatgtttacggctacttcttcgtcattcacggtaaagactttaccaacagcgaactgcgcaactacgccgatcagctgcggcgcgatctggtgctggtgccgggtgtggctaaagttgcagtagcgggcgtcgagcaggaggagatccgcatcgctctctccgccagcaaaatgaccgcctatggtatgacgccgcagcgcgtcgccgatctgctgagccggaataacagcgttgccagtgccggaacgctgcgggtcgacagcgaatcgatccgttttcatcccaccggcgaactgcagacgcttgacgatctggctaatctgccgattctgcccgctggcaacccacagaaacgtgcatctgcgcgatatcgccaccctgacgcgtggcgttaccgacaatcccgccaatatctactttgcagacggtgaagcggctctggctatcggcatttcgttcgcgcccggcgtcaatgtgattgatgttggcgacgcgctttccgcccgaatggcgcactatcagcaggatacgcccgccggtatcagtctgaaggtgttctataaccaggcccatgaggtgaaacagtcggttgatggctttatcctcaatttcctgatggcgctggcgattgtggtgggaacgctgctgctgtttatgggcctgcgcagcggcatggtgattgccgcctcgctggcgcttaacgtgcttggcacactcctgatcatgtacctgtttaaacttgagctgcagcgggtgtcgctgggcgcgctgattatttcgctcagcatgctggtggataatgccattgtggtggtcgaaggggtcaaaatcgatcaccagcgcgggcaccctttacagcaggccattgcccgcatggtacggcgcactgccctgccgctgctgggtgccacggtgattgcaattcttgcctttgcgcccattggcctgtcgcaggattcgaccggcgaatattgtaaatcgctgttccaggtgctgctgatttcactgatgctgagctgggtcacggcgctgaccttaacgccggtatttatcaactggagtgagaagcgccgcagcacggctcagcctgagcaaaccgaaccctcggcaccttatcagggcatcgtattccggctctatcgtcaggcgctgggcggcctgctgcgtttccgcctgaccacgctgacggtaatggtggcactgctggctctgtcgctgtatggctttaccctggtgaagcagaactttttcccctcctccagcacgccggtctttttcaccgatctctggctgccctatggcaccgatattcattacaccgcgaatacggcggcggatattgccaggttcattaatcaggatcctgaggtcgcagccacggtcacgacggtgggccagggcgctctgcgctttaccctgacctatgacgcggcacggcagtacagcaacttcgcccagattatggtgcgggttaaggatggccgacagcttgatgcgctggcgctgaaaaccgaggcctatattgagcagaacttcccacaggtgaatcagcgcatcaaacgtatccagtttggcagcgccagtgacagcgccattgccctgcgggtgatcggccccgatcccgaagtgctgcgccacatcggcagccagctggatgccattttcctggcggatggctcaacgtttccggtgcgcaatgactggcaggagcgcagcaaagtgatccgcccggtctattcggcgctgcgtggtcaggaactgggtatcgataaacgtgacatcgatcaggcgctgagaatgaatttcagcggtgacgcggtgggcattttccgtgacggtttcgcggctgatgccggtgatgctctatccggctgatgaagagcggcagagtgtcgatcacatcgagaatattcagctgtggagtgcggccctgcagcactttgtgccactgagcaatgtgatttccgacttccggctggagtgggagaatccgctgattatgcgccgcgatcgtacgcgcgtgctgacggtgcagaccgatcccgatcccgcttcagggttaacctccgcacaagtggtggcgcgggttcagccacagatcgaccagcttaaactcccggcgggctaccggcttgaatggggaggtgagctggagagttcacgtgaagcacagagcgggctgctgagttcgctgccggtgggattcctggcgatgttcatcattaccgtgctgatgtttaactcgctgcgcgacgcagtcgctatctggatcaccgtgccgctggcgctgattggcgtcacctgtggctttttgttcaccggtattccgtttggctttatggcgctgattgggctgctgagcctgtcgggcatgctgatccgtaacgggatcgtgctgattgaggagatcaggctgttccggcaggagaaattgctgcagctggcgattattgatgcggcgacctcacgtctgcgtcctattctgctgaccgccttcaccacggtgctgggcctgctgccgctgctgcgcgacgtctttttccagagcatggcggtggtcattatttttggcctcgggttcgcgacagtattgaccctgctggtgctgccggtcatctatcgttgcttccatggtcgggaggcgcacggtgaataagagcggactggcaatgctgaagacgctggcctgtatcaccgccgtctcgtttttcacgctttaccagagctacgacagctaccattacgacattaatctgacgctgaacgtgctgagttttgtttcgacgatcgccacgccgctctattttctgctcagcggctatatcgacgccggtgagctgcatacacccgcgtggcagctcggcaaaattcgccgcattctgctgatttttatcttctggttcagctttttctggtttgccgggatgcatcataagggctatctgattcagccgtggtttgtaattgcgctgattgtgatttatgtgtcgcatccgctgattgaccgactcattcagcggcctgggctgatggcatcggggattttactgctgctggtgttagcttttgcctatgacctgctcgccagcctctacccgggccagcgggccttttcgctgctgccgcaataccgaatctggacctgggtgctctactacctcacaggtcggctgatggccgcgccgcgcgtgatgcagttgctgacatcacccagagtgataaagatcagcctgctgctgctgcccgcggtttatctctttacctggctgtatgagcgtcattactttcttgcgcgctttctggcgacccataacgatgtggtgctgacgggctcgcaggtttatctgctggtggtgctgattgtgatcagcattaacgccattcgcctgccggaaaaagtccagtggctgacgccgtttctgacgaccctggggaagaccatgaccggcgtctatatcctgcactatctgatttttggcctgctggcggcggcaatccgcatccagacgctgggcgataaactgctgatcatcgccctgacgttaatcttctcaatggcgctatcactgctgctgttgcgcatccccggcgtcagtaagctaatcagcctgtagtcgcagagcggctcgttcggttgccgcgcgacgagtggcaagaaactcagccattttagcccgtgcctgctccacttcctgtggcggtgcggtatgcggtgaaccgctggtaaacggcggttcgggatcatattccatctgcagctgaaccgctttcgccaccgcgtcacccgcaatttcggccaccagcgtcagggcaaaatcgatgccagaggtcacgcctgcgccactgatacgattgcggtcgcgcaccacccgttgactgaccggctccgcgcccagcagtgccagctgatcgatggaactccagtgcgaggtagcacaatatccctttagcagtccggcggcccccagcaccagcgaaccggtacagaccgacgtaacccacttcgcctgatcggcctcctggcgaaggaaattcagcgtgacgtcatccgacatcagggcgatctgtcccggcccgccaggcacacagatcacatccagtggcgggcaatctgcaaacgaagtagtcggcaatatcgacaggccgcgatcggaacgcaccggatgaagatctttccagatgagatggcattcgacaccaggcgtgcgcgcaaacacctcccacgggccggttaagtcgagctgagtgacatcagggaacagtaaaagaccaatctgtagcggacgattcatgcgtgaactccgggcaggtgatgaaacgccatcatgccgcgatgcccggtcagatatcaatcccggctaccggaaactatttccagcgtatccaccagcgatgagggtaatatctggccgtgactctgaccgggataacgcgtaagaatcagtctggcaccgctcgggcgcaggatgtcggtaagcgcacgctcttcctgctgaagatcgtcagagtggccggttcggcgttcggtgatgccatcgccctccatcagatagagcgacaaatgtttaagcggtccggcgtcggcgcgtcgggccagggtaagaatgcgctgatgattccagctcagcgagggagcagccgaaaagtaatggctgaaccaggcggcatgcaagaaggtatccagcacgaacagtccgccgtaggagtgcccccagagcgcacgccgctgcggattactgggcgcaaggcgttctgcccacgggacaattgtgttcagcagcagctgacgaaactgatggctgcctccgcctttgcggccatgaggctgagtgaccagagtatcaggcgcatcattgggtggggtgtagtcgtaattacgcgccaccacatcaaagggcaaatgggtgtcgtaacccaccgcgaccagcactggcggcgtgccgctgctcagctttttaagcagaggttctgtcaaatgtgccatcgccgcattgccatccagtagccagagcaccggatagccgcctggcggcgcatcgcttttggggatagcaagccacacccgatagtgccgtttccccatcctgtgagacaaactttttactctggaagcgataccaggcggagcctgtttcggcgatgttcttacccagcggacgcatatcgggtcgggcaatggccggaacggcggttaaaccggctgtcatcacggtcagcagcatcaggaggaaacaggtacggatagtgttcattcagcaatccctgcaaggttatcgggctaatcacgcctgagagtgtgccatcctgacaaattttcactgcgataacatccccgcttttgccggggttaatgacatcctcagggcacgccgagaagacgcaatagtgccgtcatcgccgccgcccccagaataatcataatcagcggcgcccgacgccacgccagcaacagggcaaagcccacgcccgccacccgtgccacaccggcaaaatgctggccttcaaacagcgtggtggtggccgctaccgccagcaacaatatcgtggcggcgtcggagagcatctgctgggtgcactcgctgattggcagacggtttcccagcctgacgcctgcaaaccgcatcagataggttccggcagccagcagggcaatcccggcgataatcattccctgatgtgtcatttgcgcgatctccatgtcagcaggcccagcagtgaaaacagcaccggcatgcccgccggaaccagtggcgtcgccagcaaggagagcagcgcgccgacggtcgcggggatccgggtgcgtcgctggcgcagcgccgggaagatcagagcaatcaggatcgccggaaacaccgcatccagtccgatcaccgagacatcaggaataaactgcccgattgctgccccgatcatgacgctgaccggccatatcaagccgataccgataccgcacagccagtaagcactgcggcgctgcgccagttgcggctgagagatcccaaacaccacactttcatcgttcatgatgtgacagcccagccagcctgacggaccctgccccaccagatccttgaccgcgatgccaaacggcaaatgacgtgcgtttaccagcaggcccgctgcggcggcggtaaatggactgccgccaccggccacaatgccgataaacaggaactccgacgcccccgccagcaccagcgttgagagcgccagcggcacccagagcggaaacccgtcggccgacgccagcgagccataggataaaccaacaattccatcagccaggcagaccagaaaaatcgctttgatcacccctttgtccagcaactgcatttgcggaaaaagcatcactctgtctcataatgaacatataatccgatataatgaacactgcgaaagcgttttacaagatgaacgttatgttcgatataaaaaacattcaggttatcaggagtgcgtttgaatacccctatcagcattattgccaatgccttagtacgtgaacgtcagcgagccggtctttcactggctgaagtggcgcgccgcgcagggatcgccaaatctacgctatcacagctggaagcgggtaatggcaatccgggcattgaaaccctgtggtcgctttgcgtaacactgaacattccattttcacgtctgctggagccggatgcgcgtcgtctgcaggtgattcggcgtggacagggcctgacggttaccgccgatcttgccgattatcaggccgttttgctggcctcctgcccgcccggcgttcggcgtgatatctatctgctggaagttcagcccggcagcgaacgcatttcccagccccatatccccaataccattgagcatattattatcgctaaagggcgtgcgctggtgggcccggtcgacagtgcggtggagctggatgtgggggattacattacctatccgggcgatgagctgcatatctttcgggcgctggaagccgatacgatggcgctgctggtgattgagcacagctgatcactgtttagtgagcttctgcagggtttctgcgggcgtaaggtgagtgattagctgcacctcactgctcagcctgatctccggatagtgctcgcgcatcccttccagcagcacctcatcaggccattcctcctgtttcccctgtgtcgcggcgacttcgcttaagcgcagcgtgtcgacctgcttcacccacacgattaccgcgtccgtttcatcgtgctgattcaccagtctcagcggacccatagtgatatcgccctcctgccagcgaatcgtcgaggttttctctccggacctgacggctggcatcagacgcgggacaagcgtgagttgttgcatttccactcccttttaaacgctcattgatacccgaaacaaaaacacaaatccgggttgaaaacaaactcaccaatgttatgttataacgtatctataatcccgttcttacaggtaacatcatgacactctctgctctgacatccgacgatccccgtctgccggttgccgttctctccggctttctcggtgccggtaaaactaccctgcttaatcatattctgaacaaccgcgaaggacggcggatcgcggtgatcgtcaatgatatgtctgaaattaatattgacgctgcgctggtgcgcgatggcggcgcgcagctctcccgcaccgatgaaaagctggtcgaaatgagtaacggctgcatctgctgcacgttgcgtgaagatctgctgctggaggtaaaacgtctggctcaggccgggcgttttgatcaactggtgattgagtctaccggcatttctgaaccgctgccggttgccgaaacctttacgtttgaagatgaagcgggtgaaagtctgtcagcctatgcccggctggacagtatgatcaccgtggtcgatggctttaacttcctgcgcgattatcgttcagccgatgatctgcagtcacgtggcgaatcgctgggcgcgcaggatgagcgctcagtggttgatctgctggtggatcagattgagttttgtgatttgctggtgctgaacaaaacggacctgctcagcccggcgcagctgcaccagttgaagggcatactgcaggcgcttaatccgcacgcgcttattgtgaacagtgagtttgggcaggttccgctggactgcctgctgaataccggccggtttgattttgaccgggcagcgcaggcacccggctggctgcagaccctgcgcggtgagcatcagccggaatcggaggagtatggcattcgtaactttgtctatcgcgcccgtcgtccgttccatccgcagcgtttttggcatgcagtaaaccaccagcttgacggcgttatccgctctaaaggctacttctggctggccagtcggccggaatatgccgcgatgtggtcacaggcgggcgcggtggcacgtcagggttatgcggggcgctggtgggtcagcgtgccgcgaactgaatggccacaggatgcggattcgctcaattttatcgctgaacagtggcaggaaggtaccggcgatgcgcgccaggagctggtctttatcggcattgagatggacgagaagagcgtccgtgccgcgctggatcatgcgctgctgacaccacaggagatggctgcggggcctgaacactggatcactctggccgatccggtgcccgcgtggttcgatgaaaccaccgcctgacgccgcggttgacgtacttctttgacttcgcaatagtaaacgaaccggcgggtagcagttttccactaatccctgttcaggagagaccagatatgccacaacgtattgccgtaatcggtgcaggcgtgctgggtttagccgtcgcgcagtcattgtcgcgacggggcgcacaggtcaccgtcttcgataaaaactatcctggcagcggaaccagtcagatcagctatgcctgggtcaatgccaacggcaaagaacccaccagctaccatgatcttaatgcccatgcgatagacgagcataagcgctggcaggccagccatcctgcatcgccccgatggctgctggaaaccggcacgctggagtgggcagccgatgaatcatccatgcgccagctggcgcagcgcgcagcaaagcttacgacgctcgattaccccgtagagaaacgtagccgcgccgcacttctgggtgcaatgcctgagttgcggctcgatccccgcgttcagcacgcctggtctttcccgtcggagtgtctgctttatccgagcctgtttatcgcctctctgctggcagacctgcgtaccagtggcgggcagctggtctgcaacaatgaagtgacgacgctcactgaatcggcgcaggatgtccatcttacgctggccagtggggatgaatggcgcggcgatcagctggtgctggcgaccggccgctgggcaccggaactgataagccagtgcgggcttgaactggcgatgaccgatgcgaaccgcgccgatcctgttgcctgcagttttctggcgcagacccagcctctgccgatcccacttaaatgcaatctgattaccccggaactgaatgtgcggccggatggtggcggccgcctgatgctgcaggcgctggatctggatcagcatgccgattcggcgcggccggtctcgccggatggactgattggcaaagagatgctgcgtcgattgcggcggctgtttagaaatacggaaggcgcgagaattgagcggattgaaacaggacagcggtcgcgtccgtcagatggcttgccggcattaggctacatcagcgagtcagcacgcgtttatctgatggtcagccatagcggcatgacacttgccccattgctgggcaggctggtggctgaggagatgctgagcggcacagcgtcaccaatgctgagtgcgtttgcaccgcatcggttgctgcgtccgctcagtgcagtcgctaaaacagcgcccgcttatcttccgtcggcacagtaaacactagcgacgattcttccacacggtctgcacgttacagaattcgtgcacaccaaagtgcgacagctcacggccgtagccgcttttcttcacaccaccgatggtaacgcgcggatcggacgcgccgttgccattaataaacacagcaccgacttccagctggagcgccagacgatcggcaatctcttcattaccgctccagacggtggcgctgaggccaaattcgctgtcgttggcgatctccagcgcatgttgtggatccctggcgaccgcaatagcggctaccgggccaaacagctcctgcttgaacgcggtcatgtcgctggtgacatcagcgagaatggtcggcgcgtagtagttaccctgcccggccactttctcgccgcccagtaccagacgtgcaccttcacgcagcgtggcctttacctgtccatccagttcgtcacgcagatcggcgcgtgccatcgggcccaggaaggtattttcatccagcggatcgcccatggtgagtgcctggaccgcggcagtgaagcgtttttcaaattcttcagcgatcggagcttccacaataaagcgtttggcagccatacacacctgcccggtattctggaaacgtccaataacggctgatttaaccgcttcatcaagatcggcatccgccagcacgataaagggatcggatccacccagttccagcacggttttcttaagtgctgcgcccgcctgtgcagcgatcgcggcgccagcccggacacttccggtaacggcaacggcggcaatgcggtcatctttgatggctacggagacaccatcgttgtcaacgttgatcaggttaaagccgccagcaggcagatcggttgacctgaacagctcagccatcagtgtggcgcttcccatgacgttaggcgcgtgtttgagcagataggtgttgcctgccagcaacatactcactgcgccccgcagaacctgccacaaggggaaattccatggcattacagccaggatcaccccgataggacggaatcgctgccacgcatcggcaatctgcgtaggctgatcggccagcattgcagggccatgttccgcataccagtcgcataagttagcgcatttcagaacttcagcgcgtgcctgtgcaatgggtttacccatctccagggtgatcatgcgggaaagatcctgctcacgcagacggatctgttcgccaagctgacgcaatacgcgaatgcggtccgtcatggtgctctgtttccatgctgcaaaagcagatgcgctttcagtcagtgtctgttccagctctgcactgtttctgcaaaggatagcgtgccagaatttcaccagttgtagggttacgtgataaggcatgttcagtcatggtgccgttttcctcattctgtcagtgatggagagacgatacgcgctgtagttgatgatgaaaaatgaataatagtgaggaagttgtttatcgattgagaatgaatgcggctatgacctattagtcggtcaggcagtgggcagattgcgggccagtttttgctggtggtcaacacgtctgaaaatgatgttacgccttaagttttccacttatacagtgaccagatcctaataaacgatccttaatagatcatatagagatcctaagagatccccgatcgtcgcaggtcgcaccccacaagggctgaaagggtgatcgcgttcactataatcagtaaagtgttcactgtaatcagtactttattcactgtaccaggtagaatgttcactgtaaacagtgctaatgttcactgtagtcagaaaacgatccctttcatccacagaatgaagatcttacgccatggcagataaagacaacgaaaacaaagcgttacttgaaccttttctgtcagtgacaaaaaacagcggtgaagttattcagcttcatcccaacaagaataataccgttcagcctgtcgctttaatgcgtcttgggctgttcgtaccgacgctgaaatctactgcacgcggtaaatccggtgctatggcatcaacggatgcgacgaaagagctgaagaatctgacgctggtgaaagcggaaggctacgaaaagattaccattaccggcgcgcggctggatatggataacgatttcaaaacctgggcgggtattattcaatctttttcccgctatccgaccaaaggcgataccgtcacgctgccgtttatcgattttgtgaagatgtgtggcattccctctgccaactcttcagctgccctgcgcaagcgtcttgatgcctctctgcgccgtatcgcgaccaatacgctctcttttgaaggcaacggcaaggcctatcacacccaccttgttcagtctgcttattacgatcgcgaaaaagatattgtgcgcatccaggccgaccccaagctgttcgaactctataacttcgaccacaaggtcctgcttcagctccgtgcgatatcccgtctgaagcgtaaagagtctgcgcaggcgctttacactttcctggaaagcctgccaaccaatccagcgcctatctcgcttgcacgcctgcgtatgcgcctgaaacctcggctctaagaccaccacgcagaaccatgtcgtgcggcgcgcgatggagcagctgaaagagatcggttatctggattactcagaagtgaagcgtggccgctcagtcttttttattatccacagccgtacgcctaagcttgatggcatcagtaatctggagagcatcgattcgctggatgagatcgagtttgatgattaactcctcatgttcactgtaatcagtattcctgcgtggcagtgtcactttctgcgttaccggtgacattgcgccatccactcttcattcactgtaatcagtactccccagggattcactgtgatcagtaacgttcactgtaatcagtatacgggccgccgggcaaaagtgtgttcagaccccgttccccttcattgtgcgtgataacaagagcttataagtaagttagtacttactctcatattggttagcactcacttatactgtgtttactgattacagtgaatgccctgacttcggttggctaagcctttctctgctgattacagtgaatcctttttactgactacagtgaatgcctttgctctgccctgttttcaaagagcattaccgactggccagcaaatcagggttggatgcggtttaccatgaggggtctgctcagcgtgattcacatgatacgtatgacctgaatgacacacgtaaccagagagagcagcgtgacactattactgattacagtgaatgtttgccgatgggcactaccctcgcctcaccattgaatctcttaaacggctttccgaatcgctactgattacagtgaacgttgttgccagatgtccggtctgaagcgagtcataactgccatggcgagatgctaatcttgtactgattacagtaaacgttctgctgattacagtgaatgtttgctgcggtgtacctgaaggcatcgtgcattctactgattacagtgaacgttaaagtgaacctgctgacggcattgctgatgtatacgatacggggctggtgcatgactggctgaagggcgacagaagaagccgttgctcgcaaggtctggtcacttcatgactcacgaccaagtcggcacacactgatgcagaaacagaatcgcctctgtctacttactgctatctactgactcatattacgaccccgtcggcacgccctgattcagaacagaatcgcttctgtctacttactgctgactactgactacagtgaatgtttgcgcggttgttctccttctaatgcctcttctgtttgtgatgttactgactatagtgaatgtttactgctttctggatttactgattacagtgaacgtttatgggctttacgcttctgtatcgcagaccagagtcggttgtgacgttgccggtgtatattccctctccagattccgatgcttttatcatccgctgaggatttttcaacccatccttactgactacagtgaacgtttactctgccctgctccctcttctggctcctgatcggcaagtttactgattacagtgaacgttgctcttcacagagctgaacacgtaaaacgctactgactatagtgaatgttgaagtgatgcagtggcaaagatcagcactgcaagctgcagtcactgcctgaaatccatttatcaatgtatccatcgctctttcgcctgctccataacgtcaccgaaagagacacaagctttactgactacagtgaacgtttgatctcaaggttcgtcttctgtgttttcccctttcacgctcactgtacccggtttgtctgatgattttttaaacctgtttgctcactacagtgaatgttctactgattacagtgaatgctaaccgcaattaacctgcaaaagtatattcggccagatgaaataatgtgatgaagctcaccaaaacctgtgtggttacataaaaacggagattatgttgagaagataatttattgcctcacgtgcaggatttctgtataaagtcataaatcctacatgtttggagcaactatggctaatgatgacaagcaggtgatgaaggttgcgcagcgttcagaaacgcatgctgctaagcctcaccgagcaaattcaggcgcaaaagcaggaactgcatgaaaatacttactatcaggtctatgccaaagcggcgctggcaaagttgcccaaactgacccgagccagtgtggattacgcagtcaatgagatggaagaaagcggttatcaatttgataaacgtgcggccggttcttccgttaaatatgctatgtcgattcagaatattatcgatatctatcatcatcgtggcgtgccgaagtatcgcgatcgccatagtgacgcttacaccctgtttgtcggtaatctgaagggcggtgtctctaaaacggtttcaaccgtctcgctggcacatgcgttgcgcgcacatccccatctgctttttgaagatttgcgcatcctggttatcgaccttgatccgcagtcctcagcaaccatgtttctgaaccacgagcgctccgtcgggctggtggaagcgactgcggcgcaggcaatgctgcagaatgtctcacgagatgagctggtcaacgagtttatcgttccgtcgatcattccgggtgtggatgtgctgccagcatcgattgatgacgcctttatcgcctcaagctgggatcagctttgtgctgagcatcttccgcaacagaacgttcacgccgtgttgtatgacaacgttattgccaaactgaaaaaagattatgactttatctttatcgacagcggcccgcatcttgatgccttcctgaagaatgcgattgctgcgtcagatcttctgatgactccggtgccaccggctcaggtagactttcactcgacattaaaatacctgacacgtcttccggaactgattgcgattatcgaagactccggcgcgacctgtcggctgcagggcaatattggcttcatgtcgaagctctccaataaagcagaccacaaactctgtcacagcctggcaaaagagatttttggtggcgacatgcttgatgctgcccttccccgccttgatggtttcgaacgttgtggcgaatcctttgatacggttatctccgccaatccttcgacctacgtcggcagcagcgaagcgttgaagaatgcacgatccgccgcagaagactttgctaaagccgtcttcgaccgtatcgaatttattcgcctgaactgaggtttgtatgagcgcaaaaagaattacgattggcagaaccttcagccagactccactggaaaatgacacgccagacagccagcacaaccagacattcgttctggcaacgggcaagcgcgcgttgtttcgttttgaacgcattgccgccagcgacgttgaaagcaaaacgtttgtcacaatggaaaccaacggtcgcgatcaggcaggcctgacacctgattcgctgcgcgacattatccggaccattaagctgcagcagttctttcccgctatcggcgtgatgcgcgatgaccgcatcgaaatcctggatggctcacgtcgtcgggcagccgcgctctactgcaaaaccggcctggacgtgctgatcactgacgcggccatcaccgctgatgaagcccgccgactggcgcaggatattcagacggcacgggaacacaatctgcgcgaagtggggatgcgtctgttaacacttaaagatggcggtttgtcacagaaggagattgctgaaaatcagggtttgtcccaggctaaagtgacgcgtgccctgcaagccgccagcgttccgtcagatttgatttcactttttcctaatcacgccgagctgacctatcccgactataaagcgttgttacaggcagctgacaagttgagtgagtccgggcaaagcgttgaagctctgatcaaatccatttcaagggaaattgatgtggtctgtgcccgtgaaggtctggccgaggacgagcttaaaaatcatatcctgcgtctgattcgacagggcagccagactctgatcaaagaaccggagaaagataaaacccaggcgactgcgctctggtcttttgcggataaagatcgcttcgcccgtaaaaaggtacgcgggcggatgttcagttatgaatttaaccggcagtcgaaagagttgcaggaagagctggataaagttattacggagaccctgaaaaaatatctcaaccgttaacgtatctgcactcaaatcagccagcgatagacgctggctttttttttgattttttaggtaatcggcgttaatagagatggctgacacccaaatttcaggctgaaatcgccagatttttaagtgtgaattcatggttaagctattgaaatataataaattaatctattgtttcttgctgaaaaactgcatgaaatcgccacttcgctgaactctttcgccagataccgaagccgccaccaaaccgcacaggccactataaacagagataacgtttttcgtctgatgctttcgttgataaatctcatcgccgccagcgcgcatccgacggtcagaatattgcaagtaatgattttccggggctggttcattagtgaccaatcaacccccactgaacctcattaacagcgtaccggcttcacacactccgctaaaccctctgcctggcctttctccaatcattagcccgccagcgatatttcgtgattaactgtttgtttttattataaaagatgcaagaatttcagcctgaaatcgccatgcttgcagctaaaagctccctcgtttcaggcctgagggcgaacggataagatcagaaaagaggcgtatcttgagagcagtaaagtcctgaacagagagtgaaaaaagatactcagaaactatccctcacttatccacagaaaaagtggataactttttctgcgtgataagattttttttgaagaggtgcgatacaagatgcagctttggcagggaactccattaaaacctgatcagcggaaaaagattgtcatagtctgttcatagcggaaaggtagttgcatggcatcagattcactgtattgggtaaagcaggtgaaatcggcagcttatggacgaagagcccctatcggcctacctgataaaagacgatggctcactgcactgctgtttacagtgaattgcgagaaataacgtctgtatggcattgaaccgggttatcagtggctgttatcagcatagagcgtaattgctgatgcgcaaagagtgctgaccactgcaatcagtaatcagaccgatgtgaagtgacgtaatgcaatgatgatcttccacggcagaaccgaacctatgcagaagaaaaccgggccaggcccggttttgatatgaatcaggcttcaagccaggcggtgatttgcttaaccatggcatcagttgagatgccataacggtcatgcagcgtcggtagtgcgcctgctgcaaggaaagcatccggcagcgcaatctgtttaaagcgcggtgtcacatggtttcgcattaacaggccggcaatagcttcgcctaatccaccggttatcgaatgattttcagcggtgataaccagctggttatgatgcagtgctacccccgcctcacgcaggatggtctcttcatccagaggcttaatcatgggtgaatgaaccacaccgacctcaatcccctgcttctccagcgcttcagcggcctcaagcgcccgcatggtcatcaatccgctgctgataataacggcatgcttaccgccgcgcaggcgctgagccttaccgtgctgatagcgatagtcatatttatccagcaccagcggaaccttaccgcgcagcaggcgcaaatagaccggaccctgatgttcagcgatagccggtatcacctggctaatctccagtgcatcgcagggatcgatgatagtcaggttcggcatgccacggaagattgccaggtcatcagtcgcctgatgactcggtccataaccggtggtcaggcccggcagtgcgcaggcgattttaacgttcagattctcttcggcgatggccatgcagataaaatcataagcgcggcgggaagcaaagacggcataagtggtgacaaaaggcataaagccttcacgcgccatacctgctgcggcgctcatcagtaactgttccgccatgcccatctgataaaagcgtttcggaaaagcctctgcgaacaggtgcagatcggtgtatttacttaaatcagccgtcagccccaccacatctgagcgctgctctgccagagagaccagggcatgtccaaaaggagctgaaaccgtgggctggccttcagcggcgatcgaggcgatcatggcggatgtggtcagacgttttttttgcggttgtgaactcatctcagactccttgctcaagtgctgtcagggctttgtcccactcatcggcatcgacccgaataaagtgggttttctcacgactttccagaaacggcacccctttgcccattcgggtatcgcaaatgatgacgcgcggctggggttcgggccagctgcgagccgcatcaaaggcggcctgcaaagcagagatatcgttgccatcaacccgctgggtgtaccagccaaaagcctgccagcgatccacaatgggttcaaaagcgagaatctcactgctatggccgtcagcctgctgattgttgacgtcgataagggcgatcaggttatcaagttgccagtgtgaggcggacattgccgcttcccaggtagagccttcattcagttcaccatctgaaagcaggttatagactcgtgcctgcgagcctttctgcttcagcccaagacaggcacccacggcaatacctaatccatgacccagtgaaccgccggtaatttccatgcctggggtataggcagccatgccggacatcggcaagcggctctcatcagtcccataagtttccctttcttcttcaggtatcacgcctgcttccagcaaggcggcgtaaagggcgatagcgtaatggccaatcgacagatagaagcgatcgcgctcttcccactcaggttgatccggccgataattcatggcgtggaaatagctgacagcaagcaaatcggcggcacccagcgcctgaccgatatatccctgcccctgaatctgccccattaataaggcatggcggcgaatattggtggctcgttgctgcaatgagagcacgtgtgaagcgtgacgagagtcagtcatattacctcctgattaacgattaacgtccgctgcccggatgcgcagcacgcatagcgcgccacccagcaggacggcagcaataaaatacattccggaagcgggcgtaccggttgcggtggtgatggtgcctatcagccacggtgagaaaaaaccggccagattagcaatgcagttcacggcggcgatgcctgcggcggcagagacgccacctaacagattggtcggcaacatccagaaacagcgatgaggcggaaagaatgcccgcagcggcaatacaaagggagagcagtgacagggagacgctatggctcagcagagttgccagcgtcagtccggtgagtccgatcagcatcggaacaatcagatgccagcggcgttcacgatagcggtcgccactgcgcccggccagcagcataaagataatggcgcagaggtaaggcagactggtcagcagcccaatatgcagcggctcactgacgcctgagtttctcaccagcgtcggtaaccagaacgtcagggcgtactgacccatcaccacacagaagtagatcagcgccagcagccacagacgacggtcggcgacaaaggcttttaccgtgccatgacaggctttctgctgattatcctcgtccagatcggcacgcacgcggcgtttctcatcttcatccagccactctgcctgttcaacgcgatccttcagaaccagcagtaccactaatcccataataagagtggggatagcttccagcataaacatccactgccagcctgcccatccgtgaaagcctgcaaaggtcgccataatccagcctgagagcgggccgccaatcatccctgaaagtggaatggcgacaaaccagagcacggtcatacgcgcgcgacggtgtgatggaaaccagtaggtcaggtagagcagtaaacctggcgcaagaccggcctcggcgacgccgagcagaaagcgcagcaggtagaactgccatgcggtttctacaaaggcgaacagggccgagatgattccccatgtgatcataatgcgggcaatccagcggcgtgcgccgacacggtgcaggatcaggttactcggcacctcaaagaagaagtagccgataaaaaagatcccggcacccagtccatacacggtttcgctgagtgacaaatcatccatcatctgtaatttagcgaagcccacattgacgcgatcaagataggcgcagagataacagagcatcagccagggcatcaggcgccaggcaattttgcgataggtgatatcgcgcgcagcagaggctgcgctcagattaagcgtggtcatggtgttcactcccgaggttagcccgccaggcgtgcgggcagggaagggcgctatttaatggatcagcatgccgccgttcacatccagcgtgatgccggtgagataaccggagagatcgctggcgagaaacagcgcagcgttggcgacgtcactggcggacccaaggcggccgagcggaattccgtcgagaatggcgtggcggcgttcatcctgtaacaggccaccagtgatgtccgtctggatcagaccgggcgtcagggcattaatgcgtatctggtcagggccaaattcgcgcgccatcgctttagtcaggcccagaaacgcccgctttagcggcactgtagtgcgggccgccgaaaatcccgccgccgcgctgtgctgagaccgaggacaggcagatgatgctgccgcctttctgctgctgcatggtggggatcaccgcctgagacatcagcagcgtgccgcgcagattgacatcaagaatacggttgtaatcctcgatgccgatttccagtgttttaaccggctgagtaatacctgcattgttgaccagcacatcaatacggccgaagtgctcaagaacctggtcgatggcacgacgaacagagaggggatcggtcacatcggtggccaggccgagatgcccctcaccacaagactgtgcgctggcctgggcggcctgcagatctaaatcgagcaccaccacgcgcgcaccatgttgagcaaaacaggcggctgtagcccggccaatgccgcgctgagaggcggcacctgtaataatcgcaactttgttttcgagtaacattgtccactccagaaaaataattattagtggttcggtatcgctaccggcagggtcacgatcagaattgataaagcggctaatattggcaatgcaaaaaaattcatttgatgctgaatgaatttgttggtttgatgcagttaacaattctgcgatttaaaaatgggcacacatcacaaaattccagtgtggagaggcggatggaaaagcagtctgatcacttaccttcgattaaatcactgcgggtttttgagcaggtggcccattttggtaatgtcgcgcgtgcggccgaggaattaagtattacgccttcggcggccagtcatcagctggcaaaactggagcgtgaattgggctgtattctgtttaatcgttcggcaaagggcgtagtgctgacgctgtcgggtgagcattacctcagggagattggtccgatactgctgagtctgacgcaggcgactgcacgcatcagtaacgagaaagcccgcagcaacctcaggatccactgcgcgcccagtttcggtctgctgtggctgttgccgcgcatccataaatttcgcgacagctatcccgagttccagctcacgctctcctgctcttacgagaatttatctttcagccgcgacaatattgatattgcgatacgccatggattcccggactggaactcattcgagattaaaacgatccgccacgaaagaatgtcggtgctggcctcgcctgagtatctgaaaaaacatcctgttcatcaggccgctgatttaattcatcatgcgctgatattatcggagtcgccgcttattcagtggccgcagtggtttgcttctcagcaattacctcagccagataaagagtggttatttcgctttgatcgctcttatatgagtcttgaggcggcgatgttaggccacggtcttatatttgaaagtgaattgctggcggaggattatctgcgcagtggaaaactggtcagagtcttgtccgaaacaggagagtctgcccgtcagcgcccatcatctggtcttcccgcgtggatttgcccagtttccccgcgtcgcgcatttcctgagctggatccagcaggaactgaaagtgttaacctaatgttaaaataactttcacgacgtcattattgcgctggtttatttatccggttaactatccctgttataaaaatcgcattgctaaagctaacttttaaataccgtctacacttctttacccactcggtaaatatgttccatttctattccgtatgaaatttaatcaaacggatgtttaactaattaatggcagggatattatgagtacgaatacaccagactctggtgaagcgggcgatcacgcgcctgcggatacggtacgccagcgtatttttttagtggtactggttgccactatgggcgcgctggcttttggttatgacaccgggataatctcgggtgcgttaccctacatgacctcaccacccgatcagggtggacttggactgaattcattcactgaagggctggtagcctcttcgctggtgttcggtgccgcgataggctctttcctgagtggtttcttctctgaccggtttggccggcgtattacactacgcagcctggcggttatttttgtgctgggttcactgggaacagcgctggcgccttctgtcaatgtcatggtggcaatgcgcttcctgctggggattgctgtcggtggcggttcctctaccgtgccggtgtttatcgccgaaattgccggaccgcgcctgcgtgcgccgctggtcagccgcaatgagctgatgatcgttaccggacagctcattgcttatgttgccagtacgctgctgagctatctgctacatgatgagcacctgtggcgctacatgctggcaattgccatggtgccgggtcttttgctgtttatcggcacgttcttcgttcccgcctcacctcactggctggtggcggaagggcgtctgaaagaggctaaaaagatcctgaagtatctgcgtgaaacgccgcgtgaagtgcgccatgagatggcgcagatgaagaagcaggcgagagcggcggaacgtggaccggatgcgaaaaccctgatccgtgagaagtgggtgattcgcctgatggttatcggcgtcggtctgggctttgttgcccagttcaccggggttaatggttttatgtattacaccccgatcatccttaaacagaccggacttggcaccagcgcctcgattgccgcgaccatcggtaacggcgtggtctcagtggtggcggcgattgtcggtatctgggcggttagtcgcttcccgcgccggacgatgctgattaccggcctgtgtctggtggtagcttcgcagattatgctgggcagcgtgatgacctttatcgctcccagcctgatgcagagctacctcgccctggcctgtattctgctgttcctgtttctgcatgcagatgtgcatctcgccggtctactggctgatgatgtcggaactgttcccgatgcagttgcgtggcgtgttaaccggcggcgctgtctcactacagtggatctttaacgcgatagtcgcctttggttttccaccgataatggaatatgccggcagcaccaccttctttatctttgccgcgattaacgtcgggtcgctgatcttcgtgatggcgatggtgccagagacgcggggcaaaagcctggaagagattgagtcacacatgaaagagaagtttggtgaaaagccaaaagaggctgaagcctcctgagtctcccaccggattcagcccaccggctgaatccggttttacctccttatcgccttatcttgttacctccttatcttcttactaaccgttgcaccgcatttccccgtccttatcctcactaagtaccatcagacaacattcactgtaatcagcaattttccctcgattaatttccatacagttctggcgatttcaggctgaaatcgccagaaactgacttaatgaactgtcgttattgtcttcagaaatccccggttaagcgaagcatgaccgctgacaaagattgcctcaggctctgcgctatactcatttttcatctgctccgcacgctgaccggtacgcactatgaaaatttcaaccaccacggcagtttttgccgcattgctgactgctgcgccattgcatgctgaaaacacaccaatctcctcctggtggaatggattcactgacgatgttgcgcagacctggaacgcgcctcagcataccgatctctacctgccatttatcagctggcacgcccgctttatgtacgacaaagaaaaaaccgataactataacgagaatccctggggaggcggtctgggcatttcccgctacagcgacagcggcaactggagcgcgctttatgcaatggctttcaaagactcacacaatgagtggcagccgattgtcggttatggctgggagaagggctggtatcctggttcgaatcaggactttcgtcttggcgcgggattaaccgccggtatcactgcacgcgaagattttggtaactatattccgctaccgattattctgccgctgtttctctgccggttataaggcgctgaatgtacagttcacctatattccgggcacgtacaataatggcaacgtgctgttcgcgtggtttcgctatgcattttaatttttcaggaaaggatttatgacccggaggtggaaaaccgtcacccgcaggctctggcgtcttgcgattgtgtctggagtattgttactgctgctactgattattcgaatctatgaagcggagcgcgggccggagttacatcgctggcacacctgggtcccgcatgaactgacagtggaacagcttgataatgcgacctatgccgactacctcaaggccgaaaatcatctgttcgacgagatgaagcagcaggtcagcaaccggctggatgcggaagataaaacgccactcaaccgatactatgctggcagcatgatctatccggggcatttcgcgcaggactggaaccgttcctatagtctgcaaccgacgggcaggccgcgcggtgcggtggtgctgttacatggactgaccgacagtccttacagtctgcggcatgtggcagaggcttaccgtcagcagggttatgtggcagtggcgatacggttaccgggtcacggtacggtgcctgcgggtctgaccgatgttgacaggcaggactggatggccgccacacgcctggcggtgcgggaagcgacccggctggcgggcacgcagacgccgctgcatctggtgggtttctcgaacggcggggcgctggcgataaaatatgcgctcgacagcctgggcgatcacacgctgcgtcgtccgcagcaattgattctgttatcgccgatgatcggtgtgactcgttttgcccggttcgcaggtgttgccgggttgccctctgttttccctgccttttcgaaaacggcctggctgaatatcgtgccggagtttaatccgtttaaatacaactcttttccggttcacgctgcccggcagacctatttgctaacgcaggcgctgcagaaagagatcctgcaatatgcgcgtaatcagcagctctccggtttcccgcccgtgctaacctttcagtcggtcatggattccaccgtcagtacgccttcggtcatccgctcgctctataattatctgccagtgaacggcagcgaactggtgctgttcgatatcaatcaggcggtcagcgtcagtccgttattccgccactcctcatataccgcggttaatcagctgttgcctgcggcgcgtcggaattactcatccacggtgatcaccaatgcctccgctacctcgctggaaatggtgacaaaaagcgttcccgtgggagagatgcaggaacggattcagccgctggcaattgcctatcctgcgggtctctactcgctgtcgcacgttgcgattccgttcccggccgaggatgggttatatggcagtgcgcccgcgcagaagaatgagtttggtatcagttttgggacgttgtcactgcgcggcgagagtgcagtgctgattgtcgggctggactcaattatgcgcgccacctctaacccgttttatccttatatgattaaccgaatcgatcaccacatcagttgtagcgacaagccgcaacttgcggcctgcctcagcagtttctgaatcagtacagcatcaggcccgcatcgtgcgggcctgatgttaaataatgttcagcttttccatcacctcatccgacagttccaggctgccgctggtaagattctctttaagatgttccggggaagaggtgcccggaatcagcagaatatttggcgatcgccgcagcagccacgcgagcgcgacctgcatcggcgtggcattcagggatgcagccacttcattaagctgatccgactgcaacggagagaagccgcccagcgggaagaacggcacatacgcaattccctgctgcgccagctgatccaccagctcatcatcctgtcgatgcgccaggttatacatattctgcacgcagacaatcggcgtcatcgcctgagcttctgcgatctgcgtggcggtaacgttactcagtccaatatggcgaatcagtccgcgtgcctgtaacgccagcagcgcctccagttgtggcttcagagagccttctttgggcctggccggatgcaacatactgcgcaggttcaccacctcaatcacatccagccccaggttgcgcaggttatcttcaactgcctgcgtcagcgcctctggctccatcgccgccagccagccgcctttggcgtcgcgtcgggcacccactttggttacaatgcagagatcctgcggatagggatgtagcgcctttttaatcagctggttggtttcgtgcgggccataaaagtcgctggtgtcgatatgattaacgcctgccgcggcagcggcgcgcaaaacctggattgcccgggcttcatcttttaccgggccgaacacgcccggcccggccagttgcattgcgccgtagccaatacggttaacttcacgatcgcctaacgtaaaagtcatggtggtgtttgacatgaaaacctcctgcatgaatgtagatcaattgtaacggtgattcagctgtgcaactatccggtgaaatcaggacagactgtacggggtgatgcacaatggcgatcgatatggcgctgctggatgccgtggtggcggtggcaaaagcgggaggatttcgggaagcggcacgcgtcaccggcagcaatgcgtcacgcctgagcgatgcggtacgacgggcggaacaacagctgggtattcgtctgtttcaccgtaccacccgcaccgtggtattaaccgaagcgggcagggcgctgatggaacgtctgctgcccgcgatcaatgaagttaacgccgcgctggatgcggtgaatcgctaccgtaacacccctggtggcacgctgcggctgaatgtgccggtcagtgcaacccggctggtgctgcccgcgctggtgccggaatttttgaagcgttatcccgacatccggctggaaattgtggcggagagcagcgtgcaggatgtctttcgtgacggttgtgacgccgggattcgttatgatgagcggctggagcaggatatggtggcgatgcccattggccccagacagcaacggttcgcgctggcggcttctccggcttatctggcagaacatggccgaccggaacatccgcgcgatctgatccatcatcgctgtctgcgtggccgttatgccagcggcatcatggctgactggaccttcagccacgagggcgaagagatcagcgttgaaaccagcgggccgctggtggtttcggtcggtggcgcaatggatctggcggtggaggcggccatcgccggaagcggcgtgatatatctgtttgacgagtggctcaggccagcccttgacagcggcaggctggaaccgctgctgcaaccctggtggctgactttctccggtccgtggctctattacaacgatcgccgcctgatccccgccccgcttcaggtatttatcgactttgtgcgcgaaaaaaacgggcgcgaaaacaactcagctataccagctaaacccctgtggcacccgtgaaaatccggcatgtcgcaacgcgttaagcagcggggaccgcgaaaccggttcaccatctaccttctcaagcgtgaaactcgcgggcttttcacgcttcagtgccaggcccagcgccgccaccgcgacctgctgcagcgcgggatcgtcgatgaatgtcagcaactctttgcctccgggcgtcagataaagcaccagcgcgccgcctgcaatcaccacgcggcccccctgacggcgtgtcgggcggatgccgctggcgtggagcggccagctcagtaacgcgccaaacggatttgccgggtccggtgcggccagcgccacagcctctgtcgcggtcagcggcttttctgccagctcccgcagccgctcaatggtgttatggtcggcaaactgcgcgccgcccgcaccagcgacaaaccggccacgcagcagccgtccggcatcttccatgctgcgtaataccggctgtaacgccgggaatcctcccgggatctgctccgatatcgcgctaccccggctgatcaccccataacggtcgagaagattttccaccagcgacagggccagccgggcaggagcaacctcctgtcggttaacccgcgaccagcgaccagccagcgtgttgaccgccggtcggcgtgcagaaagtgcgcccggggttaagcgctgaccaaaacgggtgcgcagggaaacgcgcgggacgtgaacgggtcgcgcctggcgtggtcagcagcccacgcaccgcaatccagctatcggcagtgacatagccctgccacaccagttgccacagggcagcataaatatcggtggtttgcgtttctgcctcgtccatctgtgccatgatctcatgaacaaaccacgagccaccccggctcaatgcgtcgagagtcgcctgctgaatcggcgtcagaggctgcgtagtgtcaatcaccggcagtgtttcagcggcatattccgtgaggtgcagcgagatcaacccatcattctgacccagcgctttgtgtccgcaccaggtaacctcgccactggctaacagttcatcgagcatcgcgggctgatagtcggctatcctggcgcgcaggatttgtgactcccacagcgaggccggtagctgcacgcccgcaagttgctcaactacccgcaacagcccgttaaccccgtgatgctcttcacgctgcgtgttaagcacaccgtgacgctccagcagcaggttgatccaggcggcaggtggaacaggccgggttgcttcacgtgctgattgcagtgaacgtaagcgtaaccgtttgaagatctctgtggaaacccactccgtttccgatgcgccctctggcgaacccatattgagcaggttgccctgctgatgcagggagagcagcacctcattcacaatggcgatacccagaccaaaatacgtggccagctgtcgggcagtgaacagggtatgggttcgggcgtagcgattaatgagatcgtgtagcggatcggcctgcggctccagaaatgtttcgggcagatcgtcaggcagtacaacggccagtgcatcgcgcaggcgggctgcatcttcaatgatcgcccagcgctcttcaccggcaagggtgatcgggatcattcgctgcgcggcatcgaactgcgttatggcttccgcgatctgctgggcgttgccactgaaacgtgccgcaataccggcaaccgcgagcgggccaagatcgcgcagcagatcgataatgccttcggtgtgctgcgcctgatagcgggaatcaatgcgctgcagttcctgttcaacctgctcaacgacgtcaggtgccagtaaatcacgcttgctggtctggccgagcagctcacccagcagattactgtcgagcgccagcagtgaggcgcgccgttctgcctggggggcgtcgctggcgtaaataaactctgcaacatagccaaacagcagcggcgcggcaaaaggggagggctgttcggtcgtcacctcgaccagctttacctttccctgtgccatctgttccatcagctggtgcagggcaggcagatcgtagacatcctgcagacattcgcgtgcggcttcgataaggatggggaaatcgtcatactgtcgtgcaacttccagcaactgaccggcgcgcagccgctgctgccagagtggcgaacgtttgcccggattacgcctcggcagcagcagagcgcgtgaggcacattcacggaagcgggcggcaaacagcgccgactgaccgacactctcagtgacctcccgggtcaactggtcggcgtcgaacataaacaggtcagcgccaggtaacactccctcgctggcgggaaagcgggccacaatgccgtcatcgctggccgcaacagaagcatcaatgcccaggcgttgctggattcgggcggcaatcgccagcgcccagggcgcattgacccgctttccccagggcgaatgcaggatcacccgccagtcgccgatttcgtcacgacagcgttcgatcagcaatgtacgatcgtccggcagtacgccggtcgcggcgcgttgttcagccagcaaagccagcagattcgtgactgcgcgggcatccagccccagcgtgcgcaactgctcctgcgcatccgccggtgaagccgcactcagatgacgcagaaacagcccgaggctggcacccgaatcggccgagcggcccacaccttctccgcgccagaaaggcagacgagccggacggcctggcgcaggcaccaccagtacctggtcgtgggtaatctgctgaatccgccacgacgttgcgcccagggtaataatgtcattgatccgcgactcatagaccatctcttcatccagttcgccgacacgacgtgagccagcctgctcttcgccttccggcagaatgacgctgaacatgccgcgatcgggaatggtgcctccgctggtcacggccagatgctgagcgccgggtcgcggcgtcagcagtccgctctgacgatcccacaccagctgcggccgcagctgagcaaaagcgtctgagggaaacttacccgccagcatatcgagcgtggcatcaaacagccgacgcgacagagtgcgaaacggatcggcccgacagacctgcgcgtaccaatcatcgacctgtaagggatccattgcgacggccgccagggtttgctgcgccagaatatcgagcgggttacgcggcggaaccagcgcatcgagctggcccgcacgcattgactgcaatatgacggccgaatccagcagatcgcgtcgggtgcgcggaaacaggatgccggttgatacaccgccaacctgatgcccggcgcgtcccacgcgctgcagtgcactggcgactgaaagcggtgcgcccacctggatcaccagatccaccggccccatatcaatgccaagttccagactggaagtcgccactacgcagcgcagtctgcccagcttcaattcggcttcaatctcgcctcgctgctccttcgagacggacccgtggtgcgagcgggcaataagatcgtcactgtcgtcgcgttctgcatcccgttcgccagcggttgtctgctgcgccagataacgcgcattgagccgcgcagtcagcttttccgccaggccacgcgaattcacaaacaccagcgtggcgcgatgggacatgacctgctgcagaatgcgcgcttcaatgtgcggccagatcgaaccgctggcagaggtggcttcaccggtcaggtcaacggggctggcgatatcggtcatatcttcgaccggaacctcgatggtcaggtgcagcgtccgatcggcggccggattaacgacctgaacgggctgacagccgccaaggaaggcggcgacccgctcaaccggtcgtaccgtagcggaaagcccgatacgctgggcgggctgtggcagcagcgcatccagcctctccaggctcagcgccagctgggaaccccgcttcgatcccgccaccgcatgcacctcatcgacgatgaccgtggtcacgccctgcagcgtcgttcgcgcttttgaggtcagcatcagaaacagtgattcgggtgtggtgatcaggatatcgggagggcggcgcaccagcctggcgcgctctgcaccgggcgtatcgccggatcgcattccgatattcagtgtgatctctggctcattcagcgcctgccgctcagcgtaaacgcctgccagcggcagattcaggttgcgctgtacgtccgcggccagcgctttaaccggtgaaatatagagaatgcgagtggtcgtttcacgtgcaggtgagggctgggtggttcggaactgaaacagcgtgtcgatggcggtgaggaaggccgccagcgtcttccctgaaccggtcggggcgatcaccagcgcatgttctccgctggctatcgcctgccatgccgcctgctgcaccggcgtgggtgctgcaaaggtggcagaaaaccagcgtcgtgtggcggatgaaaaccgggctaaaaccgcatcagattgggatttcgacatcatactcacggtattacgcagcaactgcgcctgaaattaatccgttgagtgtaagtgaaaattgccgtttgtggatgacgcggcagatatctggccgcgtcgggcgggattattaactggccgctccggctaaagcgcgacctctgatcgccagcagcgacaccagtgccagcacgataatagtcatgccatagaaccaggcggtctggttcagcccgatatggggcgctgccattccggcggcaatcgcaggcagggcaaaggcgagatagcttttgatcaaaaaggcggagaacagtccggcgcgttcatgactttcagctaactgcataatgatcttcagcacgctggagaaaatcgatccaaatccctgacccgcaatggcagtgccgagatagagccaggccacgctgtgcagagaaaggcccgcaagagtgacgctgacgcccactatcagcatcagcgtaccgataactaatgcccgcgcaggcggtaacgggcgaaagagaaatactgctgccgttgcgctcagcatcagcgtcgccacaatcgagccgccgataaaaggcgatgtcaggccggttgcgtttcgccaccattgagggcatcagtgaaaggtaaaatccgcccagcatccaggttgcgatgttaaccggcgtcaccattaacagcgggcccagcgcgcgtcgcggtatgctgacctgaggtcgcagtgcggccagaacacccggctgaggcgcaatggtttctggtatcagcggcaacagcgccatggcaaccagcatcaggagcagcagcagcgcatagagcgtcaccgtgggaaagggcgcaaaggtgaccagtatgccgcccgccagcgtgcccagcgtcatccccagaaaggcggtgaacgagttcagcagtggcccacgggttttactggcatcaatcaggctggcaccaaaggtcggcaaggcaataccggtagcaaagccctgcaccagccgggcggcgattaaggtggtggcagagttggcagtcataaagatcaccagcgcgatcgcattgatcgccagcgccagcagcatcaggggacggcggccggtatagtcggacactttacccaccgtcagcagcgcggccagcaacgcgaaagcataggcaccaaagatcagcgtcagcatggtcggcgtcaaatggaacaggctgcgataaagtgggtagagcggcgttggcgcactgctggtggcggagatcagcgccgcaccggtaaaactgaaaagcgtggtgcgggcagcagcctgaggcgtcaatgtggggttcatgaaatcaccttaatgcaaagtattagcttttaataaggtatacggctatctgtgccttaatgcaatatctttgctttaacctattttgctgtgtgacttagtgtcaccctgtggtaaggtttgtgttactaagtcacacatgggaggagatatggcttcaacaagacttcgtcagcagggcggggcggtcgtgctgactatccccagcgagattgctgccagagcgggctggactgttggcattgagctggacgtcaccgcagaaggcgaatccgtgaatattgtgccggtaacgcgtgtaccacgcggtcgccgcacagttgctcagttgctggccggtatcgatcagcaggaaatccaacagtataacgaagaggccgcggacgggctgaacgacgcgacgcagggcagggagcatatctgatggtttcaaggagagtgccgcagaaaggcgaaatctggcacgttaatggcgatccggttgaagggcgagagtttaaagggccgcattattaccttgttatctcgcaacgggagttggttgcggctttgggaacggcagtttgcgtgccggtaacaagtggcggcggcgcatcacgctcacagggcgtgaccgtttatctggacggtaacagcacagataccggcaaagtgaccggcgtggcgctgtgctatcaggtgcgctcgcttgacctgactgcgcgcagggcaagctatgccgccacagttgagccacatgttatggatgaaatattgtctttggtcgtagaccttatcgacccgcggtaaatcaacactggctgaaagttaaaacttaataattataaattcctggaaagcataaaggtctggtccatattgtgatcgtgtgacctgatgcaagcgttacaaccccaaatggggctcgtttatgctaactcacatccgctctcccttcgcctgcgctttgtctctccgggccgctttcctgcgctcttctctgtccgtttcctgatacgtgttgttatgtgctttgcgggttgtttatcaataatatttcggcgagtctcactgttaataacaatcagggagccagatgatgaagatagctgagatcgatcatatccatctctacgttgaaaatattgaacaggcagaaaagtggtacaacgagatcctgggctttgaacgcgacccttccctgtacttctggtttgaacagggtgggccgctggtcataagaaataacagggcatcactctctcttttcctgcgaaaatctcagccaccaggccatacggtggctttcggggtggcagcattatctttcaacgaacttatgcctgtactccgtaagaataaaatccctttcagcgtcagtgaccacgacgtgtcgatgtccgtctatttcagcgatctcagtaataataaaattgaagtgacctcttacgactacctgcatgcaaagcagatactggagagctttgcgtaacgctatcgcagtttgcgcttagaggcgtgactgcaggcgcactgtgatctccgttccgaaagtataagtacttcactcatcagcacgctggaggaagttaagcctccaggcccttaacggcgattaataaagtgagttctttaatctctcaggcagcgctttgtcgtaggcatcgccatcaatctctgcaatctgtttgaggatggaaccggtgctgggcagcgactgccgtgagatctgcgtttcggcatcccataatccggagcgaataatcgcccggctgcactgaaagaaaacgctctccacagtgatgcgcaatacggtttttggcagctgattgttgatggcaaagcgctcaagcagcgccgggtcggtgctgattgctgccgtgccgttcacgcgcaacgtctcgccaatgccagggatgagaaaaagcagcgctacccgattgtcatgcagaatgttgcgcaggctgtcgatgcggttattgccgcgtctgtcgggtaataacagggtcttgtcatcttcgatttcgataaatccggccggatcgccgcgcggtgaaacatccagtccctcaggccccgacgttgccagcgccacaaaaggcgaggcggcgataaacggacgataggcgggatgaatatgatcggtttctttagcgacagagggccgggcgaccgtaccgtaaagaccttcaagttcggtaagttcagtgataatgctgctctgttcagccatttttgcactttcctttcactattcagatcctcatgacgctgaaggtgagactacacagacccgacgcgccagtttaagcagcactttaacacccatgcagcgtattcagaacccgtgcgccaccctttatggcaatcgccccgggtgaatctgtcttcccgccgcttaaacagcttattacctgggcggcaacctctttccaccctttaccaatatcagaagcacaacacaacgtagtgacagcctctgatgagaggtccattttctgcaatcagatgagcacgaaaaccgcggcttgtgcactgaaattagccaccgttcgttaagagtattaacagagttggtgacaggagaagttgctgatataaagagtaaagattgcttattcagcacccaaaaggagcgcaggatggtttgggaatcagagcggctgctctacagatatactcttcgcgaggatcttgacgacctcttcagaatctatggcgaccccgaaacgcataaatttaacccgcgaggtccatggcccgacagaaacgtatgccattcaggccatagagcgcatattacagagctatcaggaacagggttttggcgactggacgatatttgagaaagcccatccggataaaattattggttttggcggtgttttcagaagccagtttgacggtcgtcagacgaataatctcggttaccggtttgagccagctgcctggggaaaagggtatgccaccgagctttcccgcagagccattcgctacggattcgaagaggccgggctgagcatcattacgggtgtgacgcgcgaaaaccatctggcttcgcggcgggtactggaaaaagcgggcctgacctttttgaaaaaggtcgacgatcctgaggggttgcctcccagcctgatgtacaccctgacacgacgtgactggcttgcggctggcaacatcgttaccgaataagtttgatctttcccgtttgtgattcaggcgtggcgaaatctgcgccaccttttcgcgcaaagtccctttaaaccctctcttatcccgcgattaatactccgctgtgtggattactttagccaccttaatcagggggaggctttatggatattcgtacaatttttatttcagcagtcatggcagtcagtcttttatggataggcgcatcagataaccgttcgtcacatctcaccgccgagccggttaaatctgtcctgagtaaactgcagccttgattctcaatcgcccgatagcacacattagcgcctgctcagcctgagatggggtacactgccgctatctgttaatgcaacttcgttgctttaaccatgacgttgaggctgataaaagcgggagaaagtgatggcgagggagatgattcggcagggtgggcgcagcgcacgtattcaggcggaagtgcataacaccgttaaccgcttgcttgaaacgcttgatcgttcagctattacagtgccgatgatcgccgaacaggcaggtgtgacaccttccacgatctatcggcgctggggcgatctgtcccagttgctggcggatgtggccgtggcacggatgcggcccattgcagaaccggaagataccggatcgacggccggcgatcttaccgcgttcatccagcagtatgctgaagagatgtcgtccaaagtcggtcgtgagcttctggctgatgtgataggaagtcaggctgaagtggcgagccagaaatgctgtgggtttacctatcagcatcttgaaacactgaaaagtcgggccgaggcacgcggcgaatcaggctttgacgttgatcgcatcatcgatgtggtcgtggcgccggtgatgtttcatattctgttcggcgaccgcgacatctcagcagaatactgttcgtctctggttcagcgggcatttcagacaggagtcagcgctgaataaagggcagggcggcttgcgtgatcagatgctgcaagagtgctcgcgccggatcgtcaccctgatctgagcgggcgagcgcgatacccagatagccgggcattggcagccggtgtgattcaatcaccagcgtctccggcaaccctgcgcgggtgcgcagggtgatgcccagcccggcctgtaatgccgcccagatcccgctaagactgtggctggtgaacaccacccgccacggaatacctgccttatccagcgcctcgatggcgcgcgatcgcatgacacacggcgcatcgaatgccaccagcggcagcggctcgccgcgctgcagatatcccgccagatcaaacgccggatgctgtatccaggctaacggacactgaccaattaactgcgtgccagcctgctgctctgcctgccacagcagcgccaggtccagctcatgacgggccagcgccgtaagcagcggcagatttctgtcgacgcgtgcggtcagcatcacctccggatgctgccggttgaacgcgccgagaatgtccggcatcaacgcctcgccaaaatcctcctgcatcccgatgcgtatttcgccctgtaacgcttcgcctttcactgcccgcaatgtctcatcgttcagcgacagcaggcgtctggcgtaactcatcagctgttcaccgctgcgggtcagctgcacatgacgcccttttttcatcaccagcgccgtgccgcattgctgctcaagtttcttaagctgcgcactcacggccgaggcagaccgacacagatgctgtgccgccagggcaaagctgccggcatcaatgcccgcgacgaaactgcgcagcgcatccatatcgagggactccggtaccttgttcattattgtcctgtaattatggatggtaagagctgattaatttgattttcaggattgaaggcctgagtgacactctgtctcaccactgaggagtgtgcaatgaaaaaatcgcttgatcgggaaacactggcgcagcgcgcgccaaaactggccgaactgacacagcaggtgctgtttggcgatatctggcagcgcgaactgctgtcaccgcgtgaacgcagcctgctgacgctggcaacgttaaccgcgctggggcgggtccagcagctgccgtggcacatcgatttcgcccggcaaaatggactgacgcaggatgagctggtggagagcttcacgcatctggcgttttacgcaggctggcccgccgccgtcaccgcgctgggttatctggaggataatcactgatgccctttacccgaattaccctgcgtcagggctacagcgaggcggctctgcatcagatttccacgctgcttcagcaggcgctggtcgcggaatttgacgttcctgagcatgattgctttcaggtgattgagatgctgcccgccggacagcgggtatttgatcgtcactatctcagcggcgggcgcagcgataatttcgtgctgtttcaggtgacggcaggccgaccgcgaaacccggcaacagaagcagcggttttatcattcactctgtacgacgcttcaggcagagatggcgatcgatcctgacgacgtgatgatcattattcagtttaacagcaccgaagagtggagctttagcggcggccggatgctggcgcaggaggcgttatgattatcatgcactaccgttttaccctgcccgctgactacgacatgggcatcatcgagcagcgcatcagtctgaacggagcccggcttgatggctttccagggctggtggccaaggcgtatctctacgcctgccgtgatgatgacggacagaatgaaaaccgttatgcgccgctctatttctggcgggaggcgagtggcatgcagcgtttcctgcaaagtcctggctttgcgacactggtcagggattttggctggccgatcatcgaaagctggctggcgcttgaggggcagacccacatccctgatctggccgacgcccgctttataacgctgaaccgctggacgattccaccgcattcagacctcacgacactgccggtaacaacagggatcagcgcctgggatgtgagccgctggcagggagtcgacgttaacgcgtcactccagcgccccgctggcgagcaggaagtctatcgcatcggttatctggcgcggggtgcagccgcagcagatctgcagctctagcatcgggaatgtcgctgttttctactcagagggcaaaaatggcttcaatctctatgcgcaggtcagtggagaaaagtccgctgacctgtaccagcgagctggcgggcagatgctcgccgtagttgcgataaagcacttcccgcagcgcggtgatctctgtgaaagaggtgatgaatatcgtgaccttcagtagcgctgcaagcgacgtatgctcagctgcggcaaccgctctgagttgatcaaaaatggcttctgcctgttcagccatatctccctgctgagccgccgtaccgaaagcggtcagcccagagacatacagcgtcgcgccatgtttcactgcgtggacataaggcgcttttacttcgcccagttgcggataatttttgcgttctggcatcgtcatatttttctcttttaaatggatttcataccatacaggctactggcattaaagcaggccgaaagttgatagcggattgaaggatgttttgaataacgaggatgttcgggaagccagccgtttacaggttccgctctctcctgcacgccgtgaagcgatgcaggcccttgctgtcgtcaaaacaggcatgaacgaaatgcgcattgtgcagactatccgtatgcacaagcctttttcggattctcaggggacagcaagtggggagacagaaagaaattcgctttttgcggccttcaatgactgacgccgaattcagaggtaacaggcaggcatggctggcagcacttacaggctgattgttatagcgggtgaggactgcccgcatccactgaacagttatgatgctcacgatctgtttccggatggccgtgtcaggacacggagcttagcgatgagaagtattcccgccagtttccgtcgtgagaaagaggagtgaaaacggatttatcatatggcaaaagggcaggctgagattgatctggctttccatacgccggcaactgtcatcagatggatatcccgctggttagattcgctgctgcatcatatcgaaccggagatcatgttttatcgctggagtgagggattctcttccatgatgccttttgaacactgggaaatagaaggcctgccagtgtggaaactgtaggcagaggtcgggcgggagctggattgttgggtggtgcctaataagctgccatttctcaggctgaaactatgcggttttttttaggatgctcggggtttgcagggctggtaaaaaggactgatatgacttcacgaactttcgccgttcaggccctgcagcacgacctctcagcattgctatgctgtccgtttagtctgcaggaatgaggtcgccggagcaatcaacctccggcagaccgcgttaacggcatacggatagctatttagctccactcatcccgggagaaccatcatgtcctccctgactcccgccgctgccaccctgaccgccgacgccgccaggccccgcatcgcctccgtttccgccattacctgatccgtcaccattaccgccgtttcctccatttcccccgttttcacccccattaccgccgtcgccgccatctccgttgctgccagatccagcattccctccgtctcccccgtttccgtcaccgccaccgtcaccaccgtcgccaccatcaccgtctgcccatgccgcagtgctgaatattccggccgccagagaggacgttacagtgaatacgacaatgaaaggtctcagtaatgctgaggtcagaataatgaggtatgcaactttcatgagaaggtttttcatatcatcccctgcgttatgaactatataccgccgccatcaccaccatcgctaccgccatcaccgccatcaccgccatcaccaccgggtgaattattcccgcttcctccgttgccaccattccctccattggctccgtttgtgccgccatcaccgccattaccgccattggagtcggaacctgtgccagcattaccgccgttaccgccattccctccgttttcacccggaccaccgtctccgccgtttccgccatcagaaatcagtgacaaagaatcaggagaagggatcgggtatgccggagaggcataaccgtaatgtgttaaaaccgccagtatcagagcggagcatcttaataaggttctgcatcgtttacagatgttgtgactggtcattgttacctccatcaccgccagcacctccgggggcattgtctgttgacccgccatcaccaccgtttccaccattagcgctaccgtgtgcattgttatgatgtttgtggtgtttgtgatgcgattcagtcccggcgtttgcgccgttaccaccatttccgccgttaccacctgaagcagaaccgttaccgccgttacccccgttcagacagccggtgccgggcacgccgtctttaccattttctccgttaggcgaagcggcgttcccatcctgtccgttctgattttcacaggcagaaagctggataatgccttgcgggaatgtttgactgaataccggcagggaaaagagcagccctgcagaaagcgggaaaagaatcagagtgttgtgcagctttgacatagaagtttcatcctttaattaatggccgccttcaggaggcgaccatttttagttagattcagcagcctgattacgcaccaccaccatcgccaccgccgtcaccaccatcaccaccaccgtcaccgtctccggaaccattgccgttagctgagccgttgccagtaccgttaccattaccgctgtcgttcccgttaccgctgccgctgttattaccgccatcgcctccggggccaccaggagaattggcaccagcacctccgtttcccgccgttgccaccattagcatcgtcgataagtaagaaggtatgtgaggagtgatcagtcaacggttcgttatgtaagggtgcggcaacagaaagtcgcgccgcagagagaacaaaaatacccaaagcaagagctaattttttatgtctcataatccatccttaaagtgtaagaaatacatgagataatctttggcccatcccgtagctaatgagccgtttaattaaaagtaaattaactgaaaattaaaaactaaggattgtaatgaaaggtttatcgatgttttataatgttttatttgaattaaatcgaagttgtcggaggtgttatttaaatgttaagcctttaaatttaaatgatattaaagactaataattatcctgctaacagtttactgttttcatgaaaatatacacattacatttttattaatgtagcgcgcttgtcaaagaacagaaaaataaaaaaattaaattcaaaaaaacagaagcaaatatcatttttatataattaatctgacttttatgaggcatggtcatggggaaaactgtttaaccactctgaattcgttttaccgaacctgtgaaattcagaaatttcatgaagcattatcagaactgcggcaggcgggacctcaacagctaaaaaaccgactcattatcgtgcgtgcagcaaacaaaatagtggtgctgtgagagcgttcagcttgcaaccggtcaggagtatgcgtgaatttacgtcaaactcttcactgcataaccctccggctcctgccctggcaggcagtcgtcgagcttcactccgtcaaacttgcaggcgagttcgtgcctgacggctgaggacaacagttgcaaccggctatcaaaagagaggtgctcatgagcggtaaacgttatcccgaagagtcaaaaatcgaagcggttaaacaggtcgttgatcgtagccattcccttgcaagtgtcgccacccgtcctggtatcatcacgcacagcctctatgcctgagtaaaaaagtagggccctgattcatcagccactaaagcgcattctgatacctggtctgagagtcggcgacttcagaaagaagtgaaccgggtctggcgactgatgaagcgtgccggaataaaagctcagatcgagtaccggaacctacgagcacgcaaaggtgaagccagcatagtgtcacccaacagactccagcgtcagttcaatctggaggcacctgatgagcgctgggtgacgagcataacgtacatccggccgcatgaaggctgactttatgtggccgtggtggttgatctgttctcctggaaaattatcagcattgtcaatgcaacacgcccgtcagaaatcagcgtttcagcagctgctgacagagaagattatcctgcccggcgcgctgctgctcatcgggcgtcagttgctgccagcgagcaatcacgctgcggcccagtcccggtttataagccattttttgcagcgcataatcagagttgccgccttcaatgacgttctgcatctgccggtcgaggggctgcttactatcatgatcaatcgcgcacaacaccgcgacgtaatacgccttatcttcctcactgtcgtgtgggataaaccaccaggcggccagggcaaggatcagcagcaggggcaggatatattttactttagccatgctagtcaccggttgagtgccgttaagtcagccgggtatggccagacgcagggcgcgtatcctgccacaatttctgctcaccgttaacctcgttcagccgctgttgaggcaatgttcagtttgctggcgcttcaatcagcgtcgtactgatttgcgcacccggcatcatctgctctaatcccgaaaccagatcgtcgctggcctgttgcagcgcggaaagcggcatagcgggcagactttccagaatgaaccacatctgctgcgcactggcatccagtcgggttcttacaccctgacgccagttccagcggcgacaggttacgccctgatcgtcgcgccagatcacttcgcctggttctggcgactcataaaccacctcgccctctttaacggtatcgaaacgttcactgccgtcagcaatcaccagacgaggctcgccagcataggccgcaatattttcacccccgaccggcagcgcataacgaatgctgatggcgttatagagatccacaaccggatcgatggcaggcaatgcgccatcccgcagcacacgcttacgcaatgcttctgccgaacagggtgtacgtttcgctttggcaccaaaggctttaaacacctcagcccaggcggcgagatgcgcgtctgcccacgccgcatcatcatttaacacctgctggcatgcgctcttcagtgcatcgctggcaacttctggtcgggtaatcggtgtggcttccaccaccatactcatggcacgaaagccgggagcgagcgagaaaacagcgggatcgattgacgggtgaacagataacatcggatactctctcagtgactaatttatttcatagtaatgaccgatgaccaagaaagtcaatataacgaccgatgcgggtgccgatgtcgccagtgtcaatcaggctgtttcggacagcatcaaaagctggcgtaaaagtcagaaactctcgctggatgagttatcacgccgggctggcgtcagtaaaggcatgctggtggagatcgaaaagggtgccgccaatcccagcatcgccattctctgtaaagtggctgccgcgttgggcgtctcggtggcagatatcgtcaacgttgcgcatgcgcctgacgcctggctgattgagaacagcgaaatgccccggctgtggcagggtgagcagggcggttatgcgcagctgctggcgggaacccgtgggccggatatgatcgagctctggcgctggcagatgtttgcgggcgaagctttccgttctgccggtcactcctcaggcacactcgaactgttgcatgtcgagcagggcacgctcgccttaacggtgggtgagcagaccctggtggtgcagcagggctgtgcagccgtagcacgaaccgatatgccgcatgcctatgccagcgccgatcacctgccggttatcttcaccatgacagtggccgaaactgcagcgctgacggtgctattctgcggctgtcgcttcgcctggacacgccagcagcagcgttttcagcaacctttccagttcggcacgctctgaagcgccaagcggggccagcagcgcctcctgcgtagcggtatggacgcggagtgcatgctcaatctgctgctgcccgtggggcgtcagcccgaccagcatgctgcgcttatcctctggcgcggcaatacgctcgatcagatgctgctgctccagccggttcagacgatttgtcatcgcaccggaagtcaccagcagcgcctggtagagctgggtgggcgacaggcgaaaaggcgatcccgcccgtcgcaatgtcgccagcacatcaaattctccctcctgaaaaccaaaaggctccagtgcctgactgcgcgctttcgccagatgtttcatcagacgcagcactctgccgaagatccccattgaagaggcgtcgagatcgggcatcgcgtcgtcccactgactgacaacgaaatcaatatggtcatgcataaatcacctttaaatattgtggttatgttgtcgggttgtgcgcagcctcttaacaccgggggaaatttatcttaacgttaagataaatggtggcagcccggtgctgtcatcgtcaatcctctgtaaaggcgtcgatgatgaaaaataaggtgttgttacccattctgtttgccgtgatcgcttttcttatcgggctgaacctgcgcccaatgctggcgattatcggcccgctgttcccggtgttgcaactgcaggccgggctgtcggcgacgacgttcagtctgctgaccacgttgccggtggcgatgatgggcctggccgcactctctggcccgtggctgatcgcccgcatcgggctggtaaagggaatcgccgccggtttgctctgtctgacggtcgcctgcctgtggcgcggggttacgcttactccctctcagctgctgctcaccgcgctggcggggggcgcagggattggcgtgatacaggcgctgatgcccgctctgatccggcaacgctttgctgaggccgcggcgacgctgatggcgctgttcagcacgggcatcatggcgggcgcggcactgactgctgccagtgctgacccgctgttttcatggctgggcctgcaacccgcgctggcgctttccggcgggttaacgctggtcacactgctgatctggctgactttagtcaggcgtttcgccgcaggtgagcgtggcctctgatgcaacgacgctgcctgtgcggcgtaccctgttgctgatgctctttttcggcattggcacgggtgcttatacgttagtgctggcctggctgccgccattctatattcaactgggctggagtgctcgccacagtggctatctgctcgccgcgctgacgttaaccgaagtggtggcaggattcatcgtctcggcgacgttacatcgctttcccgatcgccgtccgctgctgctcggcgtgctggccctgttgctgctggggctgctgagtctggtcttttacccgggcacgatgccgatactctcttcactgttactgggtacgggcatcggtgcgctctttccgctgtcgctgatcgtcacgctggatcatgcgcgcagtgccagagaggcgggcattctgctatcacgcgtgcagggaggcggatatatgattgcggctctgatgccgctgctggcaggctgggtgcgtgatagcggaacgtcaatgactcaggcctggctgatcatgagcgctggcgtggtgctgttaatggtgattgcccgacgcttcagacctcagaacagtatcaactgaacaaagccgttgccgatcaatgtcgatctggcatgctggaataaaacccctgaacccggagtgcattgtgaaagtgattggtctgttaggcggtatgtcgtgggagtctaccgcgctctattatcgcattctgaatcagcaggttaaacagcggctgggcggcctgcactcggcggagctggtgctctatagcgtggattttcagcgcattgagcagctacaggccgcgggcgagtggcagcaggcgggagagatactggctgaagcggcacgcaatctggaacgggctggcgcgcagttcatcgtactctgtaccaacaccatgcataaagtggcagcacaaatcagcgccgcaacgggcatcccgctgctgcatatcgccgacgccaccggaagacgcattcagcaggccggggtgcgtaaggtcggattactggcgacgcgattcaccatggaacaggatttctatcgcgggcgacttcagcagcagtttggtcttgaggtgatcacgccggatagagaggatcggatttttgtgcatgaggtgatttaccacgaactctgtctgggcgagatcaatcccgcgtcgcgtcgccgttatggggagatcatgcagcagctggtcgcgcagggcgcggaggccattattctcggctgcaccgaaatcacactgctggtggatgccacggatgccagcgtgccactgtttgataccacgcttatccacgcggaagaggccgttacccaggctctggcctgacgtttatcctgcacttagccttgagggaatcgcatgaaaattgaaaatctgccgtttggcctgacccagtgggatcagattgaagagacgattcatcccggcgaccaggggcaggcgacctggcgaaccgtgaagtttaacgatatccgggtgcggatggtcgactattcaccaggctatgtcgccgatcactggtgcacaaagggccatattttgctgtgcatggcgggtgagttgcacactgaactggcagatggtcgccgtttcgtgctgacaccgggcgtcagctatcaggtggcggacgatgctgaaccacatcgctcctttacgtccacaggcgcgcaactcttcatcgttgactgagttcaccatcagcctctctggtgatcacctgctggtgaatcatcgcgtcgttgacacttttaaaagtaaactgaatcagctttataaaaatcagcaaaattaatggcttatttcatcagagttatctggttctgacaggaataatttccatcaggttgtatgctagaagccttataagaacgttttgcattcacctgaggtggggaagcctgtgctgataaaaaagaagaaagttcgttcgcataccgaagatcgactgctggcgctggtgcttgccaccaccgccggcatccttaatgccatggcgctgggcgcgtttggattttttccatcgcatatgacgggtaacacgtcgcaaatctcccaggaagtgaccaccagcgacctccataccatgctgtttttgatggcactgattattgcctttgtgctgggctgcaccgttgcccggctggcagtggtagtggggatcaaacataagttacgcaccatattctgtctgatcattctggcggaaggggcggcactgacggcggcatcaatctttgagatcgtgttctaccggccaagctttaacggggaagtgctgttaatgctgggctttttaatggggattcataatgcgacctcaacgcagctctccaatggccgcgtcagatcgacccacattaccggcacgctgaccgatgcgggtattgcgctggggtcgtggatctttgcccatacttctcacgccgtgcatcttgaaaccgacgatcgtcgctttttccagaaggttctgcacacccatctgactaccgtgttttcattcctgagcggctgcattgccggtctgctgctgtttaaagtctatggcttcaacgccatggttggactggggatatttctgatgctggtggcactgacggccatcgccatcaccgtgcagcgtacacgcagaagcctctactgacagtaaagccgcccgcccgatgcacacagcgcatcgggcgggttgcttactgctgcgttcgggttggccgcaccacgatttcgttcacatccacctcttcaggctgttcaatggcataacctacggcgcgaccaatggcgtccggctgcaacgcgatagcgcgatagtgctgcatcgcctcggcggctgccggatcggtaatggttgatgccagctcgctctccaccacaccgggatgaacacaggttacccgcagctggctgtttctcctgccgtaatccgtctgaaatcgcccgcaccgcaaacttggtggcgcagtagacggccgcggtgggcgacacggccagcgcacctatcgacgcgatgttgatgatatgaccgcgctggtgggccagcatggtcggcaacactgacgcaatgccatacagcacccctttgatgtttacatcgatcatctgttcccactcttccacccgcagcgacgccatcggtgacaagggcataataccggcgttattgatcattagatccacccggccccatctctccagagcatactcaacgaactgcgtcacctcttcgcggcgcgttacatcaagcgctttgatcgccacctctgcaccattgaactgcagctcttcagccagcgcggccaggcggctttcccgccgcgcacccagcagcagaatggcatctgttttcgccagttcacgtgcaatgcctgcaccgatgccgcttgaggcgccggtaattaaaatcactttctgagtcattttgtttctccagtcaggttgtcactggcgatcatacggcgactggattataaagataatccaccgaacgctttacgcactggtaactcaatctgaccaatgaatgctgataaaaatgctctcgaagtttttgtgattgtggcgcagacgcgaaatttccggctggccgcagaacaattaggtgttacgcgtccggcgatcagccagagtctgcggcgtctggaagaccggcttaacatcacgctgatgcagcgcaccacacgatcggttcagctgacagaagccggacagcggctctatgccgaagcggcaccggcgatcaaccagctcaatcgcgccgtgaccgatattgccgaactggctgcggaacctcggggcctgctgcggctggcgatctcctcgattgctgagcggatgttggggggagagctgctggcgagctttattaccgcttacccgcaggttgagctggatatcaccgtcaccgatgaggagtttgatattgtcgggcagggctatgacgcaggcgtgcggctgggggaggtgattgctcaggatatgattgcggtgccggtatccaccgcgcagcgtcaggtggcggtggcgtcacccgcctatctggctcgtgcaggcacgccgcaacatcctcaggatctggtcaatcatcgctgcatcggctggcgaagagggcctggtctggccccttatcgctgggagtttcgcagagcagggacgcgagtttgatgttgccgtcaatccgcaactcaccaccaacgacatgggggtgattatccgcaccgcctgcgccgggggcggcatcagctttggcatggaagaaaccttccagccttacatcgcacgtggcgaactggtgaccctgctcgacgcatggttgcccgcctttgccggcttctatctctattttcccagccgcaaaaatctggcccccaagctgagggcgctgatcgatcacgtcagactttagcgacagaatgcacgtctgatttagcgctgatattgctgatcgctgacctgctccagccagtcaaccggcgtgccgttcagtgactcagcgatagcaatatgcgtcatggcgttatccggcgttgcaccgtgccagtgcttcacgttttccgggatccagacgatatcaccggtgttcatcacctgaatggcttcaccctcacactgaatccagccctggccatgcgtgacgatcagggtttgcccgagtggatgggtatgccatgcggtgcgggcacccggttcaaaagtcaccgttgcgccacccacgcgggcgggttcggttgcctggaatggcgcatcaatccgaaccgtgccggtaaaatattcagcaggtcccttacgcgaaggcagcgatccgttggcgataattttcattactcactcctgttgttaacgtgtcatgcacagtgtaaccggcaagccggagcgtgattagcccgctcagtcggcaaacggttatgagccgggctcattaattgcctgacagttttcaggctgtcatgttgtaacgggtgatgatgttaattttagagtagggcgcgggcggttctgaggcgggcaaaaatccatgaaacgccagcagcgttctgaaagcgtgcagcgcatcaagctgtaaattatgctcgattaatgcatcaattttaccggcctgcagcagtgcacgattctcacgatcgagatcgtgaccaataaaagcgttaaccgtccgcttttgttcggcaaaagcgcgcagtatgccgggattaccgccaccgactgtgtagaccgcatctgcatccggatgtctctgcaaaaactgtgtcaccgactgctgcatccgggcgtcaatgccataaccgcctgccaccacgctcacctgatgctggggcgcaaactcctgcattgctcgctgaaacccctgaattctctcctgttcgccaatgaaatcgtgactgccggtcacagccacaatatgcgaacgactcacccgcagccattttgacatcagaaaagccgccactttaccggcatcaaaattatccatgccgatatagcgcaggcgcgcgctgccgggcaggtcgctcatcatggtgaccaccggaacgcgttgtttcagcagtgattcaagggtgggatgaagttcaccagaacaggctgccttaagaatgacgccgtgactatgcaacgcttttttattcagcagcgtgttaatcgcctccgcagtcaaattcgcgccgaagtggaaacgcagctgaagtttaaaggcagtaaaactggcaatctgactgctgaaacgcctcacgtatcagtggctgaaagcggtcaggtgtatgcatgatgacgtcgaaatagatcgttcttcccctggcgagtcccgctttttgcatcagttccaggtccgctatcgcctgctggattcggtgctgggtcgtggcatgcacgttgccgcgctgatgcagggcccggtcgatggtcgccagactgagtcccgactgggcagcaatctgtttcagggtaaatttagccatgtgctgctcgtgacaccagaggatgacgatagttttatcatactgctggccattgtcagatgatcatttgtgaaaggctggtcagcacatatcaggccgggaaagctgccccgcaggttatcgcaacaaacagtgagtcgtaaaagtgtttataacacattcagccaaaagtctgtttccgcgatatataactatccaactctcaatatacatgggcataaatagattacagcggttgctaccacgttttggctatttatagcttcagggctgcatggggtgaaaataaagcaagataatattctgaggttgtatagataataacctttttgccgcttcgcttatatttcccgcttgacggcttttttgttttttggctcccgctaatgatagactgtatatgcatacaccatcgggaggtcgtgtgaagtacgacaacgataacgaaatccgtgcgctggttggtgcggtagtcagtgatttgatcaaggcgggagagccggttcatttccacgacattacggacgcgctgtttcgcctgagcgaagagacgcgtgacagcaggatgaaagcattgtgtcaggaagcgataagctttttcacccggaagatgcattaaggttgccaggcctgatgccgggcgttgtcccggcctgtgtcatgatagcgtccctgctacctttgacatcggcgagcataagaggctttgcatattgctcgcagcctttaaaagggattttactgtgagtcggtcgtttcttttttattcagcgagacggttgatgaccgcattaaaaaatgtcagtcagatctttctgttgattattcattaggggtggcaaatttttgataaagaagttcgccttttcattggcaggtcttattaagcctgaatgatcatcatctggcatgattgcaaaaaagcgttatcgtcgggatcaaatccctgctacatcattaacctgcaaaagaatttttatatcggataatttctgtgtggcatatcgggtatacagcgaaagtgagggaaggaaacaaaagcgggcgagggggaagagtatcctgcgttaccagaggtaacgcagaatggcgtatcagatgccggtatcgtctggcgtgcggccaaccacgatttccagcgttttgcgtaacacatccagcctgacaacatctgaagtgcattccagttcagcgatcaaatagaggatgatcgctttattggttacacgtccctgatcagcaacaatgtcacgaatcactgcgcccagcagttcagtttccggagcaagctgatcgcctgcgctacggaagtagtcaataattgaagaatctgatgatgaatgctgcatgattattctttctctgaggaaaatgagtcagatgcaatggttgaagtcaaaaacgagtgtaggcgcagttttcgttttgcccagcccgccttaaaaattctgttcaggtctgccgcttcgcttaaaattagccgcatgtatcaggtacgcagtacgctcaatcagtgctttttcgaaccttcaggcgggccatcactgttcatacgatgagccgtgttatcacgttcggcaccgtcgccctgcacgcgtttgcgcgcggcaaccataccattacggacttcggtgatggcttttcgaatgactgacactttcacgtcgtcgtcagcatcagcagccatcagttcgagctgtgcgattaaggcattgctggataccggtttgtctgacttgagtaatgtcagaacggcttcgccgatcataacatctgtcagtttctcatcttcacttctgtacatactggcttctctgattgcgaatcaatggccatgctgcgggtccgtatgcgtcagcgggtgcgacttagtgcacccgatacgggaagcagaactgggctttgttgctaggatagatcttcctgggtgatggctgaaacaggcgtcctgattaacatgcacgaccgtgagagggcattaatcttcgcgacgaaacagcatcgcaatgagttcatgcagatgactctcttcttctggcgtggcagccagttcaaggcgactcagcagtttactgcaaatcgttttccgactaaggctatgacctgcgcgcagaatttccaccacaaccgaacccagcgtctcctgttgcgacggtgagctggcctgattgaagtaacgggcaatatcgctgatcgtttccggggcttgtccgttctgacgcatgttgttgtcctcaggtggtttaaatgtatgcactcttgatgcgcaagttatacatctttgcaaaacttgtacagaattttggatttttgggattaatttttttgtgcaaaaagtgctaaggcttttaaaacagggtgttacgaggagtttgtggcgaggtaaaaattgtaccagattcttgtatcattcacaccccaccgacgctccgacctgaatattaaggccggagaggaaaggcatacatggattagtgtttaaagaagatgtcatcggcagagacgggagcagcgggctctttgccagtggttttggcaagccaggtcgccggggcggtggtgcgggaaaccgatggttttgaaccccatcagccattgaagcgcatgctgcatctgctcaaggcgagtctcattaacttcagagtcagccatgacccttagttctttaatcagcagttcaacattcacttcctgaccggcattaaacaggttcattgcggcttcgccaatgatgacattcgctttttcgtcgctggaaaaatacaaattatcctcctgggtgattgcggtaagtaacattaactgtagcaaaaaaatttacgaagcttaatcaattcagcctatcaataagattattttaattgtcggtctgctatgcatgtcatgtgagtgccgccaggtgtcagaacgcttttcggtaaattgcgccgtcaggatgggctttttgtaatcctgttatcgttcctgcggtttactcaaccacagatgagaaaggcgtaaaacccggttatagctatacatcacgctttccataaacttcccatcattgaaattaaatttctatatatcaacaagtaaagcgattcgcttacaaaacttcacattcgggcccggacgctgaagaaacttcacaacccttcgctgttacaaaggtatagcctgtgctataaaaaatagcctatgctaattatgttttgtttttaatcacctctggagatcgccctatggtcccgaaaagaaaaataaccatcatgctactgagtgcgctactgacaaccctgatggcgaccagcagctatgcagcagaaaaatttaaggtagtgacgacgtttacagtaatcgctgacatggtaaagaacgtggcgggcgatgcggccgaagtcacttccattaccaaaccgggtgctgaaatacacgaatatcagccgacgcccggcgatatcaaacgggcgcagggtgcgcagttaatcatggcgaacggtcttaatctcgaacgctggtttgagcgtttttatcagcatctggatggggtgccggaagtgattgtctctgccggggtaaaaccgatcggtattggcgaggggccttataacggtaaaccgaatccgcacgcctggatgtctccggacaatgcgcttatctatgtcgataatatccgtgatgcgctggtgaaatatgacccggcgcatgcggaaacctatcgtcagaacgcagctgcctacaaacaaaaaatcaccgcagcgctggatccgcttcgccagcagattgccaacatcccggaggataaacgctggatggtgaccagcgaaggcgcattctcctatctggctcgcgacctgggtatgaaagaactctacctgtggcctgtaaatgctgatcagcaaggcacgccgcaacaggtgagaaaagtgatcgaccaggtgaagaaaaatgcgattccggcggtgttcagtgaaagcaccgtgtcggataagccagcccgccaggtcgcgcgggaaacgggtgcgcattacggtggggtgctttacgtcgactcattaagcaacgctcagggaccggtgccgacctatttggatttgctcagagtcaccacggagacgctggcacagggcattaaagcgggagagaaagcgcaatgacagacaccatcgttgtttcggatgtcaccgtgacctatcgcaacggtcacaccgcgttgcttgatgccagcttcagcgtgccgggtggatcgattgcggcgctggtgggtgtgaatggctccggcaagtcaaccctgttcaaagcgctgatgggctttgtccggctcgccagcggcagcatctcggtgctcggcatgccaacccgtgaagcactgcgtcagagtctggtggcgtatgtgccgcagtcggaagaggtagactggtcttttccggtgctggtggaggatgtggtaatgatgggtcgctacggtcatatgggcctgctgcgtcgacccaaaccacacgaccagcagattgtcagtaatgcgctggcgcgggtcgatatgctggattaccgccatcgtcaaatcggtgaactctccggcggacagaaaaaaagggtatttctggcgcgcgccattgcccagcagggcagcgttatcctgctggatgagccgtttaccggcgtggacgttcagactgaggccagaatcatcagcctgctgggtgagctgcgcgatgaaggcaagaccatgctggtctcaacgcataatctgggatcggtcacggagttctgcgattacaccgtgatggtcaaaggcaccattctggccagcggcccgacccgcaccacctttaccgccgccaaccttgagcgtgcattcagtggggtgctgcgtcatgtaatggtgaaagggctggacgatcagattatcaccgacgatgaacgaccttttattgcgccacgtacggcacctgaagacggaaactgaccatggaactgttactggagccttttggttatcactacatgctcaacgcgatgtgggtctccgccatggtcggcggcctgtgtgcgtttctctcctgctacctgatgctcaaaggctggtcgctgattggcgatgcgctgtcgcactccatcgtgccgggcgtagcgggtgcttacatgctgggactgccctttgcgctgggcgcgtttctctctggtgggctggcggcgggcagtatgctgttactcaatcagcgcacccgcttaaaagaagatgcaatcatcggcctgatcttctcctccttctttggtctgggtctgtttatggtgtcgctcaatccgaccgcggtaaacattcagaccattgtgctcggcaatattctggcgattgcgcccgcggatatactccagctggcgatgattggcgggctgtcgatcatcattctgctgtttaagtggaaggatctgatggttaccttctttgatgagaatcacgcgcgcgctatcggactgcgccctgaacgactgaaggtcctcttctttaccctgctggcagtctcaaccgtggcggcgctgcaaaccgtcggtgcatttctggtgatctgtctggtggtgacgccaggcgcgacggcctggatgctcaccgaccgcttcccgcgtctgctgatgattgccgtagcgattggcagtatcaccagttttctcggtgcgtgggcgagttactacctggatggcgcaacgggcggcatcatcgtggtggcgcagacgttgttgttcctgctggcgtttatctttgcgcccaaacatggcttgctggctaaccggcgtcgtggccgccatcgtcccgaaaaggagcctggctgatgtggatctttgaacctttccagttcgcttttatgaacagcgcgttgctgattgcgctggtggtggcgatcccctgtgcgctgctgtcggtctttctggtactgaaaggctgggcgctgatgggcgatgccatgagccatgcggtattccctggcatcgtcctcgcctggatggccgggctgccgctggcggtgggcgcgtttgtagccggtctgttctgtgccgttgccagtggatttctgcaggacaacagtcgcatcaagcaggatacggtgctgggaatcgtcttctccggcatgttcgcggtgggattgatcctctatatcgccgtgaaaccggaggtgcatcttgatcacattctgtttggtgacatgctcggcattacgggcgctgacataattcagacctcgcttatcgcagcggtgatcgttggggtcattgcggtgaaatggcgtgattttatgctgttcagttttgatccacagcaggcgcaggtctctggcttacccgcacgctggctgcattacgggctgctctgcatggtctcgctgaccattgtggcgacgctgaaagcagtagggatcatcctgtcgatttccctgctgatcgcacccggtgctatcgcaattctgcttacccgccgcttttcacatgcgctgctggtggcggtcgtggtgtcggtgctggtgtcgctgagcggtgtctatctatcgttctttatcgacagcgcgccagcacccacgatcgtggtgctgtttgcactggtgtttatcgtggcgatggtgatttcaggtcgcaaaacgcgacagctggagcgtctgaaacttcgcgagagcggcaggtatgagtagagtgatgaccagcatgaatgcggtaagttgggactttatgtgcaagcggatgttcagagtattctaaaactatgaacatgactcaaaggaaatggtaatgacatttgagatcagaaaaggaagtaatgtgattggtctcactgaactggagttcggtgatcctccgatggggtttgtttatggagaatttaagcctaccactttttatcaaagaaatgattcaatgactgaacttgcactttttaagcgagatgggagtctgcatattcatacgaagtttataactattgtggatagctccgagcaaattgatgaaaagctcacagaagtgacgattttaattgaatcagctgaagaatatgaaagatatttttatcaccatttggaaaaatataataataattttggttgcgttgactgatttggggtggaaattgattggctgcaatctggtaaattaacccgcatacaaagtatgcgggcttttaatttattttttcattgctggagtgattgtcaggttgttgccttgttgtacagcctggaaggtagagacataggcctttcttgtcgcctttttattctcaccgcctgcttttttattcacttcaatataaatgaggtatgtttgtccattttcaagttttatttcttctggctgaatgcaaaaaaggccagctttgggttgtttgtcagcagggaaaataacctgttctgaggggtttttcatattataagttaacgcggatacaaccttttcatcactttgtattggtatagaaacacatacatcactattctggacatgggccggaacaggtgtttctttagtatatcgattatccaggttttcgcccagcgtgcaaccactcaagagaaaaattacagggattaaggtcttagttaaaatattcattagaacgggaacccctcaagaactttttgatattttgaatgaatcttattgtctactgatccaacataagaaacttcgccatctttaccacgtcttgccagccacatattaagcccaaatttagaaagcaaaaagtaatcagcaataatttgtgcttgttgttctaatctataatcaaacagctttttattttcttcaaaagagtattcgtagctaacaaagccactaacaaggcctctcatacgtacccatatgcccctttgatactgccagacatgcgacatttcatggatgaaaagatgttgaaactgaaaagattgaattgaaaagttctcgcaataccagtcccggaaatataattctccattggggctcattgcggtatttctaccctgaagtttgaagggaaagtaacttgcatgatgaatccacacgcgaggatagacgattgaatttccgaatactgattttgctaacgttatttcgccaggtgtcaggagcctttgactcccttcattatcactcatgaaatcctccttaatttcttgattttaatgaacaaatatagagttcaggctgaatgcacctatagttaacttatctgaatcccacgactggtgatggattttagcaaaaaagacgggagttgtctcaaatatggttttggccgttaatcgaggagcttttaacttgaggtgtaatcccggcggcaaactattgccattttttatcctgaagtccctgtcctacacactgtaaaggatagagatcgtcatctggtgaaaataatctcaaaatctaaatttttagtaagccgaaaaggatgatgcacgttcattactttcttcacatccgcgagtatacctgtaagttcttcacgttaaagaaactatgagcaatcagccgaaggggatctcaccgttgaccaaactgttcagcaaaggcgtataaaacaaaaattatttaagctcaccctgaaaagcgccacagaaaatggcagggcttctgctaaatgtggcgctttcatgtattcttcctttttacaccgtctggtatcagctctgccactgcgactggcagacaatgctgcagaagttaatcagtttgaactgggcatccttgtctgccagtacatctgcttttacgtaaccaaaagtcatctttggcatgtgctatcgcagtttctgctgacccgacgcttttcacatgcgctgctggtgtcggtgctggtgtcactgagcggggtctatctctcgttctttatcgacagcgcgccagcacccacgatcgtgttgctgtttgcactggtatttattgtggcgatggtgatttcaggccgcaaaacgcgacagcttgaacgacagcggcttaatgccagctgactggctatcgcggctgtctctcaaccgcgatagcgcaccgcatcaatcaaacgtgtaaaggcgctggtgtgctgtctgcggctgggatagtaaagataataacccggaaaaggctcacaccagtcagccaaaacctgaaccagacggccacttttaaggtgttccgcaacgctatcctgcggcacatagcagatccccatcccgctcagtgcggcatcaatgcgcgacgcgagatgattaaaaattaactgaccctgcgttttgaccctgatctccttgccatcacgcataaactcccagttatagaggccacccagcgtcggcagccgcaggttgatgcagttatgatgctgtaaatcatagggagtctcaggtctgccgtgctgatcaaaatagctgctggctgccaccacgcacatattccagtccggcccgatgcgtaccgccaccatatccttttcgacctgctcacccagtcgcacgcctgcatcgaaacggccgctgacaatatcggtcagactgttatccaccgacacttcaacatgtacatcggggtattgctgaagaaagggcctgagcagcggccagagtgtagaggtgagcgcatgttcgcctgcggtgatacgaatgttgccggagattttaccctgactgtcagtgacattgaccagttcagactcaatctcgctgaacagcggggcgagggtagtgatcagccgttcacccgcttctgtcggggcaacgctgcgtgtagtgcgcgtcagcaaccggacgctaagacgctcttccagagcgcgaatcgcgtggctcagtgccgactgcgacacacccagcttcgccgctgcccgggtgaagctgcgctcttctgctaccaccaccagatagatcagatcgttaaaattttctttcagcataggccctctgacctgtttgatcggttatcctggtcgggacaggccgatttatcgacgttaactacggcttcgctacccgacctgctatcagacccgaaatagtctttcagggttgcacatttcgcggcaggattaatgaggtgcacagataaaccctatgaacgacggctataaaagcttttttcaataaaattaataaaatcatttagatgagcgttgtatgaacacgtatttatcctgattccacctcgctatgccattcatataacacttacttttcccggcttccccgcaaaattgccaaaaagctgctaaaccttaaagcagagatacgcgcgtaaagattagggttatcacgattttcccccgattcgaaccccgtcagaaataaacctataaaaaattacatcttttggcccccaacaatgggaagcagacaatgtcggaaaaaatatcgctaacaatgcaggttaatggtcagtcgcagcagatgcaggtcgatccccgtgtcaccctgcttgatgcgctgcgtgagcatcttaacctgaccggaaccaaaaaagggtgcgatcaggggcagtgcggtgcctgcacggtactgagtaatggccagcgggtgctgagttgcctgacgctggcggctcaggcggatggcgccgaagtgaccagcattgaagggctagcctccaccgaaggtgaactgcacccggtgcagcgctgctttatggagaatgacgccttccagtgtggctactgtacaccgggtcagattatgtccgccgtcgcctgcatcaaagagggccatgcgggttcagaagatgagatccgtgagtatatgagcggcaacctttgccgctgtggagcatatccgcacattgtggatgcgattaaacaggccgcagcagagatggcgaaggagtccgcatgaatgaattcagctggaaagtcgcgcagtcgcctgaggaagccgcagccctgaaacagcaatctggcagccagtttctggcaggtggcaccacacagctcgatctgatgaagtgtggggtcttcacgccgccgcagctcatcggcatcactggattgaccgggcttaaaaacctgcagtttgacgacgataagatcacagccggcgcgctggtcaccatgagcggcctggcggatcatcccgcctgccagcagaacgcgccagccatctacggcagcctgtggcaggctgcgtcaccgcagattcgtaacatggccacgctgggcggtaatttacgccagcgtacccgttgcgcctattaccgcgatccggcgaccttttccgcctgcaacaaacgcaatccgggttccggctgcgccgcactggatggcgttaacagcaatcatgccatcctgggcgccagcgacagctgcatcgcggtctatccaggcgatctggcggtggcgctggtggcgtttgacgccatcgtggtcctgcagaatcagcagggcgaaacccgccgcatcgcgattgatgatttcttcctgctgccgggtgagacacctgatcgtgagcacgatctgcgcgatgacgaaattattgtggctatcgaagtgccgcaaactgagtcactgcgacactcacactaccttaaagtccgtgaccgcagctcttatgagtttgctgcagccagcgcggccgcaggctttaccctggagaacggcgtgatgcgtcaggtgcatattgcgctgggcggcgtcgccaccaaaccctggcgggtcagatcggtggagcaggcgctggagggccagccgtttaatgaagagacggtcttccaggcggcagaaacggattactcaggagacgcaggcgctgacccacaacgcctataaagtaaaactggcgccgcgtgtgattgcacgtgcgctgatggcagcaggagaaaccgcatgagtgacataaatgacaaatcacgtcgggagttactgaaggcgacggcggcgatctcagcggcgggcagcctgggtctgagtatgcaaagcgccagtgccagtgatactgccacggcggaaccagaaaccaccgatccgattgagggactgggcgccgggcgctcgcggggcgacggcaaagtaaaagtcaccggtgaggcgcgatatgcggtagaacatcagccggaaaatccgctctatggcgtggtgatccagtctactgttgccagcggccgtatcagccggatgtcgacggaaaaggcgcagcaggcctcgggtgtggtggcggtttatacccatctgaacaccctgaaaatcaataaacctaccgcgattgcagacggcggcgcggcgcagtcaacctataccccgattcaggacgatgtgattattcacaacggacagaacatcggtctggtggtggcagagacgtttgagcaggcgacgtatgccgcctcgctggtggagatcgactatgaaacctcgcctgcactgatttttgccaccgatgagggtgtcgaaccgaaaccggtatcgaaacaggatatcgatatgggcgatgcacaggtggcgatgcagcaggccgaggtgcgtctgagccagcgctataccaccccgcgcgaatacaacatgccgatggaaccgcacgcctgtgtcgctgagtggcaggatggacgcattaccgtctgggagccaagtcagtgggtggcaggcgcgcaggtggaaatcgccgagtggatgggcattgacgttgaagatgtgcggattatttctccctatgtcggcgggggatttggatccaagccggtgccttacacccacgtcgcgctggccagtgtggcgtcgcgggcgctgaagcgtccgatcaaagtgtcgcttacccgaccgcagacctttaccggtctgggcggacgtcctgccacctcgcagcagctggaactgggtgcctcgcgtgacggcaagatccaggcaattatccagcgcagcttcagtgaaacctcattaatcgatgtatttgctgagaaactgcagcaaagtcaccgcccgcatgtatgcggtgggcaacgtctccgcccagcatcaggtcagaccgatcaataccgtgacgccaggctggatgcgtgcgccaggcgaaaaccccagcgcctttggtctcgaagtagcgatggatgagatggcctatgccctgaatatcgatccgctggaactgcgtctgcgcaactgggcggacaaagattatcagctcgatctgccgtggagttcgcgtcgcctgaaagaagcctatcagaaaggggctgaagcctttggctgggataagcgcattatgacgccgcggtcgatgcgcgaagggcgtgaactgattggctggggcatggcctctggcacctatccggtcaacaaactgcctgctgaggcaaaaatcatcctgacgccacagggtaaatttgtggtgcagtgcgccggtgcggatatcggcaccgggacctataccatcctggctcagaccgctgccgacattcttggcgtcgcctctaccaccatcgaggttcagctgggtgataccgagctgccgcgtgccggtgtcgcaggtggatcgcagctggcgggcaacgtgaccgcggcggtgaacgataccgccaaacgaatgcgcgaccagctgctgaaactcgccagcgagctgccacagtcgccactgaatggcactccggcatctcagctcacgctgaaaggcgacagtgttcagcataatctgcgcagcggtctggcggtctcatttgcccggctggcaagcctggcaccggcggagagtctgacggtgaaaggcggcactttcccggacgatctgtcacagagcgagcgcgacaagatggtgcgcaaccttaatgacatgagccgtcctgaaaaattctcggcccacagctggagcgcgcagtttgtggaagtgcgggtcgatgaagatttcggcactatccgggtcaaacggatggtggcggcgctcgacagcggtcgtctctacaaccctaaactggcgcgcagccagtggattggcggcatgatcatgggcgtcggtcaggcgctgatggaagagggcatcgtcgatccacgcaatggtcgggtgatcaacaacaacctggccgactatctggtgccggttaacggtgacatcccgagcattaccaccatcaacgttggcgagcccgattttgaggcgaccaccatgggcggtaaagccgtgggtgagctaggtatcgtgggcgtggcggcagccatcagtaatgcggtgttccatgccaccggcaagcgggtgcgcgacttacctattactctcgataagattatctgagcctgttcatgacctgctgccagcaggttgatgtgaggatatgcgggcgcgggatgaaacctgcgcccgtttttcacgcttagcggagagaaagagtgaagatagcgttgattgtgctggccgccgggctgagtcgccgttttcgccagcaggcgggcgggcataagctgctggctgacctggatggcaaaccggtgctgcaacgcacgctggagcaggccgctgccagtgatcttgacctgtttgtggtcacgcgcccggacgcctctgcgcttaaggcgctctgctcgcaggctaccctggtgctgtgcgacagcggcgggctgggcgaatcgatcgccgcaggtgtcaatgccagccgtgactatgacggctggctgattgcgctgggcgatatgccgtttgtcacgcctgaaagttaccgcgccgtcagcgctgcgctggcggacgcgccgatcgtcaggccgtggattgacggcaggccgggccatccggtgggctttcagcaccactactacccgatgctgagcacgctacagggcgatgccgggccgcaggcggcggtgaagtcactcgccgtccggttgccgcttaatgatcgcggctgtttgtgtgatatcgatctccctgctgatctgcagttaataaaggaattttcatgattgcgctggatcaacgtgtgattaatgcggcactgagcagctgccaggcgggtcagcaggtctggctctgcacggtgctgcgcacctatggatcttcgccgcgcgcgcctggcaccctgatgacggtcaacgaaacgggtgcttactgcggatcgctgtcgggcggctgcattgaagaggactttctggcgcaactggcggcaggagcctatcgcgccagcagtcagcgggtgcggtacggtgaaggcggaatgcgtcctgacgtcagcctgccgtgcggcggcagcctggagatcgtcattgagtttctgccgcccgatgatgccacgctggcgctgctgacggccatgcagcgcgcgctgagcggacagcagccgatggtgaaaatgatacgacccggcgaacgtgcgcagtgggaagtgctcgcccctgacagggtgttgcctgcgctggatgccagtgaacagcagatgttactgccggttggtgcgataccggaactgctgatcgcgggctactcgactgtggcatatgagtgcatccggctcgggcagatgctgggatttcacgtgcgggtctgtgagcaccgaccggagatgctgacggagctggagagccacttcagcgctgcggacaacgtgacgctggtgtcacagcatccggcgcgctggctggagctgaacggcgcgcatgcagcggtggcgattgtggcactgacccacgatccccgcattgatgacctgacgatgatggaggcgatcgcgacacccgcgttctatatcggcatcatgggctcggcgaaaaatagcgagaaacgacgggcgcgactacaacagatcgccggcatggatcgtgccgaaactggaccgcatccatgcgcccatcggcctgcctatcggcagcaaaaccccggcggagattgcgctgtcggtgatggccgatatcgtccgggtgaaaaatcgcgggctgtcagccgcctgagtccgacgtcgcctccggtgcgagccggtagaggtagctgcccgaataggggatcggcaggaaatcatggaacagctgccgcaatgtctgttcaggatcgacatcgcggaacagttgcggatagagcgtggtggccaagaattctgtcgctaccacgtgccacggactgaggtaaaagttgtgccagattgccccggcgtgaccgtcccgcaatgccgtcagctgcttcagcgcattctgctgaccggtcagcgccagcaggctctgccgggtctgcgctgttgtgacggcggggccgagttttaaggctcccgcttcatcggcgctgccggtgccggtggcgaagtaaaagtctggctgtgccgcaatcacactttcctcactcagccgtccgaacacgcctttgatctgctgactggcgatgttgtcgcccccggcaaagcgcagcagctcacccagattgccattcaccgacgtcacgcagcattcactgcgccgcccgagatgcagctgcaaaagaactttaggtttagctccgtgatagtccgccagtcgtctctcaatgcgctgcatgtggctgcggtaaaagcgattgaagtcagcagcccgctggggctgattcagcacctcgcccagcagggtcatgctgcgctcggtatttttcagcagctcaacccgcagatcgatcttcaccaccgggatatgcgccgcgctaagcatcttctccagcactgctccgctttcactgccgcgcgccagctgcggcaggatcaccaggtccggtttcagtgcgatcacctgttcgggattcatgtcattgacgccatccagacccagtaccggaatttcctccatctgcggaaacttactggcaaaaatctgccaggtctggggatcatactttttcagatcctgtggccagccagcgatatgctgcagcggattgccgggtgtcagcagcgcgacgctgtagagcatccggctttcacccagcacaatacgctgcggatggtcgggtatctctaccttacggccggtgatgtcggtcagcgtgcgggcgtgtgcgccagcgctgaccagtatcacgctcagcattaataacgcacagcgcagcgatttaaaattcaacacgggcctgtaccatcaggttgcgggtttcaccttcacggacgcgcaggttgccgccgcttgaactgtaatagtgctggttaaacaggttattgatgttcagacgcagctgcgttttttcaccgaacaggcggttgttccatgccacaaaactgtctgccaccacatagtcgggcagggtgaaactgttatcgggatcgcccgcacggctgccgacatagcgtgcgcctccgccgagccggaacgagccgggcaggctgctgatctgcatctcatgactgagatagagcgcaccggcatgacgcggcgcattctgcagccgattgccgttgttatccggattaacccggtcattaacgatctctgcctgatcatagctgtagttcgcacttaaatcccagccgggtgcaatttcgccgttcagctcaaattcagcgccggtcgatcgggctttatcaatggcccgcgtgctgccattaatattcagcgacatcgctttttcgtctatccgatagagcgcgacggtggcgaacagtttcggcgagagttgccatttactgccaacctcccagctggtgccctgttccggtttgccgacattgccatcatcatccacgtcggttgacggggtgaacgacttactgacgctggtgtagaaagagaggtcaggtgtgagtttgtagatcacccccgcctgcggcagaaacttattcccctcatcattcagggtttccacctgcggattaaatccgcgcgaggcgcgctgttcataatgctgataacgaccgcccagcaccacaatccagtcgggtgacagagaaatgctgtctttggcgtagagcgatcggctatgaatgcggttcaggttattggctgctgcgctattttccgtgctggcgtccgtgaccggtgacagcaggtcatattcaggcgtgtaatagttgaactggcggttgaccttgccctgatactgatgggcgcgataagtctggttcatctcatagtcggtgcccaccaccagcgcgtgctgcatacccagaatttcgggattacccagcagatcccagctcagatatttggttttgtggttaaacccgcgattggcatcggcgcgacgtgtgaccacgccgctgctggcgtttcaccgccgtcacgcgcacttcattgttgtcataacgccgctggttccagcccagggttaaccgggtgcgccactcatcattaaactgccagtcataatgagcattcagggttttgttatggccccaggcgtgattggctttgtcatccagccgatctttataaccgatgtcgattggcttgccgtcaatgaaggccgtgccgcgatcgtagggaatgtcatagcggtagtcggcatagctgatcagaaaacttgcctgctcgccataccattgcagagagggtgccagcagtgtgtgctcttcactgccaaagttgcgccagtaatcctgattttgcttttcggcgatcaggcggaaggcgaagccgttgcccagcgggccggtgacatccagggtgcctgcaccgccaccttcactggcgtaacgtccgctgacgctggagtgccagctgtattgcggttttttgctgaccacattgataatgccgcccggattctgaatgccatacagcagcgaggaggagcctttcagcacctcaacccgctcggtcgtggcatcgaaattcaatccctgactgctgcgaatgccatcccggtagattgagccatcagcgttgctgccaaatccgcgtcgtacaaagccatcttcggtgccagccagcgtgttcgcttcggtcacaccactgacaaagcgcatcgcatccgccagtgagcttgcctggtaatcgtccagttgctgctgcgtcaccacgctgaccgactgcgcctcatcgatccgcgcggtcggcattttactggcaacgctactctggctggcgctgtaatttccctctgaactggcatccgcggtcacggtcatatccggggcgctgtcggttgctgcattgacctgtggcagcatgatgctgctgcagatcgccacgaccagagcggggtgccgggccggatatcgtgagtctttgtttttcatttttcttttcgtatctgaagcaaaggacctgacgactgacaatctgtctgtcttgcaggtctaccctggaggtgttctgcaatatgcagcgtttaaacagaggagatcagtatcaggccttcaaggtcattatgccggccggacgacaacctttctcatctgtaattgagaatcattcaaacatccgctattgtagtagtaaacataatttgaatagaaatgactacattattgccgtgtcgtttatcgctgcaaatagattggctggcatttttaacttattgaaaataatgaatatatttttatatggaggtgaggggtttggttaaatccacatcttctgcaggtgaaatataaaacagtgtgacgcttttactacatctcccggccctgaaactatctatttagccagactagcaatgagtctttcacacatttaaccccagttgcaggtgcagcatgaaacagagcaggaccgttaaaaacagagtggatgtggtggcagaacgtcttcgcgcccgtgaaaagcagctttcaccccgcctgctggcggtggcgcgctatatcgatcaacagcgggaaacggtgctggagagcaccgcgatggagatcgctgtggcgaatcacacctctgatgccactgtaatccgcgcgattcaggcgctgggctttagcggactgcgtgacctcaaacagacacttaagacctggtttggtccctcgctgacctctgaagataagatgatcaccaccgtcagtgaggtgaccagtgatgtgaacagcgccatcgactttgtgctggagggccaccgtcacgcctgtgaggtgctgtcgcagccgcagaatcgggtggcggtagcggatagcgtggcgctgctgggcgaagcgcggcaggtcgctattttcggcatcaacgcctctggtattctggcggactacagcgtgcggctgctgaaccgtatcggtctgcccgccttttcccttaaccgtgccggaattgcgctggcagagcagatgctggcgctacagcgtggcgacgtgttgatcatgatggcgcaacagtcggcgcaccgggaagggacaaccgtggtgcgtgaagcgaagcggctggatattccgattattctgctgaccaacgccaccgactcctttttcgcccgcgaggcggatgtcgtaatcaatgtgccgcgcggcggcgagaagggacgcattcccctgcacggcacgattatggtctgtctggagatgctgatcctgtcggttgcctcaacgctgccacagcgcactgttaagacgatgaaacgtttacaggatcttaatcgcgggctgaagcccgccagcaaaaagtagcccgtgtaacgacgccgtggtgggttcacggtatttcacctgaaccagcacggctgatctttaagtcaaatttctccgctttgcgagcgcgatcccgtattttctgccacccctttcctcagccgtctacgcttacagcttgctgcgccagccggtgcggttcttactcatactgactttcatttgatttgtgcggagctgctgatgaaaccccttcacgcgcaataccttttctgctgtgccaccctgagcctgctgtcgccgctgcctgcgatggcctggagcgacctcaccgtctttggcgatagcctgagtgatggcgggaacgtcgggcgctttacctatgatggcgcgacccatccgctctatgacgagatcgtagcgcagtcgctgggtgataacctgcgcccttcatcgcagggcggaagcaactatgccgaaggtggcgcagttgcggtacctgcaattaatcccctgtttaacactcaggatcagcttgataactaccttgcggcgcgaggcggacgggctgattcggacggtctctatattcactggattggcggcaatgatttagcggcggcggctcttgcccctctcgctgcccggcagatagtggataacagcgccagtgcagcggcctcacaggtcagccggttgctggatgccggagccggaacggtgattgtaccgacggtacctaatgtaggggcaacgcccgccctgctgcaggcgattctgcaggtgcttggcccagcggcacaacctgccacggcggcgctgtttcagtcgctgagcaccaccactacgcctgaccgtgccgcaagagagcaggcgattgaaaccgcgcttggcgaggcggccggacaaatctcttcaattccgctgatccgggatgccattgcacagcagctgattgccgcctggcagttactgagtcaggaggcggcggccctcaccgaccgttacaaccaggctgaagagcaggggctggtgaccgcacgcgggaacatcgcacgagtggatatcaatggcctgtttaatgaggtgatcgataatccgggcctgtatggactcacgaatacggccggaatggcctgtccgccaggtgtctcggcgatggactgcacctcctcgacgacaggattttcgcagtcacagcagtatctgtttgcagacagactgcatcccagcccggcggtccatgcgctgatcgccgattacattcagtcggtgctgaatgcgccgctgcaggtagctgcactgagtcaggcgccgtcgatgctggtgggcgatgcgcataatacgctggatggacatctgcagcagcagcgtcagcagcccgccagtgctggcgagtttactgttttcggcggttatgccgggcagcagcgtgatttccgcggcgacagcctgcaggatggcgatgcgaccagcgccagcggcaccgtgggtgtgggctatcagctgaccgatcactggcaggccggtgccatgctctctacgacctcgcaacgtcaggatccctcgtcgcgctttgattaccgtttacgcggcaatctggtggcactctggagtcagttgaattatctcgatcggggatggattaatgcggacgcccattatgccgatctcgactttgatgatattgagcgtcagatcaggctgggaccggcgacccgcacggaaaagggcaacagcaatggtaaggtgctgggaatgcggctgcagaccggctgggatttgccgctgggtagctatgtttctactggcccggtggccagctatgcgctcgactacacccaggtcgatggctataaagaggaaggcaacagcagcacctcaatgcgctttggcgaccagacgctgcactctcaaatcggcgcagtgggctggcgtatcgacagcaaagatttgctgatcaatccctgggcgcaggtcagctacaatcaccagtttggtgacagcgattcggcggtgaccgccggactgaaatcgacccgcaccgcctttacccgcagcagcgattccagtgatgataactggatcgatatggcggtgggtgcgagcgtgccgcttggcacctcggtgaatgcctttgcgggcgtctcggcggtaacaggcaacagcgacatgcatcaggtgacatggaacgtcgggcttaacgcccgcttttaacggatctgctttgcggagtgaaaagccctgcagacgttgtccgtcgctctcataatgatagcggcgggcgacgttgcagcagatctgagcgttcatcacaccccggatgcagtcgggtataactctcttctgtggcgtacctttttcacgcttcgatcaaagcctgcgcctccagtttcgcggacccgcggtatcacttcgcggccaaagaattcgacctcttcatgaaagtgcagaaatgccagcagcagcagatccacaccggcctgcttcagttcgataatgcgttcagcaatctgctgcggtgtgccaatcagattggttttaaagccgtcgttgtactgcaccagatcctcaaacgacgatttcgcccagttcccctctccttcgggtgaggcactgccagcatttttgacctcatgctgaaagccttttaccgcatccgggttggctttgctgatgatctcatgaagcaccgcctgcgcctgctgttcgctctcgcgggcaatcacaaaaccgttcagcccgattctgacctgatgctgattacgtccggctttttcacggatatccgcgacctgcagacggacaccgtccggggtattaccgttggtaaaataccagtctgacaccctggcggccatgtcgcgcgccgcgcgtgaactgccaccctggaaaatttccgggagcggtgacaacggcttgggtttcatcacgtaatcgcggaagcgataaaaatcgccggcaaagctaaaactctcttcacgccagatgccgcgcaggcagcgaataaactcttctgaacgcagatagcgctcttcatgatcgagccagggttcaccaattgccttgaactcgccccggaaccagccgctgacaatattaacggcgatgcgtggaccataaagatggctgatagtggcaatctgctttgccgccaataccggattccacgggccgggaagcagagcggcaatcacttttaatttcgaggtgtgactaagtaaatcctgcgagaatgtgaccgattcatgctgattatctgcgccatatcctgcagtaaagcgaatctgcgtcagcgcgtaatcaaaacccgcctgttcagcgatctgcgccagtttgcggttgtattcggcatcccagcgggtacgctgctctatctgactgatcaccagtccgcccgagacattcggcacccagtaggcgaactgtaaaggttggttcagtgacatggttttctcctggcatatagctggattaatggaacagttaaatcttccaaactttcagatataaaagaaaagaccaagcagtaaccatgccagagattaaataattgaagttaaaggattaaaatccagttttgcataagcgagctgttgcaaatgcagcaacacagaaacagcacggttgccaatgcagcagcgcttcatgaccgcgcgtaactgcggcgaggccaggggcatctgaacccggcggtattcgcagatagccgcaaagcgatgtgataacgtagaggttctgttgcagagccggagggcactatgattgtcagacaggcatcgcccgaagaggcgcaccatttatggaacatcagaaatctggccatccgtcatggctgccagcatgcttatccacccgacgtgctcgccgcctggacgccagaccgcatgcccgccagctttcccgcaatgatccgcatgaatcccttcttcgtgattgatggtccggacgacgtacaggttgctatgggatcgctggaccttgccgccgccagcgtggaagccatttttaccctgcctgggttcaccggacagggaatggctgggctgatcatcgacaccatcaaagcggaggcgctgcagcgtggctaccaccggttgacgctcgcttcgacgccgaacgccgtgggcttttaccagcagcatggcttccggccgctgggcgaaagtttctatccgtcaaagctggcgggcagcgatttacgctgtactgagatggcgattgatctgtgaatgcccgctgccgtcaggctggcaaagctgagcaaaagtttccgttgcaaagacttcgcaagcccccgccggtaaggtatagtccgcgttttttggaggaatcatgctgactgactcatcaactcgtcttaataaatacatcagcgagagcggcatctgctcccgtcgtgacgccgatcgttacatcgagcagggcaacgttttcattaacggcaaacgcgccactgtgggcgcgcaggtatttgcaggcgatgtggtgaaggtcaatggtcagcttatcgagccgcgcgatgaagacgatctggtgctgattgccctgaataagccggtggggattatcaccaccatggaagagggcgagcgcgataacatcagcgatttcgtcaatcacagcaagcgcgtcttcccgattggccgactcgacaaagattctcaggggctgattttccttaccaaccacggtgatctggtcaacaagatcctgcgggccggtaacaaccacgaaaaagagtatgtcgttacggtcgacaagccgatcactgatgagtttattgccggaatgagcgcaggtgtgccgatgctgggcacggtgactaaaaagtgcaaagtgaagaaagaagcgccgtttgtcttccgcatcacgctggtccaggggctgaatcgccagatccgccgtatgtgtaagcattttggctttgaagtgacgaagcttgagcgcacccgcatcatgaacgtcaatctcaagggattgccgctgggggagtggcgcgatctcactgacgacgaactcgttgagctgtttaaactgctggagaactcctcttcagaagataaaccagcgaagaaagctaaagctccggcgaaaccggccgccgctaaaaaaccgcagaagagtgcgtcgaaacccgctgaaaaagcggatgctaacggtgcctcacgcaagcgctttgtccagccgggacgtaagaagaaagggcgctaataatggcccgatgcagagagcgactttcctgctctctgcatcggtaatcagcggatcatcacggaatgatccgggccgcccggaagcgggcaaacagatcgcagaacatcttatccgttgcgcgataaccgtggaatcccgcccgccgcagcttgctgccgtcgccaaacatgtcgtaatcccagccaaaaacaaaatcagcgaagacaccatcactgagcgccagaatatcgggctggatcagcgcgtttgcagcggcgatttcccgccacagcgcacgataatcctgaaatagttgccggaacgacagcgaaaccggcggcgcgatctccagttcaaaccacgctgcaatgaccggccatagctcactccagcgccagagatcgccattattgatattaaaggcctgattgcgtgcgtctggagtacgcgcggcccagatcgtcgcgtcggccagcagagtggcatcggtaaaatcgaccatactgtgccaggtttccggcgaaccgggaaagcgtaagggcagccgcgccgcgcgacagattgaggcgtacagcgccaggctcagcgccaggttcatgctgttgcccggcctgtcactgccgaccacaccgggccgcagcgcactccagtgccaggctttaccttgctgttgtgcgctcagccagttcagctgcgcgacgttaaactcagcacccggtacaccaggatcgctttcccgcgccggcgttttaaagcgtccgagatgggcgccatacactttgtatccctgcatcagactgacatgctcaagtggggcgacattttccatggtctgaaccagattttgcagcatggcaagattcggcccgaccatggttacccagtcagaagcgttcagccaggcgctgtaaaagatatgcgtgacgtcggtgagtgatgccagccgttgctggcactgctggctatcgcgcagatcaaccgcaatcacctctgtgccgctgactgcatagtctgaccgatgcgtcagtgctttgacctgccagtgatctgctaccagcgcctgactcagttgctgaccgacaatcccgcttgcacccgccaccagcgcaaccttcttatcctgcgtcgttttcatgatcattgccctgttaagagagaagctgcattctcacctgcgtttatttctgattaaatcccctgaaacggatgtcacttatcaggaaaatcaataaatgcagaacaaactgaatgcgattcagaccttcatccgggtggcagaagcgggatctttttcggctgcggcccggcaaaacggcatgaagcagtcggcagtaagccagcagatcgccgcgcttgaagaggcgctgggggtcgtgttgctgcaccgcaccacacgaaaaatggcgctgacggagcagggtcagcattatctgcagcaggtcaggcagctgctcagcgcgatggaagagctggagcagcaactacggcctgagtcgcagcctcttcacggcaaactctatatgcaactaccgagcggcatcgggcagcggcttatgccgtatctgattgcattccagcaggcgcattccgcactgcgtctgaatattgcgctggaggatcgcctgtcggatctcattggtgaaggcgttgatgtggcaatccgcctcagcgaatcgccgcccgctacactggctgcccgttcactcaccacggttgaaaccgtgctggtggcttcccctgagtggatagcgcgaaacggcacgccgcaaactcccagtgacctgcagcaccatccccacatacgttttagcggcgtatcgcccgatgcgccgctgcagctggtgtccgcgaccacgagggtgtctgtgccggtggaaagtgcttttcgctctaacaacagtgatgcattgatgcaggcccttgaagcggggctggggatcggtgggttacaaacacttatcggcgcagacgcgctggcatccggccgactggtgcgggttttaccggactggcggcttcccgatcgctatctttatgctgttttccccgatgcccgctttatcccggataaagcgcggaagctggtcacgcacttaagtgaggtgctggtggggttgcagggaaacagggcagggcgagacctaacgcccaggctgttttactgatccgcatggtgcagcagaacccagaaacgctgaagacgctcgcgaagctctgacaggccagcccgtaaggctggcatcctgtttcattatcgatgcctccggtttcccctcgctgacgaatttaaaacgctaacccctctccccaatccgatagtccgtttcacgccgccggccagattttaatgggggtcacattcagaccaacgacacttttcaccctgatcagggcgtggcaggataagcgcaatctatcaaggagtgtgcctgatgttactgaaaggtatgaacgatccgctgctgaaagcgtatcagcatcccaaatcacggatgatgatcagccgtttcagggggctggcgggggatcgaagactcagtgactggcaggcgttctgtattctggtcaccggctttaccaattactggtatgtgcatgcaggtcactacaccattaatgtcacactgactaaaacccgccagttcgacttcctgcaggactttctgcatttcacggttacgctggatgggttaattggtgatgaacattttcgtagtccggactttgtgctgccccattacgatgtgccctacgaattctgccgctggcgtaacaagcgcggctatgatgcgttaactacctatgtcagcaagcagggtgtgaaatcccataaagggatatttgtcgcctctgaaggggcttccccggaagagcaggtgatgaaatgggaaggtgtggtcaacgtctatgacaaaaccttttttagcgtgactaacttcagcacgacccaggaatttctgatcaaagacatcagtaaatccatacaggaaggattgctgaagcatctgagtttttaccgcgatctgtttcactatatcttcccctcaccagcggaggcgcggttgcaggcgcgcgatgacaggcgctatctggcgaaaagatagcgcccgggcatctttagatcaggtcaatgggttcagccgggtctgcttaaacgttgcaaacccggtagtcagctgacctctcagcggggtttaccacttcatctcgccggtattgactttggcgctgagttccagtgaagccggttctgccagtttcggccaggcggctttcatggcggtaatcacctgggctgaggttttatgttgcgccagcgccgcctcaaaactcttcagataattcagggtgaaatccaccgcctgtgaaccggccggacgggcaccgagatagtgacccggaatcacgttcttcgcgttcagcgtctgcatttcggtcaggatatgacgccattcagcgcggctctgaacggtctgagtgtcagccgtccagacatgaatgcccgaggagagggcggtaccgcccagaatggtgcttgcagacgggatccagatataagcggcgtattgctccggatgacgcagctccagcacctcgccgtcgacgctaaagcgggtctgatgggtcacttcaggcacaaacaccttatccggcgcgccctgcttcatctgtggaccccagtatttcagcttggcgtcatgcgtctgctggatatgcttcaccaccgccggcgcggcaaccaccttcacgtccggccaggctttaacaattggctccagaccaaagtagaaatcgggatcgccagaagtgatcacaatttcctttaacgtttttccgctctttttaatcatctctgccagtttctcaccgtcctgggtgctgaactgggcatcaaacaaaatcgcttcggttggcccggtaaccagcgttgaggagacggcaaagatgcccttttcctgcggattataggtttgcagttgcagggtggctgcgctggcggaggccgaggccagtaccagcatcacaggtaaaaacttaattttcattgaggatcctcagagataaatgcccgattcaggcaggcgtaacgggcaatgttcagtatcagtggtgctattctacgcatctggctatctgttagaattcccgcaatcagagatgctgagtttcataatccgaacaggtggagtggatggacagagtcacggcggcagccgttttcaaccggatatgtgaactgggcagcctgagtgccgcctcacgatcgctggggatctctcgcccgatggtcagccgttatctggaggaaatggaaaagtgggcgggaacgcgtctgctgcatcgctcttcgcgccagctgacccttacgcctgccggagaggcgatcctgcaaaaaacccgtcagctggccctgctctcagaggcgatccagcaggaaaccacccagggcgtcccggccggaacgcttcgcatcgcctgcgcccactttaccgctcttcatcttgtcggcccggtgatccccgattttctggcgcgttatccggcactgcgcattgagctcgaaattaacaatcagccagtaagcctgattggtgagcgtatcgatctcgctattcgcatcaccgactcgccagagccgggggcgatcgcacgccgtctcggcgaatgccactcggtcctctgcgcctcacctgagtatcttaaggcgcggggtaacccggaaaccccggacgatctggctcagcataactgcctctactacagtcgctttgccggacagagctggcattttacggcggctggcggggagaaaatcgcggttgccgtcagaggaaatttcagtgcgggtatctcttcactgttgtgtgacgcggcgatagcgcattgcgggatagcgatggtgcctgagcaggaggctcgccacgcactggaagcagggaagctggtaaaattactgcccgattatgagccgcaacgtatcggcatatgggggctttacctgtcgcgtgagcaccagtctgccgcactgcggctgatgctggatgagctgcaaagcagaatccagaaaccggtgatcagaggggcgagtaaccgatcaaaatggaaccttactatgagtgataatcaaacccattactggaaccctatggtgccagaactgaccgtcactgactttaccgcttcgctgcatttttacaccgtggtgctgggtttcagtgtgagaattcagcgccagcagcctgattttgcttacctctgctatggagaggtgcaattgatgattgagcagttccatccgcagggctggaacatagccgatctgcgctggccgctggggcagggtattaatttccagattgaagtcgacgatgttcatgctgtgctgacgcgtttgcagcagcatgctgttccgctctatcggccgcttcgggacaaccactatgacatcggcgagaccaccgcctgtcagcgggagtttctggtgcaggaccccgatggttatctgctgcgtttcagccagtatctggaataagctgaatgtttttggcaatattaatcagcaggagaatggcttgagtaaaatagacattctcttcggatatttttatattgactgttcaatcatgatcaatggaagcctttaatagcagcgtagtgaagtcatctaaagcgcgaagagttacctgctgtttaccaccgtcacattaatcatgaccttttccactaacggaaggcgctatgaatagcgtgttaactattgcaaagcgtcattaagtcacaggcagccgtgatttgctgctacaaggccataataaaaaatgaatgtaagaaagaaaatttatccagcgatggtctacactctcgttagctggctggattaggattattcttaacaaaagttttttaagggatttcattgggctaagcgttcgtacatttacatttattcgttcaatcagcacttaatctttgggaatgtgagccgataacaggtgatacatactcaggaggacgcacaatgaaatcttttttatctgtctgcattagcacgttgctgattgccctggccggaccggttattgcggattcaaattcaggcatgctcaccttcagcggagccattactaatggttcatgtaatatgaatgtcggacaaaatcctgtcgtgtttgactgttttgatcccgccagtggtaaggctgtggccactactgctgacctgatgaatcctgaatcgctgaccaaattacctctggaagtaaaaatgcactggtttaatcctgaaaagagcaaagggatactttacgttacctatctttaatgcttctcttgaggttttattctgaacgacagtgcaatgccttagcagcaacggtgacatggaacctaaagatataaacccatagccaatacagggtttatcattaagtcaccaagagtcagtgaagtatcttttttgaaatttttaagtcagcatcggggaattcatttaccggattgatcatcagatagtgtgcgcatcttattaaacccctgcataattgagggttaacacgcgttgcatctgttgatatgcagaaaaaacccacctttgctgtcaaaggtgggtttaatttataaaaagcttgcgtgaagatcagtaagagtcagaagagcgctgagtaaaatatttcgtgctctgacgcttctcctttttacgacgcagcaccaggctggtggtaataatcagtagcgtcaaaccgccggttgccagtaattcagcctgatgtttcgcatcaaacaacatgattatcagcaccgtgacgataaacaggatagtgacccacgtcaggccaggaaataaccacatccggtaactcaggacttcacccgctttctcgcgctttttacgcagcaccaggtgggacgcagcgatcaccagatagaccagcagtgcaatcgctcccgacgtggccagtaaaaattcaaacaccacgctgggcgccagataattggcgatcaccgccagaaatgcagccgcggtagagagcagcacagcaatccacggcgtgccgctgcgattggtgcgtgaggcagccgccggtgcatctttgcggcgtgacagagagtagagcatgcgcgaagaggtataaagtgcagagttaagacaactgcacaccgccatcagcaccaccagatcgacaatcagtcgggcgtgcgggatgttcatcgcctgtaacactgtctgccatgaaccctgttcaaccagccctggtgcattccacggcaccagcgccactacaaagaaaatcgacagcagatagaacagtgcaatacgccagatgacggagttagtcgcctgagtaatctgcttaccgggattcttcgactctgcggcggcaatcgtgacaatttctgtgcccataaaagagaacatggtggtcaggatggcagccacgaccgcgccgataccatttggcataaatccgtgagtgtcatagagatgcgacaggccgctggtattgctgtcaggcagcagaccaaacactgccgcacctgccacgcccaggaacaggatgatggcaacgaccttgatcaatgcaaaccagaactcaaactcaccataatttttcacgctgagcagattagtaatggtcagcaacagggtgatagcaaacgtgaactgccagatggcgacatcggggaaccaggcatgaagaatggttcccgctgcgttggcttccagtgggatcaccagcacccagaaccaccagtagagccagccgatggtaaatccggcccagcgtcccagcgctttatcggcgtaggttgagaacgagcctgaatcgggtgaggcgacggccatctcggccagcatccgcataatcaggaccaccagcgcaccggcagcggcataagagatcaacaccgcggggcccgcttcagaaatagcatggccggagccaacaaacagcccggcgccaatcacgcccgcaattgagagcatacgcacgtggcgcggtttaaggttttgagccagcgaatctgcattcgcactctgagtcatcgtcatgtaaacgtctcctgtcgacgtccggcctggatggccggacgaacggggatgaacttgcgttaacgcgtcagcgaaatcaggccgggacgacgggatgtccggcgggtgcgacacagtgagcgatcaccgtggagagaatggtcagcgcctggctgaactgcgtatccggaatggtgagagggtagaggaagcggatgacgttgcctttggctccgcaggtcagcagcagcaagccctgttccatcgccatcttctgaaccgcctgcgcggtgctggcctgatagaactccatcgccaccatcgaacccagcgcacgcacttcagcaatgtccggatgtttgcgttgatgttcctggagttctgcttcaagccgggcaccgagttcaacggcgcgctggcagagctgctcctcttctattacatccagcaccgcatgggccgaggcgatagccagcgggtttccggcataggttccgcccagcccacctggtgcaggtgcatccatcacctctgcacgaccggcgaccgcggagagcggcatcccgcctgccaggcttttcgccatggtgatgatatcggccttcaccgggtagtgttccatggcaaacagcttgccggtacgggcaaatccactctggacttcatccgcaatcagcagaatgtcgtgacggtcagccagctcccgcaactgcaccataaactctacgggtgccgcatggaatccaccttcgccctgcaccggctccagcacgatcgcggcgacgtcatgaggcgcaatgtcctgcgtaaaaatttcttcaaggctggtcagtgccgcctcgatgctgatcccctgaaccgcgctgggatagcgtgcatggaagactgacggcggcatcgggccgaaatctcgcttgtaaggcgccacttttccggtcatcgccatggtcataaaggtgcggccatggaatgcgttaccaaaggtgatgatgccgtggcggcgggtataggcacgcgccacttttacggcattttctacagcttcagccccggtggtgaagaaggccgttttcgccgcaccggcgatgggaacccgctgattaatgcgctcggccagtgcgatgtagctttcgtaaggggtgatctggaaagccgtatgggtaaactttgttaattgatcggcaatcgcctgttcaatgcgtggatggcggtggccggtgttcagtaccgcgatgccgcccgcgaagtcaatccagctattaccctcctgatcccataaggtggcgttctctgcccgggcaacgtaccagtcgcacagcgtaccgatacctttggggagagcctgtgctttgcgctgctgcaacaggttatttttttcgctcatttattccacctcgttaatatgcgtgtttacaattcccgacaaacacgtttatttatgcctgaggcgtggtgagttgccagagccaattgtcagaggaaaggtggagccaattgcgactcttatacgcagatcatctattagcgcggttacagtttttaagaactggctcattacatcagcggctgctgaactgcatgcaggccgcgatcgctgaagaggtgtttccgcgcggaagccgtttgccgccaacccgcgatctgtcgcgcgaactgggcgtgtcgcgaaacacggttatgcatgtttatgagagcctgatggcgcaaggctatgtcaccgcgcggaccggcagcggcacctggattgcagaaacgctgccggaaaactctctgcagagtgatgcgatagccgaccttcaggcggtgaaggcgcaacgaccggcaacgctgtcgaagcgtggcgccagtctgctggggcacgcgacagcatcgccttaccagtggggcgcgtttgtccccggtgcgccggatgtgaccgaattcccccacaagctgttcagtcagattcaggcgcgtctgaatcgcgaacctgacgttcaccgcctggtctacagcagcggcggtggctgtcccgatctgcgccatgcgctggtggattatctgcgggtggcacgttcagtaagggctgatgctgaccagatcctgatcaccgaaggggttcatcaggcggttgatctggtaacgcgggtgttgtgcgatcctggcgatcgggtctggatggaggagccaggctactggggaaacgcgcaatctgctgcgcatgaatggcctgaagattcgggcgatgcccgtggatgagcagggactggtgccggacagcggcccgccacccaggatggtgtttgtgacgccctctcatcaatatccgctgggtgtgcatctaagcctggcccgtcgtcaggcattgctcacctttgcacgtcgccatcagagctggattgtggaagatgactacgacagcgaatttcgtttttccggccagcctcatccctcactgcaggggctggaagcggatgcgccggtcatttacatgggaacgttcagcaaaacgctctatcccgcgctgcgcattggctacatggtggtgccgaaaccgctggcacagccgttgcgcatcgccgcggcagagctctatcgcggcggacatctgctgattcagcgtgcgctggcggagtttatccggctgggccattacatggagcatatccgccggatgcgcctgctttaccgccagcggcggcagtttctctgcaggctgatcgagcgctatctggggccagcctttttaccggcattcaatcatgaagcggggctgcatctggtgatcccgctgccagcaggcgcggatgacgtggcgatagccgcggaggcgctaaagcgcggcgtcaaagtacggccactttcgcaatattatatgcaccctcaggaggcgcgcggattgctgctgggttacgcctgcgtcaatgagcggcagtgtcaggatgcgtttggcaccctcaaagcctgtcttgcgtccgccggaatggtattcactccgcagcgctagcgggttcaggggcgctttttttgaaggagggcggttttactgctgcctctgtgctaacgcattgacatttaatcagagtcaccgagaatactcctctttgcgccccgaccagacaatactggagtctatcatcgcctttaaaccctttactgcaccggcccgtgcggctattaagcgaggcgccgcgctggctgccgcgctgttgctggtcagttgcgcatctgagccgccgaaatcgctggtcacaccttttccgcccgtgacgaaacagccgctaccgacgcccggcaagccagcacaacctcatgcgcaggaaccgatgcggggcgtctggttagccacggtttcacgtcttgactggccgccggttgcctcggtgaatggcaccaatccggcgcagcgtatccgccagcagcagcaatcgctgatcgacaagctggataagctgaaaagcctcggcatcaacacggtgtttttccaggttaagcctgatgccactgcgctctggccctcaaaaatcctcccctggtcagatatgctgacaggaaaaattggtgaagatccgggctatgatccgctgcagtttatgcttgatgaggcgcataagcgcggtatcaaagtccatgcctggttcaacccttaccgggtgtcggtaaacactaaatcgtctaccgtcagcgaactcaaccgcacgctgtcactgcatccggccagcgtttttgtgctgcatcgcgactggatccgcactgcaggcgatcgctatgtgctcgatccgggtatccctgaggcgcgtgactggatcaccagtattgtggccgaggtggtggcgcgttatcccatcgacggtgtgcagttcgatgactacttctatgcggaatctgccggttcactgctcaacgataatcagaccttcagccgctacggtcaggggtttgccagcaaagcggactggcggcgtcacaatactcagcagctgattgagcaggtgtcacgtaccatcaaacaactgaagccggacgtggagtttggtgtcagcccggcgggcgtctggcgtaatctgtcgcatgatcctgccggttccgatacccgcggagcggcggcgtatgatgaagcttttgccgatacccgccgctgggtgcagcagggcttgctggattacattgcacctcagctctactggcctttttcccgtcaggcggcccgatacgacgtgctggcaaactggtgggcagaggtcgtgaaaccgaccaaaacccggctctacatcggccttgctctctataaagtgggcgagccgtcaaaagttgagcctgactggacacagcagggcggcgtaccggagctgaaaaagcagctcgaccttaatgaatcgaaccccaatattgatggcacgattctgttcagagagaactatctgaatcagccgcagactcagcaagcagtcagctatcttaaaagccgctggggaggctgagaaacgccgcgacagcatgaccagtgcggttaagtttttccttgtgacttgctgctattcttgcgctttatatgggaggaaccatgagcgaactgattgatatttttacaagtcacaaaagtgaacgcagtttcactgagcaacctgtcgatgaagctgtgctggatcggattatcagtaccgcttatcgcgcaccgacatcagtaaactcgcagcaggtttctttggtgatcacgcgtgatgccggccgtcgcgcacaaatcgccgccattgcaggcggtcagccgtggattgccaaagcaccggtgtttatcacctttgtgctggatatgcataaatcagccgtgggaatggccgctgtcgatcagcagcagatcgcccatcagagaattgagagtatcgtgtcgggttctaccgatatcggtatcgcgctggggtcggtaatggcggctgcgcgtgccgaaggtctgggaattgtgccaattggcggtatccgtcgcgacccacaggcgatgatttcactgctggagctgccgccgctgaccttcccggtggcgggtgtggtaatcggtcacgtagacgaaccggctcatcagaaaccacgtctgcctctggcgacgttccgccatgatgagacttaccagacgcagggtctggagcagcagattgcaacctacaacgatgagatggttcagcactggaagacgattggtcgtaatgacggtgagagctggagcgaaagcgtcagcggttactataaaaacatctacttcccgaatgtactgccagcactgctgaagcagggttttggcacagataaatagttcgctctcgttattgagtgaatagaaaaaggccatccgtagcgtttacgggtggcctttttcattttgttactataacgaaaggtgactttccacgtcgtaacacataatttcccttttaaccgaagcgcaactgcctctaacacttaccttccagggaaataacatgtctcagcgttcactctacgcgctctgtttaatgagcttttttctggccgatgtccgcgacggcctggggccatttctgggcatctttcttacggagcgacactggcaacccgacgaaatcggtctggtaatgacctgtggcggtatcgccggattacttgctacgctaccggcagggatcgccgccgatgcgacccgtcataaaaaaatcattgtgctgctgggctgtctggtgattaccgttgccacactgctgctgtggtacagcaatcagacctggacggcgatggtctctcaggttgtagcaggcctggctgcggcgtttatcggcccgactgtggcggggatcaccttagggctcacgggtcagcgcggctttaaccagcagatgggacgcaacgaggcgtttaatcatggcgggaatacgattgctgcattgctggccggtttttcagcctggtactggggcatgggtgccgttttcattcttatgacggtaatggcggttttcgctgctttcgctacgctggcaattcgcggaaatgagatcgataacgatgtggcgcgcggttatgaaccgcatgaagagcgtcagccagcgctgcacttatcaatgttgttgcgaaacccggcgctgatgatcgccggtttgacgctgctgctgtttcatcttgccaatgccgcgctgctgccgatgctgagcatgcgcgtcgcctcggcaggcggccaggcggcgatcagtccgggcctttacgcggcggcaacggtggtgatttcccaactggtgatgatcccggtcgcgctgtgggtatctaaacgcgttgatacgcacggctatcgcctgtttatcatgatcgccctgatgatattaccgctgcgcgcggttctcgccgccggctttgccgggccgatttttgtcattccggttcaggtttctggatggtattgcggccgggattctcggtgtggcggtgccaggctatattgtctccctgctgcggggtacgggtcatgttaacgccgggcaaagcgttattatgctgatgcagggcgcaggtgccgcgctgagtcccgccatgacgggcatgatcgccgcacgttattcttacagcaccgcgtttgcggtactcggcgcaattgcgctggcagcgctgattctatggtggcgcaccggtagcgccccagccgcccgtctggcctgatcggacacaaaaaaggctgcccattgggcagcctcttctggcaaatccgtttgcgaccatccgttatttatacagttctgcggtcatgtgaacacggttgttggtgttcgcttccgtaattttatactgcgcaccctgttcctgagcctgagcagcaatttttgattctgcgccatccagtgtggatgaggtgacagaaacgctctcggcaaagctgccaaaagagatcagagaaagagttgcgagtgcggcgattgaaagtgcttttacgtttttcatggtcatattcctgagatatgccagcaactattccttacagtgtctgctcattcccgactgtttacctgaatccctgtatcagcagggaataatagaaaaaaatcggttatgagctgtttataatgttcctctgcattcataatttttccctttattacccccttttttgtgtacatactggtgtacataattttccacttcagaagatttatggcgctatcagacgctgccctgcgtgcgatgctgggcaaagaatatgaaaaagttcaggttaagaccgatcgtgacgggctttctgcccgcgtatcctgcctgggtaagatcacgtttcagtaccgttaccgctggaacgggaagggcgaacgcgttgatatcggtacatacccggctaccagtttaaaagaagcgcgtgacgaggttaccaggttgcgtggccagcttgaacaaaaccgcaatcctcgcatactgaagcgcaaagcccgtgatgatgctttttctgcactgactgttgaaggggtaatcaggacgtggctggaaaaatatgccgttgaaaataaacctgaacatcatgatgtgctgcgttcattcgaaatacacctttttccctggttaggtaatgttccccatgaggatgcacccatccacatgtggctgaacgttctggaaccgctggcacgtaaaaaaccctctataaccattcgtcttttaaccaatgccaggcaggcccataactgggcgatgcgcaggcggctgataaaaatcacaccgctaaccgatctgcgtctggcagatttagggatcacgctgacaccgcgcgaacgtgttctgtctgctgacgaaattgtgacaattttccgcgcaatggaggccagcaggctggcgagaaagtttcagttgctggttaagttgtgtctgttgtttggttgccgggtgggggaactatccaacgcagaaaagtcgcatttcgattttgaaaagaaaatatggtccatcccgccatcacatcacaaaacgggcaaacgcacacgtaagccgctgttgaggccagtcataccagaggcagaaaaaatgctaaaggagctgttcgaccagtcaccgcatagccgctttgtaatggcgaacattcagcgtgacgctccccaggcccgctcatccctgattgatattccacccaggatcaggcaatcagcgcgccgccatttgagcactgaaatggaacactggacattgcatgatctgcgccggacggcccgcactaatttttcggatctcactgaaccacacattgcggaaataatgctggggcataaattgccaggtgtctggcaggtgtacgaccgttatgagtatatcgaggaacagcgtcgcgcctattcgttatggtgggcgcgtgttacagagtggattagtggtgatgggacagtatcagtgttggcgcgctcttcgtgatagcgcatgaggtcgcaggtgcgaaacgtcagacggctgcggcgtaccggtaccggaaacgcgggattgtgggggcgctgagtttcgcccgtttactgatacccatttgcgaatggtttgcggtgctacgcgaagcagcatggcagcttcgtgcagattcagatagggcatctgtaagagagtttgaatatcaatttttggattatgcaccatttctgtctatacctctgtcatggtgtttgcctcggacatgcccgatcatccatactcatgagctggcccacaggttgtcagcgccatggatgatttgccagaaggaactgacatctgaatccagtttcgggcaataaaaaaccccgcataggcgggattttcattatttatttttgtcgcctttatcatgctctggcttctatacagatctgcacatctaaatgactacatatgttgttaagatataaacgcagaggcatccatgctcagagtatatatatcagcctgaactgtctggtccttataaaaatttatcgttccatttaactctgccacacgatattgtgataccgcccagcctttattatcccatatttccaggaaattacctgatgccagagttggcagatacaagacaattttatgcatagagtcttcttttccactgagtacgatcctgccgccatttgtcagtccagactgacgtgtccagcgaatacccagccgtgttggtttttttactctgatgtaataagacgccacgatagtgttactattattcttaccagccttcaggttgttttcagccaaaagctggaagtcaatctgactggtttctttaaaaactaaatctgcagattgtgttataggggagcctgttggagaaatgaacgcgtgatgatcaggttttggtgaaggtttgattttatgcttgccaggatgaaaaataaaaacattaccgaaggttggatttacaactaaagaaagtagaactgccataattttgatgtttttcattcagtcacctctctttaggttttgttaatgcataatgaaatggctgcgacataaaccaattgttcataagtgttttcccccgctgcaagtaactttagttaataataaaatgctttttaattatctaatcttcactcgagcaatggatgttgaaatcgagcggaaggctaagggtgttaattcataggcttagccttctttctggtcatttcatttctgatgaataactatcgttaagaaataaacgctgatgcatccatactcacggtataagtgtcagcagctacctgctgttttccttgaataactaacgaaccaccaaatctttcttcgaggttacgtgttatatgccactcatctttgttgtcgtaatcataattaccccaagcaaagttcagctcaaggatattttttggattgttcttaccgtggattttcactatgggaaaactcttacttctccaacgccaggtgtccagcgcactcctatccttactggtggtgatgaagtgatatcaaatgttgctactattttgtattcgtcatttattcctgcctttaaatcctgaacaggtatcagcttaagattcagtttcgagttctgtttgaaaactaaatctgccgattgagttaaaatctcgccgacttgttgtggtgtgttatcagctattgcgatgttgcatgcgcttaacaaagaaagtgttaagggtaaggtctttaatttaatcaattttcaatcctctgtggttgatgcctgtaataggacgtttgagaaattacgttttgagttacttcatgtttgatggttttttagttccttccgcattgaaccgaaatgttaattggccatgtatggctctcaatatactgttcgccgtttgttattaatttcagggtggcgaaacctgatgggtcgttaagcataacgcctgtcccgaattgtatgtcaggctgccagccttctccgaccagcctgactctcagtggcctgtttcctcccggtctgtcataaagggtataggacccgggggtagtctcattctgcgccgatgggctccagacatttacagcacacttttgattcataccagatagatatatcacggccagtgtcgtaccatccggaaatattcctgagtgtaattctgtatcgggtacgattttaattgctaagttttcagctatgctctgattataaaatgcattaagtagcagaagcagtgacatgcatgattgggcaaacagtctgtgcatcatgcactcctttattggcattttgcgactgctgaatacagaccatacgagtcaatattttttcttaaaacgaaaaaacatttatacgtctgacttcgtgtttttacattaagctgtccctttgcagataaacctgacaggtaaactttaccttcgttatcaacaataccttcgggatgttgtgctgagagtgcctgcacaacagatccaaaaggtgcctttgatccatcaggaagtcttatttcaataatagccttagcaccgatattggttttgaaattaaccggaataattgcgccagctgtaggcacaattttcctgtcagtgatggttatttcagcctccgccggcaacgttgtggggtctaatgaaagtgaattctcacggtaaggattcagccagtgctgcgctgtatacccacgataatctgtaaagatcccgggcgtgcccagaacttttacgcctgaagcgcctttggctgtaaccagcgcatttgtatcaccaagcgtttgtgtgaaagtcatcccgtggcgatggacaataatgccgccgtccattgcaacggtacgctgctggtaataccggccacagctgtaattacctgagatgtgcccgtaggttccggtccatcccagagatacgtcgctattgctccggcgcactgcgtgtcctgcggtataacgctgatcaacattccagctgaggcgctgatcaaacgcatcaccgcttaagcctgcagattgagtggcagggccggacgatgaatgcgtgaaccggtacgacgctcgcgtgttgccacccatccatttttttagcggaacagagagccagaggctgatcatctgttccctgggatggtgccgggcacgttgactggcagaccagattaatgacagcgtcatatccctgaacggaacagagtatcccgcgttaaggctgctttctcgcagaccgcggttccagtaggtatcctgataagcacctgcgttcaggtaaccccatttacccagtccctgactgatggatagtccggtacgactttttctcctttttctgcgaatgcctggcgccattccatcaatccgccagctctccagtgtttcagccagtgtgagatagtccggctggctgaactgtaaattgaccagtgacagcgaagtatttgtcccgacaaactctttgctgtaccgcatacgccaggaataaccgtgtaccgggtcatgacccgagtgctgtgcgcggctgagtgtgacatctgaagagagtgcaccccagttgcctatgctcagcccggtacccagggatgaagactgatagtgccgggctgcctggattccgccataaagcgtgaatccaaagggaagaccgtacatggcggtggcttccatgaccggcgctcttgttactctcctgtcagacgaacgatactgcccggccatcagactgtagcgcaggtagccctctttaatggcgattgctggcgtctggaaaggaacagtgaaaacctgaggaacgccctccgcctcccataccgtaacctgaaaatcaccacctgcgccggtgggattgaagtcagtcagggcgaacggacccggtgcgacgacctggttataaatagtgtagccgttctgctttacctcaacgcgggcctgggttctcgccacgccacgtatgaccggcgtaaacatatactggctggaaggcaccatccgatcgtcagaggcaagcatgacccctctgaagggaacgctgtcaaaaatctcagaggcggtataacgctcacccagcgtcaggcggctgttgatgccattaataccgcgctccagataagtcgtaatggcctgccagcgtccgggcgttccacgtgtttgctgccagctggtgacgttgcgaagccgccaggcaccgatgttgacgcctggtgtcagttgcagccaggagtactgatattttcttcccgaggggccacgggtaacactctggctcgtcccggtacgataattcatgatgaaggcaggtatgccgtcgtcccaaagagtccggggtgcgatgcctttaaatccgggcttcagataaacctgaggaatactcagatgcagtgactgctcatcaaagtggaaatcagcctgagcgcccggtatctgcgacagatcaaaaaagcctgagcgtttttccttctcagtaaccttgaagctcttcatgcgtactccgtaacctgacagcatggatctgctgaggtgagggacgagtccctgacgaccatatttatccggccttaatatgtaactgactggccgggagtcgataagtgtattgttcaggtagatgtcagtcggataaatgcccggtagctgactgccctgactgaaaagcatcaggtctgtttctttattgcttccggtaatgagagccgggttaaaggtatagactttgccttctgcctgaaccgcagccagcgtcagaccggccacgaaaagtggtctgtaaacagtcatcgttttaatcctggcagggagtactctcagtgagaaacaggatcagtgctcaggtcggacgtgaacgctttgctgtctccgccataatcggtaatcagtcgccagtgcacctgacctgacgcatccgcaggtatgcgcagttgccgtttacccatcggaggaacatattcagcgttggccacactcgattttccaagctgaacacttctgagattcatgaaaaagggcgtggggttgctgaccgtgagcgtcctaccgcgttttgcccaggtcaggctggaggcaaagtcttcgggtgtgcctctgagggaggatgggcgtacaagcagtttcaggcagcttttgatacgcaattgcgtcagaagggtagcgtgctgtccggcctttttctttctatacgcatcccccgtccagtccgcatccgcctcagggggtatgcctgttacgcaaagccagtaaagtgactctttcgtgtcattattgtgactgctggttgcgataacctttatccggctctgctgatgcccgtccagacggaacagtggtggggtgacaataaacggggcccgggttttccggtcttccatcatgacttccgactgcaccagcatcggatacgcctgcgggttcatcacggtcattgatgcaccattcgaacccgcagaatatataatccgggttgcgccggtttttacagaaaaggactggagttcattttccagcggcatactttctccccttgcaagctggagcgagcacagtatagccgccacaataataatggcattcgttgttctggtcattgaattgttcctgactgccctggtgttgttttttatttcgagccacaatcatgactcgttaaatttgcagatataagataaccattgcctgcttttaattagagactaatcttcttcatcaggtaatggcgtcaaaagcagatgccggatttctcctgcactcatatccacttttactgttgtgaaaagtggcgcgacatagtcatcgctgtggccctgcttttccagaaactccagtgcctcttcctgagacgtaaagagtctgtcgtctttgccagtcgggcgtttgacgacccaggctgcgggtgcagtaatgaggcacagttttgcgatgatataaaccagttgctgcagtggctcggtagaagaatggtataaaaaggtgtcgatatagcttaacagtcttgtgttcataggtggcgtcttcttaattaatgttacactcagggagcgcgcggagttttaattttatgtatatatttattcgccttctgtaaagaaactaacactcactttcatatcagtgaagtcagaaaagtgaatataatattcataatgatgagggtgtccctggataatcactgctggcttaatccctgatatgagaccatccattacgtaatgcactcatacaacactgactgcggtgttctgcccactgggcattcatcggtcttaaggccagcttcattgcccgcagccagagttttcccgcctgatcaaacttttcgcagcgttcggcaaatgcagccgcctcggcgacggcgtaataacgctggttgcggtcagtctttctctgattcatcgataactcctgaattaacggggttcagatggcatttattctctggcttcttcaatctcggctttcctgaccagaaacacatctgtggctttatccagcagcggtggcacaggtttaagtacctttgatgcgtaggcgtagcagcgggcgagtgcgctgaccgactgacttttcatggctgcctcacaaaaatcagcgagaagttcttctgaagaacgttccctgtcctcagcgcgttcctgttctttacccggacagtgtttaggccagggcgggggtgcgctcgccggctggtcaggcgatctgaccgggctggctggtggcgctgcaggcacgggcgtttctgctttaatctcttcagttcgcaggtccgggacagaatggttttgcagcgcaataccgtgatctcggctgactgactgattgatgaacgcattcaaatcttcacgagctggcggtgtcacgtcgcgttctgcaggagataaggtttccagttcatccggtgtgtacacccccagaatgacgtccgggcagtgcagacgggcccagcgtttaacagcgagataagccagctgctgacgcggatcgctcgcccagagtgttgagttccgcacctgtgcctgtgagagcagcagttccagcacccgcggctcctgctcgttcttcattgttgcccacacccgaacaccgcatccggattcatcctgcagtgtccagtccggtgcgatatatttattgcctttggatgaggttttctcggtgaatctgccgataacattttcccatggcccaaaccattcgtaatggagccgatcccgtgcaggggccatggtgttgatcactgcattcaccagctgtgcctcgtatcccagaacaccgttgacggtgaaggttttttgggcgacggcaaacggattcatacgccactgcagggcctgcatggtcacagccagacagtctgcggctttgcccgcgagatgcgccgggacagtgactctgctgctggccatgatttctgcaaagcgcaccagtttatccagggcatcggggctgaaaatagtggcagttgtgtcagtgctgtcgggcgcagagatcatcggttgattttgcataacgcctactcctgttaatgtgcccatgcagggcgcttaattatttctatgccgccccagttattgccgaggcgacaggaatggaatgtgcacaggtcccgacggaagagggcggatcccgcgctcatgtcattgtcgtgcagctcaaacacacgaaccggataacggccacagtcgatcgcttcactgaccgcaataaaaacgaactgcggatatgtgccagtgcagtgataaaagccctcgcagtacatggctgcctgaacgtggtaccggaacgcttcgatgtggcgggcaaagcgcgacatatcactcacctttttcacgtcgacgatgagagggcgattcgtcagatatttatctggccggatgcgacagagttcttctgtctctgcatctgaccagtagagggaggattcgcagtggccgtcagcttcaagaaaaaagcgtgcggcgtgatgcgccattacgctctctctcataagctgaagtttccggccctgttctgcatccatgaccgtcatgttccggatgcgtgtctcattcagaaatgctgcttcgtctgctttaccttgagaggtgcgccggttaaaagaaggagccacaataaagcgcttatcaaactgttcaggctcaagcagcatgcagtgcagcgcgcttcccatatccagtgcggctgttttatccgtatccacaggcgcatgtttgcgccagaggtaaatggccgggttaaccgcaatgtcatcgagctgcgatttactgacgccgggaccggcgtgataggcctcattgctgaggccttcatagacacccggtttcatcatgctggttcctcccagccaagcagcacctgaaggtcgtaatttcgggccgcctgcaggtaggccagattcgtgataaagctgatgtattcctcagcggcttcaggatgggcacagcacttcatcgcatcaggatgcaggttccagtgacggaacaggtgaaggtggtcaggaaaacaggacagcaggcgctgggcttcgtcatcgatccactgttctttcctgactgcgtcctgctcctgggcatccaggtggtctttgtgacgttccagcaaagcatacggtgtgatcatggcttcccctcctgaagaaggatgccgacaaaacggtcaaacaccacctgcatcacgggcaaaggtggctggggtggcaatcccggggatgtgggcgatgaaaagctggcaccattgacaatgttttcaggcgcaaactcgatatcgcggatggcattaaaggggcgagcaaaagcagcatcgcccctgatgtctggttgcatcatgggaaatggtcctttgaatagtcagttaacctgttccggttctgataagcccggcagtatgatgaggggcagggatgacgtgtttactcaggtgtcagtaagaccgggcacgacgtcatcagaccctgcgtttactcttcttcttcacgacgggcctcgcgggtggctgcaaggatttgtgccgggtctcctgctatgcgcgtatgaataacaaacgtaccagtgtgggtcacccgggcatccggtgcggccatgagagccgccctgacaacacgttcatggataaatgcccgaagaacgcaggatttgatatggagcgtgccctctgttgaggtcgcgatgtactgaattttcatcttttaatctcctttaagtgaaaataaccgtttaacttcagggttggtgacccgcctgatctggctgttatcccggacctggtttctcccggatgccgcccgctctgatcggagcgaagcttcgggtctccgcatttgcgagccagcgtttatggacagcagggcgatgctgtgactcttgagcgtccatgaccgattttctctgttttgccccgtgccggtcattacggctgaaacatcgggactaaatctgattgtcgtaatccgcatgactgagtaattcccagttctgtccattgtctttcgataacagtctccactgcggcgtaacccttaacgtaagatactgaccccgataggttcgcctcgcccggatttgcccggtacgccataagcgcataatgcgctcagcacgcctcattatcctgacgggggtatgtggcttggacatcaccgttacctcatttcagcggcacaggcagcggcaagcttctgcacatacgtccaggcgatgccttcactgaaacagacaaaacggcggcttcggtttaaagaactggcggtgaagatgaacctgccgttccggatatgaataatcatgctttgtctccgttgagatataaaaaaaccgccctggcggacggtttactctgacgtattcaggcaggcagttacggctgtttgttgtcttccgaggcagaagaagcgcagctgcatgctggtcgtaaatcagggtgcgtggcgaaaatggttgtgagagttgactgaagcaattcatccagtgatcccatcacacccttacggtatgcgtctgcttcgtccatactgacttttccgtctttctcactggcatcaaccatccttaccgatgccaccagcttgttcgccacttccagcagtgtttcagtgactttttctgcagtttcacgatgttgcataatgacctccaggtcaggtaatgcctttgcgggcggggtttccgaatgacatctcagcgttcatggatgccatcttcatcaataatgatgaggcgcgtatttttgatgaaatcgctcatgttcacgcctacatcgtgccagtgagccagtgccatcaggacgtcacgacgggactgacagtgacaggcatttacatacgcctgtacatgagcaagggcgaggcggcgcatttcttttggattcaggacgcatgaaggtttttctttatgcatggtgttctccggttccggacgtaaaaaaaccgccataatggcggtcatgtggacaggtaagagagcgatcacgacgggccgttcctgtctgtctctgaaacgtcgctacagcaacatccaggcagtaagtcagggtgctcagtcatgatgggatccaggatttcggtgaagagcacgtcgagaacaacctggactttatgcatatgtgtcgcagcctgctcttccgtgactttgccttcctgctggtactcaaacatctgatcagcagaaacactcagttcacgggacagcaacaatacagtctggctgatacgcacggcagcttcgcgatataacatcgttactccttaagtggatttgccattcaggcattacggaaagggtgattgagccagagaggctttgatgcccggccggacgtaacatatccggggcaaaaaaaatcccgcacgaggcgggaaagtcattcaggcacttggtcagacagatcacactcataattatacaatcaggatgccactactttcggtacttcaggctgtcaggcattcgctgacagtgaagttatagaggtattccgtttcataattctgaatgaattgaaaacccttcgcactgacacctcgtttaaactgcgaaaagggtttcagagaagctgtcaatgtcgtgatgagtcagagtaagcagggtgatttatttttgtagggcttacttttcccgaaacagagacgccgggcgtcgcgtatcaggattaactcatggcgtgatgctgcgctatgatgcttttttatatgaactccaggtgctctgggatcaaagttgattccacagaccgggcacagaacgctgtgctttttcatactaacctccatcaacaaaggaaatgacactgggcaaagccaactcatttgttgagaggaaggtgggttttgccacttcgggatctcgcgcttctgcactcctcccgcccgacagtatgctgtgccgttcagctaataactcaataatgaactataagtactattttggtcaacaccaaaagtacagaaaattagtacttttccggggttttgattcatctcattgtttttgttaattttaagtgtgcggtatcacactgaggctttgggcgggatcgggggaaacaaagctcattcggcactctatcaccacaccaataaacttgcaggaatcatcaatttccacaggtttataattagtattcaatggcttgagatactttctgttgataccctcatcaacaatgtactgtttaaaagtcacttcttttgcagaagcaagtttagcaacgactaattggccattttctggaatgcgacctgtgtctataagaatcatgctgtttctcggggacacatgggcccgcggggctcgtcattgagtcgtctttaactactagccagaatgccggggcatctcccagtacagcgccggaatagaaataactgaatctgtccaaacctttctcaaaaaactgcgtgacattaataacctcatcccagcccattaacggaaagctaccgcgaaacagggcatgagctaacctttcttcaccagcattagcctcatctccatgttgcagccacagtgggtctacgttcagagctttagcgatgtttttcatcatcgcagcccggggaagtgactcaccagtcagccatttactgacagccttcgatgttacccccatacgctgagcaagcattaccccccgaccatgtggcgggtatttggcgttgttgagcgcttcagtaagccgcgctgcaaactgctgacggatcgtttctgtttgaaccatgggtacaatgttaactgacttgataaaactgtcagttcaaattaaagtgaactgaaagtactattgagggggttttcatgtcattcattaaccttgcaattaagtctgtgggagttgctgaagttgcgaaagcgtgtggaatcagtccaagagcggtctacaagtggctcaacaagggttcacttcctaaaacagagttttatgggggaactcaatatgcaatgactattgagaagttatctcaggggcagttctgctcagataagttactggaagaaagccggatatctttgctgaaacgttagtttaaggtgacgtttggtcactgcgtcacagccgactaaggaagttacattgtggaaactgcaaaaacacgcaagcaaggatcatcagtttcagggacgacatctccattcactggctctaagggccctttttaacacgcgtcaatcggtggttgcccgccgtctcaacgtcgctgattcaaccatcttgagacgcactgaaaaatacccggaaatcatggaaacgctggctgccagcggtattgaggatttcgtgatgaagggggagatgaaaataccccaggaacaatatcgctggctgatgaaggtcgctatcaggtttgctgagtatgaactggaacgaacctgtaatgaggaaggcgatgagcatcagcacagacaatcctgtccatgagctggtggtttcaggactgcgcttaattcagtgtgaggggggaagggaagcgacaagagttgcaacgagagtcagatcttaacctctgcacacatagcgagaatgcaatgaaacttcttaaaattttttattttggagggacatattaaatgagtcgcgcagcaacagactgggcctggagtcttaatctcaaggcttcccaaaaactacttctcctttcactggctgaccgggctgacgaataccactgctgttatcccagcatcatgaggctcgtcaatgatacagggctcgacagaaagactatcgggaaatggattaatcagatgattgaggaggggctgctctccgataccggtgagcggaaagggcccacaaaacgggtgcgtgttctgaagctcaaccttgatttcaaatgcacccaaagaggggaggattcatcaaaagataatggtcccaaaaacgggaacgttcccaaaatcgggcctgtatcagttaagccctcaaatgatcccaaaaacgggcttttgaacgatcccaaatttgggattttgaatgatcccaaaaacgggacacagaatcagtcattagaacccaacatagaatctataaatataacacccgccgccagggcgacatgtgagggggaatggatgccttcacgctatgcctttgagggcaaagtcgtgaagcttaaccacgcagatttcgcatcgtggcaaaaactctacacacatctggacctcgtctacgagctgcaaaaactcgacatcgaattctcataccagaaacccagacactggtttatcacagccagccagaagctcagctaccagaacaaacaggcagccttgcggggccagaaagcgcctgctggtaaagggatgccacactggaacgatctcagcgagtgggagaataatttcttatgacgaagccagaatccggatttaacgagcagctgcaaaatggtcactttggcccgagtggggctgaccagcagcaggaaggccgtttagttgactcaaacgcagagcgcctggtggacactctcttcgccagtctgaaggttatctttcccgcatccttcagcacggtgttaaagcatccacgcgatgaagcaacagcaaaacgtcagtgggtcgctgcgtttatcgaaaacggcattacctcggggcatcagatttcagcagggatgaagcttgcgcgtgccagcgtttcaccgtttctggccaacccccgggcagttcattagctggtgccggaagggcgactatgccgctgctgatttgccggatgaacatgcactgtatgacatggtcattcgctacagcgcgcgacgtggtctgtataactcaccagaaacgtacccatggcaggccaatacccattactggttggtcacaaccctctacagccagatgacatcacataatctgtctgagggtgagttacgtaaggcatgcgaaaaagagcttgaaaagatgtcccgtcgtattcgcgaaggggaatcgatacccccaccgcgcgcgcaacttgaaaaaatttatgtacctgtgagtcctgagagggcgagagcgcatatcagccgacttaaaatgcttctgaagagaaactcaaagcatggcctgagaccagtcctgccatcagaatcagagcactcgtgtttccgacgctgatgtagctcctgtctgcgaatttaaggagcaatgtgcctctattcaggtcatggtaactgatatcgccgataaaccacctggcagggataccggctggcatctgtcgctatatgtcgctctcgcgcataaccttttcaaaacggaatgcatcattgtcttcttcaagcaaaacttcatcttcgggatggttaatatcgggatgttttttattgaagaattcaacgattttgaacccgcacttgtttacgtaaaaatggatattacgcttttcaaaatagggcgtatgtgtttgccaggatactgtctcgggatattcttcctcaatcaaatgccaggctttaaggcctatgcctcgtccctcctctccagccatcaagaaaaagaggtcgagcgaattgtgatgggttttattatcaatattcagcacagcacctccaacctttcgatcattacaaagaatgtgaagtgatacggcattggtagcattcattgtcatgtctagcgttttatcggatgggattggctcatctgaacgctcttcaaatttatcgactatcgctacggagaaagctttctgtaactctgatttgaaatcagcaacatcagctatttttacaggtataagggttatgcgttcttccatttttatccttaagaatgtattagctaatcgggtatgacaaatgcgggttatgatcatctcgagagcatttcgttctggctgtagacgaaaaaaacccggcaaggtggtttttagaaggttcatcaaccgacaaatttctgaactgtggcgactgttttcatagagcacagaaaccgaacttgatctgacagcctggccgtaggtagcctcatcattaaacacttctttgtactgtgagtcttttatcagtggcgttttaccgattaattttccgctgaataacgtcatgattactcggctgttgcgccgtcagtacgtcaatctgtttagtggccgataaaattcggccacgctatgagagcttttagaaccactaaatttctgcttttgacacgaggcgggcaccacgtaattcgttttccgccagcaacgtatagcagaccaacttttctcattatcaactagccgtcattatcagaaaacatttgcggcagagctcattcgccttctgccaggatgactgactttagtctaaggaagccagaaagagaatcgggtgccgttaagatcgtttttttcgcaggacacctttccaccatgcgccagtacaatcgctttgacaaccgccagacctaagcctgtcccgccactcaggcgtgaacgagagtcatcggtgcgcacaaacgcatcccatatcgtttctggcaaaagcctgatcgattcccggcccttcatcgtctatgtgcactgcgacgcctgctgcatcctgctcacaggaaatcatgacaacgcccgggatggaataacggcgggcattctccagaaaggccagcaacacctgcctgaagcgtaaggcatcgcattcaatgatagccggattaactttcagcacgagtgagtggtgactggctttgaaatcctccttaaccagttcagctaacgattcaatctcacttttaatatttacgcgctcatagtgaatatgcagatgtcccgactgcgccagactcagggttctgagatcctcaattaaccgcgtaagaccatcagtctgatgaatcagattaacgaagagcttatgatcgggcgcaaatatgccgtccgctaagccctgaagtctcccacgcaatatcgtcaccggggttcttaattcatgagcgatagcggcgttccaggtccggctatcatttgacagggtttccagtgtttccgccatgcggttgaagtctttgaccagcgcattaatctcgccaatttctatagcaccttcgctggctcgcgcgcttaaatccccttcagccacgcgttttgcactgtgagtcagcgactccagcggaacgatcatctggcgcgcaaagcgggcagaaaaaaacaccgagacggctatcgttaacagcgtcgacaccagcatggtaatccagtcgccggtcgtccccatgtctaagtcgagtggcaacagttgacctgaaaataatccgataacggttgggtaaagtgaataggtggcaaaggaggtcaaaaaagagtagatcgtaactttgactataagccagttcagctgcccgctaagaccacgttgcttcatttactctctcccaggcgataaccgaagcctctcacattctgcagcaatcctgacgcacccgcgtcatcgagtttcttgcgcaatttactgatatggctgtcaacggttcgcggtaacgtgtcaccttccgggaagcacgcttccagcagttcatcccggctgaaaaccctgttgggttcgcgcacgaaactgggtgattagcctgaactcggttgtggtcaggcgtggggcaatatccgtcccgtcaggtttaacaacaacgctgtgctgctgcaggttgatagaaagcgatcgggtagagaaactatcgtctgaacgcgtcacaacctgggtgcgtcttaataccgcctgtacccgtgccaccacctcagcaggattaaacggcttaacgacatagtcatcggctccaatacggagcgcggaaagtttatccacatcgtcgtcgttagccgtgagcataatgaccggggtatttccccgtcgacgcacttcggccagaacctgccagccatccatcaccggcatacggacatccagtatgatcagatcaggtgaggatgttgcacaaaacgctaatgctaacgcaccgttttccgcatggcttaccatgaaaccgacattttgcagataggcggttaatattgcggctatttctacatcatcttcgacgattaaaatcatgctgctattcattcttatcctgtaatcgatctgagtcggcccggaggcggcggctcagatcttattctgaaagaccgccgccgggcgcgttataaacgctattgatttatagccgttgccatcatgatatcaggcctgtgaaacaataaatcagacgagatacccgctggctgcatgtttccagtattacctttcattcgctctcagcttatttcgcagagtcatgacagtgacaaaaaatagcggaacaaaaataacggccagaatcgtagcgctgatgattccgccaaaaacgccggtgccgatggcatgctgggtttcactggctggcccggaagcaataatcaaaggaacgacgcccagtccgaaagccagtgaggtcatgatgatcgggcgcagacgcattctggcagccgttattgccgcttcccgcaggctctttccctcctgatgtaactgtctggcaaactcaacgatcagaacggcgttcttggctgacaggccaataacggtaatcaatccgactttaaagaaaacatcatcagccaatccgcgcagcagcacggctgttacagcaccggcgatacccagcgggatcaccattaatacagaaatcgggatggcccagctttcatagagcgcggctaacaccaggaaaattaccagtattgaaagtgccatcagcatcggagcctgcgcggcagattgctgctcctgcaacgattgaccggtccattcaaccgcgaaccccggcggcagctgtctggccagcatttccatctccttcatagcatcaccacttgacacacccggcgcagcactgccggagagcctcatcgcgggatatccctgatagcggacctgctggagaggtgctgatgaccacaccggtgtaacgaaggtcttcagcgcgaccatccggttttcactgcttcggacatataaattgaggatgtcatcaatttgcatacgatcttttgcatccgcctggataatcacctgctgcatacggccgttgttggggtagtcgttgacatagagtgaacccatcgcggcagagagggtgtcactgatgctggcgaacgagacgcccatggtattggctttttcacgatcaatatccagtcggacagtacttcccggcggcagaccgtccgggtaaacctgcgtgactttatggcttttagcggcaagttgcagaagtttactctgggcggcttccagcgctgggtagccctgattcgcacgatcttcgagtctcagtgtaaagcctgaagaggtacccagctcctcaatcgccgggggcatcatcgtcatgatggtgccttccggcgagtcgcgcatcgcgtgcccgacaaattcaacttcacctcgtgtcgtgttatcgccgcgttctttgccctctttcaggacggtgaaagccagtgcggtgttcgccccggcaccggagaaaccaaagccaatgatggattgattggttgcgatggcagaaacgcgaactcactgcctcttcatattttttaaccaccgccatggtgcgctgctgcgttgcctccgccggtagctgaaaagccgtcatgaagtagccctgatcttcttctggcagaaaagcagaagagagctgactgaatgccagaccggttcctgcgcacagcgcgacaaataacagcatcattcggccagagcgtttcaggataatagcggtccagcgtaaataacggtttgtcagtcgattaaagctgcggttgaacatgccgaaaaatccgcgccgggcgtgatcggaaggcgttttaagcagcgtcgcgcagagtgcgggcgtcagtgtcagcgccagcaaagcggaaaacagaatcgcggtcgccattgagagggcaaactgccggtagatgatgccgactgaaccactggcgaatcccatggggatgaagaccgccgttagcaccagcgtaatgccggtaatggctccggttatctcgtgcatagcttttgacgttgcctcgcgggggccgaggttttcctcacgcatgatgcgctcaacgttttcaacgacgacaatcgcatcatcaacgatgatgccgatggcgagcaccattccaaacatcgtgagaacattgacggagaagccagcgagcagcattacggatagcgtgcccaataaggcaatcggcgcgacgatggcaggtatgaaggtatagcggatgttctgtaagaacagatacatcaccatgaacaccagcaccatagcttcgagaagcgtgtggatcaccttcccgattgagagctttacgaagggtgcggtattgaaagggagtgcgtaccggatgtcctccggcatcgacagactcagttcctgcattcgggtcgacaccgcctctgcagtctttaccgcattggcaccgggcgccagcataatcgccgcaccggttgagttctgaccattttcacgcatcatcatgctgtaactctgggagccggcctcgacttttgccacatcagagagtttgacgctggacccatcctgattagcgcgcagcacaatgcggccgaactgttccggcgtggttaactgaccctccaccgttaaggggatggtgaccatctgcccgggcagcgcgggttcgtcaccgacccgtcccggggcgatttgtgcattctgctgggtgattgcggcagaaatgtcattcattgtcagattgagtgaaagcaggctggccggatcgacccatacacgcagggcactttccgcgccgaacagctgaacacgtcctacgcccggcagcctgcgcagctcttcaaccacgtttctggccatgtagtcacttaacgcttcactgtctgttttaccggctttagaggtcagactgataatcatcaggaagccagtgtctgcagattcaacctgaagtccgttctgccgcaccgtctgaggcaggcgggactccaccgtcttaatgcggttctgtacatcaacctgagccagttcggcatttgtgcccggtttaaatgtgaccgtgatggttgcctgtcccgaggtatctgtggatgactcaaaatagagcagatttttaacgctggagagttcgcgctcaatcaggctgacgaccgtgtcgttcatcgtctgcggcgaagcgcctgcccaggtcgcggtaatggtgacattcggcggtgctacagagggataacgggccaccggcagtttggggatcgcaatgctcccgaaacagaatgataaacaaggcgacgacccaggcgaaaaccgggcgcttgatgaaaaactgagccatattactctccggccttcatggtcagatttgcagggaaggcagttgaaatcactgccgcgactttcattccattgctcagcttatccatgccctggacgacaacacggctgccggcaggtaagccttcggcaatgcggtatgcaccgtgggttaactccccaacatggacgttgatctggcgggcctgttgctgctcgtcaaccacccagagcacagcgttaccttcccgatgcgagacagcctgctggggaaccagtagcgcgtcttcataatgctgacgggggatctcaaccctcacaaacatgccgggcaggagttcgcgatccggattactcacctggatgcgcaccataacgtcgcccgtagcggtatcaacgctgatgccggaaaaaagaatcctgcccgtctgttgataaacagcgccaccgggtaacaaaacctttaccggcaagcctgcgtcggcatcctgatgacttgatgcttgctggcgcaactggtggtaaacctccgcttgctggtggacgtccacataaatggggtctgtctggtaaatgcgagccagcggggtgctatcgctggctgtcacataagccccttcggaaaccagagcctgatcaatgcgtccggatatgggtgcctcaactgtggcaaaactcaggtcaagctctttgcgcctgagcgtagcgctggcctgcgcgacatctgccgccgcctggcgggcattcgctatggcctcatcgaaactttgacggctcactgcgcccgttttcatcaggggccgcaggcgagcagcctgctgctgagctttatcattggcggcccgggcacgcagtaaaccggcctgcgcacttgccacttccgcttcaaagggagccgcattgatctggaaaagtggcgttccttttttaatttctgcgccctgttcaaacaaacggcgctgaataataccgctcacctgcggccttatttctgctgtgtgcagagcattaacgcgacccggaagcgtctcgttaactgataaaaactgtggctggatcacctcaatggcaacctgaggagcaggggcatcagctgccgtaatggttttatcatcgcagccagtcagcgcggcaatcaaggcaaccagaaataaaggcagcgaaaacagtttgagggacaatgtgggtttctcgtatcaaagagtgatgccccatgttatcgaacacgtgtttattcgccgttgagggtgtgttgagattgtgtgtagaagcgaatttttttactgattaaaggtaattgtattgccggccagaagttcgggtggcaatgcaaaacccttaatatattcagctcagaacagagtacgacctgagggcataatatcgcaccactgttttttgtaatgccagcctgggttgtaggcgcctagggaaaaaataaattttttatctgatgacgtggctaacgctctggcgtgctggatgttctcccagagtaaaacagagccaacccccatcgatttgaactggggatcaatcccgccattaaagtcctcgaagtaataccatgatgggcactcaactttataattgagatcaaaagcacagggtgagtcattaatgaataaaactttgccaaaaatcatgtctctgaacgtggtgaacgtctcagtcaggatcccggggtcagtgcacttaaggctgttttgccaccgcaaatcgaacaggtgctgatagatagccgaaagttcagcaggagaaaaagacgtaacatcttcgactgttccccccgcttttctgaatcgtcggacctctccggtacgcttcttagcggttttcacggaaaaatcagacttgatatgagccattttcttcttaaacaggttgtgagagatgctgttaaagattatgccctgagaatggggcgataaccgcttggttttaaagggaagaatgactttttcacccgctttaatcgggaggataagatcatcaaaaacaaagggaagcgttgaatttttatatgccagagagccattgacagaaaacacgccagcaatgggttgcccgtgtcgccttttcatatagtactgaatacggacgccttcacgttcagaaaggtaagcgagaaacgcggggatgggtgcacacgctccccccaaatgtagtgtaaatttgggcatacgcagaaagcgtgcattcttcccagccggtatttttaagttttaagtgtgttgtaaacatgcctattacctgaagtgaagcacaagagtccctggatgatttgtgcggaaatatttaatgacaggcaagggtgtaattgatgaatactaaacaaggggtaaacaaaagtagggatttctactataaaccttctttgtttagcttctacacatgatctacacacagtctgaactgactctccataaataagcccaggaaacacttcattcaccaaagtaataataagttcacgaaaaaaaatttaaataaagcttgattctaaatggcaaaaattgttcaaatcagatcgtgaattcagcaaggggatacgtatatttaagaatcactacctgcacatggaatataaacaaaatctaaatgaacaagtttaatgaaatatctacattgttgttgagcctggcgatagtttttatctttatactggtatggtttataacatgataagtaattaaatcgtcagtatgggatttaacgtcaatccttaatttatctttaactcaccataaataatgaaatcaaaataattcatttattttttggtttttttgtgttcggaaggcgttctgttaatgctttcctttaatcaaccagattcaatggcactatcatgaaaaatatccttattaccggttcaacaggttttttaggcggggctgtcgtagcaaatttattgcagaacagggttaaggatcgactgctgctgctggtcagaggcgaaaccgttgaggaagggttaaacaggcttaaagcaaacctgaaaaactttggcttaaatgagtcagcaatcaacacgatagcccctgagaatattattctgggtgacctcgcgttaactgagaaatttattaatgactcacggcttagcgacgttacccacgttattaactgtgctgctgtcgcctcttttggtaacaatcccactatctggaaagtgaacgttgagggcacattccagttcgcagaacggatgagccgcgttgaagggttacagaaatttatccacgtgggtaccgcaatgtcatgtgcacctgaaccgggttcactggtcacagagggcggactggactccagccgggatcagcatattgtcgaatacacctggagcaaggcctcgattgaaaaactgatgatcgaaaagctgccgggtctgccactggtcatagcccggccgtcgatagtagtaggtcactccgatcaggggtgtctgccatcagccagtattttctgggtattccggatggcgctggcattaggcaaatttacctgcgacctggacgatcgtattgacgtggttccggttgattactgcgcggaagcgctggttatgctgctcgacgcagaaaaagtcatcaatgaagtgattcacatttctgccggaacacagagcagtgtaacgttcgcagaaattgatgaggcgatggccaaagcatcagggagaacggctctgggtgttgattatcaaaaggtttcctataaacagctttctgacagcagaagaacatttaaggatctgtttggcccgtgcaacgaacggatcatgctgcgtgcaatgaacctgtacggccatttctcaagtctgaatgtggtgtttgataattctaaactgctacagcttggtatgaataagccttccaggttcaccgattatctggatcgctgcgtgctgacgacgcgtgactcaacaattgccgaacttatgcaggtcgattttaaatagtcaggtatcggaaaaaagaaataaatactgaagcataagtgggggcagggatcgatttatgtcgccctgttcatgatgagcaggacgtccctggaatatcaccgtttgcgaacaactttagcgtgtacagggctaacctccagccagactgccacacaggcctccgcagcgccgatgaaaaaatcctgattcagcctctcatccaataccagctctataaactggcaaacggcaggagcagaaagggctcggatattaatttcaacgatccgatactggtgatcaggtagaaaaagagaattcaagccagcgagctgcagatgaattgtacattactaatgttcggtgagctgaaagcgcgggagttttatctcgagtttgtgccattcagcgttgaatttgaacaccggttcgaacccaatttacctttgtatcctggcatagatcgagatggtttgcagttgcacttatctcaacatcacggtgacgccccccctggagcaacaatatttatccctatgaagaatattgagttgttcagaaacgagctacattgaaaacaatatggttatggtcgcccggaaatagtaagccaggactgggcgaatgtcctggaagtttacgatccgtttggcaaccggctcagcttctgtcaaagctgatttacgctgttcattgcgagagggattgccataggctatttccaatatttcataaaccagaaactagtaatgtccgtttatgacatacaaggggacttgtaacagtcagatgtctgctaagagcgagaagcggacgcccggtgtccgctaatgtgaactcgccaggttacttaaaccgtctccctgcctcatcagtcaccttttctccatcctctttggtgaaagaacctttctgaccttcagggagaatatccagcacaatttctgagggacggcaaagtcgtgtccctaacggtgacactactaccggcctgttaatcaggatcgggtgctgaagcataaaatcgatcaactgcgcatcagaaaatttatcttcatccagacccaatcgctcataaggctcaacattcttacgcagcaatgcacgtacagaaatccccatttctgaaatcagcctggtaagctcttctcgtgtcggtggcgtatcgagataataaataattgttggttcgttgccgctgttacggatcatctccagcgtgttacgtgaggtgccacaggccgggttatgatagatggtaatattgctcatatcagtatctcattacaaagtgacagagagccgccataccagcgcggccagagtaacgaacagcacgggcagggtcataattatgcctgtccggaagtaatatccccaggtaatgctcatgtttttctgtgccagtacatgcagccacagcagggttgccagactcccgattggggtaattttgggacctaaatcgcagccaatcacattggcgtaaatcattgcttctctgacgacgccagtcgcagtactcccgtcaatggacagcgcaccaatcagcaccgtcggcatattgttcatcaccgacgacatgaaggcagtcaggaagccggtgccgaacgtggcagcccataaaccgttgtctgccagcatattgagtacggcagaaagatactcagtgagtccggcattacgcaggccatagacgaccagatacatacccagcgagaaaatcacgatctgccagggcgcaccacgaagcactttcccggtattaatggcctggcccctctttgccaccacgaacagcaccgctgcgccaactgctgctatagcgctgacagggatccccagcggctcaagaacaaagaaaccgaccaggaggaacagcagaacaatccagccagccctgaacgtcgcaggatccttaatcgcactgccaggaatcttcagcagtgagacgtcatatctgacagggatatcgcggcggaagaagagatgcagcatgaccagcgtggcagcaatggctgccagattcacaggaaccatcacggaggcgtactgcgtaaagcccaggctaaagaaatccgccgagacaatatttaccaggttagagacaatcagcggcaggctggcggtatcagcgatgaatcctgcagccatgacaaatgccagtgtcgttccctggctgaaccccagagcgagcagcatcgcaatcacaatcggtgtcagtatcagtgctgcaccgtcgttagcaaacagcgcagcaacagcagcgccaagcagtactatccacgtaaacaacaggcgaccgcgcccgttaccccagcgggaaacatgcagtgcggcccattcaaagaaaccagactcatcgagcagcaggctgatgacgattaccgcaatgaacgccgctgttgcattccagacgatattccagacgacagggatatcttcaaagtggatgactcccgttcccagcgccagcacggctccgatacttgcgctccagccaatgctgaggcctctgggctgccagatgaccaggacaagcgtgagtataaagatacttcctgccagaaacatgctcagactcctttatatatgcttatgtgtatgtgattaagcttgtcagcaggaagtacatgcggatttttccagtcgttcacgcacatcatcgcgcaggcagtgccatgccgtcgttatcgtctcgccggcccatgcgggcatgtggggtgagagacggtagtgaatccatttcccttcccgacggtccagtaccagttcagcctcacgcaggatagccatgtgacgggaaattttaggctgtgattcagtggtagccgcacatatatcgaatacgcacagttcgcccgattcccggagaagcatgacaattgcgagccgggtttcatccgacaggatcttaaaaagctgaacaggctgtagcatttattactccattccctttagaacacacatatgttaaatcatatgtgtttattttgaaatcaccagagccacccgaaggagaaaaaatggagcactttcctgccctgaacgctgattgcttcgatcagcatattgctgaacgtctgcagctccatgagccgccacgcattctgattctgtatggctcggtaagagagcgttcttacagtcgttttacagcagaggaagcaggtcgcctgctggaggcgatgggagcggaggtcagactgtttaacccttcaggtttacccctgccggacgacgccccggatacgcacccaaaagtcaccgagttgcgcgggttggtcaggtggtgtgacgggatggtgtggagttccccggagcggcatggggcaatgagtgccgtgatgaaggcacaaatcgactggattcccttaagcgaagggtccgttcgcccatcccagggaaaaactctggcggtcatgcaggtatgcggcggtttgcaatctttcaatgccgtgaaccagatgcgaattctgggacgctggatgcggatgtttacgatccccaaccagtcttcagtggccaaagcatggcaggaatttgatgagaaacgggagaatgaaaccctcgtcctggtatgatcgtatcgtcgatgtcgccgaagagttgtttaaaatcacccttatactcaagggacagaccggttaccttgccgatcgctacagtgaacgaaaagagagccatgaggagctttcatcccgcgttaatcaagacaaaatatgacgttcctgttttcatgaattcatgctgtgtgaactcaacaacgtccgctcctggcatagagtggtctgacatcggataatacccgctatgagcgaaaagcggacgttgtccgctttggtacagagttgaatttacttactgcactttgggcctgtcagataagtcctgtatttaactgtttatgtcctcggggctggctacctgaacccgggttgcgaccaggctggcagcgagaatgaagaccaggcaaatcagtgcctgtattctgagagtgacgtgttgatcaatcagcacacccatgatgaccggggaagcgccgctggcaagcacagtacctgcctcaacggccgatcgcacttttgccagctgcgcggagccaaacagctgcacccacagcgcggtcgccagcatggacgcaatggctgacgatacgccggtcacgatgagataaaacggcgtgacccattgactgctgctaagccacagcgccagcatgccggctccctgcggcagcagaaaccacggtagcagccggcgtggcgtcagccggtctatcagcggaacaaatgacagcagggaaaccgcctgcgttatcgcataggcaataaaccaccctgcaacccacgacagcgcccatcctttctcctctgccaggcgcgcctgatggaaaaagaagcccgtagtgatgaaaggtgacgccagctctgcgggcagagcaagaagcagattccggttcttccatactgatgcttcgcgaaccttctctgcgtcccgctttctgaacgtccgcagcggtttttcggcagcgcacggaaggcagatgacaaccagcgcaacgccggcaaccagaactgcagcgtttatcagccaggcaatgcgccatcccgtcggataattaatctgcacagcagccaacggaaacagcaccagcgccagcgccaggctcagcgcgatggtacccagcgccttgccggcatcaagcggacactggcgcgcagtcgccgtcagggcggtatgcaccagcagcccctgcccgccgaggcgaagcaggtaaaagcctgcacaaagcattcatgccgcctgcgcaccggaaaccagcaggcacgccgctatcagcagcagggtatcggccagggtgaagcgacgggtggtggtgtaatcaatcatcctgcctgcccaggtcagcgtgacggcactcatcacggtgccggcggcataaatgccgcccagcccgccgtcggtgagcccgaaggcctgacgcaggtcctgcccgtaaagcgatacgaaataagtctgtccgaaactcgacattgccatcagtatcgcgccaaaagccagatggctgccgtgctgatacataaagtgaaacagctgacgcagggtattccctgagcgcggctgacaaaggtgccgcacaaatgaactgctccgggactgatgttccgcaggcgcgttatggaaagggcccgcgattgcaggcccgtaaagtttatcgcagcatcagcagcggatgacggctttctgccagcatcgccgtggcgtgactgccggtaaagaaccggcgcagccgggagtgtccccaggttcccatcacgatctggtccgttccgttctcctccgcgtaacggcacagcccgcgcgagacggattcatcctgaatcagccgggactctgcatcaatgccggctgcctgcaggatttgctgcgcgtcatgcagtgaagcatcgtcgccgttcaccatcacaacatggcaagccaggccgcgaagcagcgggctcacggtcagccgggtcaggtttcggcggctggcctcgctgccgtcccaggcaaaaagtacctgggatggcgcaataaaggtttccggcacaaccagcacgggcgctttctgcaggcggatgacgctttccagctggctgcccaccgtatgttccgcgccccgtcgtccgagaaccatcagcctgacgtcatccagtccggcaagtatttcatccagcgcgccgtgcatctgcagctgacgcacttccggaacccccgcacgggacagccgctccgcgcaaccgctcagaatggctttaccctctgccatgagcaggcggctgcgctcaccctccacgcgcacaagctcttcggtcagcagctctttgctgtcgatgccaatgctgccgctcaggtcagagacggccggatgaccatctttttccagcacgtgcagcagggacagtggcgccgggaggccggcggcggcccacgccgcgtagtcacagaccggcccggttgacggcgaaccgtccacgcaggccacaacggtattgttcatagctgaatctcctgtcggttagtgaccgcccatcagtttttccgcttcttccggcttgtcatgcacgccgaagcggtcaacgagggtacgggtggcgtcgttcatgcccagtatttccaactcagcgccttcccggcggaacttaatcaccgccttatcaagcgcgctcacggaggtaatgtcccagaagtgagcgtgtgtgacgtcaatgaccacgcactctgccgcttccctgaagtcaaagtggctcataaagcgatcggcggaggcaaaaaagacctggccggtcacggtataggtccgggtatcgccctccagtgacgatttgaccgtcataaagcgagctaccttggtggcaaaattcagcgaggcaatcagcaccccggtcagcacgccgaaggccagattgtcggttgccaccaccacgaccacggttgccagcatgaccacgctggttgacagcggatggcggcgcaggtcggtgatggatcgccaggagaaggtgccgatggaaaccatgatcatgaccgcgaccagcgccgccatcgggatctgcgacacctgatcgcgaaggaagataatcaggcagagcagcaccagtccggccgtcagggtagagaggcgcccgcgcccgcctgacttcacgttaatcaccgactgaccgatcatggcgcagcccgccatgccgccgataaacgccgtgcagacgttggcgatgccctgcgccttgcactcgcggtttttatcgctcggggtatcggtcatgtcgtccacgatagtggcagtcatcatggattccagcagtcccaccacggcaaggccggcagaataaggcaggataatcagcagcgtatccaggttcagcggaatgtccggaatgaggaataccggcaggctgtcaggcagtttgcccatgtcgcccacggtgcgaacgtccaggtgcaaccacatggaaatggcggtcagcaccacgatgcagatcagcggggagggaatggttttattgaggtacggaaagaggtagatgattgccaggccagcggcggtgagcgcataaacgtgccaggtcacgtttgtcagctccggcagctgcgccatgaatatcagaatagccagcgcgttgacgaagcctgtcacaacagagcgcgacacgtagcgcatcaggctgccaagcttcaggtagccggcagccagctgcagcaggccggttaacactgatgccgccagcagatactgcaggccgtggtctttcaccagggttatcatcagcagcgccatggcgccggtggccgatgaaatcatggcgggacgtccgccaaagatggccataacaacgggtatacagaacgccgaatagaggccgacctgcgggtcaactccggcaatgatggaaaacgcgatcgcttcaggaatgagcgcgagcgcgacgacaataccggcgagcacgtcaccacggacgttacccagccagtccttacgcgtcgaggacagcagcatagtaatttctcagattttgatacagtcagcccgtgagggcaaaaatttcaggtgcgaaaagcacatccgcagacgggatgctattgagtgcgcgactgagacaactcagtgcgacagagaagggttacgactcagggtggcgtaagacgcatgatttttagagttctcctttacggcaaacgatgccttcaggactgaattaagccagttcatcagggggatgaaagctgaccgggaagcctgatcttgtcagaacaggcgctaaactataaacgaaagaagaaagagatcaaagtttcactgtgcatatcatcgtcaggtaagtaatcagaaaggcattcctgcgaacgtccgcttctggcacaaagcggacacggcttcaacattctgcagatttcctctgcctccctggcaagccaaatcagtgcgatagcttaaccagtacagccgctaggctctgccgaaactgtcggaagctagtttacgcaggagttcaccatgaagataataattcacaataccgtcatttattgtgccccctaaagactgataaaaacggtttgctccggcgtttgatttctcggcattccagctgaggctacgacactcatgttcaagagcgagtttcgccataaaacgcattatggattcccctatgcctttacctctctcactctgggagacataaagctctttgatatgcagctggccactgtaccggggagaagggtagagaatactgcaacacgccagcccaacgatatgagcgtcgtagcgagccctgagcaccagagtaccggagagctgactgaacagtcgattgcggaggtaattcttcaacagtggttcctgaatgatgcccttaccataatagtgttcttccatttcggtaaaaattttcaccatggattcccattcatctggcggacacagttctacccttacttccatgtttactccttttagctaacaaaacgctacagctgaggtaggatttagtatcattgcagccattaacaattcagcccgattcttggattaaatctgccgacacaccagaagcgtcgtttcaatcgtgtcttatagcgtacaacttggtcaatcctgcgcttttcagatgttaacactcacaattaaggaattcagatatgtacgctatgagcgaaaagcggaccatgcgactttcgcttataagttgaataaaagcttaagagaaataaaaaatatgtatttcatataaaagcctttaactcctcaacatttatgttcgccagcattgatgctttcaagtttggagatgatgcgagatacttggatatcaagttgaaacctgccgtataacccagccaccttggtaaatctcctgttccgaaaaaccaggcattatggtcgtaatcagcgcgatgccagttttcaagcatgagtggatagtagggcttaacaatatcggacttgaggctttcccaaggctcaaattcaccacccaaaagctcaagagaaaaatgccctgctagtccttcagagactagtgcttctcccagcgttgagccgtatcccggtcctgcccaccttgcagcatggtgaagttcatgagcaaacatacgctcaatagagtgcgcaacgtttttgcagaatgcagggttttcaggatcgacggttatatagataacaccagcttcaggacaaaaaccagcatgccctttttcagggataacaaacttcccggccttaactacgacatctactgaaggagtcggcatcaaccttgtgacttgtacgtaggtatcggtcagtttagttcgcagccattcactgtgaacagtgagtttttcctgagcattcagaatatggatggttatttgagacatgtcagtcttacccagaaacattagtaatgtgcggatactaacagacatatatggcatgttatgttgctgctcagcaagtggccgaccaatgatcactaatgtccgcttctggcacaaagtggactgacggcaggccagggtccgctatgagcgaaaagcggacgttcagtgttacgcagcatttcaactgagagttggttcgtagatgcagaaaatagaatattaattatgccagtgaggagaggctgacaaatttcttgagctgaaaaatgaagtgttatacggttggatttaaattaaatttcaaggacatctgaggtcgccatgctggatattaccaattttggactctttgccttttcagtttttttgctttctgtaactcccggacctgatatggcttatgtgattgggcaaagcgttgctaacggccgtcgcgctggtattgtctcagcatctggagtggcgttaggaagttgcacacatgcgattgcaagcactttagggctgactgcccttatcaccgcctctcctgttatgttcaccgcgattaaatacattggagcgagctatctgatgtttcttggtggaaaaatgttgttaggaacattcataagcaaaaaggaccgcggagatgctgccccccaaaacaccaggaaggtaagtgcctacaggctactgtccagggggtttatcactacattaactaatcccaaagtgctccttttctttatttcatttttccctcagtttgttacaccggaaggcgaacaacatgcggcatcctttctgctactgggactaacatatgcgtttatagcttttttgaccgatatgacatttgccatattagctggcagcacggcaggagctgttgcaggtaatcgaaagctacaaaatttactggatagaattgtaggtgctacattcattgcattgggcgtaaggctagtcttaacccgccggtaaaaatattttcatcgttttaaacataacatccctggccgcacccccgcaggggccttcagaacgtttatgagaccagaggggcgttactggtacttttaccccggctcaaaacctgaaaatgcccttaatgattccggcgagcctgcatggctatgccgtaagatctgttctccatcggttagtgcatgcttatgttggaaacgtccgcttctggcacaaagcggacgttactggctcaattacagtattttcatgcatccttggtcaacggtcagtaatgtaccagaccgccatctaccgcatactggctgccggtaacataggatgcatcatcggacaggagaaatagtgcaactgccgcggcctcttctgctgtttcctgcgcgacccaaaggaacctggcttaccacaaaatcttcaaactgctgacgcgactcctctggcataaagtgcctgaagttggtttcaatcggacctggcaccaaagtgttggcgcggataccgcgttcagccagcgctgatgcccagcttttgaccatagcgataacggcgcctttcgttgctgcataaaggcttgtcatcgccgcaccttcatatacagatgaggatgaagtaaccagaacggatgcgcctgaattaagtgatttggagagggctgccagctgtagcatcgggccgcgcacattagcgttcatcattcgattaaaagaatctgccgttacagattcgggagagcttacctctgcgaagccagcattaagccataatccatcaagggtaccccagccactaatctcttcctgcagcgcatttatgtcagtttcgcctgcagcatcgcttttcataacaagcgatgtcgcaggaagcatgctgcgcgcacgttccagcctttcttcatttagccccgtaatagctacatgaccaccttccgtgacaatacgctgagcgcctgccagccccattccactcgtaccaccagtgatcaatatacgtttaccctgaaacctgcccatgcttactccctttatttgggtttggaaatcagcatttaccttaattaaaaaaaacactattcgtcatctgtttcattacgcaacgatgacattgcttcttgaatgtccgcttctggcacaaagcggactaacggccggctgatgtccgctatgtgcgaatagcacactttttataaagactttttcataaagatacggcttgttccttcgggtttgcagtcaatacgtccgaattcttcccaaccatgctttttgtagaagtcaggggcctgaaagctaattgtgtataaaaatgctgcggtacagccccttcttcttccttcctcctcgaagtgtaaaaggatttctgtaccaatccctttactccgcaattccggtggaagatagaacagatctataaaaagtagacccaacgaagaacgcccctgcatccctccgagtacctcaccgtttgtctttgattttattaatacagataatggcagacgatcactcattcccgtcattaaatcattgaaatcgttaagaccttcttcaatcggaatcaattgcttagcgttaggattttcgcagacctctaaattgaacccttcaaaaatgccattcatttgaaatgtccttaaaaattaaagtggtgtttaaatatacagctccttgatacaggcacaagagtcttgtcatttatggtttgcgttcaagccgcatggtcaacttccgcttctggcacatagcggacgcaagaaaatatcgatgtccgctatgagcgagaggcggacatcactgacgtttgctcaaaggcctaacttatcaattatagatttatacgataacctggcggcccggtttcgaatgcgtccaccctggttttccccagttctgtgcgtttctcaatctaatgccgctagcgtgaagcgatgtcagccatatacttttgagtggcgtgagtctctccattacacgaagcgtgatattccttgatacaagttcagcatccaggtttgaaattaccttcaagccagttgggataacgtttgtccgggatacccacataccgacctctcccgttggctcaaagtgatctacaggcaattcatatctataaacttttccattttgaaagcgtgatagccatgcatgctcgatgcaggcaatggcagtagcatgtgagttgtttcccatccattgttcaaggtccactctgtttgtatcaggtagtggccaaaatacgatgcgcgggcactcccgagggaaaagataaagtaattcgtgagcttcatcagtagcccatatcagtgacccatttaaccactcttgtccagcaggcctgtcgacatgaacctttattgggcgaggtttgaatgtgctgatatcaggactatcgctgaaatgaaaaagacgcacttaaggctccattcaaaatgtatccaatattccgaataaatcattttgagtatctaaagtgtcatccatatgaatgttacttagcttaatttccttgaagtaggccgcagcggatcatatgcgaatgtggatatgtgagatgtccgctactggcacgcagcagacctgcgctcctgaaggtccgctatgagcgaaaagcggacgctggcgttctttgtaaaaatccggtttgtgttgggttgcattagtttagggacgaaaaatattgtgtcggcgatttacccagcgctttcctgaacattgtaataaacgcgctgaccgaatcatatcccagcgttccggctacgtgctgcacggattggccttctgccagatggctcagcgcaaccattaaatgcagttgctgacgccagcgaccaaagctcattcctgtcgcatcttttatcagcctggccagagatcgttcgctggtagccagatgcgcagcccactgctttagcgttcttcggtcatcaggatcattaaaaagtgcctcagccatattccggattttaggatggtcggatacaggcaggtggagcgctttaaccggcacatccggtatatgttccagcagcaccgctgccagcctcgcggttttactgtcaggcgaataagcatgttcctgctctgccagaaaaagaaccagctcgcggaccagaggagtaatagcaagggtacagcaggtttccggcatcgctgccgcgccgggctcaataaataaaaagcaggtgtctgcattcttcgtgacccgacaactgtgggggatttttcccggaacccagacagcatgtcccggtggaacaagccacagcgcatcctgaaccttacagctcactgcaccgcgcaaagagagaataagttgtcccttacggtgagcgtgcggactctgacctgcatactcgcctgacgatgatacatgcagcgcgatagcagcctgactgaaagcatcggcattaaactcatccggtgaggtcaccggttttttattaactggcatgatttagttatatgttgtcaggttatctatattgtgtaactcatgcgtcctttaaagtctttctttttaccagagaacgcaaaatttatgtcccacactacgaacaggtggtcttcaatcatacttgtgaccggcatcctttttattgccattaacctgcgagttccatttaccgctatcgcacccgttttagagtccgttcgccatgattttgggctaagtatcactgccgttgggttgcttaactcactgcctttactggcatttgccgcattttctcccctgagtgcatcaatttcccggaagtacggtctggagcgcaccctttttggtgccctggccgtgatttcggggggtatcctgcttcgctccacaggcagtgtctgggcgctttatggcggaaccatattgataggtatcgggattgctctgggcaatgtcctgctgcctggccttataaagcgtgacttttctggcaacgtggcttccgtaacaggggcatattccatcaccatgggcgccgctggcgccattggctctgccattgtcattcctctgacgcagagctggggctggaacatcgcgttagccatgctggttatagcaccgctgcttgcgttgcttttatggttgccccagttaaagaagaagcatcagctgccagtagcgggtgagaaaaaagcggcgaccgtcgcggtgtggcgctcgcctctggcatggcaggtcaccttgtttatgggcctgaatgcgatgccgttttatgttgctgtcggctggctgccagccattcttacggacagtggactctcctcagctcaggctggtgaggtacatggcatccttcagcttaccaccgccattcccggcctgattctggcagccacgctgcgtcgtcttaacgatcagaaattagctgctgctggcgtcagcctgttaaccggggtgtcatttatcggcatcctgtatttgccgaatctggcgatgctttgggctgcgcttctcggctttggctcaggtgccagcatgatgctgggtctgaccttcatcgggctgcgtactaaaaacgccggtgatgctgccgcgttgtcaggcatggcgcagagtgtcggttatctgatggcggcgatgggtccgctgttgctgggcaaagtacaggagttttccggaggctggacggtgccattactgataaccgcagcaatcgcagtcgcaggtgcctgcaccggaatggctgccggacgaaacgctcacctggaacctgtacagcagccggggtgaattagctgacacagcaggggaaacgatcggttcctctgctgaggatgctattaattgtcgttctgaagcgtttacctgttaccggagccgtccttaccgggaagaccgtttctcacctgctccttcgttgaaaagtccggcaacccagtcagcaaaagcacgcacggcaggagagagaaaacgctgatgcggatagagcatcgtcaccggcatggagggtggctgccagtccgccagaaacttcgatcagtttgccttgttgcagattctccgaaatcacattctcagcaagctgtgccagcccaaaaccttcaagacacagtctgatgtagagtcccgtttcgttaacggctgcatccccctcaacctgaacagagaagggctcagtgcctcgtgtgaaacgcagttcattagtgcgccttaccgaaccggaaaagtaatgaatcgcccgatgctgcgacaacgcttccggcgtctcagggacaccatactccctgagatagtccggagaggcgcaggttacccagcgaaaccggccaagcggacgggcaaccagtgtggagtcagttaattccccggttcggatgacgcaatccactccttcctgaacaagatcgacctgccggtcgctgacaccaatcatcaggtaaatatccggataatgccggtaaaagtctttcagattgggcatgacgatgaaatgggcaattccaccaggcatatcaacccgcagccgcccctgagggcgtctgatggattcagtcaggctggattcactatgttcaattagcgacaggatctcccggcattgcgccagatactgcaggccttcaggagtaaggctgacccgccttgtcgtgcggttcagcagacgcacctgcaggtatttctccaggtttttaatcgtgctggtgacggtggaagaaggcagcgacagggtttctgccgcgcgtacaaaactcccggcttcagcaacccgcgtgaaaacctgcatagcctgaatccgatccatcgtcctgctcctgggtaaaagtgagtctgattattcgttaattatgaattatgaaaacgctttaagcatctttttcagggtaattacgtgacgtatcgtttccccattaatcaggaaagaggcaggtttaatgaccgactacatcagaaatattgttaacaatcagaatgtcactttacaggctacgttgattcgtggcgcgacgatactgagcatggacgagaacgtcggtaacattgagcgtggcgatattctcatcaacggctcaacgattaccgccgttggccagaaccttgatgtaccgggtgcgcatgtcattgatgccactaacatgatcgccatgccgggaatggtcgattctcatcgtcacgcatgggaaggacagctccgccgcattaacccaaacgctacctgcctggacgactacagcaatgccacacacttctcgttcgctaaatattaccgtcctgccgatatctatgttggcaacctgctgacggcgcttggcgctattgacgcgggcatcaccacgatgatcgataactcgcacaacagccgaaccgcagcgcattccgatgccgccgtcgaggccctgcttgataccggcattcgtgccattcatgcttccggcgcaccggtagctggcgaatgggataaagcgcactggccgggaaactggcagcgtctgcaggacaagtatttcaacgacaaccctgaaagcctggtctctctcgccgtcatggcgcagctggagccggagttgtgggccgaggcccgcagactgggattgtcgattgtcactgagttctttggtgcggagatgggagctgaacttaaatcactgcatcagcaggggctgctgggtccggacaatatttttaatcactgtacggcgctgcctgacgagggatggaaaattctgcgcgaagccggtgtccgggtgaacgtctgcccgcgctcagattcgcactatggcatcgaaagcggaatgttcgccattgaggccgcgcagcgtcatggcatcaatcctggcctgagcgtagacaatgaaacgtcgtacagcaccgacatgtttatggagatgcgcgtcgccttttacctgcagcgcgtgatgggcaagcatcagcagcagtgctgcgattctgaacatgcgctgaaaacgcttccggcggcgcagctccttaaagccgcgactcttgatggcgcggcctgtgcagggatgcaggacaaagtgggcagcctgacgccaggcaaacaggctgacctggtgctgattaataccagtgatatcaatctttacccgtccggcaatgcctttggtacggtggttcatgccgccgagcgcagcaatatcgacaccgtcatgatcggcggacgcatcgttaagcagaacggtaaggtgctgggcgtggacagcacgcgactgcgggcggcgattgatgagtcacgtgagcacctgtttgccgcctctggctaccagcccgacaattttgctgacaccttcctgccgctggagcaggcagactgaaaggaatgagaagcatgatctattacgtaatcgcttttgccgcaggtctggggatcactctgcagacgaccctgaacagccagctggcaaagggactgggcggcgacccggtcactgcggcgctgttttcctttacggcgggcgcgttaagtctgggggtttacgcgctgctgaggggaggattgatgacatcgctggcggcgatcccgtcgcaacccctctggagtctgacgggtggaatgataggcgcatgtgccctgttcagctatgtcgtgcttgcgccgaaaatcgggttttcagctctgctcgggctggcgattgtcggacagttactttcctcgcagatgattgaccactatgggttgctgggtgctatgcggcgaccggtttcgttactcaggctgggggggatggttgtcatgctgatcggacttgccgtcatgcttttcggcgatcggatctctgcacgttttctgcagtaactgcgttatccacttttgccatcgtgcagttcgaccttttatatccggaggattaacatgttttcaattgcagctgaagtcaggaatacgcttggagagtgcccgctttggtgtgaaagaaaccgcagactctactggactgacattgaagccagtgaactgctcgccatagaagaaggcaatgatgcagtgatgcgctggtcgctgcctgaacgccttggctcctttgcactgactgaacaaagtcacattctgctgatgggattcgcgtcagggctggctttctatgatctcaacagcagtttaattaccccagtggccgcttcaccgggagacatcgggacccgcataggtgatggacgatgtgaccgtgccggtaattttgtcttcgggacgatggatgacggttatcccgttaaagtcatcggtaagtttcatcgactcaacgcggcaacgctgactgttgagacgcttgcactgcccgatgtcgctataccgaacagcatctgtttcagccccgatggtggtacgctctattactgtgactcgatgcagggtcggataatgtgctgtgattaccccttgctgcagaaccagcgcgtgttcgccgaaatcgaaggcagcggcgcgcctgacggctcctgcgtggatgacatgggctatctatggaatgctgaatggggaggaaaccgtgttgtccgttaccgcccggttgggaccacagacgctattctgacgtcacctggaatccagagcacctgtccgacactcggcggtgagggttttacccgtctctattgcaccacggctacagtgggactcactgcgctgtctgaatatgacggtgcattgctgaaagctgaatctgatgtcagccccggcttacctgaaaatcgctttgcggcacacacagtttaacggttttgattctgacagaattttgccagttcaggctcaaagaaaatgtccgcttctggcacaaagcggacataagcatcaacaatctgatgtttccttaaactcatagggtctggaaaggttgaggtcggcgggcaatcctggctggcctgaattcatgttacaaggctctcagacatagtaatcacaaagaaacacgtttctcaaaatacagatcaaaacgctacctataagccactatttccacttaaaccggaatgtttttttgcaaggtttgttccagtaattcagcagctttattctcataggatgggtgcgcttgaacgggatgttatgagctggaatgacaggcattctcttaacgatctgcatcatagctgtgacctttccatgatccgtcaggctgacgactagcccggactcaaaacacttttcaaccgactggctgaagtggcttccaggtacaacgcgtaagcgccttcctgtcactttaagcgatccagatatggctttatggtaaatgcagggtgctgtttaaacggcaaaaagcagtgagccgctgagcgcgaaatctgcgcttaaggaaacagcccggaaggtgggggttggcattgacatcttataattcgaactaatttctttctaagattgaacgacaacagccttaactaacttaccgcgccgaatccatacttacagttcatcaccttgcacctctctaagtcccatcacattataaatatttggtgtgcgacttttaacaaaaccccatgttttttcacaactaaaataaagtttggttaacaaatattcaacaacctgaggcggcatctcaggttacgcgcataaatgttaaggagacactttattcattaaatgaatataaattcaattgaaagaaataagcatgctttacatagatttacatgaagctggtagagggtttcacgcgcttactggagtcattaagaaatatttatgattttttaataattcactgtgataattatgttgttttgtaaagttttgctcttaatatctcatccgggaatgtgaggaggctcacacagcaggataatcaatatctaaggagaagattgtgatggacatgctggcctaccttaagaggctgaaaattaatgaaaaaattgaaaaggatggttttaatctctcaacgctgcacaacgctcacttttttactgtgccgttcgaaaactttgccatgcacaacggctcagatgtcagcctacgtccagaagatgtcgccaataaaataatacttaacagtagaggagggatttgcttcgaattctctgtcttactacagcaagtttttagtcactttgccgttgattttcaaagccgaatggccagagtcctcatccctcatttgtcgcctgcaacgcatcagctttttctggtgaacaaagataatgagcgatggatttttgacgtcggatttggagccaaaggcccccgggggcttttattgcttaagaacggattcactcatgaagatgattttttatcatcccgagtcagatgcgatcatgagcttgggtggattgtttctgttaaagaaaagagcaggattgatgcggtttgggaagacatctattcatttcaggatgtagaaatttatccgccggatatcaaaatggcgcatttctatactcttttttcacctgaaagccttcttaaaaattatagagttgcgagccttccaaccgacaacggccggataagtatcagaaacaatacattcactgaggtcggcggtcttacctctacttcatatgaaatagctgacaaagaagagcttttattgcttctgtcctcaaggtttggaattaacatttccgctgacaacgtaacttatacgagaaactgatgactactacctatctcattgtccccggatatacaaattcaggtccggatcactggcagtcattcattgagaagaaatacagtaatgtactacgcgttcttcaggatgactggaactcgccatcatctttatgggttaaaagactaaatcaggtcattgccgtgaccaggggtgacatagttttactaggtcatagctgcggggctgttacagtggcccaatgggcagctgctcattcttgccagcgtgttaaatccctgattcttgttgccccggcggatgttgacgccgaaacggcgattgagccgatcaggcagcaacgctcattgcccacatcccgcttaggatacagcagcttgctcattcacagtgataatgatgagcatctcagccttactcgcgcgcgcatccttgcggaacaatggggatgcgaaacccgagagtttagcggggcgggtcatattcatactgcagcaggatatggtgaatggcctgagggcgaatctcttttcgagagctttacaggtattaatttaattaaagctgaaggacgagattgaatatgtttagggaagtaagaaaattcggatcagctgcacaaagttttttagtggcgactttcctgatgggtctgagtaacggtatgttcgatgctgtttataatttttatcttgaagaacgtggcatcgataaaacaaatactggacacatttatgcaatagctatggcgatgatggcagcagcggtaatcccattaatcttagccagtcgacgggtatcacagaagaagctactgcttgttttttcattcctgtatgcattaccttttattctgcttcctgtgctaacaacagtatgggctagcgcttttacacttggattgattctttccggtatgattgcacagctgtcgctgggcaattcactcatgggatcaaacattgatgccggaaacagaacgacactctttagctgtttcttcgtatcgtatctgggtgctgctatgacaggtttctgtcgcagtcagtgctattacacacttctcacagtttgctgcattacggaactatcaagctatcctggccgcctcgtttatttccgctttgctgatgatttactttcgaataaagtccattctgggaataaatgagccgggaagcgatgagcgccgatttaagagcgctaagaatatggagtggagcaattttattattctctttattgctgcttcacttctgggtgcgtcaataacacttattttccggtttgttaatattgtctttaatcttgcttattcaatgaatattagtgaaatatcattgattatgggaggtgataaagttgtcagtattgttggagcactgtttgctcctatgcttgtaaagcgtttttctctgaaaccggccgtaattatcgcgggcatcatgacggccgcgtgtttgttctttcaaacactacatgttcctgtggcaatctttattacattatattttttaagacttttactgaattactgtctcatgccgctactggatactctggctataacaggcttttcgaaagacagaaactctcctgtcaaccagcatcaggcagctcgccttttatcttggcagtgctctgtcagcaattgcatacggcgacctgcttgatggcgggcactgggaaaatgctttgatcatttccgctgtattagccctatcaggcgctatttttatgagtttgattagagtaaaaaacgaacattaatctggcagtcaaaagttaaaggagtaatttatgtccgctgaatttgcagtgcccgacagtgaaaatgtcgcccttatgttgaaaagattgtctgcactttggaaaaacagagctgcagttaataaatctcagcctgagtattcagatcttgaatttgaccaaactaaaaaagattttagtgagtctttgctgccattcagacagcacgatgcctggaaggaagcgcctgaagatgttaaggacaagtgtctttcttatgcgtggggtatatacaatttaaaaaccatctatattgaatgcgacattgttacgccggcttgtgaagacataataaagtgtccgccggtgaactcacctaacagggcagatcttcaggatgtaatgtcagaagctcttctggatgaagccctgcatacaagaatgtcagtgatggcatgtaattatatctatgaccgccgaaaacttgagccgcttaactatacagattttaatctcataaactggcgacgggaaatgctggccggatgtagtgcagagtggcagcgaagactgacacgttttgctgtggcatgtgccagcgagacgctaataacagactatctcaaagtgatggctgaagatcacagtattcagagaatatgccatgaagttacacgagttcatgctgaggatgaatggagtcattcaagcgtctttagttatgtggcttatgatattgttcgtgatctgggcactagtgaacggaaatatcttcgggacacaatgcttaaaacagcggatctctttgctgataacgagttgggtgcatgggagacagttttcagactgtcggggatgccctatgccagagaaattatttctgaaacagaaagatgtaatgagataaatatttatctcgattcagctgagacagtaatttccagaataggcctatagggtaatccagtaaatgaaacttgtctgcgaagaaacatccctgcttacatcaaggatgagatcattccgtctgatgcctgtgagtgatacagatttattagctgctgataccatgccgggtgagtattttgtttttagcttcgatgatgagggtaataattctctccagcgttgctatacactggtatctgctgagcatggaaagttttatgaatttataattgaagacagaggcgaaggaagtgcatcaaatgtcatcagtcggctattacaagaaagaaaagaagtaaatatcttggggcgagggggcgaaataacctttaattcagtccggagtagaaagaatgtgcttctgatagcaggcggcgttggaataacacttcctatggctttgataagagaatgttttaaatcttatgggtacagtgctcccggggtcgttgtgcaattggtactaagttgtcacgatctggggtctgtgccttgcctgaatgaattaatggatttgcacacacgatgtgactggttttcgatgcgcattcacgtaactcgggtcaaactcgcaaaattcagtgacattgtcagagcaggaaggattgatttagcttttgactatattaaagcggtgcctgaatcggcaatagtatgtggcggtgctgattttgcacagtcaatggttactgctataaatacaaaattcccacaaacttctgttgctgtagaggcgtttagttcaggcagatcatttgattacatcatgaaatcagaaactcataaaacagagattactttgaaaactttgaatagagtcatctctgtagatcctggtttaactgttttggataatctcatcagccacaacgtttcaataagaaatatgtgtcggtcaggtatttgcgggagctgcaagttcaggcttcatagcggagatgtaaaaagtgaaccagacttctgcctttctgccaaagataaagccgaaaaaatatacctcgcttgttgttcgtttccttctgaaaacgctgtgattgacataatctgatttagaaccataggatggaaaaaatggaaaaaaaatgtgttttaattgtagatcccttttcaagcggttctgtttttgcaagcagaattaaatcgctttacggttatgatgttgttgctttaataactaatcctaatcttcctcaggcgatccttgccacatttgttgaggaagattactcaatggttttcaactatcattctcatcttgaaacagttcaacagattgaatctgctcttggaaaacaacctgattttattgtttgtggctcagaacccggcgtactggtttttgatcagttatgtgagcactggcagctattacctaatgtgtttgaactaagccatgcgcggcgtgacaaatatcttatgcagcatcagttgaagaaggatgacattaaatacataccgcattataaatccggaaatcttgatgatatcctgcaatggtgcacaaaaaaccagtttgatgaatatgtgattaagccggtcagttcatttggtacagaaggtgtttttttctgcaaagatgtatcagaagttgaaagtgcctttggtaaattgatcaatacatttgattattcgggtagtaaaaacgccgaactgcttatcgaacagaaaattattggtacagagtatgttgtcgatgctgtcagtagttttggtcagcacttcgtagtgaacattttcagatatgtaaaacaggaaattaatggtgtgccgatctatcgtcagatgatcacagaaaccgctggaggaacatccagttcttatcagttatatcaagtcggtacttacttcactcggcattcgtaatggtacgtcccataatgagattattatgtctgccaccggtcccgtactggtcgaatctggtgcgcgtatgcatggcggacttggaccgcgccttgttgaagactgtaatactcattcactcatcgatctgagtcttatggcccgtatctcaccaagagaatttactgataagacctctgtgagccctttattgaaaagatacgcactggagtttttcctcaattcacctgatgcaggctatcttaaggaggttaatattgaatcgaagtgcagcctgctaaagagctatggatttactgtttgtaaatataaacctggcgattacatcaataaaactgtcgacctggtcacttcttatggaagggttgtgttggttaactctgacagggagcaattggcagcggatgctgagaaaattactgaaatggaatcttccggtgtgctggtaaccatcatttaaattttttaattactctcaaaaatcaaatttttagatgaggccaatggcgattatctttatgcaaagcgctgagcaaattggctatttcattgtatcttcacgtcatgtatgacttatgctgaccgataaggtcatgggatggattgtccgctttgtttcgaaagcggacttttcccgcattctatgacatgtggcaggtacaccgctcatacgactgagataagtgccgctatccttctgtgatggattttgtggttgatgtattaacactggatagcagaataatttaccatcgtatttcttgcgggataaaaatctaacttaatcgcaatgagacatttcacgctgcctttacaaaatttcgcaccccagaaatttgcttaaaacctctaactgcagttactgtttatgtatacagtatttctgaaagggcagtgatcatgccacgcgattatgaaatcaaagacgctttccggctggccattaagcgggacgcgcgcggacgttacaccgtgagcacactcgactttgttcacgaactccagcagctgaactggcagtttaccgccagggaagcgaacaggtggatagaagcgcacaagtcagatttccgggatatctcagcatccgaaggtgaggatcgcatcttccaggtcttcaacccgaatggcgctatgtgatgtttgcgctggtagatgtgaactcgttctatgccagttgcgagacagtattccggcctgacctgcgcggcaaaccagtgttagttctgagcaacaatgacggctgtgtcatcgcccgaagtgctgaagtaaaggcactgaatatccctatgggcgcaccgtatttcaaactcagagacgaaatcagacggcataagattcacgtcttcagcagcaactatgcgctttatgctgacatgagtaaccgggtaatgacgacgctcgagcagatggcacccagcgtagaagtctattcaattgatgaagcgttcctggacctgaccggtgtacgcaactgcatggtgctggaaaacttcgggcgcgaagtgcgtgagacgatcaaacgcaacacgcacctgaccgtgggggttggcatcgcccagaccaaaacgctggctaagctggcaaaccacgccgccaagaagtggaagcagactggcggagtcgtcgacctgtcgaatatcgaccggcagcgaaagctgatggcgcttgtgcctgttgaggatatatggggagtagggcgtcgtatcagtaaaaaactcaatgcaatgggcatcaccacggccaaagacctcgcagaaacagagcacctggatcatccgcaaacatttcaacgtcgtgcttgagcgcaccgtcagagaacttcgcggcgagtcatgtctggcgcttgaggaatttgcccccaccaaacagcagattgtctgctcacgctcgttcggttcacgtatcactgagtacacggatatgcgtcaggcggtgtgcgcgtttgccgagcgtgccgctgagaaactgagaaaagaaaggcagtactgcaggcagatagcggtttttatccggaccagcccgcatgccgacggggaggtgttttacggtaaccaggcaaccggcaagctgctgaccccatctaacgatacccgcgatattattcgcgtcgccatggatgcgctcgacaggatatgggtagacggacaccggtacatgaaagcaggcgtcatgctgggcgatttcttcagccagggtgtggctcagctcagcttgtttgacgaataccggccgcaggcgaacagtgaggctctcatgcgggtagttgacgggcttaatcagagcggtaaagccagtctgttttttgcggggcagggtatccagaaaacctggtcaatgaagcgggatatgctgtcgcctgcctacacaacccgtgtgtctgatttgccatgggccagatagggctcaaatcaggctgtagcagtacaccatccggatggatactctccggcatctgtcctggccagtaattattgtaagcgaagcggatatacctgtacagatttacatattttgtataatttacgcaaaacacgtcattttcgaatcatacagtggagtcagtcatgcaactgaatctgagcagcacaggttccaacagcgatatcgctgactatttcagccgtgcaaatctgctctcgcagcaggaaacgcttggttcagttgttgctgagatcctccgttcaggtcagacactgaatcgcaaagctatctgcttaaggctgattgtacgtcttgataaggcttcatctgatgcagaagaacagcagttgcatgcgctgattgagcttttgttcagcaaatgagtgtgattttactgcccaccttttcggtgtcgtgagacaggagaccagctgcagtcatgacagaaacaggatatgcaattgctgcgtgatgtgctcatcggggaagcgactctcgccatactcaatgacaacacacgtgtctcatggccgggcatactgaacaagctgaacagttttctcaaaacagagagtgatatacacaggattgatgccctgaaactggcaatcaatgatgtcagcgacgaaatcaaaaggcgcgatgcactacagagaagtgccatggtagaattcaccatgaactcaaccgacagttacgatgacctgacctggcattgatcgtcttttcatatccctttttgctgatgacagtacagtgccctgcgtgcggtgtctgcagaggtatcccgacagggggcatgttctctctgatgacttaaagggagatgtgtattgaccttctcagtcctgttgtgatgcgctgctgtagggtaattctgatggcctcaaagacgcaacgggatcatcctgatcggcttccggcggtcgccagacttcatttcatctgctgttcaatgaatttaagacaattggagcaggctatactgtcaatagtgctatcacgcagtcactgaattgcacgcgtaatggtgtcagctgtttcagtattgttccgcgtcggcatcctcggtcatgccagccatttcatctgaagtaatatgcgctttctttttcaatttgtctcaggatggttttagagataccccgtagcatcatgtaatacttcctttctgtgagtggaaaaacagcactcctctcattatcttccctattttttcatgactgaaaggtgattttcacaatgtgaatttaaccgatatgtgagtgtctgtatgaaagtacaaatccgccttctattattcaggctcgtcagaattcattttgggtaggaatgggtgctaacaggagtctgaaagttaatcctaatacttttcctggtgtgactttaacttattttaatcaacaggttaagggggtaattttgtttggcatttctgtcgggcaaacgattgcattgaatgtcctgcaggatatgagtagtaataatacgcgtcattaggagggtagatgttaattcttttgggatgaaatgcttaatacggaaggcaggatatgaaaagcaaagaatgctgtattgtcgtcatcggagacaacaatgttttacattatggactatttagtcttatacacaccgcatgcagaaaaagaaatctgacagtattatcgtgcggaaacggcctgaaattcagcagtcatgcagcgaacagatatccgggtcgctatcatctcgccgttatctgcctggggtacgatgacttctttcctgactggtttagcttatttctcacgctggtgcgtaaaacaaacggtaacgtgctggttttttcagacagtcaggctcttctggacagccggaaaagaaaccttctgaacagggtaagcgatatggaatatgttctggatgtgtccatgcctgtttcctgcatctcattcgttctcaaacgctatctggacaggaaaccttcagacagagaaaactgcagaataacgctgcgtgagcatgccgtcattgatggctttcttaacggcacagatgtcagtcatcattgctcagcactgggtatacaaaccagaaacgctttaccagcaccggaaaaactgtgctaataagctgggcgtcagaaatctcaaagatttactcaggctgtaacagcaggggaagtcgcgtgcccgtcatcaatattcataaaatcgactggttccggatcctcacagacctgagccgttccggttactcccttcaggacatcgcagatgaactggatgtggttgcctccacactaatcgggtggaagaaaggggccagcccccgtcaccattctggcgaagcgctcattgaactgtggtgccgggtgacggagaagggcaggcatcagctgcccagagaaaaatttgtgcagaaattcatttttcattcgtcagaacgtgcctgcaggcattcagaaaaatgaatctgacacgactcatagtgccggtgacattcttaccggcacagagtctttaccatgaaacttgaaagtgttgttaagtatcacagcccgcgctccgtttcgcctttcacccgccagtcctcccgttcacctggtgacatgctcggcagcgatgtgatggctgcactgggtatgacacagaagcgtgcacccctcggttattctgcattctttggcaaaatgcagctcagtcaccatgacagagaccgcgctgtagggttgctcactaagaccggaatgaaggcatcagtgcattatccggccctctctagattgcccgaagatgagcgaatggcggtggttacggtcatcgcgggctatgcctttcttgattatgcgcgcagcccggattccgaatcgccatgtcatgcctgtcacggcacgggcctgcgtaacggaaagtattgcagtaaatgtaacggaaaaggtgtcgtgcgggcagcctgcaaggactgcaaagggcgaggggaagctgttaaccgtgtgatgacgcgatttcagggtgtgccggtttatcagccctgtaagcggtgttccgggcgcggctttgaacgtattccttccgctgttgtgttcagggcggtgtgtcaggtcacgcaggctgttacgctggatacgtggaacaaaagcgtgaagcagctgctggagtttctggtcgccgagctgcaccgggaggaagcctgggcagagaagacgttatcgcgcattactaaatagcgagcgataattcacgtagcgatgttatagctcgctatttacatttccattttttgtgttagattggctccaacgatgggtaaatgaccctcgagagatttctattcagccctggcatttttgtcagggctttttttatgaccggatgccgtcactgtatcctgctcatccaccggctccggctacttttctcctgttctgcgcggcaaatcctgatgagcaaactcacaactggtgtcgcttatggcgtatccgcgggcgaaatcgtccacggcatcctgacctatttcagtccggaagagtggagcgccgtcggcgttctggccggtatcagtcttgcaaccgtaacctgcgtcatcaacgggtattaccggcgcaaggcgacactggcagaaatcagggcgctgcgctgtacctgccagaataagccgcaataaatcatggctatttccgctgcgctgcgtaacagacttctggctgcagccggtgcgggtgccctgactctggcaatgacgctgctgggtggtccggatggtctggaagggcgtcgttatgttccctatcgggatgtcgctggtgtgctcaccgcctgtgatggtcacaccggccccgatattgtcagtaacaaaacctattccgacagggagtgcgacagcctgctacgcgcagacctgaaacccgttcaggcagctgttgacagtctggtcactgtccccctcagcgattaccagcgcgctgcactctacagctttgcctataacaccggtactgacgctttttcccgcacttcccttctgagaaaactcaactcaggcgacacgacgggtgcctgcaatgaactgcggcgctggatctttgccggtggcaggaggtggaaagggctaatgaagcgtcgcgaaactgagcgtgcactttgcctgtcggagagcagcgatgaccttaagccgcgttaagtggggtgccgttaccatcacaggcctgctactgctggtcatcgcgctaagcgtcgccctgaagcttcagtccttatcgaaagtcgtgattactcagcagaacaggcagctggcgcagcaaaaagctgcagcagagatgctcgcgactaatgtcctcagggcaacagccctcttcagcgacattgcccgggcaactcaggatgcaaatcaggcaggcgatgaagagagtgagcgcagggtggtggttattcaaaagctggtcaggggtaacagctgtgccactgaacctgtgcctcgtcctgctgctgaccagctgcgtgcgcaccgggacaaagtacgtaccggttccgccagtaccgataccggtgagtctgctggctgactgcgctgtgcctttgattcctgacccgttgacctggggagacagcctggagctgaatgagcgtctgcttaacgctctggagcagtgcaaccacgacaagaccgccatccggcaaatcgaacgggaacggcagaaatgaatttcctccagtggctgaaaggccagtttatccaccctgaagaagcgagtaatgaaatgtcagaatcaatgaatgacgaacacgttgaacagtcagaattctctgccgaagcagcgcagatgcccccatcagctgaagtcaaagtgggcgttcatgattttgaagctgcgctggcgtttgttgaaagtggggttgctctgctgggtgacgcagcaaaggacgatgtaaaagcgctggcgattaaatatctgtgagcaatgcagtgcacctgtcgtgcaaggcagcgtgatcattacaagaagcttcaggtatgattcgcatctaaatagctcaggatgaggatcatatgaaaagggtagtcaaaattttagtcatcgccatcacagtttctggcagtgctcgcatttgctgtaatgattctgttgatagtatcgatcagaccttcaaaagttgatgctgcccagattgaagcctgccggcattatgataatcagaccattatggctaaggtgatccgggccaagaccggagaccaggctgaatggaaaactttctctgacgctcaggacgccgctgaaaagaacgggattctgattgactatgggcatttgacattcgggaacgatatctggttagtcccttttactcagcgtaacggccagtcagctatcggggaatactttggcatgctggactgcacgacagatagtgttgaatttagcaaaaagggattttcccagactagcgccgactgcagctcaacgctacatgtcagaagcaatctgccaccggcacctccagcatatatgatccagccaccgcgcgacttactgacgccgctcaaagggattatttcaccctcagagatcgaatcgaagtcgccggaaagcagatagccgaattgcagcagtacatcaaagagcagtgcttaaattaaatcacttttatcttgaataaatataaacacatacttttatggcttatcgcccgctagccaagacattatgccgtcaaacattccgtaatcctcaagcttgcttttttctgttccatagagagcaagttttgttctgtttcgtgcggctactgatagacagttccagactgtagaatcatttttatttaattctccaaaagcaatagcgagagcttcatctgtcagcttatcctttgaaattaaaagttgatgatattccttggatattcgtaatgcttcagatgattttcgtccaaactcaccgacaaaagatagtgcagacaaactagcaaccatggcaccaaaaaacatgttgctgccaaaattagcgaatactgcagagccggtgagaaggagagtgaaattgatagccttatctatgcggccagtgagagtggcgtacatcttctctttgtaatgagaaagacaaattgagtactccagtttcccagcgttccatttatgacctcaatactatcgatttgatggcttgggtggcctgacaccgtcagtatgccatttctttctgctatcgtttccatttgagccatcgcgtcgatggtttggcgtaggctcacgcgaagggggaggagaaggcgggcgcttatcagattgcttcttatcattcattttttggcctcagggggtaatcgaatcagctgaaatacgctcaagtaaatatataagagattctgtagcagtgccagttaggagagcattcgttcttttttatgaaacgaaatgctttaagtaaaagttatgcaaatgatctctgctaaaaatttggctttaaaccgatgcacttctgcgcatgttgtggtttgtaaaaaattaccagcctaaagcctgagataaaacagtagctgccgcggctaatgcagctatggagttgtatttggattgcaatcgcgcggtatcgtaaaaattatgtaaatcgacatcgtcttgttccccattgaaagttatcattacctttcctgggttcagctttgatttaacggtcgctgatatcacccaaaataatgcagatacgataccagtcgctatagacggtatgtgatgggctaacagccagtttaaaataaacataattattcccatgcatttaactgattgaggaagttatggcactcaccgacaagcaacaaatgttctgtcgcgagtacctcatcgatttgaacgccacgcaagcggccattcgggcggggtacagtgcaaaaactgcgaatgaacagggtgcccgtctattagcaaatgttagcgttcagataagaatctctgaactgaaagcacagcgcaatgatcgaatcgatgttgatgctgattatgtgctgagacgcttgtttgagattgaccagatggacgtgctcgacatcatgacagatgacatgagcattaagcctgtgtcgcaatggccagcttcatggcgccgatacctgagcggattcgatctggccgagatgtttgaaggccggggcgaagagcgcgagatggtcggcatcctgaaaaagattaagtggccggataaagtcaggaatctggaattgctcggcaaacacatttccgtgcaggcattccgcgaacaggcggcgacatcactgacaggcaaagacggcggcccgcttgaggttgccctgctttcacgcgaggaataccggcaggcacgccgggaaatgctggaggatgacgactgctgacttcaagaccgctgcacgccgtatagagtgtgaagaggacggactctactttacccgctacttctttaagcagcgcaccggcagccgaatgatcgtcgcgcaacatcaccaggtgatacagcggacgctcgaccgggtgattgatggcgacatcaggcgactcatcatcaatgtgcccccgggttacaccaaaacggaactggccaccatcaatatgatgggccgcgggctggcgctgaaccgccgcgcccgcttcatgcacctgtcctattcccacaacctggcattactgaactcatctaccacgcgcagcatcgtgaagtctgctgcctttcaggccatgtggccgatggcgctacgcgatgacgccgacagtaaagccatgtggtggaccgaatacggcggcggggtgtatgcctcgtccgctgcgggtcaggttaccggttttcgtgccgggcatatggagtcgggctggcaggggagtctgattattgatgacccggtcaaacctgacgacgcctatagcgaaaccatacgcgtcggggtgaacacccgcttcaatgaaaccatccgttcccgtctggctattgagaccacacccatcgtggtcatcatgcagcgaattcactaccacgacctgagtggctatctgctgcgcggtgggagtggcgaacagtggcaccacctgaacctgccggtgctgattgataacagcgaacagtattcagtactgtacccggaaaactcgcacgcgatacccattgaacatggtctgcctgacggctggctatggccgtacaagcacaatgaatcacatcgcgtctctctgttttcacaccggcgcaccgcggaagcgcagtacatgcagcggccccgacggtttaatgccgacggtgcactctggactgaagggatggtgtccggtgcgcgtgcgctggatatcaccctgcagccgtcccggacggtcgttgccatcgacccgcaggcgacaaacagcgaagagagtgatgaaaccgggattgtggtagcaaggagttacgggcgcggtaatgacaggctgttctctgctgacgcggattactccggtaagtactctccgaacggctgggcgaagcgcgccatccgggcttatgaagagcaccacgctgaggcaatcgtcattgaaaccaaccagggcggtgacatggctgaagacacgctgcgcaatgcaggctaccgcgggcgcatcgtccgcgtccatgccagcaagggcaagtttgcccgggctgagcccatttcagcgctgtatgagcaggggcgggtggcgcaccgtggcaacctctaccagctcgaaaaccagcttctggaatacgtgcccgctaccgcgaagaaatcaccggaccgcctggatgcgctggtctgggctattacagaactgttccagccgaaaggcacaacagtccgtccattctctgcctgacagaacatcaatatgagcaacgacgtccggaagcgatcgcccaaaatcgagtcgatggccggatgctggcccatgatcagcaagctgctgggcggcacggccgccatgcgtgctgcgggcaaaacgtatctgcctaaatggcccagtgaagaagaggcgttttatcagaaccggctatcggtggcgacgctgtttccggcgttttcgcgtacggtcgaggtgctgagtggcaaacccttttcccgcccggtcacctggaatgaagaagcggtgcctgcacgcatacgtgaaatgttcggggatgtggacctgcagggcactaacctgcactcctttctggctgacacttttgaggaagcgatggcctacggactgtgcggcatccttgtcgagcatccacctgcggataaacagctctctctggctgaagaacgccagcgcggattgcggccttatttcgccagggtgaatgccaccagcctgctggattacgactcagaacgggtcaacggacaggagacattcacgctgctgcgcttcgtcgagacggtcagtgagcgtgacccgcagaatgaatttgtcgtgaaaaacattgagcaggtcagggtgcttaatcccggccgctggcggatttatcgcgaaaagctgaatgaaacgagcggggtgctggagtggcagttgcatgacgaaggcaccaccagcctgaaaaaaatcacctttgtcccggtctacggcgacaaacgcggctttatgaacggccggccgccactggtcgaactggcctggctcaacgtcgaacactggcagtcccgcagcgaccagcagaccattcttcatgtcgcccgcgtaccggtgctgttcggcaaaaaactcggcgacggcccgatttcggtgggtgcggcatcggccatcctgtcagaagaggatgaagcagacctgcgatatgtggagcacagcggcagggccatcgaggccgggcgcacagacatcatcgaccttgaagagaaaatgcgccagataggagccgagctgctggtggtaaaacccggccaccgtaccgtggtgcagacgctgaccgataatgaagcgagcaccagcgccctgcagcgcatggtgtgtgacctcaccgatgcggcccggctggcgctgcagtatctggcggagtggattggtgagtccgaaggcggacacgtcactatcttcagtgactttggtgctaccacgctggctgaagcctcggctgacttcctggttgacatgtataaaacgcgggcactgtccgacgagacgctgtttaacgagatacagcgccgtggccttattaacagcgaactccgctgggcggaagagcaggcccgtatccgcgcaatgccagccccggtatcagataaaccggccacaacaacgccggcttaaccttctccgggcccgtgcagatgcatgggccttcttttattgccgctcgctgcggatgcagcgcggcgtcacgggccggatggctcttacacggttggatgaccctgatgaaactgaaactcgatgagaacggccatgtggtcgtaaacgatggcaaacctgtgtacgtacaggatgacggcaaagagctggcgtttgatgcccccggcacgctgcagaccatctcgcgtcttaacggtgaagcaaagtcgcaccgtgagcgtgcggaaagtgcagaaacgctgcttaagacctttgaagggattgatgatccgtcagcggcgctggcagcactggacaccgtgaagaacctggaagacaaaacgctggtggatgccggtgaagtcgaaaaggtccgcactgaagccgtccgggcgctggaagagaagtatgcccccatcgtaaaagagcgcgacgacctgagccagaagctcacggcggagaaaattggcggcagtttcgcccgttcaaaattcattgccgagaaaatgagtattccggctgacctggtggaagcccggttcggcagcaactttcaggtagtcggtgacgccgtcacggcgtttgatcgcgacggaaacaaaatcttcagtgcggtcagacccggcgaagcggcggagtttgatgaagcgctgagcattctcgttgagcactacccgtataaagaccagatcctcaaaggcaccggcgcatcaggcggcggctctgctggggggaatggcaacagcagccccaacacacttacccgtgaacagttcgaatccctcagccctcaggagcagagcgaaagggcctgtgcgggtgtacagattaccgattaacaggataaccctgcatgtctaataccatgactcaactcattcccgacctgtatcagtcgctggatatcgtctcacgtgagctctgcgggtttattccctccatcacgctggacgccacagcagaacgcgcagcgctcaaccagccgatccgtatccctgtgacaccggcttcagacgctgaagatgtgaagcccggacaactgcccccggatgacggtgaccaggatattggtaatgtgccgctggccattaccaaatcgcgtatggtgccgttccgctgggaaggcgaacagcagaagggcattaaatccggtccgggttaccatggtatccgccgcgaccaggttacccaggcgatgcgcacgctggttaatgaaatcgaagaagatttgggcgagctgttccgtcgcgcttcacgcgcatccggtgaagcgggtaaaacaccatttaaagataccctgactgacacagcacaggtgcgcaaaatcctgacggacaatggcgcaccgctcagcgatttgcagtgtgtcatcgataccactgcaggcgcggcactgcggaccatggcgcagctgaccaaagccaatgaggccggaaccacagcactgcgttctcagggcacacttctggagttacatggttttacattgcgtgaatcagccggcgtcgctcaggtgaaaagtgagtcgggtgaaaagccacttaaggacagaaccttaacagttgctgaggattgcccggaaggaagtctgtctgtaaaaatccagccttcagatggcgacaacagtaaatccagcgtgcccgggttcgttgaggaagggtgcgtcgtcattattgggaagcacaaatatatcgttgccgctaaaagttttaacaccattgacattcatgagcccggactgatggaagatgttaagccaggaaccaaactggaaattgtcagtgagttcactgccaacttcgcattcagccgttcagccatcatcctggctacccgcgccccggcgctgccggaagaaggcgacatggcggatgaccgcatcatgatcaccgacccgcgcactaacatgtcgtttgaagtctccatgtacagacagtatcgccgtgtgcgctatgaaatcgccgcggcctggggctgtcagaacatcaaaccggagcatagcgccctgttactgggttagtccgggtcagccattccagacaaaatcctttcagatgaggtcatatatgctgacacaccagcagcaggccgacgcacgtcgctatatgggctatcccatgaccggtgacacgtcacctgacgatcgcagtgatgcggcttacgcgcaggtcacatcaggccggttccagacgctggctcaccggctgacgtcgctgagggctgaggaggaagccattgtggcgaactatctgacgacactggccggtctggaaagtggcatcacccgggcagcagataaccttgatacggataaagcggctgtctggcagcgcaaccggtcagaagtgtcagaccgcacgcggctctacaatcactggcggcgtcagctctgcggactgctcggtatcccgccgggcccgtcgctgggcaatggcgtattaactgtgacacggtgctgatatggacgcacatcagctggcggcgaaggtgaacctgggtaacgggaaggccgcgaaacgcctgggcagtacggcccgtcattaccgggcagtatcaccgttcagtccgctggatgcgcagccgctgcgggagctgtcggcctcattcaccaccgattacggctacatgcgcgctgcccggttcggacaggccatacgtctgggcatcttcgatgcggcggggtttgagaccggcgatatcctggtatccaccgaggggactttttacgtggcagccatgccactgttacagcccattctgtgcgtcagagctgagcggcttgtcagcgtccggcgtaccgcgcaggcaggttctgatagcggactgcagaattatggcggcaccacagatgcctgcgagacgctcatcatggccagctggcccgccagtattctgctcagccgtggcggtgagcacagcccgcttaagttgccgggtgagacgcgcagtgcctggcacaatattctcatgcctgcattcagaggcctgtctcttcatgccggggattttgtgacggatgaagccgggcagcgttatgtcgtcagcggcacggaactcacagacatgggctggcgcctgacggcgcttcaggtgacggtgtaacatggcaagtaccgatgatgttgcccgttacctggcagagcgtatttcagatgttgtgtatcccggtggcagcgggcttccgggcatcattaatgccgcagtgaaaatctatccgggctggccggtgccgggcacacttcagcaggatatcaacagcggtggcgtacatgtctccatctggccgctgccggctgagcgtaaaatcagcacggcgcttggcaggccgttccgtttgatggcgaagggcaaaccctcgctgcagttcacagtgaacggcaccgcgataagtgttgccggtgtggcgtcggcactgactaacgtgcagataacccttaacaggaaaacgttcagtttccatttccgggcgggaaccacggctggacgggcaatacacgcgctgtctgcagcactgccgaagtcattcactgtgctcagcagtgtctgcatcccgctggcagagcatctcagtatttccgttaccaccgcgggcaaggctgtaaaagagctgcacaggcagataaaggattttcagatcactgtctgggcacctgcgcccggccttcgggaccgcatcggcagcgccattgatacggcgctctctgaacagtgtcacattgacctcaacgacggcgcgcccgcgcagctcctttatacccggcagtctgattccgacaggtcagagaactggcatgtctaccggcgcgacctgattttcagcgtgaattacgccaccacccaggccattaccgcacctgaggtgaccagcacggtcgtcaccgttaacggccagcagaccacaccgtaaaccctttttccagcatcagttcactcatccggagtctcactcatgccgatttattcaaccggcgatctcagcacgtctgcactcacggcacctgacctgtatgttcaggttgttccgccccgggcacgttacattaacggtgtacccactgacgggctggggctggtgggtgtggcaggctgggggccggtaaatagcgcctttcgtatcacgtcagataacgacattgcattctttctgggcacgcctgaaaaccgtaagtatgacctggcgacagcggctgccatttcacttcagctcggtgcggcgaacctgaactgtgtgcgtgtgacaaacggtcaggataaagccgccagtggccggctctgtgaaaatggcagcaagtcaggcctgctgctgaccgcactctacagcgggacgcggggaaaccagataattgcaggtatcggcagcggtaccgcggtgaactcgaaaaagctgaccatcagtctgccgggcgtgagtgccgaagtctttgataacctgcagggtgaaggggatgcgctgtggaaagcgatggcagaggccgtaaatcacggtcagatgaatatccgcggtcccagccagctggtacgcgcgaaagtaaccgaatctgaagcgcccgcacaggccgcggttaaagagatcacactcagcgggggcaccgacggcgcgaccggtatcacggatgccacgctactcggtacagacggcactgatgctccgcgtaagggtatgtatgccctgcgtggcacaaattcacaggtcatcaaccttgccgatgtgaccgataaagcatgctggcctgcgatggcggcgtttgcgcgctccgaaggtgcatatgccatcggccagggcccggcctccgctggctgtaaggcggtgtctgaagcgcttaacagctcaggcgtggacgactggcatttcaagctgatagtgggtgactggccttactggaaagataccgcaaacggcacaagccgcatgattgcgcccgccacgtttgaagcggcaaacattgccgcccgggcaccgcatatctccacgctcaacaagcgcatccccggcatcattgccactgagcggcagctggcgggacgtccttactccgtgccggaaatcggggccatcaactcagcccgccttgatgtcatcaccaatccgtgtccgggcggcagttactttgggatgcgctccgggcgcaatacgtcatcgaatccgacccagaacgatgatacctacacccgcatgaccaacttcctgtcgctgaccattgcggcaagcttcggcagcgtggtgggtgacaatcagaccacagacctgcgccgggaaaccaaaagtacgctggagtctttcctgtcaaatctggagacgctgaagatgattggcgacccgaatggcggacctgcctttgcggtgcgcctcgatgcggccaataacccggatgcgcgcgtggcactgggctacatgaccgccgatgtgcaggtaaagtatctcaatgtggtgcgctacttccttgtgaatctggaagggggcggcagcgtgtccatctccgtctcagacagcttatcgcgctgaacactgactgactcattactccggagataaaccatgccaacccttggctataccatcgggcgtgatattgccgtcgatatcatcacgcccacggggaaactgcgcattcccaaaatcatgagttttgactcaaagccgcaggtctcgacccataaaatcactccgctcaatggcattaccgatgaactgcagatccccgttggctggaatggcaccattacggctgaacgtatggatgccacgctcgatgacttctgggcgaagtgggaagacaactactacaacggcatcgatcagccccgcggcaccattaccgaaaccataaccgaggcaaacggcaccatcagcgtgtaccgctacgagggcgtgtcgtttcacctcaccgatgccggtaacaagcagggcgagaaaacggtgagccagaccctgtcatggacagccagccgccgtaaaaaagtgaactgaggaataaataatggtgcaggtcagagtgcatgagacgtcgcccgccgtggcggaatcgccggtaaagccaaaccaggtcagggatgccagcgggcgcgtcatcaccctgcgtgagctggacccggtgcaggaatcccgtctgaccgtagcggtcggcccggaaatggctatcaatgtgatgtacatgaacatgtatgcctttccggcggcggccgtagctgacattgacggcgaagaatacccggtaccgcagaacccgaagcagattgaaagcatgctcgccatcctgggcaaaaacggactgaaagcggtcagtgcctccctgcgtgacatgtcgaaacgacagggacgatgaggccacggagaccgccgcaaaaaactagcgcagaaccccgggtttataaaccagtgctggctgatgaaagccggggttccgttcagcgtgatttttccaggcctgacagcgctgatgccccatgagcgcattgccatgggtgtggtcatcggcgagctcgagggtggcacctacaactggagcacacgaaggtgggaggagagtaagtagtggaccttgagcagtttgcacgtgaactgtcttctgcctcagcctcaatcgctaccgggctggaggtaagtttccgcgttatcgtcaaagagattgaggaaacggcgaaagaagaaatcggcgtgtaccagcccgcttatggactgtttgacgcctgggcgccactggctgaatcaaccaaagccgaccgcgttcgtcagggtttcagtgaagacgaaccgcttctgcgctcaggcgaactccgggactcaatcgagagtgaagtagtgggactggcggccatcgtcgggaccaaaagtgaaatcgggctctggcaggaggtaggcacccaacacataccaccgagaccgttcatcggaccagcatatgtgaggaagattgacccgttgagggaggcgatgggcatggtgatatcaggcagtttctaagtctactaaatcaggaaagatttgccggtattctaggattggggtgaagtgctataacgctaacatttcctgatgagatcaaatttaataacatgaaattaaagaaaaaatttaatctcattaaggggtgtgcgggctacaatttaaaacccaaagaatgcagctgaacacaatactatgggcccagttaaaggccctataatcatggacgatcaacgatgatgttcgatgcaaattcaattgccgcacgatgatcgctagcaggaacatgcgcaattttatgcttgtctaaattgagctttatagaatcaagcactttaacttgcgccaaggtcggtgagagaggttcctcaatagtaaataacacatcttttacttcgagtaacttttcttctgcagcacgagtaactctcattacccatgtgtcaccatgctccatcatctttccaggttcagattgctcaaaagctaacggcttgatcgctcgtgatatgacgtcacttctcttggcgacaagaggcatagaaaacttagcaagcgtcccgttaattgtctgatttttgaacatgttttttagggcatcaattctgtcgatgctccttttaagttctttagctaaaacctcttctctacgtgctttggtgtaatcactatgatttacataacgatcatagatttttttcatttcttctctagggttgtttgaaagtacaactctggcttggctgaagtgaaagattgattcgcgttttgcagtaaagtagtggaaaaactgagaaagagactgcgcaccgcttatctcaagggcagtgttcttggcaaatcccagctctctaaaaaatgcatctttagctaaagggaaaatgcaatcgtcgtggaaaaaccgccttacgcgagagtcatttcgatttgtgatcatgaaatcgaaaaaattctcctttggagcgcacacgaccacacctacgttcgcaaactcttcagtttccggatagggtgaatatcgaacgatgctgtataagcaaggcgttgtcatgtgatgctactccaaaaatcatctgtctcggctctaatgagcgtagtgtcaataatgttgttgaaatcctgatcactacgccagtcatccggtacatcttcccagaagtgaggcatacggcaataggtttctagaagtttttctttatgctcgacacgatcaaccatgtcaaaggtccacttcctcgatttgtgagagtaaacgtggtactcgaaatctccagcagcgttcgcattttgatcaaaggctagattatggtcaataaggtaatacctatcatgctgaacgtcgtagagcatgttcacattgcctcctattgcagtgaggcttctgtcaccattcatgatccatcggtcaaacaagaagattctcttctgatcgtcaatcgggacaatttgctcgtttcttgactgtgcaaatgttaaagaaacggcattttcaatgtaaagcgtagcaaacgcgtatcccggattaatgtcacatttgagttctggcgagaattctagcagctcatcagggatgtaaacgacggtaaaatcaggtagtggaagaccaagatcttgagctaggcaagcagaaatgaattctgcaagaagatgcttgggcggcattaatggcattgattttacgatgtattttttgccatcatcgcatcgacaaagaatgggctttgtactgccttcatttatgcgcctgataaattctatgacgctaattttgggagaatccaacgttatgctcatccatgcgttgattaattaggcaaagatacacggataggtctgattgccatatcctgacagatgatcagtgcttatcgataaggcgcgttcggccacttcctgtaagcgaagacgtagagcatgatgaaatgtatacccggacaggaaaggagcaacgccatcttccatccgaaacccgctttctgagccatgcgcaagcatgggataaacatcaaaaaccagatgatcgacgacagtactgcaagagggttcagttgttccattaagcgtttctccttgagttgcatgcctttggcatcggcagcagtcctgattatgttcagggaatgaacactgctcattggttgcttagcaaatcaatctgagcaagcaggcgctgtaaagtgtgaatgttttggcgaagcaggtattgcatttcaacatcccagtcagggcatgtagcaagattcggcattgcacagttttatcacaaagtgaattgcagctatttcgtcccggcgacactttccagcgattaaacggagttgagcatcactaagtatcccatgtggcgtttcagcccagccttttttaaagtgccggtaagtggtttctactgacataatcgtctttcacaagattggctcagccgtactattgattttcggcaacctgactgaaaacttaagctgttctttggtatgttcactcttttagtcatattaaaaaagcccactagagtgggctttcagtaaagatgcaatacgattactcagtgtcgcttctcataatggttgccggtacgagcatttttatacttgccatacttatgggcagagccatgtccgccagcgtaatgaccaccgcgtgcaaagctgacagttggtgcaagaagagccagagtgattagagcgacgattgtttttttcatttatgattcttaaaccttgccatacgggaagaccccattggcaatatacgcttaagtttgggaataggaatcctgataaaaaaacaggtcttttcgcaatgattggaatttgtgaatgctcaaatgatgagctggaactaatggtgtaaagtgtctggttctggcagattaaacggaaatacagagccgaaaaatgtgtctgataattaaacgcaaacatctcgttgattaaatttaatgctctgttttaaaaggaattattttggcatggattacggttattggttcactgtagttgctatttttttgtcggggcttgtaatggtcaagcaatcaatcaattactaccgatctggtgtctacaccaagactttcaaaggtacgacccgatgcgagcttattaaaaaggccgaccggcctcacgcatactggttcaatcttagcttgcatatgctcgctggtgttggaggggtttacttcagtctatggtttttgcaattcgatccaacagtgaaggaatggtatgaggctcttatagagtccctgtcgctccgaatcttaatgttattttcttaaaacccgacccgctccggcgggtttttttatgtccgtaaattgaggttcccatggatgttcaggcttaccgtgtagccgtgcgccttgcactggatgaccagattacacgcaatctgctgcaggtgagccgtgatgcgatcgagctgaataagaagttcgttactatctccaggaacatcaaagcactaacccgagcggcccgtgaggccacatccgcgctgcgggctcttaatcgctctttgaataatgaatttactggcgcgtcacgcggcgcgcgtgaatatgccggtgccatccgcgagattgctgaccagacacagcgtatcaaccgggcctcgcgtaatgccccgttgctggcgggtggttacggtgcagccatgacactgcccgtgctggcagcgggggccgccgctgcaggtggcagcggtggatatggcacccctggcgtgagactcgcactgcttccgccttcaggacagggtggctggtggcatggctggcataatggcgtgccgccgggcggctggggtggcggcggtgcagggcatggcggcggtaatggccggccacctggcggaggctccttttcagagggtatgaccaatctggccaccggctatctgggtttcagaatgttgcagggctttgttgatgaggctgcccgctaccagaccatgaccgagaagttcagacagtttcggcatgggtcaggctgcgacagatgaagcactgcgtttcgcagaaaccacacgagtccggggctcctcggccactgacatgatgaaatatctggtggaagcgcagggggtattcagcgaatccggcgcaaaaacgctggatgagcagctgcgtgcggcgaaactggcggcaccggtgctggcgcgtatcaccttcgcctcccgcgggctggatgagcatcagcgtgaggccacaacagcgaagcagatggatatgctgcgcttcaccgagacggcgggtggattgaaaagcccggagcgctttgatgaactgatggacgcagcgttccgcgccattcagtcttcaggcggcaatgtcgattttacccagtaccgtcagtttatggccaaggcgggtacttcggcctttaacctgagcaataaagccctgtttgctgagctggagccgattatcggtgaactgaaggggagttcagcgggtgatgcgttgatgactgcttacaaccggttaaacgggattgtgaagctgcctaatcaggtcacccacgacctgatgacgatgggcatctgggatgccagcaagatagagctaaacagcctgggcggcgtgaagcgtttccggggcaatccacttatcaacgcgcagctcttcagccagtcgcctgtcgaatactatgaaaacgtcatcctgccactctaccgcaggcaccattacaccgaagaacagaagcagcgtgagaacgccctgatattcgggcgtaccggcggcaagatgttcagtctcatcgacaaacagcttgagaccattcatcaccgcattgatgcctacggagtcgcgcgcggcctgaatgatgcctatggtgcggtcggcagcacttacaacggcaaagcgatcgactttcacaagaaatggcaggacctgcagcgggtaatggggaaggacggcggtctgctggacacattcacgcaggggctggaaacactcacgcactctcttcagcagatggcagacattgcgcaccggcatcctgagatggcgaagtttgcggggcaggcggcgctggccgtgaccggccttgcaggcatcagtggcggattctggctcatcagacatgctgcgggcgcactgctgacaccacttaaactggcgggctggggcattgacctgcttattggcagaagcgccactacaggtctgacaggactcaccgccgcgctgaccggtctgccgggcataatctctgccgtaacgcttgccgccctgtatccgggcagcacggtatcgcagagccgggaaatggcagagcgtggcagactggcacgtcagaatgcgcttgaccacggcgttgcctataaaccctggatgcctgcccaggcggacttcgacagacagcatcttcttgagcaggcgtttcgtaaaaccggcaggtatcccccgataccgccagtttctggcgttaataacgggcagcccgtaaatctgctgatgacgcatgaaggacgacaggtactggtggccactgtcatgagtggcatcagtaagcaggcagccagagcaccgtcatccaccagcaccttcgatccatccatgctgatggtgtatcccggtcaggctggcagcctctccctgccctgatgacagcctgattttattcacactcctgctggcaggccctatctgcctcttcttcagctaacaccttcacagttgccggtattcagaattctgaacgccgctttggccatgctgatttcactgttagtgaggtaatgaaaatcgcagtcactgcgttccgctacggcaaccgtgagattatctgtggagcaggattatgcttaatgaattcgttttattgctgatgctcatgggcgcagggccggcatctgccggagtggcgcatcatcaggcaaacactggcattaccgcagaaacagccgcagcgtccatcgcagacagatgctctgatgcgcaataaactgctgaacgatccgctctctcctgtcgtcggtgctgagcaacctgtactgaaaattgtcagtttcgtgaactacgactgtattcattgcaaacgactggacagtaatctggaaaagcttttaaaggcctatcctcagattgcgatcacctacaaactgatttcatacggtccggaagcgtcaaccgctgttacgcgcatggcgctagccgtctggatcgaagaacctgaaaaattccatgcttttcaccatgcgctgatgtcagacagcggtatgggtgacgacctgcgtatttattcagccctgcatgctgccggaatgaaagtcacaacttatccgcttgatacacagaacattatcgaagtgaataaggcgttaatgagacggcttcattactcaggtacgccgacaaccattatcggggacagggtgctgactggcgaggttacttatgacttgctggaagaggccgtcaacatcgcactggccggaataaatgacagtcatcatctggctgacctgcagcagaataaaatccggactgaataacgtctgggtagatgcttttttgcaccatatttgatgtccggacatcttttgcaggcagcctgaacggtcaggctctgaaaattcgcatgcctcccgacagatggcggctcctatttttcattgtcagtcatatctgaaacaggcactcgcagtatgtctcttctgaattctctcacgcagtttgctcagggtatcgatccgactgttacccggcttatgctgggcgacttcgagtttatggaatttgaggtccccgaacaggttgtcattcacggcagacagaaaaccgtccggcatcagctgattggcggccaccgcattattgatgtgctgggcacggagtatgagccactgacttggtctggcatcatcacgggctcgcaggcgggtgagcgtgtcagcgcgcttgaacgcatgcgggatgccgggcacccggttctgttgacgctcgatgactatcgtttcacggtggtcatcaccgcgttcagtccggtctacgaatatgtctggcgccgcccctattccattgaggtcgcggttgtccgcaatgagggctcgccagcgaaagtggatgccctgaccggggcgctgcgggagctgattgacagcgacctgggccgcgcgctgggccttgccagtatcatcaacgttgatgccgttacgcaggcaatcagaaatctgcatcaggcggttaagaaggtaacggactttgcgcatgctactgttgcgcagattcagtccgttgtcagacccctgattgcagcccggaacatcattcagcatgagctggcactgctcgaggctgcggcactggagattacctcgctgggtggactggtacccggcaatcccatatcaaaaaccgtcagtaatctgcttcttcagtcagaccacgcgacccgcattccggccctgtatcatcttcagaatgtgctaggcaggcttaacaaaaatgtaaattcaggtcaggccgccaatggcgtcagagcggtaacgttgtccggtggcaatatgtataaggtggcatcagagcagtatggggacgcctctttatggaccagtattgccgatgccaatgacctggccgatccgcagctgagcggcattcacacgctgaaaatacccaccagctcggcgagttaacgatgaacgtcagcaaccccattaccgaatcgggcacccgccaagtcagcgggcgttgtgttttaaatggcacagacgtgccatttgtatcattcagcgttgagaacaatgcctttcgtggtgcagggacgtttgagcttacactggcgatttcagcactgccgccggacatgcagctgcttaactggtgggcggttcagaccacgatcaggaccgagctgttcatttcgatagtaacccagaccggtgttaacgagaaaagacacatcacaggcagcattgatacctggcattacgaaccggcacgctttgagatttcagcagaagggcgcgatttcaccgcaaagctgattgatgcgaagacaccgggtgaaagctttaaaaatctcaccagttcacagatagtctccacgctggcgcagcgtcacggcctgacaccggttgtgacggcgacgacacagcgcgtcggtgaatactatcagatcgattcgacacacctgacaggcgaacagacggaatgggacctgataaccagcctggcgggcatcgaaaacttttcggtttatgtggaaggtgacagcctgcatttcgaaccccgacgcgaccctgccggtgatgacgattatgttatccgctggcaggcccccggtgagcaggcgtatccccgctgccatgtctccgatgacctgacattttcacgtgcgctgacaattgccaggggagtgtcggttgaggtgctcagctggaatgcaaagtgcaagaataaacagttcagtgcctcttacccaaaccctggtaagcgaacagttcccggaagcgcctcatctgacacgcagatttatcgtgtcatacgtaacggattaacgcctgaagcagcccatgcgctggcacagtccatctaccggcaggtgatacagcacgagatgaacgtcagcggatcaacggcaggtgacaacctgctcatgccttacatgcatgtacgtattgagggtacacgaagcccgttcgaccagatttaccattgtgatcgggtgcgacgtacgctgagctgggaaacaggctacaccatgcagatgtcgggtaagaactacagcacggcgccgggtgttgagcggtgagggcgctgctgaatatcatggcggcgacatcgcgccagagcaatgcgggtaagagtggcacacgtcagggcattatcacggcttatgacccggataactacacagtgaaggtactgctgcagccgacgggtgaggaaaccggctggatccccctcagcacgccctgggcaggaaacggctgggggcttgcggcaggaccgatgattggtgccgtagctgaggttgagtttgattccagcctggccggggttggcatggcggcagggcagttttataacgatgaagaccgctgcccgggccccccttccggtgaattctggctggtgcatcagggcggatcgcttttaaagtttctcaacagcggggacgtcctgctgagtgcgaaggaaaaactcatttatgacgcaccagcacatcactttactggtggcgacgtccggatagatgaaaatctgacggtcggtaaagagatcagcgacagcaatggtcgctatggcacggttcatcatattcgtaccgtttatagcggtcacacacatctcgagaaaggtcagggcaactttacagccccgccagaacagcaaatcaaagccactctgcaacggtaacctatgcacgacctttatcattttaccggaggagatcttgcgccctcctctacgggcgatctgcgcacggctctgggcagcgttcgcacgaagcaacgtattctgcgacgactgctgaccaaccccggtgattatctgtttcatcctgaatacggtgccgggctgggtaaaaaagtcggtgaagctgtacagccgggcgagtggaagtcgctcatcagcggccagatgctgcttgaagaggccgtcgcgcactatccaccgccagttgtgaaactggtcctgattgaagggggtgtcagcgtatccattgtctacaccgatgccctgaccggcacgccagaaactctccacttcgatgtcgcgaggtaagcggatgtcatcgctcaacgtcaaatccttcactgaactcgtcggcgaacaggtcacagcgatacaggctcgggcagcaaagctggtggatttttccatcgggagcattctgcgttcactggctgaatccaatgccggtgtggtcatgtggctccagcagctgattgtaaagctgctggtgacaacccgcgcggcgacatgctccggcgaagacctggacagctggatggcagactttggttttttccgtcgctctgctgtacaggctgccggtaacgtgacgtttctcccgtcttacacccgcgagccaggcccttatcccggtcgggacaaagataaccaccctcgattgcacacagagctacacggttattgccgaccggcccggacagtcgggctatatcatcgcagcgggtgtcatttccctggaggtaccggtgagggcagataccgcaggcgctgcaggtaatgcgcagccgggtaccgtcacccttattacgggttctgtgttatatgtcgataaggtgactaacccagcggcgtttgtgggcggtcaggacgctgaatctgacgacgatttccgcgcgcgattcagaatgtggatcgcttcattatcaaaagccacaagagcggcgattgcgtttgcgctcagcaatgttcagcgcggcgtcagctataccctgaccgagaatgtctcctgggacggcagaccacagccgggctatttttatgccgttattgatgatggcagcggtatgccgccacgcgaattgcttgatcgtgcatacagggctattgacgctgtgcgcggatttaccatcacctttggggttttcaggccggtggtcatctatgcaaaggtcatactttcatttacgacagataatgaagcagatcactctaaggtggccggtctgattgaggcggccgtatcgcaatacattgcagaccttcatcccggacagcttctggcctacacccggatcatcagagcggcctatgcggccagtccactggtcacgaacgtgacataccttaccctcaatgacggtaacgctgaccttgcggcctcgccaaaacaggttattcgcaaaggtcagattacggtgagctgaatggctaaaggtgacaggaacgactttctcaaccggcttcatgcgctgctgccggcaggctggttcagtgatgacacaccgatttttgaaggtgcgctttcagcctgtgccacagcgttatcctggtgctacaccctatatcgctacgcacgtaagcagactcgcatctccacggcgagcgatggctggctggacgttgcagcctatgacttctttggcactggcctgaccagagattcaggtatgtctgatgaccccttccggatccagataaaaacgaatctgcttcgcgagcggggtacgcgtcaggccgttaccagcattattgagatgctgaccgggaacacaccagtcgtgttcgagccgtcacgccctgcagatacaggtgcgtatggcggacctgcaatcggttatggtgctgcgggtggatatggatcacgttatctgccttaccaggcatttgtggacgtcagtcgtccgcgcggtcagggcatcccccgggtggcaggctacggaatttcaacagcgggctatggcagtgcttcgcgcgcgcaatatgtctcccggggaatggttacgggcagtgttacggatgcacagatttatgctgcgatcgaagccgtcaaaccggaaggcacgctggtctgggtgagaattcattaatctctcttccttcgttaacaatcatgcaatggtcaccctgaaggtggccttttttaatgggtaactttatggatcgtcagattgtttatccgggcgctattccgctcgaaaccgacctgcttaataccaataaattcgccatgacagggctggcgaaactggcgtcagcctttctgggtgagagtacctggctatgtggtctggtatgtaagccttccgcaccggcttccatgactgttcaggtcggggaggggcagatttattccctgcagcatattgatggcacgccttactcgtcattggctgccgataacatcaatactattctgaagcagggtctgagtctggcaccctgccttttcaggcttgatgcacccgccatgcaggggcacagcatcaactacctcattcaggtggcttatgccgacacggacacggggcccgctgtgctgccatattacaatgctgctgatccggcgatcgctttcagcggaccagataacagcggcgcaccacaaaacacggtaagatccggtggctgtcatgtctcattaaaagcgggtatggccgcccgaaaaggtgaacagatatccccgacaccggatcccggttatacggcagcatgggtaattaccgtagataacggcgcaatatccattgatgcttcagcgatacatatggctgagcatgcgccttttcttcctgaggatggcatcattgctgctgtgcagcagggacgtcttaacagtggcaaagttaaaagcgagggtgataactttcatctgatctgccagccacccgtcacaaagctcaccgatggcatgcgtctgttctttcgcacacaggcgactaatgcaggggcatgcaaactccgtgtcggtgatttcccggcctgtccagtcttaaacgatgacgccagagaaactcaggaagggtaccctaagcagctgccagcaaaatgaagttgagtggaatgcgactctgaatgcctgggtcctgtgtaataaccagcagcatattgactggggtgatcttgatcgccgctatattcccgtaagcggcggggaagtaaaaggtccgttaaacgttgaaggctcactgagcaccgacatgccattgaagattgggaaagcagaagtcactactaaaggcgatattgctggagaagcatggagcggcggaagtctgcattcatggctggcaggccgttcagcatcatttgttcataagacaaaaggcttccctttcatctggaaagatccggtcagtaagctcgttattcagggaggactgcatgaaacaagcaaaggcgaaattaattacccggcagcttttcccaactactgttccctcgtattaattacgcaatgtggcagacataaaatgagtaaagacaattcatttatatcagatgttaatcaattaaactttaccctgcacgccggcaatggtgaacccgcattctactggctggctatggggtattgattatgcaggtgggtttcagtgcaaaaagtaatgccttttattttctggatgaggaggccgcttacagaggaaacggtatctggcaggaggatattattcctgtttctgatgaagtctggcaacagtttaccggtacccccccagaagggaaacagcgtgggtctggcaaggaaggaatgcccgtctggacggatatccctgaacaggaatacagcactattgaggataatcaggcaataaagaatgcgctgatggaaaaagccgataccgaaatacgcatgctggcggtagtgcaggatgtatacggactaaatgaagaagagaaacagaaactcgacgcctggaaaaaacatttagctgaagtatacaggctgaatgcaagtgtaatgaaaaaaatagactggccagcagcaccaggcaatagttgaaagtggctcgtccggaacgagccactgaattaatacttaaaagcgatatcccgcattgacaaagacactggtcatcttatgtttttttgatgcaaacgcggcctgagatccttcaaagcccacagttagtgccagattttcggttgcatcaaatgtcagccctgtgctgtatgcaaactggttggatgaagtggaaccatttttcatctgagagttgttatgatcatcgaagattaatggattatctactttcgtatgcgaaatcccccctaaggcaaagacgctgagtttctctgagatgcgataggtcgggccgatcagagcagagtaatattctgcctgtctgtctaaccgatgttttgcattataatcctctttgcattgtgcattactccttctgcactcagtatcagcatcctgccagttcttcttcatcaccgatacagatcccatgaaaccccacggtgatgatgtctcatactgaaacctgaagtttccgccctgaatttcaccaaaatctttaatatggccacgctggtaaccaaaagacatggtaggccttacatccgtatcctcagccaacgcattggtacacaaaattgtggtggccagcaaagccatggacgcttttctgaataacatctgaactcctgattaaaagtgggatgcatgattcggcatgcacaaccgtttagaggaggccattttcagtcaggtacaattcagaaaagtgaaaattacccattatatttcaatgcattaaaatgaatattgtggtggcagtgctgttattttaatgtttagtttaaagatgccggacaatagcaatcaatcatgagtgatgaagacagcgtgtcagcttaacgtcggtaatcctgtttaggggcataacatcctgactctttatggagaagccggggccatacagctcagggaggtgtgcgcaatatcgttgtagtgctgcataattgttttaaagtcagctttttgagttcgatgcagataattgggttttaggaacaggcgtgtaaggcagcatgcacaataatgggtgaggctgtctggcaactggttttggcagataaatcggtaatgctgaataccataaccggcatgatcattgagctttcagcgcgttgtgatgaactggcggcatgcattgaactgaaaatattgctgcaggtttaaaaatagacacgacgggcaggcggtgcaatcctgaagctatcaacgtcagctttgtgccagaagcggacgttgcttgcatcatggtatgttagtttacggggagcaggtcataggtttgagcctctgcctgaaagctgctctctttggccctcggggcttatgaagttatcaactcaccgataaggacacaattaccttcccctatctgacataatgctatatttacagcggttcgtttaacggggatattcatgaattcggacgaggataacaatgaaaaagcactagatctcattggtagtactgcccgcaggctgctcagtcagaaagccacagtagataaagatgaactgataaatgcactggaaactgctcagcaaaagcaccgcggacccgcgtgtgcgggtaaacatcataaaggcgattcagatgctgagtcaccgggtacactgacctggtgaggcagaacgtaacaggaggagtaaaattccggataaatactagtacccaatattttgctggcaagaaaattcgcgcgataatcgctttacttcagcactgctattaccggaatagagggctgtggcgagaagtctgctggtctgccttattgcctctttaatgatttcacgacgggcagcctctgtctccacctcaagcatctgtttcaactgtcgggaaagggtgtaagcgctgaagacaccgtcgtcctcaagcagcgctaatatggcttcgccaataacgatattgatcttttcttcttcacttctgaacatatcaaacttcctgctgcctggcgataagagtccgtcgcagcggacaagcagtattgcttttgagtggttatagtttttgcctgatttcagtagcagcactaacctggctgaaactataaaatcatgcctgccctgagtgtaacagagttggactaacctgcccgaagtttcaccagctcggtcacaccttttataccagtcccaccggggtgatgatgattctacgaaatcaaataatgtgcgtttaggtctcattaaggctctattgtgctagaagcagactgacctggtccctgttgattcacacagactgctgttagcaatgtccgctcctcgctcttagcggaccttagctgcattataaagcagccccggccatctcgaatggcacgatgatggcaaatccggtaaacatgatgcgcattaatacgctttacggatacatgtcaattaaccggacgtccgaggcttagcttggcatctgatagagttcaagctcgccagctcgcgaaaaaaataaatggcaaggtggttatttcggggatacatctcatgacggaaggacgatcataggggaagggctaaggggagaatactgctagagaagtgatggtgctcgtcatggatgtttacgaaccgtcgtcacctacagtttggttttaatcagaaggctattgtgttgttttgtgtacatagcggtgtacatacttaagttcaggcttaacaatcacgattcaaaacccagtcaaagcagggttcaacacggctttactgtcatattcctgagttatgaattgggaggatgtttgcctccgatgggaataatagtaactcaggttatgatatcaatattaactattagtgcggcaatggtgatcgtgctaattgtttatctgaggatcagacagcgactgtgccgtctccgttatcaacgccctgaaccagcgatgggcaggatcgtcgcgatagcgtgcatgccagcccatttcaaccggaaaggtgcccagatcaaccggcgcgggaatgattctgagccgctgatcgcgtgaaaggtgctgacagatcaaacgcggcagggtcgcgcagtagtccgtgaccgcaatcatttccggcacggccagaaagtgtgtgacggagactgcaacctgacgacgcaggcctcgctgttcaagcgcctgatataaaccggcgcgcatacggccaggcggcagaacgttgacgtgctttagctgctcatattgctccgcgctgaggttttcgcccaccagcggatgatcggcgcgtatcacgcaggccagaccttcattcatcaggtgctgaacgacgagattgtcgggcggctccacgatacggcccagcaccatatcggtattacctgaaatcacaccggtttcagtgacgtcattgccaaaaggagtgaggcggagtcggatgccgggcgcacagctcctcagacgagccacgatggcaggcatcatgatgaattcgacatagctgttaggcgcaagcgtgaagagccgggtggcatgaagcggatcaaagtcctgctggccaagaataaccttgtcgatcgatgacagcgcagcaccgaccacctgagccagctgttccgctttcggcgtcggtcgcatcccgtaacgctcgcggataaatagcggatcgttgagcgtttcacgcagccggtttaatgcattagaaagcgccggctgggttataccaagccgttccgctgcgcgagtaacgttgcgctcttccatcatgaccagcaaaactggcagtaaattcaaatcgtatttcattaagctataatgctatgtgaataactgaaattgaagaaataaatttcataaatattcgtaaccccgccatgattaacgggtcaacgcagaagatagcggctcagacgctggttctgactatccttacacctgaaaccgactaactgttatatggagcggaaatgaaaattttaatggttttgacctcgcatgatgagttgggcaccactggcaagaagaccggtttctggctggaagagcttgcggcaccttactatgcatttcttgatgcgggcgtagagattaccctggcttcaccgaagggcggacagcctccactcgatccaaaaagtgatgaacccgattctcagactgatgagacccgccgcttccatgccgattctgctgctcaggcagtactggcctcgaccgtcaagcttgatactgttgatcaggaagcgtttgatgccgttttctatccaggcggccatggtcctttatgggatctggcaaacgacaaacactccatttcgctgattgagcaaaccctgcaggcgggcaaaccggttgcgctggtctgtcatgctccaggtgtcctgcgtgatgtgaaaaatgctgatggcacgcctctggtcaaaggaaagaaagttactggcttcacgaacagtgaagaagagggcgttggcctgactgaggtggtgccgtttcctggttgaagatgtgctgaaacagaacgggggtctctactcacgaggcgatgactggcagtcctatacggttcaggatggcttgctgattaccggtcagaacccaggttcatcagccgagaccgcgaaggttttactggcaagcctggcgaaataaagatctttacagcatgctgagttttgagggcgcctgcgggcgcctttttttattgctaccgttaagtgtcaggatagatagtgacctgcttaattattcaggttgaatagattaggactcaatttttcttaacattgataataaatttacgggcgtttcagagctaaatgattgcctgaaaaattcactgcaaatataaacatgtttttaaaaccagtgttgacatcgttttttatatccgtaaagtaggactcatcagcggcgtgcagttgccctgataaaccggaaacaaaagcattatgagtaaagtaaaaaggcccgacaaatttgtgagttgaacttgtcggtggttctgttaaacattgttctttaaaactgttcgttagttaagataaccctgttaaatggagtcgaagtaagtctttaagaagtatgtagtatcgcgtcgcgatgatgtaaggcctcgtagttctgaacgttacgttacgacaggatacgattgcggtttaaacgtcgtaatgaaagtaaggcaacgcatcaaagagtatatatcgcgatgggggtgtgcagatttatacgggcctgacctgtctttgtctcctgaaagactatcaggtggttgaaaccgataataatagtgacatttcagtatcgtgatcattattatccgcaggatctgttcataaatagcagtaccgaagtagtacctatcaattaagttagttaatggtaaacgtaaaatctgtagtaccttaaaagccctggctatttcagtcagggcttttatcattttacgatgtgtatcagttcttttcagaacgtaaatatgagtaattaacattatcaaagcagcttttatcgataatatttaaagtgtttcacgcgcgatttatttttctgctattttttcctcagttcaacactctttttcctgaattccccagcatcaatttttaccccgctatcgacatagcaaagcgcgattttgccttttcgacgtcggacagaatgcgatataacgccccgttatcctgcctgttgcttaaacaaaatcgcaaaacagtgagccgcagtccgctatctctgttaatacaccaccgttttagccacggacgccagtcgtttcacgcagccactcatgccctttgtgatgatgggttcggttatgccaggccatgattttactgaagccagggatgatcagcggtgctggcaacatgaccagacccgtagtgtcgatcgccagtcgtttcggtaccacgcttaccaaatcagtgacgcgcaaaatttccgggagcaccagaaaactgcaaactgagagcgttacccggcgggcctggccaatcgcagccaaagcctggtcggtaaccccatgaaaatttccgccgggccacgaaaccagcgcatgatcctgcgcacagaactcatccagcgacagcgtcgcactgcccgccagaggatgatttccattcagcagacaaacatattcttcattgaacagttgccgcgtatgcaatgtcggtggcgtgggctctggcgtcagcaacgccacatcaacgtccccatgttcaaattgtcccgacagggtcttatctggcaaagtaatgatgaaaacataatcaacccaaaaaaaggaaaatacatccgttataaatttttaaattattgaaaaataagctctatatctaaaatatactgaagaaagacttactcagcatggtgatagatgactgatagatatctcacctaacaactatgcatctataagattccactagaaattcataagaaagtatctcttttctggagtctattgcctcaggggtccgggaaggattttttaatgggtttttaatttacccattgcgaaccttttccgttttcagatggcaaaaaaatcaatctgcgtcatagtcaatattcactgagttattgcgctatagctttcttttgaaattcatctgcgcctgttaagtgcgctattcaaacagaggttaaaatgtctgcagaatctccagagaatatctccagcgatctttcacagttcgtcggtacgcattttgtctatacctacgataatggctggaaatatgagtggtacgctcgcaatgaaaccacctgcgactaccgcattcatcagggactggtaggtggccgctgggtgaccaaccagaaaatgcacgcgattcagttcgcccctggcatctacaaagtagactggcatgaacccaccggcacctgcgtcagcctgctttttgatctgaatcgcaccctggttcacggcacaattttcttcccgcagtggattgccggtgaaggtcagcatccggaaaaaactatctgttatcagaatgacttcattgaggatatgcaccgcttccgcgatgaaggcccggcttatccgtatgtgatcattccagagtttgcgaaagtgacctatatgaaaaatgaaggtccagataacgatgaagtgatcaatcaggcacccggacagatgcctgctgactattttgatggtaagtaattaagccggtcacccgcccctacgggcgggtagcttctgcctgacgcgccagcgtgcgggccagtattgaggagtagagtggtttcccccccagaaactgcgccagcagcgtagcgcccagacaggtaataatcatcggtaatatcagctggtagttatcggtcatctccagcaccagtacgataccggtcagcggtgcccttaccgacgccgcaaacagtgctcccatccccgcgatagcaaaagtgcccgcttccagatgataaaacgggaacaggtccgtcattgccactccaaaggctgtcccgagcagcgtacccagcgccagcatcggcgcaaaaataccgcccggcgcacctgagccaaaacagagcagggtggtcaccagcctgaccagaaagatgatcagcagcagggtgaaacgggaagacgccatggaccgcctgtgggatcagttctgaaccgccgcctgcgccaggtgcaaacatcagagccagaataccgcaaccgccgcccagcaatgcaccggccagcaccacgcgcgccgttttaccggcataaaagcgcgcaaaaaggtcctgcgtgataaatatcaggcggttaaacaggacaccgaccataccgataatcatcccgagtaccagatagagccacagcgtttgcaccggcgcatcagccagcttgccgacggagatcaccgcctcttcgccgttgaaacagcggaacacaatgctggccataatcacaccggtaaacacggctttaattgaaatcaggttatagcggaattgcggacgcatctcctcgatgataaacaggatgcccgccagcggcgcattaaacgccgccgccagaccggccgccgcgccggttgccagcagcgtatgacgtgcctcattgctgcgcatccccagaatatcaatgaccatgcggccaatgttcccgcccagctgcactgtcgggccttcccggcccagcaccataccggcacccagcgtgcccatgccgccaaagaacttcaccggaatcacccgccaccagcgcacaggcctcagctcttccagcgcaccttcaatttcagggataccggagccacccgcttcgggagcaaagcgcctgacgagaaaatagcccaccatcgccagcagagccgagatggcaaaggcggcggcgtagagcatccagccctgaaactgcgatggtataagcgtgtcagcacgccactgctgtattgtttcaacggcccgggcaaacgccacgcccgccaggccaaccagcgtaccgaccagcgcggcacagaacagcatcgccagcggcgttttatcacgatagagcagggcgcgaaacatccggctgcgcgccgcgatggagcggggaacataaaccggctgcggtgattcttcattcattgagagacattcttgttcaaccagaccagcgccccagtttactgagtgataaggtgaaaacaaacgtcaggatcaatttcatcggggtaaagggttaattcgtctgtggtggacaaaccacttgcgccatgcgttcgcggtaggctggatcatcctggtttttcagcgcctgagccgccgcagtcagcgtgacctgattctgcttctggttctgcttatcgttaagaaacgtctgacgcagtttttcatcggagatggctggtgataactggcacttctggcgcagatcgtcagttatctgctgctgacgcagcgcaaacttcagcgtgtcgtagggtgcggctgccacaatcagcgggcttaacagcggcagaataaacagcgtgttgcggatcacgttcatgatggtctcctgactgctgaggacaggatcgggtcttcggcagttttcagttgatattaatcgcattgagtgattagcctgagcacaatatccccgaccgactgcggcaacgtcgccacggtcgacgcaataatcatagcaatactggcgtgacagggagctgacatgcagccacattccactgaaattatcaccgctgactgttgtatcgtcggcggtggcccggccggattaatgctgggttatctgttcgcccgcgcaggcctgcgcgtggtggtgatcgaaaagcacgccgattttctccacgattttcgcggtgacaccatccatccctcgacgctggaaattatgcaccagctcggtctgctggaatctttcctgacgctgccgcatcagcgtgctgaaaagctggaggcggaaatcggcggacagagtattacgatggccgatttctcacgcctgccggttcagtgccgttttatcgcctttatgccgcagtgggatttcctgaactatatggctgaacagagcgcccggtattcgggcttcagcctgctgcagtcgacctcttttgagtcgctgaatgttgaaaatggcaaggtcagtggtgtgatagcttcccgcgggaatcagcaactgcacatccgctgtaaactggtggtcggtgcagatggccgccattcacgcgttcgcgaagcggcgggactgaccggacaggaattcggcgcagcacgcgatgtcatctggttccgcttaagtaaacagccgcaggatcccgatctgggtatggggcacaaagggccacgccagaactttattgttatcgatcgcggcgactactggcagtgcggactgactattccgaaaggggattttgaagcgaaacaggccgccggactcgacgcgtttaaagcggaagttgccgcactgtcgccgttcgggcctgcgcgcatggcggaaatcgagagctgggaggcgttcaaactgttgtcgatacgtatcgaccgcctggacaagtgggcgaaacctggtgtgctctgcattggtgatgcggcgcatgccatgtcgccgattggtggggttggcgtaaatctggcgattcaggatgcggtagcgacggcgaattttttgaccgatcctctgaagcggggagaactgcagctgcgtgacctggaaaaagtgcagaagcgccgtcagttccctaccgtcgccacgcagtttttgcagatcaagatgagccgcagcaaagccagaagaaaacctacgggaagcagcaaggttcccgcgattatccagcgcctgccatttctgcgttttgtactgggacgcctgatcggtctgggcttcaggacggagtcgccgcaggttgcgcgcatgaaagaagagcgttaaatgatttcgacagcgatcagatatcatgcgacactgtttcactgtgaaagtactgtcagattgagccgctatttatctgataattgggcgctaattgagcattcctgagctaaattattttcgatttttgcgcctgcataggagaggtttcagtgcataacgagcaaaatggcagcgacgtaaaacgtctgagtgcgatcaaggcacttttgtccccggatgaagcccgggataaggtgctggaaagattcgttaatctcgccagccaggtgctgggtatttctggcagcttcatttcaattattgacgatcataaccaatatattaaagcgtcacggaacttcgatcttaagcaatcgacccgtgatgaatctctttgccgccacgtcattgatggtgagggacatctggtggtgtatgacaccttactggatgagcgctttgtcacgcacccatttgtgaaaggcgatccgcatattcgtttctacgccggtgtctcgctgcagaacctcgacggcgcggtgctgggcacgctctgcgtcaccgacacccagccacatccctttagtgatgagaaactcgctacgctgcgctcactggctacgctggtcacctcatttctggatgcctggaacaatgcgggttttgccgacgtcattacgcacctgccgaatcgcccacgtctgattcgtgatattcagcaactgacccttgtcgcaccagagagccgcttccgcctgattcttatcgactgcctcgacatcattcgcgcctatgagctttcccgtgcggtgggcattgcgccgatggagaaactgctaaagcagatggcgcaggatgtcgctcaccggctcaatcttccggagaatgagacgctctatactttcgccccaggccgttttgctattgttcagccctactcgggtcgttatacagcacataacatgatcgacctgtttaagggcatgaaggccgatctggcggaaaatatcacgctcgacctggatgtctttaccggtgaaacagagtttgtaccgggccagatggatgccaatgaaacggtgcgtcaggccgtgagcgcgctgcatgaggcggtggatgagaacatcagtgcaatgtgttttgaagagagttacgactcgcggcgcaccgatgactttatgatcatgaacgatctggctcaggcgctgaataaagacgaagagctttacctggcctggcagcctaaagtgtgtctcaaaagcggtaaaacggtcgggctggaggcgcttatccgctggaatcatcctgagcggggcgagcttttcccttcagaattcattccgttagcgggtaaaaccaacctgatttccgatctgaccaactgggttatcgatcacaccattgagcagcttgcgcgctgggatcgcgaatacgatctgattccggtttcgatcaacgtcagcgaacgcgacttcgcaaagcccgattttgccgatcggctggtggcaaaattagcggcggctcagttacccaattctattctgggcattgagtgcctggagaatgaactgatcaccaaaaccaatgtggcgatcagcgggctggaagcgctgaaatcacacggctttgtgatctcgctggatgatttcggtactggctacagcaacatcagctatctgcaggatatcccgctggatgtgatcaagatcgaccgatccctgatctcgcgtatgggtgaagatgatgcatcaaaaatcatcgtcagatgcattattcagatgctgaaagagctcaattacaccgtgctggccgagggcgttgagacggaagccaccctgacgttgctgaaaacttacggttgcgatcaaatccagggctacttcttttcaaaaccgctgccagccagcgatattgaacactggctttatcagaagtgatgccaggaaaatggcccgcagcgatcgttgcgggctctcatattactcactgccggtagcgtagcgctcaaccggcgtgatgcttttaatcagtttgttatcaaacagaaattgctcgtaagcctgatagcgtgcgcgatccagttttgccggatcggcagcgaaacagcggcagggtggcacgccatgcctgatgatttagcggcgtgttcagctccggatgcgcgcgggcaaaggcctgccagctctcctccgggtgcgcctgcaactgcgcattacctttctttagtgcccgcaaaaactttttgattttctccgagtgtgcctcatcacggttggcgacgatgatcagttcgtcataggccggaacaccataatcttcgacgttgaagactaccgggtttttaccgtgctgtttcatctcaagcgcttcgatattgcgatagccgccgataacggcatccacctgcccggtcatcagggcgctggtgagctggaagttgacgttaaccagcttaacctgatcggctttaacgccatcatggttcagcatggtcgccagtgtcgcctgttcaatgccgctgaccgaatagccgatacgtttcccttttaaatcggctggtttttttaccgtttcgtctaacgtcatcagcgtattcagcggactgttaatcaacgtccccacccgcatcaagggcaatccctgatcggcgaagaaatgcagctgaggctgataggtaatcgctaagtccgcctgctttgctgccaccagacgcggcggcagcgccggatcggaaggcggcacaatgttaacctccagcccttctgccgcaaacgcgccggtctgctgggccaccataatgggtgcgtgatcggggttgatataccagtcgagcaccagtgtcagtttctccatcgcctgagcctgtgtggctaaggtggcgctgaacagcagggtaaacagaggcatttttgtcatgggttttctcattggtatggtcattaatgtgtctcgggtgcccaggtaatcaggcggcgtagcaggatgtcgagggtcagccacagggccagtgtcatcagcaccagaataaacaaggcggcgaaacagaggtcgctctgcatccgggcgttggcattcagcatcacgtagcccagcccctcggccgagccgacccattcaccgatgattgcgcctattggcgcgacggctgccgccatccgcaatcctgagcccagggctggcagcgcggctaacagccggacatggcgcagttgcgctgcaggtgatgcgcccagcgtgcgagccagatcgagatagccgggggtgacgcgacgcaggccatcaaaaaaggcggaggtcaccgggaagaagatcaccaggacggccatcgcgactttggcgcccatgccgaaaccaaaccagagcaccagcagcggcgccagggcaaaaaccggaatcgcctggctggtgatcaccagcggcatcatccagcgctgcagccatggcgaaaaggtcatgcccagcgccagcacgctcccaagcagcacgccgagggccatgccgctgacgatctcggtcagggtaatcaaagtgtgatggccgagataacctgcgttttgccacagtgcgatggcgaccgcagcgggtgagggcagcagaaaggccggaaccgaagtcagtgtggcgagccaccacagcgcaatcagtccggcaaacagcatcactccacggtgaagaccggcaaaacctttgtgtaatctcatcccgctatcctgctcagctgcttcagcaatccggcctgactctgcaatacctgtatgtcgtctgcagcccgcggtggctggcccgccaggggcgggcaggtttcaattcccgcagaaccgatcaccagcatgtggtgactgagccgacaggcttcagcggcgtcatgggtaatcagcagcacggtgtgtccgaccagcacttctgcggccagcgtctggatctgagcgcgggtgagtgcatccagtgcggagaagggctcatccatcagcacaacgggctgacgggtgtagagggtgcgggctagcgcggcgcgctgacgcatcccgccggaaagtgtcgcgggtcgtgcgttcgcagagtggctcagacctacccgcatcagcaaatgctgcgcccagtcgcgatcgaccctttcacctttcaggcggctggcgagacagacattttgttcaaccgtcagccacggatagagcagatcctgttgccccatccaggcgatgcgtccggtcagtggcaggccgtcgctgccgctgacctgcccggcggtgggtggcgtcagaccagcaatgacccgcatcaggctgctttttccgacgccgctggcacccagtaaagcggtaaaagcaccgcccgcgatctccagatcaagctggctgaagagtggctgctggccataattcaggctgagctggcgaattgaaatgcctggcggcaccggatggcacggcaggttcatgagctgatccgctgggcggcagcatggttgagacccatctgccagaaagcggcttccagccgggttgcagtggtaaaaatctccgccagcgggttaaaccggtgttcaccggcgcgctgccgggccagggtttcaaacagtgaaagtgaggagcgaacgccagccagataggcttcgtcgccgtaattttctatccatgccgcgtaaggattcccctcaaagcgggttgcgggatcatgcagtagtgtcaggccaatttcagcgtaaccggcaacgcacggcatcagcgcggtcagcagctccagcgcatccccggtgtgacccacgtccagcacgtagcgggtgtagttgagcgtttccacggcttcgggttcactcgccatagccgcctcgctgatgccccattgctggcagtaagcctggtgaagtggcagtttcgctgacgatagcgttaagcgatgccgttgcgctgcgtaaggctgctggctcggaaagtttgctgatcagcaggccccaggcacgggcgaagtgcaacagaaacagataatcctgggtgagatagtggcggaaggcggcgggtggcagggtgccctgaccgagttgccgcacaaaatcgtgcccgatataggcgtgccattgactgcccgcctgctggcgcagacgaccataaaagccggtgtcgaaaagcggatgtgacataggatctccagtaacagggagatccgggcatacggtctggaacagggaatgttgcaggagatgacgcagaaaatctgccgacccgtcccttcgctggcatgacccagatcaggttcaaagggttcggcttacgccatctcagcccattacaggacacccctcggagacattggttatacgataattactgccggagtacaacggcagaaataagagttctgttccggcgttgttgtcgcgccagtaacagcatgacgatagaatttaagtgacgttgtcactcaagatccgcgccattactggcgatgacttttttgtaccaccagaaggatttcttccgcgtgcgcgccagcgtgccgttacccaggtcgtcgcggtcaacatagacaaatccatagcgcttgctcatttcacccgttgaggcggcaaccagatcgatacagccccagctggtgtaacccatcactagcacgccatcctcaattgcgtcgcccatggcgcggatatgttcgcgcagatagctgatacggtaatcgtcgttgatctcgccatttgattcgatctcatcgcgcgcgcccaggccattctccaccagaaacagcggcttctgatagcggtcatacatcatattcatagtgatgcgtaagccgagcggatcgataccccagccccattcactgcgcgttacatgcggattggtcagggatttcaccacattggcggcgctgctgttctgctcgttcatctctgccgaggcgcaacgtgaggcgtagtagctgaacgagacaaaatcgacgctgtttttcagaatgtcggcatcaccgtcagcgatctcaagcgttacccctttttcacggaacacgcgggcggcgtaggccggataggccccgcgcgcctgcacatcaataaagaacaggttttcccgatccttttccagcgcagcccagacatcttccggcttgctcgaccagggatagaagttgccgcctgccagcatgcagccgacctggttcatcggattcacttcatgcgcgatgcgcgtcaccagcgcgctggcgaccagttcatgatgggccgcctgatactttacctgatccttgttctcaccgggttcgaacaccagaccggcgccggaaaacgggctgtgcagcaggatattaatctcattgaaggtcagccagtatttcaccaggccatcaaacgcctcaaagcagctgcgggcatagcgggcaaaaaagtcgaccattttgcgattgcgccacgagccatattcagtcaccagatgcatcggcacatcaaagtgacagagcgtgaccagcggttcgatattatatttccggcactcctcaaagaccgcgcggtaaaaggcgatgccttgcggattgggcgtcagttcatcgccattgggatagagacggctccacgcaatcgacgtgcggaacacgctgaaccccatctccgccatcagcgcaatgtcttccggatagcggtgataaaaatcgatggcttcatggctgggataaaattcatcgtcacgcagggtaaaacgcttttccagaccgagtttgaccggcatacggtgcgggccatgtggaatcatgtcgacggtggttaagccctttccgccttcacgaaagccgccttcactctggttggcggccagtgcgccgccccataaaaatccttgcggaaaccttgaatcagacatgcaatcctcttttccgggtcagcgtgaccctttcctttagtggctattaatcgcgttagcgcgttcggtaacgggcgcaggttgcgttgcgctttcgggtgcggttttggtttcgggttcggtttcaggaatatcttcaaaacctaacagcagcgtcagcacaaatgacagcaccacagacaacaccatgaccgcaccgacccagacaatactcatgggattggtgggatcgaagaactgtacgctggtaaacaggccaggagaggccatggagtggctggccagcccgccaatgcctgctaccgcgccgcagataaaaccactgatcagacaggcgatcagcggtcgttttaagcggaccgcaacgccatagagcgccggtttctgaaatgccggcaataatcgctgatgccgccgctgccagcgcggtctggcgcagttcacggtttttggtccggaacgccaccgccagcgacgatcctcccagcgagaggttggcaccaatctctgacggcatcaccatgccctctttgcctgtttcggcaatggtctggataatggtgggggtgaacacccgatgcatcccggtcatcaccagcagcggccagattgcgcccataatcgcaacggaaagccagccaagatagccatgcacggtgtagaccagcgcggagatgccgctgccgatccagataccaatcggaccgatcagcacaatcgcgatgggtgccgcaatcagcacaatcagcatcggtttcaggaagtttttagctacggcaggggtaatacgatccacgccgcgctcgatgtgcgacaggatccaggtcatcaccagcgccgggattacggtgtaggtatatttcaccgcggtcaccgggatgtaagcaaattccaccgcctgaccctgtgccgctttcgccatcagttcaacaaagttgggatgaaccagtacaccggcaatggcgatcgccagcgacatgttcgttttgaatttcagcgccgcagaggcggccaccatgatcggcaggaagaagaatgcgccatcgccaatcacgttgaggatgaccagcgttgatgagcctttctcaaacacgcccgccatatccaggatcatcgccagcagcttaaccattgacccgccaataatggccggaatcagcggcgacatggtgcccaccagcgcatcaagaatccctgcaccgatgcctcgcagcgtgattttacgtttcatgggtgcagccgatgtcgctgcgggcgagcccagctccagcaccgcctgataagcctgtgaaacgttgttaccaatgatcacctggcactgagtgtcgttgtgcaccacgcccataacaccattgatcgccttgagccggggatagtcgacctgagcttcatctttcaacacaaaccgcaggcgggtcatgcagtgggttacggcttcgatattggtgaggccgcctagcgcatcaacgatggcgcgtgacacctcggcataatttctgggcatgatcgctcttctctgtagggtaaatcggtcaaagtttttatgtttttgcgcctgcgggcaggcaaataggaaaccggtttcacaaaatcatgaagtgctttcactgcgccgacaagcgccaaaatcatccagatctcttttttgtgaactccatcacctgatgctgtcaggtaacctcatactaaggcggggtaaatatttccaacattgagaggcttaggtagactgcaggacgacgcagcaaaggagcatcagcatggcaacgattcaggaagtggcaaacagggcgggcgtctcaaaagcgacagtgtcacgtgtgctctcgggcaatggctatgtcgggaaggaaaagcgcgaaaaagtactgaaggcgattgccgaaaccggataccggcccaatctgctggcgcgcaacctggcgacaaaaacgtctcagaccattggactggtgatcaccaatacgctctacagcggcagctacttcactgaactaatggcacactccgcgcgcatactggagcagcagggccgccagctgattctggcggacggcaaacacaccgctgagcaggaagaggcggcgattcagtttctgctcgatctgcgctgtgacggcatcattatctatccgcgcttcctgagcattgacgcgctggatgcgattatctcccggcacaaacagccgatactggtgatcaaccggcggctgcgcgtcaaccatagctactgcatttacagcgatcagcatgccagcagcgctgcggcggtgagccatctgctgaatcaggggcatcgcgagatcgcgtttatcaccggttcgctcgattcgccgaccggcgtggagcggctttccggctatcacgctgcgctgaccgcacagggcattgaagccgattcccggcgaatcgtgaccggtaaatggacggcgcagagcggtatggcggccgtggaccagctgctggaacgcagggtgacattcagcgcgctggtggcgagtaatgatgagatggcgattggtgctatcaaacgtctgactgaatgcaacatcgcggtacccgggcaggtttcggtgattggcttcgatgatattccgctggcgcccttcatcacgccgtcgttatccagcatgaaactgccggtcaccgagatgatcgatgagacgattaaccgcctgctgaccatgctggatggcggagactggcatactcaggcacctttcacggccagcctgatgctgcgggactccgttactaaaggccccggccgttctgcttaacctgcggcgatctgtatcacctctatcgcctgttccctgagctgcgctaccgtcgccgcatccagcgtctcatcggtaatcacgtgcccgacctgaaaaccggatgaaagcggataggggtgaatctgaccaaacttggaggcgtcggtcagggcatagctctcagcgcctttcgccagcacggcatccaccacatcacagcgcagcatgttgcggccagtaaaaccagtttcgggatgccagccatccacgccaacaaatgcccggtgaaaatgaacctgctggatggaataccgcgtcagcgggccgactaccgactcactgcttttctgcagcaggccaccgagcacaatcacctcacaggcggcttcccgaagaagctgggcaatatagtgactgacggtaatcagcgtaagatcggcgcggtcagccagcgcacgcgccagcagcgcattggtgctgccgccttcgatgaagaccgattcacccgcctgaaccaggctggccgcatgtcgtgccagcgcctgcttagtgagatagcgggtattcatgcgggtgccgacgttatcgctgtccagcgccagcgcggaaccgtgaacccgccgcagcaaccggtcgcgttccagcagcgtgagatcctgccgcaccgtcacttcagaaaccccggtaagctgcgccagttcgctgaccgttacgctgccccggctattaaccagttgaataatctgatgatgtcgcgggttcataattgcgtttcgcagaaaaaaagaagctccagtgtaacagggatatcccgcgctggtgtacaacgcgggattgggatcaggacaaatccagcgaccggcgtccgttaagattgagatcctgcagcgtaaaacgctggtcccactctgtttcataatcttccggcggaaaatctcccggcgaacgtccctgctccagcgcctgtgcaacccgccgggcataggcgcggtttttgtcacacataggtgcagcggggatatacatcacattgccccagccctgttgatcttcaaccggtgcaacggcgtggatcacatcacagtgccaccataccgaatcgcccgcctctaaggcaggtatcgaacagagtcctgcaatcaggtgcggatgccactgttcattaacgggcaacacccggcccggcgcgacgccgcacagttcatcttcaggtacgtctgaaagcaacgggcgcagcagaacataggccatcgcctgcggaactggtacaacgtgtagcaggccctgaccggggatcatatcggagagtgcggtccagccctgaaaggtccggaacacggaacatttggtggtacccggcagatcatactcatccacttcggtgcggtgagctgcatcccaggggtcgtaagcggcaaaatcaccgtgaaacagcttactgaaaacctgctgatacgcggggagtaaccagcgttccagcgcgccggaatcggtatgggcgcctaatcccttcgaggtggtgcccggcaagcggcgacggatgcgatcgggatagataacgctgacatccgggtcaaaccactgcttgccctgtgattcagacttccataaccggttcagaaaagattgcgcgtcagccattgccgcgctctgccgcgcctgcatttgcgcctgtgaccagtaaatcggatagatttcggggcgggaggcggccagcgatccaaaaaagtcatcgccggggccgcgatagtgttcgtcaaaccggttgtgatccagatagtcgagcatcgacttatcccatgccagcgcctgctcacgcgcgaagtgctgcttaattaccacacagccgcgacgtttaatcagcgcccgggtttcatccgaaacctttcccgctgcaatgtcctgcatgggcactaccggccaggcactgcccgtgcgcttttcatctgcttttgcttcagcaatcgcagcagtgatgttgtcgcaaacctgacggaaaagggcatcgacatcaccaatctgttgacgtaaatgctgtttcatctcgcgaatagcggttttgacgtcgtcaggtaaaggggttgatcgggaatcttcacgcatctcgtgctcctgaatatctgggggttgagttacgaatgtaattgaaataaccttcattcgtaatattcggctgaggttaacatccttttaacgaaaaaaaacgtgcgtgataacacaactccggaaccggaacgctctgaaagccgttagcaaagtcactatttgcattctcattaatccacacagcgagtaagctttatgaatcaaatcaatcagccgaaaggacagaacggcgaacgtataggggcaggcgagatggcggttaagatgattgcggtggatatggacggcacctttctggacgacaataagcagtacaacgttcagcggttttcacgtcagtatgcgctgctgaagcagaagggcatccgttttgtggtggccagtggtaatcagtattaccagctgcagcgctattttcccgacatcaaagatgagatcgctttcgtggcggaaaatggcgcatgggtttctgactgtaatgaagagatcttctgcggagagttagctcaggagaaagtgcataagatcctcgatatcctggcgcatgaacctgacatcgcggtcgtggtctgtggacgcaacggcgcctatatgcattcatccacctctgatgaggtgatggcaatgcttgcaaaccactatcaccggctggaaaaacgcgatgacctctatgccatcgacgacaccattttcaaattctcgctgaagctggagcacgaaggggtggatgcactgctgcaaagactgcattcccgtctgggcgagctggaaaacatcatgcatccggtatccagcggttttggctttattgatctcattattcccggctgccataaggcacacggcattgcgctgctgcaggaaaagtggggcatcagcgattgcgaagtgctggcaattggtgacagcgccaatgatattgagatgctgcgtcaggcctgcttcagtttctcaatggccaatgccgctgattcggtcgctgccgtggcgcgctatcagactcagagcaacaatgatgaaggcgcgctgaatgtcatttcccgcgtgctggcgcgcgaattcccgttcgattaagcctgcactgcgtgagaaactggcggccttctatccgccactctcctgatggctgcgcgcgtgatgttccatttcatccagcgcagcctgattctccagtccccactgatacatctgctcaatcggcttggcaaaggtatgccccaacggcgtgaggctgtattccacttttggtggcaccacctgccacacctgacgcgacaccagtccgcgctgctccagctcacgcagcgtctgaatcagcatcttcttcgaaataccctgcaggctacgctccagttcacccgtgcgtgcccgattttccggccagtgatagagcgcatgcagcaccatcgtgctccacttcaccgaaaagagttccatcaggcggcgtggcggtgaatccgcataaaagcaaagttttccttcaacccagaccggcatagtgacttcccagacatgatggtaaccaaaaggtaactactaccaaatggggttccgtatgtctatagtgggccgctttctttacgaccaccaggtgataagaggcaacagatgaaaattaacgcgctgatagcgtcccaggcagaccagccgctgcgggcaggccaggtagagttacgcgagctgcaggctgacgatgtgaaaatcgaaattctttactgcggtgtctgtcactccgatctgcatatggcccgtaatgaatggggagtcagctgctatccgctagttcccggtcacgaaattgtcggacgcgtagtggcagtgggcggcaacgtcactaaattttccgccggggatacggttggcgttggcgtgatggtcgactcgtgcggtgaatgccatttctgtcagcagcaggaagagcaatattgtgaggcgggtttcacgccgacctacaacggcacggataaatacaccggcaatacgacatttggtggctatgcgcagcatgtcatcgccgaccagcattttgtggtcacggtgcccgacaatctggcactgaatgcggtggcaccgctgctgtgcgctggcgtgaccgtctggtcaccgttgcagcattttaaagtcaaagcaggtgatcgtgtgggtgtggtcgggctcgggggattgggccatatggcggttaaactggccagtgcactgggcgcagaagtcaccctgtttacgacttctccagcgaaaggggaagatgcacgccggctcggcgctaagaacgtggtgatctcacgagacgccgcacaaatggctgactgccaggcgtcactggatatcattctggactgtgtcgctgcaccacacgaccttgatccttatctcggtgcgctgaaaaccaatggtcagctggtgctggtgggcatacccgatcaacctcatccatcaccgaatgtgacaccgatggtgtttcgtcgcctgagcatcactggcacctcaattggcagcattcaggaaacgcagcagatgctcgacttctgtggtcagcacaacatcacggctgatgttgagatgatcacaggtgaagaggtcgaaactgcctttgaacgtatgctgaccagcgatgtgaaatatcgttttgtcattgatatgcagaaaacccactggtgatgaatacggcccgctgtgaaagcgggccgtctgacttttacacgggctgaacccaaaggattaagccctgcctatagttacaacatacttatatactttagtatcgaccgttctcattgaactccgtgcagcaggggtcttgcagcaagatcgttctgattaaacaaaaaatacccggctcattgaccgggtatctcttttgccgcttaccaggcgcagttaatcctgctctttatccgcgtcactcttttccgcttctgctttctccacagcatgggtaaaaggcttaagcagctgaatatccagaatcacataaaccatggtgttgataaacagggagatgacactgccaaacaccccgctggtggtaaacgtcagatagttataaatcaccaaccaggtcaggcagataaacagcgcgagcgaaatagaaaggttgggcacggagtagttgctggtaccaccgccctgggtatgcgtcgctttaaacagatttccgatggagtatttctccagcaccaggatagtcctttcccagttacgctgtttacgcgcgctggcgcgggtcaggaacagatagagaatagagatgaagaagccggagaaggcgatgagtaccggaatcgcttccagcgcatattcaatactcttatgaggcgtgccagtggtgctgagatcaagcgtcagcgaggcacccagcgcagcatataaaaagagaaacagaatcagaaaagtcagactacgtttccagtcgccatcagcctctgcacctttttgctggatggccagctgaagcgattgctgaatctgttgtgcctgtggtgagtctgtttcaacggtgtggcatggcgcagcaaagaagttgtgcataaacagctcatcttctttatgaatggtgattttcatcagaaacctgtattcgggaaattttctttattctaatcagcacagcatgaattaacagtaactttggctttataccttcagccccgcactgactcagcgggatatcaggttcatcagactacttaaaactgaatcgtttgcgaaactctgctcagcattatcctcttcgtgacgcagttgctgatagcgcagcagcgcggcatcggcgttatcggcatgcaccacgtcccacaccatcttatagccatcagccattaacgcgtcctgctgatcctgccgctcagtgttcacggctctgactgtttgctctttctgaaacagacgatagtctggcatggctattactcccctggatggtccagcgctttaaactgcttaatggcttcattgatattgttggtatcgacggttgcaatacagcgatcgccattgaacacctcatagcgggcattatgcagctgaaacagtaaatccctgccacggaagtgtatacgtttctgtttaacgccaatcccatgccgccgtaatagtgcctgtgacaggcgatcggtctcttttatcattccttcagctcctcggcagtacgtggtcactgccagtaaacctgatgaacattagttttatattaagagataaccctattttttacagggctaagcgcaggtttcagagaaattaccgggcggcgtgtgctgacggaatcagcagctcaccggattaatgtcattccctgcgttaacggaccgcaaatgcggtacacttgccggaataactcgccacaggacacgccgctatgaacgataaaaagatgatttccattgatcagttcaacgctgatgaacgactggccgtcgagcaaacctataagggcctggccgagaagtaccgtcaacgaaccggtaaagagcctgatagcaaaaaagagaaagaatttaatagtgaagctcgtcagatcatcatgaccagcaaactggagaaggagagggcgcaggctgagaaggagaagaaaaaaccgctgcgtaagaaaaaaccttcttcaatgaccgccagcgaagtcagcgatttcaactggtctgcctcagtggttaaaggccgccgataaaaagcttccgcgcgtattcatggcgcgcggtatcttttcacattactgccattgttccctgactgccatcgtccccagcacacaagtcaaagcctgattagattcccttcgcgacccgcaataagaatattctgtaaatagtttaccttaattcattaattgccgataaactgccataacctgttgctgcttcagtctgcatatgaattactacactcctgacgatattcagctgaagcgccgatcgacgcgatttgtgcgccgcatgttcatgatgcgccagctcggcaactttctctgtttcctgcccattctgtcagtattgatggagatgggaaaaagcctggaactctgcgcactgctatttactaatgcgtttgtctggccctatgccgccttcagactggcattgcgatcgcgcgatcccacgggttttgaacgtaagaatctgacgctggatgccgctttcggcggcttctgggtggcaaccatggcgctgagtccgcttccctcaattattattatggcggtactgatctctgatcgttactcggcgggcggttggggtcagctgaagtctgctctgcaggcctttctgttgacctttttactggcctggttagccgaaaaggcgcctttgcaactgaccttctctacccgcaccgtctggctgactctgccgctcgccagcggctatctgctggcgctcagcgtggtttcacacaatctgaccctgagtctgcgaaagaagaatcaggagctggaacgcattgcgctgatggatcctggtctgaaaatacctaaccgacgtctgtttgagcggcggcttgaaagtgagtttttacgtacacagcgaggtgagggtaaagcctggctgatgctgctggatgtcgatcacttcaaacaggttaacgacaccttcgggcatgaagccggcgactttctgctggcagaaatctcggcactactgcgtgacagcgtcggcctgaaagatatacctgcccgctttggcggcgatgagctgtgtgtgattgtgcgggatgcggatgaaaccagcatcatgttgctggcagagcagatcagacaggggattgccctgctgcggctaccggcttcatctacctttcagtgctcggtgagtatcgggattgcaccggcatgcgatgcggcgacaattcatgaatggctgagatgcgccgatgaggcgctgtatcaggtcaagcgcgccggacgtaacgatgtgcaggtgtggcattccggcacgctggaaacgctgagtgaagtcaggggcagttaacaatgcagcctgagacccggtctcaggctgagagattaaatcgccgggtagtcgccggtgccttcaggccagggcgtgagcaaatcaaaaccctcatcggtgacggcgacggtatgttcccattgcgccgagagcgagcgatctttggtgaccaccgtccagccatctgacagcacgctggttccggctttaccggcattaatcataggttcgatagtgaaaatcatgcctgatttcagtggcatcccttcgcccggcgtgccgtagtgcagcacctgtggatcggtgtggtaaatttcgccgacaccgtgaccgcaatattcacgcaccaccgagaagccagccgattcagcgacacgctggatagccgcgcccacatcgcccagcgtcgcgccaggacggacggttttgataccggcgaccatcgactgataggtgatctcgaccagacgttttgcacggactgacggtgtgccgacaaagtacatccggctggtatcgccataccagccatctttaatgatcgctacatcgatattaacgatatcgccatccttgagttttttgctggccggaatgccgtggcagaccacatgattaaccgacgtgcaggtggtgcgggtataaccgtggtaaccgatgtttgctggcgtcactttaagctcattcacgatgaagtcgtgacagatatcatccagttcttccgtggtgatgccgggacggacgtgaggtgtaatcatcgccagcacctgagccgcagcctgtccggctgcccgtgccatttcgatttccgctgtggtatgaattttaacgctgttcatgacacgtctccttgtgtggtgaggctctctttagggagcatattgcgtatatcagcgctgccttccagttcaagccggattagcatctgcgccagttgatgttgggtctgctgcggatagagtttctgccagcataccgagttttagccagtgttctgcctgtgcattaattgagcggctcatcgcctgactggcgatgcgcagattctcatgcatcaggtcggagatttttacgatacccatgcaagccttatatgaaacgtatatgtttcgtatagcttaacgttatcggcgtgatttgaaaagaggggggagattgttgcgcgtctgaagcagggtacagaatgatgacccacggccacacatttcgatcggaacagaaaaatttatagataatagagaggtgtgtattgccaggtaacagtagggcagccccgccgaaaaaaagcgccgaaacactgtctttttttgaaaacgtagctgatgactgagcagatgaagtactgggttgttctggtggctgtggatattaagactgtagaatagatgatataaaatccgggcaaacatcagggatgtaatcatgaagaaaataattgcttcttaattttcataaaattttcaagtcagaccgacaataagctaaaccggtgtctgataaaaccctttctgttgcatgcaacgttctgcagcttcaggaatttcctctctgcggctcatgacaacaaacacagttaaaaaatattttcctgactacttttacacggtatggctatatgtagtagcccatgagccagccagaactgatgctaacagtatgtcgatctctgaagctatgccgtcagataccggctgctaaaacatgaggtgcagatgtgcaccgcgatgcagttatccgttgtcagcaacagacagcaaactcttactccggtacaagctccattcagcccagcaactttcagggttgatatcgaagtaaccgcggcattcagccatggcgagagcaacatcacgcggcacttcgatagttgtggcattatcacggatgctactgacttcctgctcagtaagcgggcttcctttctcattctcaattctcatcagtaatgggatgagggcaggtataaaaactatggtcatgagttatatctcatattattaaaggttcgtgtccctacgaagtcactaaaatatgacctctccggggtgcggtaagtggcattctgtaaaatgtgtcttcctgaaaaatatcaattcatcgtcgtttcatcgctacaaggcttgaaatcaattaacactgcccaggcatacaggcaggtttgtatagcccggctggcttaccatagataagggtgaacatgtcggtgccatattctggctaactggctgagcctggggctgatttggatactggttgtcatagctgttcgttgagggttttcttgcggcctgacggcccttctcacgcacgtaggatgacgtgtagttatgggcctggtatgcgccataacccgccacgcccgcagtagcatatctggccgttcgcttgctgctggaatatctcttcttgattatgggtgtcgttgtttgtgatgagtaagctgaactaaaactatggctgtagcttctatgcccacccccaccacgatggccgcgcgcatcagctgtaaacgaggcagccatcagtgatgccatagccagacttaaaataattcccttcattactactccagtttattcatattcattaattatgttctcgtcaaaaatcacgatatcttcagccagaagaacaatttttttagatttatttaactcgttcaacgctgcgctatccttatgagaggaggtccccatgtgtggacggtttgcgcagtacagcagcagagatgattactttgcatccctggggctgaagcccgatgaaattatttatgatccggagccgataggccgctttaacgtagcgccaggcaccaaagtgctcttgctcaatgagcgggataatgaactgcactttgatccggtttactggggttacggtccggagtggtggaacaaacaaccgcttatcaatgcgcgtggtgaaaccgctgcgacgggacgcatgttcaaaccgctgtgggagcatggtcgcgccattgtttcctgccaatggctggtatgaatggaagcgagagggcgacaaaaaacagccttactttatctaccacaaagagaaagaaccgctgttcttcgccgctatcggcaaagctccttatggtaaggatcatgggcatgagggttttgttatcgtaacggcagcgagcaataaaggcatggttgatatccatgaccgacgcccgctggttttaagtgcggatgctgtacgcgaatggctcagtgccgaaaccacgtcggaccgtgctcaggaaattgcacatgaagccgcattgccggaaaaggactttacctggcatcctgttacagccaaagtcggcaacatccacaatcagggtgaagcgcttattaaagagatcaagcctgactgaacagactgatgaggtgagagatttacatagtttcccgcaccgtttcccgttataaaaacaggatcactcgtttcttaatctgagagcgtttattttgcagcaagacactatgcggttgtttcttcggccagtcaccccatcagatgccgatgatctttacaggatctacggcgaccctgcgacgaatacgtttaatcccgcgggcccacatccggatatccatcattcacgggaagtgctatcgcgctctatccgtcactgggaattgaatggcttcggcagttgggctatctcgcttcaggataatccagaaagaatcatcggttttgggggattgagcatcagaagctttgccgatatcacgatcaataatctgggatatcgtttctctccggaagcctgggggaaaggactggcgacggaatttgcgaactatgcagttagttatgggttcgaagagataaaactggctgaaatttctgcagtcgtaagagcgaatcatctggcttcacaaaaggttctgattaaggccggactccgtcatacccgggatatttatgatgtggaaaatgcgcccgcaagcatgctgtttaccctgagtcaggatgaatggaatcaaaaacgggggtgaggaggatatatcctgtcctgtcagtacctatcgtttcaggtcaatcagtgcgagctgtagatgatgcgctataaagttcgctttgagcgcgctgtagcgttgagcatcgttgttacagagtgatgctgcttcacgctttatctcagcataggttgctgcgatatctctgttttctctgaggtaatcacggaaagcaaggtgccttattatctgttcgtctccagctgcaaacgcatgcacctgatggctacgcctttctccacccttaataaaatatctgcggcctgagattccgttctcaccacgaggacacttctattgtcagtcatctcaaatgacgctgaagagtctgttaaatccgtggtgccacaagcgaagctggaatagttttatccgcattcaggcgacaagttacgagaataacactcactgccttaatggcatccgtcagggatttacccttttactcagcccaggaatcatcgcttcttacccctttcattactgtaatttctttccccgctgccgataacagatccagtaccagcgagccatagaagcggaacgtcggtgataacctattaattcaaacatcggggtctcctatgtatcggaacaaaaaaataaaattaagcgtcatgctcactgcggcattcctcacagtcatcttaacgggcgtttttgtgacaggatttgccgggtttaaactcaatacggccagcgatcagcaggaattgacgcgcgcgcggctgggcgatctccaggccctgcagacgctaaaagataatttaactcagcaaactgtccttttactgtccgtggcttcagacactcagcctcaggcagaggccactataaaaacccagttctctgcgttgcagaccaacagtgataataccaccgcgcattttcgcgaactgatcaacggtgccaaaagcattccggggatcaatcttgctgaagtagaagaggcttccacgcaattaaataaaatcgaagtggcagcgggtccgcttcatcaggcagagcaaaacctgtttatgcagaacgccactccgttcccggaaaaactccgtggtgaactgatccctgcgctttcgcactaccgcagtgcggtagatgggatggttgattatcaggcgcgggtaacgagtaaaacggcggaaacgtccacgcaggcgctctccggtgtttatatgacgctggctggcctgaccaccctgtttgttgtgatgggatttgtgatgagtgggctgatcacccgctggatcaagactcagctgggtggcgaaccttcgcatgcgcagggcctggccgctgcgattgcggcgggcgatctgacgacaaaggtcacccttcgtcagggggataccgtcagcatgatggcttctctggatagcatgcagagcaatctgcgtgacctggtctcgcagattaaagattcttccgcttcggtcgccatggcggctgatgaaatttctcagggcaataccgaactctcttcccgtacagagcagcaggccgccgctttgcaggaaaccgccgccagtattgaacagctcacggttacagtgaaaagcaatgcagcgggcgcgcagcagactgcggattcggcccgcgaaaccgctgcgctggcgcgtttcgggtgaacacgatatgcagcgcatgtcagagacgatgaatgatatttcaaaaagcgcggtgaaagtccgggatatcacgtccgttatcgaaggaattgcatttcagaccaacattctggcgcttaacgcggcagtcgaagccgcgcgagcgggcgaacagggtcgaggtttcgccgtcgtcgcgggtgaagtcaggacgctggctcagcgcagtgcaacggcagccagagatattaaacatctgatagaagaggctgtggcacaggttgaaagtggtgttgtcgtggcaaccgggaccggcaagagcattcttgatatcaatgcgatggttggaaaactcgccgtcgcgatggataacatctcactcgcctcagctgaacagatgcagggcatttcacaggtcagcatcgcagtgaacgagatggatggcgtcacgcagaataacgccgcgctggttgaggagtcctcttcggcatcacagtcgctttcagcccaggcacacgctttacgtgaagcagtgaatgcttttcgcatttaagttcatgcgcataactcacggcgaaagacgtgggttgagagcatctgagctgtccggggcaatgccttttttacattgctgatttgtatgaccgggagctatttcttgccagtaatgacggctgtctgctgtgcgtgaaaagcagacgttgacgcagtatggactcgttatgataagcccacctctggtgggcttattgcatatcgcatcagcctgaacccccccagctaaaaaaattaaaattttttgcatccgttttcgctgctcattcgtattaacatataagggcgctctcgccctgtccgttaactcaatgagggaagtgaaaatgaaaccattcctgccaactctgattttttctgcattagtcttcagcggcgccacttatgcggcgagcatggacagcgacacggtgatggtcggcggtgccgccatgtacccatcgaaaaatattgttgagaatgctgttaactcgaaagaccacaccacgctggtggcggctgttaaagccgccggtctggtcccgacacttgaagggaaggggccgtttaccgttttcgcgcccaccaatgccgcatttgaaaaactgcctaagggcaccgtcgactccctgcttaagccagaaaataaacaaaaactcaccagcatcctgacctatcacgtggttgcaggaaaactggacatgaaagcgctggagaaaaaaatcaaagcgggtggcggtaaagccgagctgaaaacggtgaatggcgaatcactgtgggtgatggcaaatggcccgcacaatattcagcttaaggatgctcagggcaatattgccagtatcaccacgtatgatgtgaatcagagtaacggtgtgattgacgttattgataccgtgctgatgccgtaaagcgttacctatactgtgtgtagccacttatcacgtggctacatctttcacagggaagccgatgacaaaaaatgtgccccatattcaggccggtttaatgaatcagatagccgtcggtgataaagctgctcttgagcagctttaccgcgtttctgtcgccccgactctatgggatcatcctgcggatggtgagacgccgggactgggcagaagagatcctgcacgatacgtttattcaaatctggcagtcggctaactattacgacgataagcgcagtgagccgcatatctggctcagtcacatcgccagaaatcgggcgattgatttcctccgtaaacatgaaaacagaagctgttccgtggatgagataagcgaagcggaagcgggtttccagacgccacttcctgccgatgcgagtcatgcggaggcgcgtcgccttcagcactgcatggcgcacttaccctctgagcagcgacaaagcatttcgctcgcctattatcgtggcctctcacagagtgagattgcgctctcaatgagtcagcctgaaggaacggtgaaaagctggatccgtcgcgcgttaacccatcttcgggagtgcataggcttatgactgggcaggaacaacatgatctcactgcggcggaatatgtgcttggccttaccgacgatgtgacacgtcatcggctggataaacgcctcaatgacgattcagtattcgccgcggaggtgctgcactggcagaaagcgttcagcggcattgatctgctcactcacgccgttatcccgccttctacggtctggcagcagattgagcaggatcttggccggaatgcaggcgtctctggcacgacatcaatccgcaagcatcctggcttctggctcggctggggcctggcggcggcaatggctggcatcctcattttcacccatttaagcaagcctgatgccccacaatccctgcagccgattgcggtactcagcggcgcacagcccgatgcacagtttgtggtgaatctggataagtcagcttcactccttcaggtttcggcgctgaacatcacgctgccagagaataaaaacctgcagctctggctgatcaggggcagtgctgcgccacaatctctggggctgatcaatcaccgcgacagtaatgttttccggttaccgcctggcgagttagataatcagacggtactggcggtaagtctggagccggtggggggatctaagctcagcgggccgtccggtccggtgattttccagggcaaagtcacggtgctttaatcatcaggacgcgggtccacggaccgggattcagcggaaaaggggagtggatggcttttcaaatggcaaacctcatccccttgccttaaccaaatcaggggggaatgacaaaagaatggaaatcagaacggcgttggagtctgatgcggcaggcatcagtgagctgatacatattgtgtcgatgcaatgtaatttttcagagacggaaccctgtccgcaatggtttatcgacagcataaaacccgatgcgcttaaaccgttgattgtttcagatgactatctctggctgattgccgtggaaagaggtgaggtgacaggcgtactcacccttttcgaaggcaatttagttaaatacctttttgtacatccgaaatgtcagcgtaaaggggtagcgaaggcactctggcagcaggcgattcccgaactgcgtgcagaaattagcgtacgttcttcactccttgccgtccctttttatgagaaaaggggatttaaaaaagtcggggaggtcaaattttttaacggcgtatcattccagacaatgatcgctcagctctgaattaacaaagagattgttaggttctctgtttccgcaataaaacggcccggccacgcatttatcaaaccagctttgagggagagcggaaccgggccaacccgccttatttatacccgcgtatattccctgtcttcaactcactgactttttgcgccatcgctgtccgctaatgctatatcgggcgcgtgatttgcagcgtttttacacttcatcagactctttttacgccttttttacaggccgttcggtttaattaacggcagcgggcgtttacgtgacaacgttacacgatggcagtcacaacccgattttgcaaaaagcgtttgcaggcattaagtggacagggtgcacattcatgagtggttttctccagtttattctccgacctcctattaatagcggctcgctgccaggcactggtgcctctccgcagcgggttcttaaggaatacagcatgtcaggccttattcttgtttcgcataatcaatgtcaacgttcgacgcttactgcaatttatgacggcatactttcccgccagggaggcgtctggattagctgggatggtgaaagcagggtgatgcctccggatgcgtcaagaccctacgccgtgcagcagatgggccagtatgaaaccgtgaccttcccgtatacgccgggcgagcttaatgaggggtaccataattatattcacaaagggctgtggcctgtttttcatcagcgtccggacatggctcgtttttccgccagcggctatcaggaatataaaaacatcaataaagcctatgcgcgcgccatctgcgaaaacgccgcacccgacgatgttatctggattcaggattaccatctgctaggctgtgccacctatatccgtgaagaagggctgaccaacttagtgggtatttttctgcatcaacctttcccggctggcagaatgtttgaaaccatacccgaatggcgctggttcactgactctctgttatgttgtgatctgattggctttcagaccgtgcaggatatgaataacttcctggtctggctggagagcgaattccgtattgaacggctggaggcgcaaagctttcgtgttcatggccggattatcagggtgggtgtgtttcctgtcggaattgaccttgacgatgtccagtctctgcgtgatagcaacagctgtgcttacatggagatgcagtgccgcgaaagcctgcccgaaaataccgtgctaagcggcggccatcttgatgagagctcagggctgccctaccgaattagcaccctggaggtgctgctgcgaaaacatgattgctaccagaaaaatatcacgctgttgcagctggcgcctccggcagccggacacgcacatgatgcgtcagaactcggtcacgctctggaagcactgtgcggggaacttaacggcgtgcatggcacaatgaactggtatccggtgaactatctgactcatggctacagccgcgaagagcaggccggcatctatcgtgcctcacgcgttgcgctggtgacgccgttgatggcgggcatgagtctgatggccaaaatgtatatcgccttacaggacccgaaaaatcccggggtgcttatcctctcgcagtttgccggtgcagccgggcagatggagggttccatcatcgtcaatccttatgatcctgatgcaatggccagtgcggtacatcgtgcattgcagatgccgttacacgaacggcggtctctgcatgcccgtctgatgaagggactgcatatgcacaacagccatcactgggctgagtcttttttgcgcatactgaacgctgagccagccaccccggaagccttgccgtcgcctgccttttttccgcacctgagcagtagccgggcgaggtactgagttttataggttaaaacggcgatttaaaagggatggtgtggacgtcaaacagcatcacgcggatagagagcagggcaggtaaaattttacctgcttattcatgagctctttgagtttgcgctcaataacatgaggttaaggtcctcatcgaacgaaggtatcattacaggtcttagcttcacatgagagcagctattcaggttcgttctgtcatcacgctacgcagttcctccctgagccagcgcagtgacaaatcgttatcacatcgcttatgccagagcagtgacagggctatttccggtgtttcaatgggtaccgggctacagcataagccgtaatgcgtcatccactcatccgacagcccggcgggaacggtggctaacgcgggtgcgcgcgccagcagcggaggcagagaagaaaaatgcggcgtcacgtagcgaattgaacgtgcctttcctgatgccgcaagctggtcatcgatagcgctccagttcgcccctcgataggaaaccagcagatggtcatgcgccacataatcctccagcgtcagcggtgcacgcaacgaaagctgttccgggtgccacaacgtacaaaagttgtgtgacacaattttctcgcgctggagcgtggcgggcgtgctctctccaaccgaaatggcaagatcgatctctccacgcgcgaccagttccgcatcccggaagggatcgctggccgtaacctgaagcgtcacgccgggagcggtgcgcgtgatgtgcgcatacagtcccggcatcagccagcgttcaacccagtcgctcatccccagccgaaaaacatgtgtcgcctcagaaggcgtgaaggatgctggctgaaacaatacgctctgcatctgtgccattaacgggcccagctcagtgatcagcgcttcagcacgcggggtaggctccatgcctttcgccgtgcgcacaaacagtggatcgctgaacattacccgcaaccgggccagtgcattactgaccgctggctgacccagatgcagcttttctgccgcacgcgacacgctgccttcccgcttcagaactaacagcaccgtcagtaaattcaggtcgattcgatgaaaatcattttctctgatagtgagcatcagtttaatcaatttgagtgatacaggttgagtaaggatactgcccaccacgttgtgatgaaactttctggagagatatttatgaaaattttactgatgctggtggcttctctcatcgcgttcagtccggtctatgctgccgaacagacctctgcgggggatcagcaagctccgggttattaccggatgacattggggaaattacgcattaccgcggtttccgacggcacggtaaccgttcccctgaataaattactgactaacatttcgcctgaaaaactaaaccatgcaatggccagagattcgatgacgccgcaggccgaaacatcaatcaatgccttcgttatcgatgatggtaaaaagcgcattttaatcgacaccggggccggtgagctttttggacacaatggcggacatctgctgactaatctggccgccgctggctatccggcagagtcgatcgatgccgtacttttaacccatattcatgccgatcattcaggcggtgtttcacgcgcgggcaagcctgcttttccaaaggccgaagtgttcgtggataaacgggatgtcgatttctggcttaatccggctaacgtcagcagggtagagaccagtcaggcccatacctttgcagaatctgaacggacgcttcgcccggtcatcaatgctggcctgcttaaaacgtttatggcaccagccacattaccggggggaatccgtgcagagtcgacagccggccacacgccgggtagcgtactttatcgcgtagagagtgaaggccagaccctggtgctgtggggagatatcatccatgccaaagcggtgcaaatgcccgatcctgaagtggccatccattttgatgtcaatcagaagcaggctatcactacacgtgaaagggtactgaaacaggctgcagatcagggctactgggtggctgcggcgcatatcgccttccctggcctgggccatgttcagcatgaaggtaacgcttatcgctgggtgcccgctaattacaccacgcagctccgacagtaggttgttaactaaaaaatgtaataatatcagggagaaaaattttgatgtaagttaacaggtggcgcttcaatattaacaaattgaataatgtcttttagtttagaggcttctctgtaagaggggccagagcgttgccgtacagattagtaatcaatgaggttatggggctgataaagtcgacagcgttatgccactcattgtcgctgcgctctgggccatttctcacttcaacctgaaggtgaatacagtcaatgttcgggatatcgttgtagaagcttctcgcttatacagtcccgttctttctgtaggtagagtaatagcgcaggacctgattttccgaggccagaaccttaaagaaggtgacagggtcatgttttacacggcgctggctaacttcgatgaaaaagttttcgataacccattccgttttattgcggggcgaaaagaaaagccactatcattcggcacgggcatgcatatgtgtattggtatgggcatagcactcagctttgcttcgtcgtttattggccacataaactcacattacatgctcagggacgttagcataatcgaatttgcagagggtgtgtctgcgccaggtgcttcagattttaatattggaatagacttcaatgaactggctgaaaattaaatatttccgcacgttactcgcttctcttttcatctcgaagttgggcgattatgtatatgaggtcgtttttgtgtttattgtgctcgagaacacgcataataattatcttcttgccggctgcgtctatttttttcgttttattccttttctatttttcggccccgctggtggctggatggcagacaattggcgcatcaaatgttcagttatactctcattggcagacaagccctgggtgctgatgttcaatacattaacgtatgcaatttcaattgttatactttgtacgttttcagaaaattcacagaataaaacgtcggcgttcagattgaaacaagtatatcaggagaacctatcctgcattaaaagtttatttcaggaagctcctggcttatttattgctatttttggttcatctgtttgcattctctttaccggatcattacttcgttttattattcccgctgtagctgtcagtcaggggaatggggagatatttaccagctggatattttctctaatggctgcaggcacaattaccggggggctcatttacggacggtttgccataaatatttcaccattgaatgttatgcgcaattggttcttttacggaattttactgattttaatgtcatttattgccctctattcgctcgaggctctgctgccggtagcattcgtccttggtatgagtggtgcattcgttgatatttctctggtgacactcatacagtcctggtcttttgcagagaacacaggcaagacattcggcacgttttctaccctggctaatactgctgaagcactttctggtctcctttccggactggccgccgctgcgagtctgatggttgtttttgcaggcatgagttctctcatcgtactcactagcattatctcaatggcttgtcttccagacaaaaaacaaaagaatatttcgggaagcaacgaatccgatagttctatttaaagaatgcccaaatggacgacttaaataactgaggtctcttttagatattcaaagcaggcggttggtgccaaaacagggcgtccgttccggacgtccctggaagtcactattttactaaaggttctcttgcaccgggcctgaaagcatgctttttcgcgcaccaggcgataatcaacgcaacagccataaagatcagtagcgcccatgggaaagataccgcaccggcattattgagaagcagaccaccaatgacgccgccgcttgcgatagccagattccaggcagttgtaaccattgcctgaacgacatcgacatgattgcctgccgcatcagcggcagccgtctgcatctgagttgacgcgccgccaaacgaccatccccatacgatgacggccacaaagaccacaatctgttcccgcatgcctgcggcgagtgccacagaaaccgccgccagtgccaccagactgagcagaaccagattgcgcagatggcgatccaccagcatcccggttatccagatgcctataagtgccgcaatgccaaaaatcagcaagataagcccgacatttccggtcagccccgacaactgcaggaacggtccgatgaatgtataaagaatattgtgtgccgtcatccatagaaagataaccgccagaacaggtctgactccgggcatctggaaaacttgccataccggtagtcggcggtcggcctgctgtcccggcaggtcaggaaccgccacccatgtccagatgaacagaatgactgccaatgctgccatgataccaaaggggactctccatcccatcatgctgccaagccatgcgccagccggggttccaagggacagggcaaccggtattccaaccatagcaatagcgagagcgcggccctgcatttcagcaggaacgaggcgtcgcgcatagcccgccagaattccccatgcaagtcctgcagccacacccgacatgaatcgggctgccatcgtcagccagtaactgaacgaaagggtggtaatagtgttgaaaatcaggaaggtacctacggcgagtaatagtacctttttacgacgccagccactggtcagaaccgtcagagggattgccgcgagtagcgaacccagcgcataaatgctgaccagctgacccgccatcacctgagatacgtcaagacccattccaatttccggaagtaaacccgccggaagggtctcggtcaggatggcaataaagcctgtcatggcaaatgccagcagggaagccagtggcagaccccgttgtgttgtggtctcactgaatactgtattggcgtgcacgttggccccttttttagtttgtaacgactaaaaattgcgaaaccctccggataacgggttttacaatatatataccgatcggtatatatcagaaagtatagggcacactgaggcttgtcaagtatatatgtatcgattagtatttatatacgataagcgaaaaaggagcggatatggctcagatgggacgcccacggacatttgaccgggaagaggcaattcgtcaggcgatgacccttttctggcagcatggttacgagtccacttcgcttgccatgctcaagtcaaacctcggcaacggcatcaccgccccaagtttttacgccgcgtttggttcaaaagaagcgctgtttgaggaggttgtcgattgttatatgacgacttttggtcaggttaacgattgcctatgggatgacacgcttgaaccccgtgacgctattgaactggcgttgcgtcgttctgcaaaaatgcagacagaacaggggcatcccagtggttgcctgattgcgctatccgttaatacctgttcgccagcgaatgagcacatccgtgagattctggcagcgcagcgcgatcggaccagggcgggatttttgcgatgtgtcacaagagcgaaagaggcgggactcctggcttccgataccgacgtgcgggcgctggccacgacccttcacagttttgagatcggcctgtcgactgaagcccgtgatggcgcaaccggcaatgaactcgattcggcggtatcaaccgcgatgaaagcctgggatgctaatgcactgaacgttgttgagtgacagagaaacggcgcttagtttcagcacgaagcttgtgcctgtcagagagcaactatgcggaagcgtaaagtaagcacgtctcaataagttaatgcctgttagtgactatcaaacttattgctgacaccagacaatgggtgtgagacatcaaacgggactgcacgcggtatggcttgccgcccgcgatctccgcacgccgatgctcgctgaagtgctggcgttgactgtcgcagcctatactgtttaacccacttgatttaatacccgatttcattcccatcatcggttatcccgattacctgcttatagtgcctgggacgtcttacccagtcgatgtcatgcgtgaaaaccgggaaaccgcagcgcaagctagttaatctccggtcggtcgcatgaaggcaagcggtgtttatattgatatgggtagtttgtgctactctgcttgtcaggccacttagagcgtcagcttgtggttctgatgtgttctcgctttattcatttcagatgtcgtagcgattagcgcaaaatggttttccgctcagatttggccatctaagaaaatttcccacaacgcttctaccgcccgggacatcctcgctgcgggtctgaacagccggatctctatgggtatccagagtgcgctctccttattagctgctacggcaatcgagccagcatcaacatccggcgctgccagtgtttccggcagccatgcgatgccgtctccggctttgaccatggcgagtaaggtggcagcaagatcggccgtgaaggcaatatccattccgcgtctggcccggttaacctgtgaggtattagacaggatgcggcccaggccggattcagcagaataggagaggaaaggaaactttttaccgcctgacgcatggaatagaggctcacgcgttgtcggatcgcatcgtgaatacggctgtaaaacttcccgtccaagccggacgctgagatatttcgactgatcgagatggatgtgcatatgaggatggtaataagaaagcagaaattgcgcgtcacctttctcaatcatgcgttcgcaggcacttaatgagtctgataacagtcgaaaagatccgaagcgggcaattttttcgttgttacgcatcagtgccgggaaaaaagaaaatgacagggcatgcgtagcggaaaaaataacatccggccgggcctctcctgcggcctcgatagattcactcctcagggtataaagcgcacgaataagttccggcacctgcctgacgaaaacctctccggcgcgggtcaggctgacgccccgacgatttctttcaaaaattggcgtgccaagccactcttctagcgagacgattctgcggctgaatgcaggctgtgtcacatatcgtgaagctgccgcacgggaaaaattgagtgattgcgccagcgcaatacagtcttcaagccaggttaactcaaggtgatgccgattttgcattacaggctgcctctttggcattagaacggaacccatgtactgcttaggataatagcagacagaacaatcaggtccgttaacactacgctacttcattgtgccgatgaatgccgataaacagatggcatgacataactgattgcgtaggaattttagtaaaacagtctttgactgagaactaccggagagatcatgcgcatccttgatgttgtagaaattaccaaacccattgcttcccctattcgtaacgcgtacatcgatttcagcaagatgacgacaagcctggtcgccgttgtgacagatgttgaagtcgacgggcgccgtgtagtgggatacggctttaactctaacggccgttatggccagggtggcctgatccgggaacgcttccgcgatcgcatccttgaagccgatcccgaaagcctgctgaatgccaaaggtaacaatctggatccgcacaaagtctgggccgtgatgatgagcaacgaaaagcctggcggtcatggcgagcgtttcagttgcagtgggaaccctggacatggccatctgggatgcaacggcaaaaattgcaaacaagccgctgttccgcctgctggccgaaatgaagggcgttgaggctaatccgcgcgtcttcgtctatgcggctgggggttactactatccgggtaaagaccttggcgcactgcgacaggaaatgcgcggctacctgaaccgcggctataacgttgtgaaaatgaaaatcggtggtgcctctctggacgaagaccgccgccgtattgaggccgtactggaagaaatcggcagcgaagcgcgcctcgccgttgatgctaatggtcgctttgatctggaaactggtattgcctacgcaaaaatgctgcgtgaatatccactcttttggtacgaagaggttggcgatccgctcgattattctctgcaggcagccctgtcggagttctatccaggcgcaatggcaacgggcgaaaacctcttttcacatcaggacgcgcgaaacctgctgcgatatggcggcatgcgtccggatcgcgactatctgcaatttgactgcgcgctctcctatgggctggttgagtatctgcgcacactggatgtgctggagcagtttggctggtcaccgtcacgctgcatacctcatggcggccatcagatgtccctgaatatcgccgcaggcctcggtctgggcggtaacgaaagctatcccgatctgttccagccttacggcggtttcccggacttggtaaaagttgaagatggccatattattatgccggaactgccgggtatcggtttcgaaggcaaatcagacctcattaaagaaatgcgggcgctggctgaataagtttccgcttacattacggcatgtttaatgtcactgcgcccctcgttaagttgaggggctgcgggaaaatatcaatctcttaattaacctgacgcctcagcgagaataagtttatctgaatctgagaggagagggcgttattgaactggcaaagggtagcattgttaataatttctggttgaagggctggctttgattcaggcacaacatcttcttgtaggtatatcagccatccattgaattatcggcattcagatattatttttggattagatatgcactggaaattttgagaaatatcaggcatttcgaaccactcattaaccctggcgcccggcctgtttatccgcgccttttgctttcagatcgctcatttctccgttacatcctacgggtaatgaataaaaaattttgactgatatttaaaagaatctgaaatcagcatttcctccccctgccacagtgttaaatgaggaagttatcatgagtgagaaaactctcaagggtcatgcgcttatcggaaataaacgctggacaattatattacctgccgtattcatcatgtataccatttcattttttgatcgggtaaatataggtatggcgctgccccatataaaagctgaaatgggcctgagtcctgttgaagccggctggcttggcggtgcctttgcctggggttacgtcgccacgcaatttaccgcaggatggctggctctccgttttggatcacggaaaataataggcatcagcctgtttctgtttggggcctgcgcaatgcttaccggcctgacgcgtaacttcggtgaactggtagcgatccgtttcttactgggcatcgctgaaggtccaattcaggccgccacggccatgttcctggcccagtggtttatgaagcctgaaagggggcgggcattcggaatctggaatcttagcctgggtgcgggcgcgtttctggccggtccgatatctggctggatccttgcacatcataactggcgcatgatgatggtgattgaaggtgcaccggcctggctgttctgcatcatctggttttatctggtacccaaaagtattcaggccgctagctggctgagtgccgaagatcgggattatatccagaaagacctggccgctgagcagtcaaactacaggaatgagaaatccgatccctggtggaccattctcaaaataccggccctctggctgatgctgatcggctactccctgcatagcatgctcgcttacggttttacgctctggctgccgacagctctcaaagggtatggcacgctcagtgaatttatggttggtctcatcagcgggatgcctttcctgatgacgatgctgggcatctggtatatcacccggcgttcagataagtacaaccaggagcgacgactgcatgccgctattcccaccgtcctctgtggtgtggcattactggctgccgcttttgtgccgctgtcatattactgggctcagataggtttgttcatgtttgtcggcctgacaatgaagatgctggtgccactggtttacgtcaggctgactgaaattctcccgacaaagaaagccgtccctgcggtggcttttgtcggcgcatgcagtaacttcattggacagtctggcggcccccttgttgccggatacctcaagcatctgggtggtggtagtgatatgacgctggcatggggtgttctggggatgttctctattgtgggtggcgtgctgtttgcccttgccgtgggacgtgaggaacgcatccgggacttcagcaaggcattctctgtgtcttcacacagagcagtatcaacacgtcaataataaagcggaatcttcacactgccatcgaacgcccgatcgggcaggatgcgcggatcagcattaagcactcttgtgcacctgtggaattatcatgctcatccccggcgtgtatctctctcaatacctgactgttacagcccgtacttcacgggcttcagaatgcctacaatcccaccagcgtgatatgtttctttattgtcagcgctttatacaacgcttttgccagcgtgcctggttccacacctgattgagcgccctcggaatcggtccagaacgatttgatgcgcagtatggtgttgatactcgttacgcgttccatttccagtacggccagcacaggatggcgcatttcgccatgttcctctgttgcgtccgcctggatcactgcggcgcgggatgcctgactgtcaaagataacgtggcagcgtacgccgttcaggttgagtatgccgatgacttcataaaggcactcaacagcctctgcactgtaggatgcgggcacaacaaacataacagatccttctgaagtgaaatttaatgagcagccagcataggcgaactgtaatcagaggagaagttactgtttttgaatgaaaaatgtagagttctaaggttacgataacgcgcgttattttcactccagttttcgctggtactatcaataactgacgtgtaacccgatcaaggcggtggggtgcggatttgacttaaggaaaggccagcaggtggcaggttaatcgttccagtggggaatgtatttatctatatgcgcaacgcgttagctgtgtgtttcagccacttaacaggatgaacatcagattaagtttaagatttttcgcgctcttcaatcgctcatttctcaatccggccgtcacgtttaaccgtaagccatcagtatgacatcaggtgctgactcatatattgttgttatccgtgtagcagaccagtcagtatgggtatcagctatgtgcccgattttgtcgtacgtgaatctttggattcggggcaactgaaagaggtattgcccggttactgtaccaggcaggggtatttctcggcactctggccggccagccgatatctctcatcgagaatacgctgctttatcgtttttattgctgagtcaggcctgtctctgtaatccgtatcgggaagttaatgctttctgaaatcgtatgcacttttatgcttaattcaaaatcataaacgtccgtttctggcatagagcagagcattgcccgttatatgcaaaaagcggatgttacgtttatttgcctttattagattattaagagttatttatattgtatgaagatattcaattggtgctcattgagtcaccttttgctatcgactaattctaaagctataagttctttatacattaggtaaggcatcattgggctcttatatacaaaacccatcctcattaaatcaaaggcgttgccagaaattccggtcgctgttcggctagcaatgtaaacccggccaattccggatacagcgcacggctgacggtatccggcagcatcaattctgtaaaactccaggccactgcgatgctgataccggccacggacagcatgtcaggatgactttcccgcagcccgtttctccagcgtctgccaggcaccatgcagttgttgagttacgcgatccacccagggctggtgctgtttttcttccggcctgagacgctgttcgtacacaatctgcaccgctttttcgcaggctgccagggcgaagccggtaagatgcagatcccggaactcttccacgccggacgctgatgtaggtgcaggcgaatgaccgcaatatttctcaaggtaatgaatgattagtgtggaatcgatcagcacctgattatcatctgtgataagcgttggaactttaacggccgggttaattttcgttaaggcatcaaaatcgccgaataccgaaagcgggcgatgctcgaattgaatacccaatactttcatgtaaatagcaacccgtctgacatagggtgaatccagcattccgataaggatcatggctctacctcatattatgttgattaacaaaatcaattacctgtgcggcgactggcaagggggcatcttccattaaaaagtgtccggcctgttcaaagatatgcagcgtggaagagacgatgtcgcgctgcaaacgccttgcatactcaacgggttgccattcatcttcggcgccccataaaatctgtactggcagccggagttgcggcaatttttctgcaaagtcactggtgtaacattcattatagtgcgcaacctgatgctgataaaatgaaggctgccctaccacaccacaaagcggtgcaagataattttccagccgctgctctgtcataagatgcttattaaaaacagccatctttaactggcgactcatcgcgcggtaatgctcagtggcgggaatcagcgcataatccgcatagttatcccgcatatctctccatgtgggcgaaggccaggaatcgtagctgggaatatcggcaatcgtaagcgtcttcagaagggatgggttgtcgaaacgccagtctgagtgaaatggccccaccgatatcgtgaccaaaaagatctgttttttcgatctgccagtgttcaagcagccttatcagataacccacttgtccagcaaccgaggtatcagcagtcaaagggcgctctgacgcgccaaacccagccaggtcatacagatgaacatgaaaacccgcatcgacaaataccggcaccagtgactgccagattattgagtgtgcgggcgtgccatgaaccagcaccagaggtcttcctgaaccatggactccggtcgcaatgcgacaaccgtttatcagaacgtcgtcattcagtaatgggttattagcgggcatctgctttctccgttgtgtttgtttcagtcaggctatccgttgactgaatatgacaccagtgacattctttcccgctgtaatcctacttttgtcatacaaaaatgaataaacgactctccgttgactcactcagagtgttccggaccgtgctgcaaacgggcaatatgagtaaggccgcattactcctcaacctgagccagtccgctgtaagctggaagctcagacggcttgaagatcaacttcaatgccagctattaacgcgcatcgccggaaaagccgttccgacagaaaagggcagcgttctgctgcaacatgcggaaaaaatactcactgaacacgatcaagccgtagcctatttttcgccttcggcgctgcgtggcaagctgcgaatcggggtgactgaacacatctcaatgactgaaatatgcggggtgatttcaaccttcactcaccaccatccagaggtggatatacaactggtggtggagcaaagtcatctcctgcgtcagcatttttctgaaggaagtctggagatcattttacatcaggatttcacgggcacggcatcgatggaagataaggtattgtggagtgaaaaattatactggtatgcaacgcttgcctggcgacatgactcggataagagcctgaagcttattacctggggaccggattgctattaccgtaacctggctgaggagaaacttcgccaggcaaacataccatttgatgtgatgctggagtgtccttcagtagcaggtatgcttgcggcgataaccacggggctgggggtgggaatactcaatcaatatagcgttgataaagcgatttgtagcgtgcctgaacttgagaaattgatgcctctgccgtcggtcgattgcctgctacgcctgaataaacaccgcgttaatccagcaagcgaggccttctgcgagatgctgaccaggctgatgcataaagattgaaagtgaagtggctgcaattagttgatgaatacaacgcgttgtaataaatatccgcgtctggcactaagcagacaaacaacaaggatgttgcatctggtgtgagcgcaaatagaagcacccatatcattacatcacccgaatcaggatccgctattttctcacaggcaacaacgctgcattcaaaatgacgatcgtgaacatatcgcctgcccgggtgtgatccccgtctgcctttgaaacatggcaataaacgacgacgcgctgttatagccaacttcgaaggctacactttccacttttccacctttttccagcaggtgcatggcttttactacgcgcatccgctgacgccactcgttcagcggcatacccagcgcctcctgacatttccggttaagcgttcttattgtcgtgcctgatgaagaagccagtttctgccagcggcgtatcatccgccagatttttttcgagtttttccagaatccccttgagcagtggatcatcagtgtagggcagaaaatttttataacgctgtgctcttttcaactggtcacggagcacgtcgaggagccgatggttttcctcagaaagcggcgacagaagaggatgcagccggagatgttcaagcagggcaatcgtaagaggatttacctgcagtgtgcagggcacttcaggcatgcccaggcagagttcaggcatcaggtaaagtgaacagtgggtagcagagtagcggttcagcccttcatgtacgacgcccggcggcagccagataccatagttagccggggcagtgaggtgatcgccttccagcctgacttccataactccgctgaaggaaaagacaaactcaccccaggggtgcgagtgcacgggataggtagccccggcgggcatgtcagccaccctgaaccatgccgggccgggtagttcatgtgtgaaggggggagaaataagctttttgtttagcatgactgaacccgattgattcctgtattttcctgctgttttacactacaggatgtccttttcacactatatgctctatccacgtcactgccatactgaattttttcaggaggcagagatgacgttcaggcgaaaaaatgcggatctgcgcgcaagcgcaataatgacggtgctctgcatcatatggggagtacagcaggtcgctatcaaaggcgtggcagaagaaatttcgcccgtgttacaggtagctctccgctccggcattgccgctctgcttgtgctggtcgtaatgacctgcaaaaaagagtcgctgcgtcagtcccgcccttatctgatggctggatgtgtggtcgggctgctgtttgcactggagtttcctgtttgttgctgaggggctccgctatacctctgcctcccatatggcggtttttctctacactgcgcctgcctttgccgctgtcggtctgcagctttttcatcctgatgagcggctcatgcctgcacaatggggaggcatcgttgtcgcgttcattgggattgcggtggcattcctgtccgggagcagcagcaccggcgacacagtgagaatgctgactggagatgtgatgggcctgctggctggactggcatggggagctaccactgtcgtggtgcgctgtactgcgctgaaccaggcaccggcaacacatacactgttttatcagctcacaggtgcctgcattttactctttatgtacgcactgctcagcggacagcttcatttcaggccgggagtcaccggaagcctgagcttgcttttccagatttttattgtcgggtttgccagctacctgacctggttcagcctgatgaaaacctatctggcctcacagctcggcgtattgtcgttcatgacgccggttttcggtgtcctggcgggaatgctgtttctcgacgagcagcctcagccgggcttcatctggggcacgctgcttatcctgagtggaatcgttattgtcagcggctggccgtggtttatcactcagctggaccggtctgctgcgcgtcgtcgtcgttcaacagggagaaatccctgaaagttctaatcgtttttgcccacccggaatcgcagtcgtttaacggggctgtaaagacaattttatggcgtggatggcagataatacgtcgcaggaaatcagagaggcctgtctggaaaagtgggctacacggctgcggcatattgagcaggaagcgccattgttctttcatccccgggaagattacatcgacgagtaacggctacgcccaggtatcgaggcaaagacaggtttccagtggaattccccggcaggccagacacgtgacgctgctgccggtgcacacacgaataaactgaaaaaataaggcaactatggtcgttagccgctgtaaagtgttgtccggggttctccatgaggggatgttgattgaagattgacatcccgcttgagtttacgcgttatcatatttttaatttctctatgggagtctgcgaaatatcccaccttgttaacttccgcttctggcattaaccggagcttcgagaaattatggacaggaaattaacattgacgttgtggcgctggctattttctttatgggaaataatgttgttcttaaaattatagtgatggttctgtaaagagcgcatgtgggcgcatcagtatcatttctattttttctatccttcagccacaacctttatgccttctgcgggttcccagagattccacatctcccaaaatattgttgcaacggcgtccttgagcatttcgggcgggaaagttttactctgcgaaaacgtcccgatatttgcactgattcgcccatcattgccgcttgttccaatattcattgcgaagaaatcacagtgcattgataaccaaataattctgccacaagtgcaggacgaggggttatgaagggtaatattagttactgccggggcttcaggcatattcatcatgtcacatcctttggtattgagttgaaaacaaaggccggagaaaaccggcctgtttggtgtaagcaaaatcgacgatttattaagcgaaaataaatacctctgatcatctgttaataaaatgcttcgattaagatgtgcccggtagcttaatgtccttcaacatactgaatgcaagcttcatatgatcttcactgacaacaaatgcccgtagtgcaccgtcttcgtcacggccttgagcaattatgcctgccggggatagcgccatttcccaatgataagcagcattcgctggatcgcccgccagctgaagcggcatatccggcgttttaatcttgatcaacatggctggtagcatcagtttggcgttgtggccggtaaggtttttagccagcgtcattgccgcaagggctgctggttgcagatagggcatcggtttcccctgtatttctgcacaatcacccagtgcatagacatcggcaaccgacgtggcaagagtgtcatcaactacaatcccatgacgtgtcttaatcccaccactcttcgccagcgtaagattagggcgtaagccaatggcacacaccacggcgtcaaaggtctttctctgtccgttactgaaacttgcctccagtaaatcattatgccgtgagacctggatgagttcatgcctgaacataaattctaccccgttgttcgttaaacggttttgcagccgagcactgatttccggtggtaacagcgttgaaagaaggctgttacttcgatccattaccgttactgctttaccagcacggttaaaatccattgcgagtttctgtgccgattaggccaccgccgactatcagtatttgatgcgcatcaataagcgctttgtcataccgtcggtattcctgctgactgttcagcgtgaagatcagatcactgccttctatctccggtacgatagcctcggcaccggtggcaagtaccagcttgccatagacgtaatcgcccgcgctggttgtgataatgtgtgcagccgtatcaatgcacgaaactacggtaaaaggatgcagcatgatgttctggctttccgcccagtctgctgctgcttgtcgagtgagtgcctcagcgcgataacccatactgaaaacatgactgagttcgggtttgttatattcatcacagctgtcggcagcaatgatgcgaatcggcacatttttgtccagatgccggatgtttttgaccagatggcgggcggcgaaacctgagccaatcaccacaatgtctgctgacatagactcagccctcgtaaggttcgaacacggatttgcccagcgcgcatccaggacataagaaatcgtctggtacggctttccatgcggttcctggtgcgacatcctgatttggttcgccctcggctgggtcgtaaacccactgacaaaccgtacaaatcattttctgtccgatgttctcacccgcttctactacgccgacgccatcctggtttatgggcacggcggctgccataaccgcagcggcattattcgctgcgacgacggctaccggcagcggcatgagcgcccattcacgggcgattttgcggccatgctcgcggcactcttccagcgcggagaggtcgggacgccacttagttttgagcgcaatcgtcatatcaaaaccggcatcctgcaggcgggtggctacgcgatccactgctccgccggtccagccataagaaccgaacgcggaggcgcgtttattgcggaatttcaggccggtaatctcttccagcatgcccgccaccttcggcatcatcacattgttcatggtggaggaaccgaccagaatgcccttggaacggaagcaggaggtaatgatttcgtttttgtcgtgggtggagacgttgtaaaccttcacggcaacgcgaggatcggtttcgcggatgccctcggcgatagcatccgccatcatgcgggtattgttagacatggtgtcgtagaacagagtgatgcgatcttcctggtaatccgcagcccattgcaggtacagctctataatctgcgttggattatcgcgccacaccacgccgtgcgaggtcgcaatcatactcaccggcaaattaaatccgagtatctcattgatttttggggtaaccagacgtgcaaaaggcgtcagaatgttggaaaaatagcgctgacattggtcaaacagttcgtgttggtcaacttcatcgttaaacagatgttcatcgcaataatgctggccgaaggcgtcattactgaagagcacggcgtccccggtcatgtaagtcatcatgctgtccggccagtgcaacattggggtttcaacaaaaatcagttttttgccgttgccgagatcaagcgaatcaccggttttaaccacgttaaaattccattcaggatggtggtgatgaccattaatggaatcgacaccattagcagtgcagtaaatcggcgtgcctgggatcagcgccagcagtttcggcgagtgcgccagaatggtcttcttcggcatggttaattacgatggcatcgatttttttcagatcaatttcttctgccagatttttaacaaaatcagtgcgaaatttcagatcaacagtatcgatcaggacgttctttgcttcgcgaataaggtagctgttatagctggtgccccgctgcatcttgtactctttgccgtggaagtgctcaacttcccagtcacgtttgccgacccaaaaaatattgttttttacaagaatgttcatttgatgccctgttagcgtaagttggtttcacaccagctttgcatcaaatgtgccagtttttaagttactgatatttgggtgtttacattaacttcattgttaaaattacactggcatattttgtgttaatgacatctaattgttaaaatgacaatacatgtgatataaaaaaaccgccgcagcgggtcagtgatatggctcatttcgatgattccggaatatgaagctcgcgttcaaatccgtcgccttctaatgcaacgtctgggtcagcaaaaaattcaagattgaaataagtgtcatcatttaacaactcaatgcggtgccaggatagcgacgggctgatgccaaactgcccggcgataatggtggtttccatttcgtgttctgtctcgtgttcaccggagaaaccataatatttcaccgcaccgtacataactggaagcctgccatatacgccttttttcgtgttgtgatgtgtcaaaagcgcttgcggcatggtcatactccctagctacattatctaatctgataaggcatattccatgccattactttacacgatgatttgcatcaaacaggcaaaacgggattgtgctaaatacaatgcgtttagttatctttgagacaattcatgtgcaggggacaatatgacgctttctgttgaaacactggcggcgctggctgtcgatattcaaaatggtgtacacggacgcgatcggtttatgcggatgattaacagcatccatggcgcgctaaactgtgatgcgaccgcgctgttacgctacgagaatcagcagtttcgtccgctggccactgcaggtctggcaccggatgtgatgggacggcgattcaatcttgatgttcatccacggcttgaggccatcgcgcgcgctggcgatgtggtgcgctttcccgccgacagcgatttacccgatccctatgatggattgattcccgatcaaggcgatttacacgttcatgcctgtgtcggcatgccactttttatcggacaaacgttgatcggtgccctgacgctggatggcattaatgccactcagtttgatgaatacagcgatgaagagttacgagtgctggcgagcctgatggcgggcgcactgaacaatgccttgctgatggagcgtttagaaaaacccgcctcatcctttacaccgtcaccacaccgacccgaagagaacgaagaggtggaaatcatcggtgattcggcggcgttagcgcacctcaaacagcagattggagtggttgctccttctgatctcagcgtgctgatcatgggcgaaaccggcaccggtaaagagctgattgctcaggctattcaccaacaatctcagcgcgcagcgcggccactggtatatttgaactgtgcagccctgccggaaagcgtggcggagagcgagctgtttggacatgtcaaaggagcgtttacgggtgccattcacgatcggcccggcaaattcgagttggcggacaaaggtacgctatttcttgacgaaatcggagagcttccgctttcgctgcaggccaagcttttacgtgtgctgcagtatggcgatctgcagcgggtgggcgaagataagccacttaccgttgatgtgcgcattatcgccgcaaccaacctcgatatgcgtaaggcggtgaccgatggcaaattcagggctgatctttatcatcgcctaagcgtcttcccgctgtttcgtcccgtcgctgaatgagcgtcgggacgatatcgtgctgttggcgggctatttctgtgaaaagtgtcgggttaaatttggtctgttaagcgttgcgctaagttctggctgccgcgctatgctgcaagccgcgagctggccaggaaatgtgcgcgagctggaacatgccatataccgcgccgtgattatcgcgcaggccgaatcacgcaacggcgaagttattctgcttccgcaacatttccaactggagaataacggggctgttcatgcagaaccgatcaaaacgttgctagcaacgccagcgatgaacctcagcgaggcgacgcgtaaatttcagtacgattacatcaaacaggtctatgaaagctgcgatcgggtgtgggctaaggcggctagaaagctggaattagatccgggtaatcttcatcggctggcagtcaaactgggcctgaagtaaaaaggtagccttaatcgaaaaaaggccaggaaattcctccattctgtagggtaaaacgtttaaatgggtcaaagaaaatgtgacctgcttaccattgcttcacacagaatgttgttcgcaacttccgcactggcactaagcggacattttcctcatcttcagctaacaacctgaaaccgaagcctgcctcgttaaaattaagctggcggccgggaaatatcagatgatgttgtgaactggcactaaggctgaacaaggctgttctgacggtcaatgttaaagccaaacacacaaaaccccagtaaatcttttgcctcatcctccacccgcgtaatcataaccaaatcggtgctaccgccgggcagctttacttcaaacggagggtaaggaagaccttttatcctgaaatcctgcaaccaaagcagcttctcagcttgagacggtatcacttcaaaaatatggcgatgggtaatgtcctgcattggccagccaacccgcgctgcaaaggtatcacttgcgtcaacaatcatcagttcagggcttagaaaacagatagaggtgttaggcgcagcatacatcgatgaaatctgatgcgcgcgctgctcaagagacattcgtgccacacgactatgaaatttacggccagagccagcggtgagaaaattatgtgtttcttcagccgggatcggcctgctgaataagtagccttgtgcataagcgcagccgataccccgcaacatctcagcctgttcctctgtttcaacaccctcagcaatgacgtccatatccaggctgcggcccaaaccgactacgctggagataattttccggctatcctttttctgaagcattgaacgaataaaactgccatcaatcttaatcgtgctggcgggaagctggattagccaggcaaggcttgaacagccggtgccaaagtcatccatagcaatcatacaacccatttcagacaatgcttcgagtttctgcatgagccgtctctatatcatcgatcaatgctgtctcggtgatttctatcctgagccgcgaaaggctgaactgataacgttcagccagttttcttaaaatttcgggaaggtgcttaccgttcagttgcgaaggagaaacgtttatagacagaaactggtgttctggccaggagctcgctgtcatgaatccctgagcggccagacttgtcatcagctcattgagtaacccatgatgttccatagccggaatgaactcagccggagatacgataagcccttcgggcaaaatacgccgtgccagcaattcaaaacccactacgcgctgatcctcaagtgagactatcggctgaaaaaaaggtttaaactcgcccgatttaattagctgctgacaagctgcacgagaatcagcatctttcaatttttcattcatttaaatatcctgaaacgtatttctgtaaggcattgatgacctgagcgggaacggaatagaaacccttttttaaaaccctgttttgtttgcggcggaaaaattgatctttttcagacgtcatttttccggaggccttaaattatctatggctattaagtgcgagacacatagctatgatgtcagtgagcggagaaagttcatgtgcataaaatgccatgcttatttaactcacggatctgcatgaggctgatgatatctgatgtcataaaccagaaacaaattgaaaccaagctataaaaatatcgcttaagttaaatattaaaccctgttaatacatctaatatgatcagcagccagtttctcttatgaattgctgaagtatacctatggatatcaataagtaatgtgcgggttttcgcctgtcagcagaagtgacatgccacagctaaaccactcatttaatatccgcgatagccagctagtataaatccacaatcgcgtgtcaaaactaagagtaacatttcaacgtaaatttcgttgggaatcggagcgtcgggattataaggcctgaaattttccagatatcatagaccaaagataattttgcgccacaggatttcaaaaaaataaatttagcccgctggcggtgaggctcatccatcacctcagctccggtagttgtcgctggcgagctatctatagcatcttgttacggtattaattcaaaccagcgacctttaacttaatatccagaaagttctgccgataaccctttcaggcatatttttatgcctgtatatgctcaccaggagaaataatgctgaatttattccggaaacagtccgccaaagagccgacaacgatggatatcgctgagaaatttatcgatgaaacgatggatgtggatcatagtgatgccacgctgctgaaatgtattatgaacctcagccagaaaggctattggtatgttgagacgaccgatcttaaaagtgacgcgcctgcatttgtttcacctgaagcacgccagcttatgggattgcctctgcagaaggaggtcgggctctcttcgctgatccagatgatccatgcggatttccgggaagcgttcaaaggtttgataagtcatacactcaaacatagcggtgatgaaaagctgttacgctgcctgatcaaaactggcgcaaatacctttcagtggttttgcatccgtgcatcatacagtcgtgaatttacgccgccgcgcctggttgccgttatagagaatacagaagaagaaacgtcacagtcccgcaagtttgatattgtctccacccgttttgacctgtcgcgcgaaatgcttaatgacggcctctgggatctggatattattggcggaaatcccctgaatcccgacaacgtattctggtggtcaccgcagtttcaggaagctgttgggttttgaaaccattgaagagtttcctgatgtgatggacagctgggcatcacgccttcacccggatgacaaacagaatgcgctcgatgctttcgtcagccacctgatggacttcagtggtaaaaccggttttgatattgaatatcgtcttaaactgcgaagtggtgaataccggtggtttcaggcccgcgggcagactaaacgtgcacctgatggtacccctttgcgtgccgtcggtgcgcttattgatattcagggccgtaaagaccgtggcagacatgaggaaagcgaagtcaggcgaaacattcagaccgccgaaaccgcaaaagaaattgccgaactcgtctctgaaaacgggattattgctacgcagatcaaactcatttcactgaacgccagtatcgaagccgcgagagcaggtgtacatggccgtgggttttctgtcatcgccagtgctatccggggattagcagaaagaactgcagatatcaccgggcacatttctcgtcttcagatgcgaataagtaattctgctagcggcatagaaaaatcgcctgaataataaacatcacatattgatgaacgcttatctcaggtaaatacagggatgttctggtgatgagatacgacagcctgtctctgatttactctaaccagaacatcagttcagttctcagtttcaccctatgtaaattctcccggagcgagtacacatttccgtatgcaaacttgctctgggagttactcaccacctcagagcaaatatctgaatagtaagtagcccgcaagctttctcatctgtggttcacatccggaagtgcataacgatagcaatatggtgatgaataacaatcatttttctgccaatgtcagctcctggcactgagcagacagcattgcgcaccaggcaacgttcactctacgttcaccacctcaccagccggcgccttaacggtggaaaaatcaacctgttagcagtccgtttttaccgcaaatatcattttcctgtcatttatcgtctttacgctgtcagctttccctcatggattttaatattatgaaaataaaaacgatttctttgattatcagttgtgcgctctcgttttctggtcttgcggcgcaacctcaggctgagcactatatcgtcagttttccggaaggtacgcgcgtcagctacagcggcgcgttcgccagtgcgtttccggatggtttgccggtgggaatcggctccggtttgctgtttaccggtaagcagggggatgcgctcaccttcgcgaccgtcaccgatcgcgggccgaatgccgactcacccgatgtgggcaagcatgagtcaaaaattttcgtcacgccagacttcgctccgctgctgatgaatattcgggtgcagaaacggcaaagcagaagccacggatgcccgaccgctgcatgacgacaagggcaacattaacggattgccgctacaggatggtgtcatcggctcaaccaatgaagtcgcgttaagcgacacactgaaagtgctgaagggcgataaccgtggtctggatacggaaggcattacgccggacgggaagggcgggtactggttgtgcgacgaatatggcccgtttctgattaacgttgatcaacgcggaaagattctggcgattcacgggccgcaggctaatgaaggggaaaaatccattgcgggcggactgcctaatattcttaagtggcgtcagcctaatcgtggttttgaagggcttacccgtatgccggacgggcgcatcatcgccgcggtgcagagtacgctggatatcaacggtaaaagtaaaaagcaggcgcgctttacccgcctggtgagcttcgatccggcgaccgggaaaaccgcgatgtatggataccctatcgacagccaggcttatagtaaaaacagcgacgccaaaattggcgatatcgtggcgctcgataatcagcatattctcttgattgaacaaggcagcgataaaaacgacgcgatgcgcaaccttatctataaggtggatctcagtgcggctaccgatcttgccgcattcgatcagcctggtgagtatccggaggctgacaacgagaaagcgctggcgcagcgaggcattaagctcgcagctaaaacgctggtggtcgatttacgtcaactcggctggcagcaggagaaggccgaaggactggcgcttatcgacagtaaaaccctggcggtcgccaatgacaatgacttcggcgtgaaaacggtcatgcaaaatccggtggaaggtaagaagcgcaaggattatcggctgaatgaaaagggggaacttactgtagagggtaagccggttgcaacgacgatcggcgtgaagccgctgaagaaaccggagacggacagcgagttatggatcgtaacgctgccggaaccgctgaaataaacgttccccttgccctgggctgtctgcgcttagtgcctgattttctgtaaaagagcaggatacagcccggatttacccgcgaaagatcggtctgcgccgttttgttatagcggccggcagcagaccgatattcgtttaagcagttaaacagctttccaccgcgttgcggcattaagcgtcactggcgaactttaaacgtcagcctggcgtttattttttattttcaatgcgataaccgcttccttctgcatccgagcgctttcgatatcgggcaacccggtcaactacggctcaagtcgccaggttgcagggcgtgattataacattgtgtaataatatgttatctgcctcttcaacagatactcaccaccgtgtaagttctggggtctcatacgcttgttgtccccgtaatccgctgaggagaaagagagtgaaagcaaccgcaatggccgctacaagtctgttaatgctgatgagcagtgttcacgctgaaggtctgacgacgtcagcagatggtaaaaacctcgccgtcagcttcggccagcccaccatcaaacaggtgctgcactaccgaaaaatgtatgacaaaaagccgtttccggatgcggagatttattattacgacaacggtacctataaaatcatttctcagggcgaaaaccactacggtgtttacgtcatgcagggcaagtttgatgatgaaactttcacggtgcgttttatctctctgccttctgctgactggggcaataaaacggcttttcatcagttaacttttatcaggggtgacgagcagaaacgtctttattcagaatgccattgtggataccggtgaagccattgcgcagcagaacggcacctatactcaggaaaaaaacaccgtaaccaacccggtctctaccagctggaaaaacaaataattgtcgggtggcagcgtgtctgccactctgatttaaacccgatgcctgccacgttcctcgtgcaggatcatattgagttttggctggcggacacctccacacactgattttttactcagaagatgcatagccgcaattaaatgccttatatttcatagcctgatgtacatttgccttgcagcgcccacgccagcagtgtgagtgcgctgcaacatgcagtaccggtaatctgcctgtgaagggtaactcctgctttttttgatactgccaacactcaatttgtcaggtcctgaggcgcaaatatggacagagtttcactcctgctggatgtgcaggatgtcgctttttcagtcggggataggcagctactgaaaccggtctccctgcagttatatcagggtgattgcgtcttgctgaccggcccatccggaagcggaaaaagtaccttcctcaaaatccttgcttcgctgattacccccacctccgggcaacttttcttcaggaacagtgatatcaccacgctgagagcagaggcctatcgccagcaggtctcgtactgttttcagacgccgcaactgtttggtcagacggtatatgacaacctggcgctgccatggcagattcgacgtcagaaacctcagcgggacaaacttgttgctgcgctggaaagcgtaaatctctctccggatatgctgaataaacctgttgaacaactatcaggcggagaaaagcagcgtgtcggactactgcgcaatctgcagtttatgcctgaggtactgttactggatgaagtcaccagcgcacttgatgaagagaacagactatcagtactttcactgattaaccggatctcagctgaagaaaaggtagccgtggtgcggattagccatgacgttaacgatatccagcaggctgagcaggtgcttcggcttgagccgccagaaaaggagaataagcgtgaatcagcataatatcagtgacacctctctattgctgtcactgacgctggtggctatagcgctgcttatcagccagaaagaaaagctcggcatgagcaaagatattctctggagtgtattccgggcgataattcagctggtgattgtcggctttgtattgaagtcgatcttcgatgttaataacagctggctgacggtactgatggtgctgtttatctgcgttaatgccgcgatcaacgcccgtaaacgcggtcgaaatattgataacgcttttacgatatcgtttgttgctatttttagtggcaccgttatcacgctgacgattctggtgctgagcggggcgatagcgtttgttccgatgcaggtcatccccatcacgggcatgatcgccggtaatgctatggtcgcagtagggctctgttacagcaacctgaaccagcgcttcagcgacaaccagcagaaaattatggagatgctgagccttggcgcatcggtgaagctggcatcgggccgcattattgccgacagcattcgtacagccatgatgccgacggtggacgctgccaaaactgtcggactggtcagcctgccagggatgatgtccggactgattttcgccggaatagatccgctcaaggcgattaagtatcagattatggtcacgtttatgctaatagggaccgccagtctgtcaacgatcattgcggtctatttatcctatcgtcgtttttataatgccagggcgcagctaaaaatatcggatagatcgctggattagcgaaactgattggcggatctgaaggttatagctggtgaggaaagtaagtctgctatcacacggcgctctgttgctcgcgagcgcttaattgatagcagagtgctcaggggatgcttcaaaaacactccccgctgaatctgaaatatcccggcagggttcgtgctttgactgttcatctggatgcctgatacacaactggctttggtttttaattctgcctgtttctgataaaggtcccagcggttgccgtacagatcttcaaaaaccaccacggttccgtactcctcttcacgaggctcctgggagaatgtaacgcctttcgatttcatggctttatagtctcgccagaagtcatccgtctgcagaaaaaggaatactcttccgccgcactgattgccgataaaaccttcctgtctgttatttgaagcgcgagccagaagaagattgcaatcgctttcagggtcaggtgtaactacaacccagcgtttacctggctgcggtgtatcctcaacaagggtaaaacccagcttttcggtgtaatactcaattgcccgatcatagtcatcaaccacgatggccacatatcccatacatcgcttttgcgttctcatttctgctccgtcatgtttcaggcctggttgccttgaaacattgttttaacacaaacgagtatcccggagttggttgaattgattcagtcttcacagtattaagccgttgcaataaagatacatcagctgacatcagcctataatttttataaattcatggcgcgggtatcaaaaaatgtttgagggatttactcatacacaaatcagactttctgaagcagtgctaaatgttcgctatggaggtaatggtcctccggttttgctgttgcatggacacccccgcacccacgtaacctggtcaaaggtggctccgcaacttgccgaatcttttaccgtggtttgtcccgatttaaggggatttggccgctcatctaaacctgcagatgagcccaatcatgctggttcttctaagcgagctaaagcgaaagattgtattgagttgatgagccagttaggtttcgatcaattcgcgctggtgggacatgacagaggtagttatacagcatatagggctgcacttgattaccctgagcgaattacacgacttgctgtactggattgtatacccatacttgaagcgctcaaccggtgtaatgagaagtttgcccgacagtggtatcactggttcttcttcgctcagcctgaaaaacccgagctggcaattttagccgatccggacaaatggtatggaggccagcccgaaacaatggggaatgatgaatacattgaattcaggcgagctatacacgatccggagactgtacatgggatgatcgaggattatcgtgccggtcttactatagacaaagagcatgagctttatgatcgtcagaatgggcgattgattgaatgcccgacactctgtttatggtcaaaatatgatgatctggaagatatttacggtgatgtattgggtatctggaaatcctgggcaccgcatgttcggggtaaagcgatagccagcggtcaccatatggctgaagaagcaccagaagaagttaccactgagctccggcattttttgttgcatgagaatccttaactggccggtgcgtagttaaataacatcccattatccaccccagagaatgaatcgctgtccctgcattgtcatgttatggtaaaaacacttcaacaacatgaggatagcaacatgattgtcagaacatggcacggatgcgtaccggtcaggcacgccgaaggttttgcaactcacttgcagaaaaccggtgttgaacattcagaagcgacgccagggaatctgggagcctatgtacgcagagaaacgcagggcgaatgggagcatttcttccttgcgacgtactgggaagatttagaagctataaaagcctttgcaggcgaacagtatcagattgccgttacctatccggatgatgaacaatatgagttgctatcagatccctacgtttttcagcatcaggtccagactgtaatcccattataagtatttgcctgccgccgccagaaggcggccaatgactcacctgaacctgtccgctgactcagtattaaattttaccaggcgaaaagcatgacttttaacacaaggtttagataaagccttttaattgtagattgatcgatctacaataaatcgtcagcacaggagaaccttatgaaagcatcagcaggcagacccagagaattcgatccagagacgtttcctcaacaccgcacttgaatgcttctggcagaagggatatcaggcaacatctatggctgatcttatgaaagcatcaggtcttgcaagtgccagcatctataaactttatcccgataagcgtgctatctacctggctgctttgcagagatacatggatgaaggcatttcaaggacagtgaaacgaaatgcagaaatgtcgccagaagctgccttgcgagaaacgctcgaatttgtggctcagttatcatctgctcctgccggagagaaagggtgctttactattgcggcagccagcgagcttttacccggagacgaagaggttaaaggcaaagtttcctttaaatttaaccatttaattaacgagttagagaacatcttaaaaagaggccaggagcagcgggtatttcgccaggatgaagatgcgcgagtcatggctcaaagcattttcatgatgatggaaggtatgcggatatatggaaaactccagccagagattggagatctgagaaaaagtaatgacttcattgtcagaacgatactttcagatacccatgacgtaaccggcaatagtgcggttaaggcatccgcatgattgaagtgggcaccattgttcggcgaaaaaaaagaagaagaataatggtggtaattgaatattcagatggcatggcattgtgcggctgggtcgataaaggacgttttttcaaaaggcgttttccactgtctgaattaaaaataggcgtgccttattcaaatttctggtcactcacctaaatcattgcacctttaaagacatctggttcaaataaatataattagcataaccggctgcccttaattcaccgtgcttttgtgagtcaacagactcaggatgggtatcactcagcgatcaccggacatcatcaatgcccggtaatcagttgatttacatcggtgctacaacctcagcttatttttgagactgctgattttgctcagcctctttctgttttttcttcgccatatgatgaccgactgcgcagcccgctgcggcaccggccacaccatgatgagcaacatgacctgcgacgccgcctactgcggctcccttaagacagccctgggcattagcctgtaaattcaccgacaaaaacagtccggtagcaataacgataactgataattttttcatcacttaatatcctgatagttagttatagttgcaggttgaacccgacagagcatagccgcactctggggtgtttcgctggccgggatacaggaatcacgacattagttacctgtcgttacgctttccagacggaatgtgagtatttaatgccatacccgtgagccagatacttcccagctcgttaagcggcagccagagattagcactgagaagataaatcggggggagtgtaaacaggaggtttttcgacgaagacgaaaaaacagcgcttccaccgggaagcgctgctgcagatcagaaggacattgtcagcccggcataataagcgcgtcccggttcgttataggttgatgcaccatcagcttcgcgatatagctgcttatccagcaggttattaatcccggcattggcacgcagatttttggtgatgtcataattaaaattgaccccaaatactgaataagcgccgacttcgcgattcgacattgaattgctttctgtgcgggattccgcatactggcgtggtttctgacggccatacatcgtccagttcagattagtggagaaatcctgcgtcacctgccagtccagcatcgtattgatcgtgtattcaggaataatcgacagcggattgccggtctttttatccttcgactcgatcatataagttgcgttagtccgccactccagctcgtcactgaccagcgggatagtgaaattgccttccagaccttccactaccgctttgccgccgttactccattgcaggatattgttaccattagaggcgtaacccagcacctccgtcccggagacgattttgtttttatagtcattgcggaaccaggtgatacccgcaacatagccatcctggctgaactcgatacccagctctttatttacgctgacttcaggatcgagattttcattgcccagcagatagcaactgccacgggtaacgttgatcggacagccatttccccgcgtcgccagtaaatagccttcgctggactgataaaggttaggggctttaaacgcacgggcgatacccgctttcagggtaaaactttctcccagagcctgagaaatattgagcgacggactccagttcgcaccaaaggtgtcgtgataatcaaaacgcagaccggggatcacttcagtgctatcggttgcagcaatattatcttcaaaatagagtgagcttagcgttgcgctgtttttactgttgcggctgcccgcatcaccactgacaccgtcgatggatacgccaggcgcactggtgccgttcattgaatttggatcgttcagctcatcacggttccactcggctcccagcgtaacggtctgctcacgcagcagtttccagcgggaagctgacttcacctccggcccggtaactttcaaagcgactggttgagaacgtgttgctgttgatccggccttcacccgcacccgccgtgccttcattcaggcgggtgttattggttttttcatagttaaaggtgagcttagattgtccccagtcccagatgccattatgcgcaaggccccaggtctgacgatacagacggttggtttctgaaccatcgagagattcgattaaagcattaccggcaccgttactgtactgggtatcaccggcgtagatgttgccctgacggctatatccgtagctgaaatccagcacctgtaatggcgtgatcttccaggacagtacgctgttgatgtctttattgcgaacaccttcgcgaccggcggcggcagaaccattgtgcgactggttaatgtcgaaagcatcgctgtcggttttgttgatgttgccatagagccgcatggtcagagcatcgcccgccagcggaccactcaggttaaagttagcgcggcgggttgcgccttctttatcatcttccggctggttagtgtagagcgacagcgatccgctccagtcattggtcgggcgtttggtaatgatattaaccacgccaccggccgcgccggaaccgtaacgcgctgccgccggtccacgaatcacttcaatccgttcaaccatctctggtggtacccagtttgagtcaccgcgggaatcgcgctcgccacgccagctataacgcaccgaattgcgcgaggtggtcggcacaccatcaatcagaatcagcgtattttccggccccatgccgcgaatatcgatctgacgattgttgccacgtacgccattggcgctgttgccagtaaggttaacgcctggcattttacggataatgtcggaaaggtcgttgaccggcgggtttttctcaatgtcctgcgacgtgatcaccgaaacgccaggctgctgtttaagctcctgttcagcggtgaccagcatcgtctcatcatcagccagcttttctgtctcttcctgattagcgccgttagcagaggtactcaataaaccggccagcagtagcgcaacagggcgcttatggacacgcatggttacattcacttagaaaatctccctgaagtattaaggtatgtaagcaaatgcgtatgataatgataatagttatcattgtatatcgcggtaagccacctttacattccataacaatgggctatttattcgccataaccgtgaccagaagagagaagtgacgttagttttacttgttggtccatcacccgaaaacttcctcagatttcatcagaacgcgtctttatgactccagacttattaggtctggagtcatagataaacaatggatagaatggcccgctctgcagtgacaaacaggtataaatgtgaccccagatctgacacagatccctgcgcgttcagcccacgtaggccgccatgtactgatctggctggagcaggttaaaaaggcttcactcagcgagctggataattttggcgatgaaggctcggtagagcaggtgatgaaggtctgggtaaaactctcgctgctgatcagtcggcggcgtcctgagatcgccatctcctcattgctgaaacatgtcctgccgaacatcggttcgcagccactcaaaacgctgaaccgcttacgccttaaccggctctataacattctgatcgccgacggtaaaaaagaggaggcgcggcgggtgttcgcgctgaccaaacaatttctcgcctgggcagagatgcagggctatctcgatcattcacccatcgcttcaatgaaaaagcgtgatgtcgcgggtcgcgctacgccgccgcgcagtcggcaacttaccgatgcagaaatctgggtgttctggcacgggctggataactgggcactctcggaacaggcgcgctgggcgctgcgtttatgcctggtcagcgcccggcggccggatgaaattgtgcaggcgcagaaagcggagttcgatctgcaattaggattgtggatgcagggtacgcgcaataaatcgcagcgggagcatgtgctgcccatttcaccgctgatgcgtcagtgcatcgaagcactgctgcgcgccgccgatccggcctcaccctggctggtgcccgcgccacgcgatccgcaacagccgctgtcaaaaggcgcgctgaatcaggcacttcgccggatgatccgcgctccccgtgggctgggactggaggcgtttaccccgcgcgatctgcgcaggactgcacgttcaaaactctcagcgctcgacacgcctaatgacgtcgcccgaaaaatcatgaaccatgcgctggaaggaatcgatcgggtctatgacacccatgactatctgagccagatgcgcagcgccatgactatcttttcggacgcggttgagcagattattgaatgcgaaagctaccatctgctgcgtcatcgctatgatggcgaaaccctcacgctggacgatctctcgctcatggcgatgtcacgctaacgcttatatcggcaactgtcagaagtggtagcgcagccaggcaaaatagacgttaccgttgttatgggtgccgggaatataggtcatctggaaatcgagatcgccatagccgacagaggccagcggcagtagcgcaggcaccggaatataatcccagttgtgccgtgcggtaaagcccgccgtgtaacccgcaccccagtgaaaattctggtcggccagcggacgccaggttgccacccagccatagccaccaaagggttcccatttattaaaggagtccttaaacgccattaagtagatgccgttccagttccctttttcatcgtagcgggagatacctccgcccgcgccccagggtctttcattatatttattgatatgttcacgatcgtaagtggcacggttgtgccaggtaatcgcgggcagataaaagtcgtaaccttcaggctgctgccaggttgtggcgactttatcactgaaattatcccagcccgcactcacggtctccacaagtgtggcggagtgggctgaaaaaacactgaaaacggtggtcgttatcagcgctttaagcattgaaattttgcgcacgtacgaattcctgcaatatctggtgttaaataaggtgataaaagatttaaggcggatattgtggcatcaggagtgacaactacagttcaatgaacggccattacaggattttatctttaacaaataatgatgcagcagccctgttgctctgacaagtcagcaggcgtgctgaccctataaacgcctccctgtctttatcatcttccagccgtctttcacacgcagacaattccctgaaaaaattcgtattgtttgctaacaaaatcttgcaatgataatcgcaatgcgtatatttctcatttgttttataagttcatcacacccgcgcgcaggcgctcagggaaaggtttctggttcctcaaaccataagcagggcagcgatgtccgcaggaagcatggtcgtgacagtggcagcataaaaacataaagataattgaggaattaatgaacgctttcgatcttcaacaccccagggcaacggacacttctgctctgcaacgtccattccgcttctccttgctggctgtcatcgtcgcctcgtcgctggcgcataacgctgctcatgccgcagagaccggcgcacccgctgccagcgataaccagactatgacggtcagcgcgtcagccgatgatgccgtagccgcttcgcccgccactgattacagcgtaccggttacccgtgcgggcactaaaatgctgggcaccgtacgtgatgtcccgcagtcagtcagcatcgtcagtaagcagcgtatggccgatcagcaactccagtcgctgaatgatgtgctcgcaaataccaccggtattcgcggtatcagtggtgatatggatcgcaccaactactatgcgcgcggctttatgatcgacaactacatggtcgatggtattcctactgcctttgccgctcgctggaacctgggcgatgcgcagaccgatatggcaatgtatgagcgcgttgaagtggtgcgcggagcgaccggtctgttaaccggaccgggcaatccatcagctgccatcaatatggtgcgcaaacacgccgacagcaaagagttcggcggcactgtctccgccagttacggcagctggaataagcagcgttacgtggccgatctctcggctccgctcagtgactccggcaatgttcgtggccggctgatcgcgggctggcaggataacaacagcttcatagagcgctacggcgccaaaaaacagtttatctatggcgtggttgacgctgacctgaccgactctgccacgctttcggtcggctatgaattcagccaggtcaatacggattccactatgtggggtggcgcaccgcgctggtacacagacggcacgcagatacatacccgacgcggctacaacaccgcacctgactgggcctacaacgataaagagaaccgtaaagtctttgtgaacctgaaacaggacttcgacaacggctggaacatcacactgaacggcgcgcacaacgagatgcgcctcgacagtaagcagatctatcttgatggctatttcgatcgtaacaccggggcgggcgtctcttcctatgccaactatccggtggtaggcgggactggttacaacaccggtaaacgcaaagtggatgccgttgatgccttcgccagcggtccttatgaactgctgggtcgtcagcatgagctgatggtcggcgtcaattacacccgccaggataacaagtacttcagtacctttgagaatatctcatcggagtcgctgggcaactacaacgagtttaacggtcagtatccggaatcagcctggacgccgcgtctgccagccagcgatacccaactggttcgccagaaatcgacttatatggcgacccgtctgtcgctcgccgatccgctgcacctgattatcggtgcccgttacaccaactggaaccgtgaaacgcctggtggtgaaatggaagaaaataacaccaccccttacggcggattgatttatgacttcgctgaaaactggtcggcttacgccagctatacctcggtgttccagccacaggactatcgcgatgccagcggcgctttcctgtcgcccgttatcggcaaaaactacgaggcaggcctgaaatctgactggatggatagtcgcttcacaacctcgatttcggtgttccgcaccgagctgaataatgtcggtgaagcaaccactcagacggttcaggggtcaggtgatgtcgcgtacattggccgtaaaggcgtggtgagtcgtggcgtggagtttgaagtcaacggcgcattaaccgacaactggcagatgaccctgggcggcacgcgctacattgcggaaaaccgcgatggcagcacctttaacccgcaactgccgcagaccagctttaacctgttcagcagctatcgcctgccgacgttgcagcagctgacgctgggtggcggtgtgaactggcagacacatatctggaatgatgtcggtggcccggaaggcaatggcacctggcgtgcccgtcagggcagctatgcgctggttgatctcttcgcccgttatcaggtgaacaaaaatctgtcgctgcagggcaacctcaataacctcttcgacaaagagtatgacactaacgtggccagctccgtagtctacggcgaaccgcgtaatttctcagtgaccgccagctacactttctgatttgtgtcgttgtaaagcctgtgaaaaacgcctcacttgaggcgtttttcatcacctcctgaatctgcactcaggtaaaacgcagtgccaggttaaaaccttctgccgactccaccacaatcgcctcgggctgctcctgaaaggcaatttcacccttcaccagcgcgcgtttcaccaggtcgagatcttccgtctcaaaacccagcgcaaccatgcgggcgctgccatcatagtcttccggcagcgggccaaatcgctgctgcgcatagtctgccgaagcaaaacgaaccgtggcagcacccgcgcgcaggacaaaggcgccttcgggacaggcgagcaccttagcggccccaaacaggcggctatagaccagcgctgaaagcgccggatcctgcgcgacaatcacaaactcactgatattacgcacgccattggggtgacgctgccatgccggctgccataccgcttcgggcgtcagatgctggcaaaaaaagctgcggccattgggtaacagcgaagggcgaatccgtacggtccgaaagtgcgcttcactcaccgaaaccgtcgggcagggtgaccggacggtgaaaggccgctggcggatcgccatccagatcctgccgttgcagatgctgaaactcactctctgcatcgctgcttttccacaccagaccgctcaatcccagcggcgattgccagagatcggcgcgctggctccctttgcccgtctcatagcccagcagttccaggtagttctcaccaaaaatagccaggtgattactcgatcccagagagtgatgaccccgttcagtgagctgaaagccgagccttcggaagcgcgcgctggcgctgtcgagctggtcggccacgttaatcacagcatgatcaagaatcggttgtggaacctgaactgacatagcagcactcctttttttcgtcattgcgccgccacaatctgcaacgcgcgcggcaccagctgcgtgaagtagtccaccgccgggccaatcaacgcttcatcaggatcgaaggcggcgtgatgcagaccaaattcgctggcactgccgatgctgacaaacgcccccggcacctgctgcagatagaaggcaaaatcttctccgcccatctgcggcgactcagcgtgctccgcgagatagccactctgttgggcaacgtccagcgcaacatccacccagcctggcgtgttaatcagggccggcggtccttcagtccactccagttcggcggtcgcaccaaacccggcggcaataccctgaatcagggatcgcatgcggtgcgggatctgcgcccggatttcgccgttgtgggtgcgcacggtgccctccagctcaacgctttgtggcagcacgttccaggtattaccggcggtaaagcgcgtcacgctcagcaccaccgtttccagcgagctgaacacccggctcggcagggtctgcagagccgttacgatatggctggcaatcacaatcgaatcgatgccctcctgcggtcgtgcggcatgggcgcctttgccctcaatgcggataacaaagcggtctacgttggcataaaacgcacccgcccgactacgcagcgtgcccagcggcaggtcgggcgcgttgtgcaggccgaatatcgcctgaacgccttccagcgcaccggtatcaatcagctgacgtgcgccattaaaggtctcttcagcgggctgaaacagaatccgtacccggccttgcagcgtgtcttcctgctgtttcagctgcaacgccacgccgagcatcacggcgctgtgaacgtcgtgaccacaggcgtgcatcacgcccggctgctgtgatcgccacgggcgttcggtggtttcttcaatcggtaacgcatcgatatccgcgcgcagggcgatcaggggttcgccatgaccgatttcagccacgacgccggttttcagccccagcggcaacagccggattccggcctgctccagccagcgggtaatacgttccgtggtggcaaattcatgattcgaaagttccggatgctgatgcagttcgcgacgccactgcaccagttggtcggttaaaggcaaagtcatgattatccctgttgttccggcagaaaaggttcgcccagcgtcagcatcaggcgattagcccaggcaaaaaaggcggttgattgaatcagatcgagcagggcgagcgtatccagaccctgttcacgcagtgcagagagctgggactgtgtcggctgggcaggggtcagcgacagtgctgctgagaatgcgatgatcgcctgccagcgcgcggtgtgtccgtgagataacaccgcgccgggtgcgacattcagcagcttctgtaccgcttcatcctgctttgagagctggctggctttacgcgcatggactgaggcgcagtaaatgcagccgttgaccttactcaccacggtggcagccagttcgcgctcggcgcgtggcagccctcctgcggtataaaaaatgcctttatcggtcagggtgcgctgttccagcaacggcagattgcgcgccagcaggcgaaaatagtcggagtcggtgtgaccgaattttgccagtgtcgcctgctcttcctcgctgaattccgtcagcggttttgccggcagccagggctcccagccgagttcctgttgcgtaaacgcggtcagggcagatttgccgctggcggtatgtaaggcctcgtgccagtgaccggcgactaccggggcaacctcacccgacgcctcatcgccctgtaagctgcgcagacctgccagcaaccggctctgaaaactgacaaatgccaccagctgtgccagtgtgacaatgccgcgcaggttccagcccgcctgtttcaaagcctccagatgcgcgggagcagcagtaaccggctcaaaggtcaggcgatgggcaaaagcctgtgccgcgttgatccgaacactcccggccagactctcctgtggctggtagtgcgcctgcaggccgggttgtgcatgccagcctgcaacctgagcggccagcagacggcgctccgccagcggaaaatcttcatcaccctggctaaacaacagggtgtagctaccctgagcatgttgtgtggcggcgtgacgtgtctggcgcgcatgggccagttcggaatcgggatcgatatctgccagtgtggcaatcaaatcgtcaggttgattcatgaaattctcctgtgaggttcgccagcggcacgaagcgcgggcgcaagatgttgggcaatcagttcaatcgagcgcagcgtgtcggcatgcgaaggctcaaccgaatgcacctgaaatgagatgtcagtgacgcgcgccagtgcgctgtcctgcgccagcgagtgctgcacctgatcgatgccgccaacatgggcatcaaactgcgccagcaggtcatcaaagcgttcaccgcgtaattcaccacgatactgcgcagcctgctgacgaattcccggttcagctacctgacgggcatagcggtcagaatcggccacgaatgcggtacgggaggcgaggatgcgcggagtggttcccgcaggaagtgccgcaagataggcatcgatcagcggattctgcaatgcatccagcggcagctcaggctggcccgccgggcgcggctgggtgcgggacagcatcaggccatggccgccctgagcggcacggattgcgccctcaaccgagaaggtggcgatccacacccgtccggcaagctgcggcgcggcgggatagagatgattatcaggatgccccagtgaatccccgcgccaggcgctgagcagcgtatgcagatggtcggcaaaagcggcaccgcgctcggtaaaggtcagaccaaacggcaaaaacgaatccggcgtgccaccggagcccagcccgatctccagccgcccatctgccagcagatccagtactgcggcatcttcagccacccgcagcgcattttccatcggcagggtgatgatggcggtgccgagccggatggtgcgggtctgcgcggcgacatgcgccaggaagagcagcggcgacggcagacccccctcatcctgatgaaaatggtgctgagcaatccacgcattatcaaatccgcagcgttcggcatgctggatctgttcggtggccagctgatagcgctgtttcgccggcaccttatccagcagccgggtaaaaaatccgagacgtcggctcatgctgactccttgtgggttaagggaataagcggaggaatggcagccattaattcccgggtataaggatgctgtggcgcactgaaaatcgtgacaacgtcaccttgctctgcgacttcgcccgcttttaacaccgtgacgctgtcggcaatctgccgcaccgtcgccaggtcgtgcgtgataaacagataggtcagacccagtttcggcctggagctgctgtaacaggtcgaggatttgcgcctgcaccgtgacatccagcgccgaggttgcctcatccagtaccagaatctccggcttgcagatcagtgcccgggcaagagccacacgctgccgctgaccgccggaaagttcgtgaggatgacgtgacagaagagagagcggcagcgccacccgcgtggtcatcgcttctacgcgctcacggcgctgactgcggctcagccgctcaaaattacgcagtggctcttcgataattgcatacagcgtctgacgcggatcgagcgaggcaaacgggttttgatagacaaactggatcttccgccgcagctgacgcagcgcctcgccgcgtaatccgttgaccacgatgccatccagcgtaacctcgccgctgtcggcggtttcaaaacccataacgatgcgcgccagcgtggttttgcctgagccggattcgcctaccagtgcatgcgtagtgccgcgcgcaacctgaaagctgacctggttcagcgcctgcaaacgctgctgtttgcccagcgaaaagcttttcatcacgccggttgcccggatggcgggcgcagaaaaacgggaggccgcagatttaactctggcgggtcgctgtggagccgcatcattcagtaactgacgggtataaggatgagcaggcgcgctgataacctgttcagtgcggcccgattcctgaatctcgccgtgacgaaacacgataatacgatctgcgcgttgcgccgccagcgccaggtcgtgggtgacaaacagcacggcggtgcgggattcctgccgcaggttgtccagcagatcgagaatgcgcttttgcaccgtgacatccagcgcgctggtcggctcatccgcaataatgatctccggctgcagggcgagggcaatggcgatcaatacccgctgcttcatgccgcccgacagctgatgcggatactgcttaacccgctgttccggatggctgaggccgacgcgattcagcaggtcaatcacccgctgctggcgctgcgctgacggtaatttcaggtgcagtcgcaggatctcttccacctgttcgccgaccgttttgaccgggttcagggaattaccgggatcctgcggcaccagactgatgcgcgccccgcgcagcgtatcgaagcgcttttgcgaccactgactgatatccacgccgttgagcagtatttcacctccttcgcggcggccattttccgccatcagacccattatcgcctgtgcggtggtggttttaccggagccggactccccgaccagcgccaccatctcaccgggctgcagctcgaagctgacgttatgtaccaccggctgccaacggttgccgctgcgatagcttagcgtcagattgttgaccgcgagtaacggctgagcgctcattggcgtcctcctgaaagttgctggctgatgcggttggctgcgagcaccacagcgaccaccaccacaccaggaaaagtggtcagccaccaggcggtagccagataattacgcccttcagcgattaacagaccccattccggcaccggcggtggggtgccgtagccgaggaagctcaaagtcgacagcgccagaatcgcctgaccaaattgcagggcggcataggcgatcaccggcgtcagcgcattgggcagaatgtgacgccacagcacgctgaaaaagcggccgccactgccgtaagccgcttcgacatactcgctgtgacggatgcgcaccacttcggcgcgtgccagtcgggcgaagctggcgatggaggcgatgcccactgctaatgcggcattcagggtgccgaagccgagtaaaatcagcacgctcagagagagcagcagcgccggaatcgccagcaggacatccactgcgcgcatcacaattgattcagttttgccaccgatagaccctgccaccagacccagcgcggtacctgccagcagtccgatcgccaccgccatgacggcggcggagagcgaatgggacgcgccgtaaacgatgcgggcaaagagatcgcggccgagctgatcggtgccgagccagtgtccggcctgcggtgcgagtcgctgtgcacccgcaacgccttcaatcgggctggcctgggtaaagagggccgggaaacagggccgccagtacggccagcagcatgactgaaacggcaagccacaggcccggcgaaaactgtaaagtgcgcctctttgccgccacgggttgccgcgcggcagcgtaatcaaccagactcatgttgcacctcgtaacagctgtaagcgcgggtcaaacagcggcatcagcagatccaccagcaggttgatcaccacaaaacccagcgcggagatcatcaccaccgcctgcaataccgccacatcctgattgttcaccgcctgctgcgtcagctgtcccagaccgcccaggccaaacaccgtttcggtaatcagcgcaccggcaatcagttctcccagcagcaggcccgccacggtgagcaccggcagcatggcgttgcgcaggatgtgccgccacagcacatagtgctcgctggcccctttggcgcgcgccaccgccacaaaaggccgggttgcaacctcatcgatgctgcgcaacagaatctgagccagcggcgctgagatcggcacggcgaccgtaataatgggcagaatcagtccctgccacggtgagggattgattaccgggatccagcgcagctggaatgagaagagctgaatcagggctatgccgagccagaaggtcggcactgagataaacagcgcgggcagtgactgcagcagattacgcaggccgcgcagggcaggcagccgcgacagtgtcgccagcacgaatgccagcagtgtcgccagcaaaaagccgcacagggccagtcgcagcgtgccaggcagattgctggtcagcagttcactgaccggcacgcccgcctgcaccgaatagccgaagtcgccgtgcagcatcgccgccagcgtgtgcagatattgctgccacagcgggctgtccgcgccataggcctgacgcatctcagcaatctgctgcggactcaggccgagatccggattctgaaacttgatcaggaccgcatcgcctggcagcacctgtagcagcacaaacgacagggtaaacgcggcccacagcaccaatacccccaggccagcacgttgcagcagataatgacgcatcctcacctccggttactgtttttccagccaggcgccatagagtgccggacggcctaccgcttcaaaactgacccctttcagccagggcgcaccggcatagacctgcggctcttcgaagatcggaatcacataggcctggtccagcagataccgctgaacgtcaccggtcagctgtaatcgttttgccgggtcaacttcagcggagatggcgaccagcagctggttcagcttgtcatcacggaagtttttcactttgtcgctggagccgcctttctgcagcaggttgtcgcggttagccgggtagaagctgcttttgatcacgtcgggatcggcgcggccgacttcggtgacgttcagcggggtcttaagggggtcgagattatccagcgttttgctgccggcatcgcccgctttaacgctgagggcgacgcccgcctggcgccactgctgtgccaccagttgcagcacctctttgttttgcggctgcggcagtgattcatagacggttagcgccagtcgctggcctgctttttcacggatgccatcggcacccggttgccagcccgcctggtccagcaatgccttcgcttttgtcagatcaaaagtgagtttgtccgccagattgacgtagccggcggcggtggtggccacgaccgaggttgcctgcggatagttcggcgagaagagcgtctcaaccacctgtttggcattggtggcgtgcagcagagcctgacgcacccggatatcgctgaccagcggattatccggacggaagctgaggctgtcgtttacaccacgggtcggcgcggcataaaccgggaagttctgatctttagcttgcttctcgtcgtaggcctgcacctggcggatcaggcctgcctggcccgccagcagtgcaccgatgcgcacgctgtcttctggcgtcacgatcacttttatcgcatccagattggccggaccttgctgctgaatgtttttcggtccccactgataatctttacgcgctaccagatccacctcccgaccgagcttctcatcactgaccacaaacggaccggagccgataatgtgacgggcatcgcccagctgatcgaaactgcgcgccagggtactcagtgagaccaggccagagccaatggtggcggtgccctgcaaaaatccgggtgagggctttttaaaatagaatttcaccgtcagcgggtcgatcacttcgctgcgttcatagttattaatcacttctgataccggcaggcgcagcgctttatttcccagcccgtaggtatcaaagtttttcgccaccgcgttcgcatctaatggtgtgccatcggaaaaagtcacgccaggccgtaatttaaaggtgtattcagttttgtctgcgttggtagtccagctttccgcaatccagggttcaacctgcagcgtttcgggattctgccaggttaatttatcggtgatctgattgagaatgccgccattagggtaaaagccaccggcaggcggatagaggttggtatgtgcctgctgttcaagataaatcagcgtaccgcctttgaccggtgcagccaccgcgttaaaggtcagcgtcccggcaagtaaagtaaaaaccagcgtttgtgcgcgtggtttaaggggaaataacgtcttcatggtgaattcctttgttatcaattgcctcagcaggcggaatcatcatcgaatgacgcaacacacagataaagtaacgatttggtcaaagcttatctgaaaaaaataaatgcgggattgggcgggatgtaatctctttatttcagttgcaggatggcaaataaatttctgccatcctgccgggttatattttatcaacggcacacagcggattcataagggtccgctattccgtgcacaatttccgctggtctgctcgtagaaaagcgctgaccagaaccagccacagcagaccgcagatcaggttcaccacactgaagccgccggtgccgtaactaaaatacgcggttttggctgcttcaatgcccagcgcgatgatcagaatactcaccatgccgagcatcgctgccacgctgccttttccggcgctgctggaaaaaagcgtcatgcgataaagtccggcactgaccagcccggcaccgaaaccgtagaggctaattccggcagtcagccacagatagctttgcggatttagcacggtagcggttactgcgattgccagcccgcagaccaccggccaggcaccgagccgtaacggctgttcaatgggcagacggctggataagcgtcccagcgtcaggttgcccgcaatcatggcggcgaagaccggcagctgtaacaacgcatagccgatgcggctgagtcccgcatcgtgaattaaaatcaccggcgacaatgcgacccatgcgatgcagggcacagtgaccagtccgatggctagcgagccgcgcatcacctgacgatccttcagcaacgccgcgtaaccgctgataatcgatcgcagcgacagcggtttctgccggtcgcctgcggtttcgggcatcgcaaaccacagacccgccagcgccagcgccgcaatagcgccaatcagccagaacagggtgcgccattcacccacagtaagaaaagccgcgcccgccagcggaccggccagcggggccagcagggcgacgttggccatcagcgccatcattttgatactgagcgattccgtaaaggcctcctgcaccgccgcgtagcctaccgcgccaataaaacagaggctgacgccctgcagaaaacgcagcaggacgaactgctcaatgctttgcacccagtgcgtcgccacacacgagagcataaaaaaggccacgccgctgagcagcaccggacgccgcccgatacggtcagagagggggccaagcagccattgcagcataatgccaccggccagataggcggtgagcgaagtagagacccactccggcccgaccttaaattcctgagtcaccagcagcatgccaggctggatcatgtcgtgagcgatataggtggcgaactcaaacaacaccagcgacagcggaaaaatcagatgtcgtcgggtcagttgcacgaccggttcgaaagaaaccattacggatacctgcgataaagccattaaaaaagcggccaccagggtgaccgcataattttagcgtgacggtgtaacgcttatcgccagcgggcgatcgggttattcagcgttccggcgaacttgaggttctcagcgggatcggcgaggtttatcatctgctggttattcgccagctgcaggcggttcagacaggagcgggtaaactccggcgcgaacatgtcatagcgcgcgaacttagtggcatgctccgggtgcgcctgctggtaatccttcacgcactgcgccaccgcctgccagaactcttcctccggcagcgttcctgactgatgcagaatcgcgctgataaagcggaagatgcagtcaaacacatcggtgaagatcgagagcagcttcaggttctccggcacatccaccgccagacgctgcacgccttccggcagcaccgaatccggattcatcacggcgatctcttcgccgatatccttcatgtatgcactgaccggcacgttgttctccagcagcatgatgaggttttcaccgtgcggcataaacaccaggtcatgctgatagaagcagtgcagcagcgggctgagatagcaggtcaggtagcgttctatccactgcttcgcgggcaaaccagaatccgctatcagtgctggcagcagtgcctgctgatggtgatcgacgtgcaggaaagaggccatggtcatcagacgctggccgggctgcaggctggccgcaggattatcccgccacagcgcagcgaacatctttttataggcggagtcgcctttgatcgcctgctcatagtagcggttgtgatagccgaccgccgcgacttcgcgcaggatgcggaaatcacagcgattcagccacgcatcgccagcaaccagttgttccagccagccgtttatcgcaggcgttgtcgccatatagtagggggacagtccgcgcataaagcccatgttcagcaccgacagggcggttttcacgtagcgcttcgcgggctggctgcggttaaagaaggtgcggatcgactgctgcgcctggtaagcatcgtctccggtgccgagataaacaatatcgtgactggcgatgtctgccgcaaacacggtcagcagcttgttctgccactgccacggatgcaccggcatcaggatatactcctcaaccgccagccctttattcaccagctgcgcagtaaactgctccagggtggtgtcgcccagttcatcacgcatcaactgctcatagctcagctcgctgaggctggagaaatgggcgttgcggcgatggaccgcgacccagatgaggtgaacgggcgcggcggcctcgggcgcatacgccagataatcatgggcatcgaagccaatacgcccgttgttggcaacaaagcagggatggccttcggtcatcgccgcttccaccgtctggaaatcggctgagaccagcgcctggctgtcaggattattcttctgcagcttataaacgctgctgcacagcgtgctgctgatctcttccatgtaggtcgccagcagtgcctgtgtaataccgatctccccgttaaactccacgataaatttcagcgcatccagcggcagatcacgaccgtttctcctgcttgcgcagtgagccggcgtcaatttcccagtgatccagcgccagccgcgacgcccggaaatggtagctcgcttcaccgcctggcaccgcaagctgatagctgccgtcgcccgactcctgtggcgtaatgattttctcatgcgcgaactcggcaatcgctttccggatcagcatgcggtttgcctgcgcccagtggtcgcccgtcagatgtgtaccgttcatcagcgaagagggggtgttcatagtctgcgactcctgcagtaacgcgtgttgataatcttcccgctggcaaaaggccagccaggcggttttatgacccatgtcgatggtgtgctgatagcggaacccggcacgcttattcagcacgtgaatcttctcattgcgcacatctggctctaccaccacgcggcgcacctcggggcggctgaacatgtagtccatcaccagcgtgaagacctgccagctgaaggctctgatcggctggctggcgggggcaatcagaatatgcatgccgtaatcatcgggtgcggcaggataaaacttgccgacctcatcgtcgctggcgcgatagcactcaatcaggcagaccggctggtcgttgcagcaaccaatcagcgcagcatggggatcggctgcagtcagcgtctgatagaactcagcgacctgattcaggctctgctgctgcatgccccagaagcgggcgtaatcgcgggtgacccagcgatgaaccagcggcgcatcgctggcgagcatgggcctcagggtgaactggcctgcggggcgggcggcgctgaacagtgtttgtgaactcatctcagtgctccgatttagccgggaaggtctggaaggcaatctgacgctcgatcgggtagacctcgcgtccggtcagttcgcgcagcagcaccgagttgcggtagcaggccatgccgagatccggcgtaacaaaaccgtgggtgtgcagttcggcgttctgcacgaagatctgattgtgataatcgatgctgtagttgcgctgcacgtcgtagcggcctttgtcatcccagcgcaggcgggcgttgatgccctctaaaaacatcggtggctggtagtgatagccggtcgccatcaccagtccttcggtgcgacgggtgaaggtgcaatcctgctcctcctgatgcagcgtcagctcgaactctccctgtggcagccagcgcatagcggtcagcgccgagtgagtaaacaggttaacgttcagatcgccatcgagctgttttacatacatcaggtcataaatgtcgttaatcaggctgctgttgatgcctttgtagagattcttgtggcgcgcattcagttcgtcgcgggtgctggcgggcagcgcgtggaaatagtcgacccactccggcgaggtcatctccagcgtgagcttagtgtactccagcggatagaagcgaggcgcgcgggtgatccagttgagctgatagccaaagcggtcgatatcggtcagcaggtcgtagtagatttctgccgcgctctggccgctgcccagcacggtgatggaacgcttctgctgcagttccgctttgttgaccagatagtggcttgagtgcgtcaggcgctggcggtgcggctggctgcactccggcatccaggctttaggcccggtgccgaggatcagatgtcgtgccagatagttctgtttctgaccattccgggtgtcggtcacctggagttgatagacgccagccgcctcatcgtagctgacatactcaacgtggctgttccagcgcagattagagagccgcgaactggcccactggcagtactgattatactctttgcgcatcaggaagaagtcttcacggatataaaaagagtataatttccccttttccttcatgtagttaagcaggctgtaagggctggtcggatcggcgagtgtcaccagatcggccataaacggcgtctgcagatgggcattttccagcatcatgccggtgtgccagtcaaagcccgggttctcatccaggaaaagaccgttcagtccctcaaccggctcactcagacaggccagactcaggttgaaagggccgataccgataccaataaaatcgtaaacggaattattcatttcagagctctcactgtttcgccgcgttcagcgcagacgcacgtacctgctcgcggccatagtgcgcgatcaggctcagcacatcttcgatgtcggcgatggtcgtggtgggatttaacagggtgaatttcaggtactgacgcccatcgactttggttccggcaatcactgcgttgccggagcggaagagcgctttacggatagcggcgttgatttcgtcgatctgtgcgtcgctggcgtttttgccgggcacgtagcggaaaatctgggtggtcagctcaggcgcgtgcagcacttcgatagcaggatgcgcagttaaccgctcatgagccgcctgtgtcagctctatcagcgtatcgaaagcgtcacccagcgccgccggacccatcacgcgcagggtcagccacatttttagcgcatcaaatcggcgggtggtctgaatgcttttgttgaccagattcggcgtgccttcctgctgggcactgagcggattcaggtaatctgcatggtgcgtgacatgcttcaggttgtggctgtcccgcacaaagaacgcaccgcagctgacggtctggaagaaagatttgtgataatcgacggtgacggaatcagcccgttcaatgccattcaggcgtgagcgatgattctcagagacaagcagcccacagccgtaagcggcgtcaacgtgcatccacaaaccataatcgtcacagagacgggcaatctccggtagcggatcgatgctgccaaagtccgtggtgccgctggtggcaaccacagcaaccgggatcagcccttcactgcgacatttctcgatctccttagccaggcacgctgcgtccatacggtagtgggcgtcgtgatcaacggcgataactgcgtcatagcccagccctaaaatcgccatcgatttctggatgctgaagtggctgagtttggaggtaaacactcgccatttcgacgcggtctcaggcaggccgcgatgtttaatcagatgccccggatgatgtgccgcgcaccagctatcacgcgccagcagcattgccatcaggttggactgggtgccgccgctggtgaagatcccatcagatccggcaggcaggccgatgcggccaagcgtccagtcgatcaccttctgctcaatcagcgtaccgcctgcgctctgatcccaggtgtcgaccgagctattcactgccgccataatctgctcagccatcagagagggcagcacgaccgggcagttcaggtgcgccagatatttagggtggtgaaaccagacggcgtcacgcagatagagctgactcagctctgtcagggcgtcatcgttgttacccagcggacgatcgagatcgacctcactgaattccgccgccagttcatggggcaggataccgctgaaaggcttctcaacgtcggtaacggtacgggtcatcagcgccagcacctcctgagtctgctgtgaccaggccgccagttgctgatcgttaaaaatagccgtttcggcaccgctggcattggatgctggcgcgagatcctgtgccgcctgagtggatgagcgtaaaagcatgttcagttcctgtgcgttaataccagtgaccctgccgacgtaaggtcagcagcgttggatgtccgctcaacaactccagtaaacataaaactaactaaccagataaaaaccctgaccattaaatggattagtgttttcaccttaaaaagagtaaataccgcatattatttgtggatttggcagcgttaaacgctttgttatatgcggatgagagtgtaaatgttaatcattatcattcaaatgttttgttgttaaattttatttattagtatgtctaatgttgaaaatgtgatgttgatcacttttctggatcggaataatcctttttttactaggtttagcgccagcaattcattcagaactcatctgcgtgtgttccatgttggaaacattagctttgtgggttagaatgtttccaacatggaaagtttgagagaaaaatgcatatcatctcaagagggccgttcagggaagcggcaataatttatccaaatcatgcctccgcactggatgcggcttatctggtcctaagggacgaaaactttgccacgccagatgcgctgaaaattagctttcagagccttgaccgcatgaagtaccgggaaaagtggtgggtaatcgatgtgggcggaaacagcctgagaatcatgttttatgctgactttgatcgcggcaaaatttttatcaaacacatcgtgacgcatgcggaatatgacaagctggtgaagaagtaccgggagagtaaagaatgattaccgaagcaatccaggcgaccaatgacctggtcagaattgttccctttctgggaggcagtaccgataaaagggactacgagcaggcgctggaactggttgaatatctggttgagcaccagccggacagcccgttagtagagatactgtctgataaagtcgcccgatacgaaaacagcgcccctgagttcgctgcgtttaacgcgcgtactgatgctattccgcgcggagtagcacttttgcgagtcatcatggatcagcacggcctgactcaatcctcttttgcggatgaaatagggcagcgctcttatgtcagtcgtatcctgcgtggtgatcgtcctttgacggataaacataaagcccgactggcagcgcgttttaacctgccgtttgaagcattcgctgaataacttagcctgaacttatatgagtgcggttttttttctggaaactgaatgatgaaggtattccgcaaacaaccagaaagtgctcattgccctttctggttgccattaagcgttactattaccctgcattcgtttctacaggcaccttctttttagccgtaaagttataaatcactaacaagccaaaaatgccggtgataatcatagtaatggttcccttatccataaagtgagccatattaccaagcaggatgccggtgacgccgaagtcggtatccgagaaggtggtgttggtcagccctatctgtccgagtaccggcagcagggcgacaggcaggaaggtgattaacaggccatgagcaaaggcaccgcaaatcgcaccacgcttgccgccggtcgcattaccaaacacgccagccgtagcgccacagaagaagtgaggaaccacacccggcagaatcaatacccaatgcagctgaccgagaacaaacagccccaccagtccaccgacaaagctggagataaagccaaccagcaccgcattcggggcgtaggggaaaacaatcgggcaatccagcgccggtctggcttccggcaccagtttttctgaaaagccggtaaaggcagggacaatttcagccaggattaagcgcacaccctgcagaatgataaagacacccgccgcgaaggtaatggcctggataaaggagtaaacaaggtagttctgaccattgctgaaattagcctctacatagtctttaccggcagacaccgacaggattaagtagataatcatcatcgtcagagagatcgagatggtactgtcacgcaaaaaactgaggttttttggcatgttcatctcttcggtggatttagatcctttgcctaccaaagagccgatccagcctgataagacatagccaattgtcccggtatgcgccagcgcgacatggtcgccaccaatgatcttacgcatatagggctgggcgatcgccgggaaggtggccatcagaatgcccaacagcagtgacccggtgtaaataagctgaataccttcaaaaccagcaaccgataaaataatcgcgatcatacaggccatatagaacgtcacatgccctgagaggtagatatatttcagtcgggtgaagcgagcgacaacgatgttggcgaccatgccgaaggccatgatcatcgtggtaggtgcaccatattttgccagagcgatagagaccattgcttcgttattaggaatgatgccctgaacatcaaacgcatgtttgaaaatgtcgcccagtggcgtcagtgaaccgaccagaaacggtcgcaccgcctgccagcaccaggaagcccagaatagtttttaccgtgcccttgataacatcaggaaacggcttcttctgcgcaatcagtccgaaaaatgccaccagtccgactaatatagagggcactttcagcacgtcgacgacgaactgcaaaagattttgagtaaacatattaacctcgagggtaaggtgtttatctaattattagcgtcactttttctcaaaatactcacgtattttctgctccacttctttcaggtcaatgatgttattaatgatgatgaccttctgttcaggaaggtttgcgctataagcaatgtctttggccataacaaaaacatccgccacatcgggggtgacagagccgagatccgaatgttcaacttcagcttcaacaccgatcgttttaagcactttcttgatgttcatttccatcatgaagctgctgcctaaacctgaaccacacaccgccataattttcatatcaaacctcattaactaatgattaaaagtcgcgtttcaacgggcagactaaacgcctgataaaatcgtcatgagcgcttctttgctgctcgcattgaatatctgcgccatgatctcttcatcggacagcacttccgccagttgggagatcatttcgatatggctattactgtccggtgcggcaaacatgaaaatagccttcaccgggtcgttctcttcggagtcaaatttcactgctgtacccagcagcacaatcgacaaccccagtttgtgtgcgccttgttccgggcgcgcgtggggcatggcaatctgcggcgcaatgacaaaaaaggggccgatctcctttttttgctgaataatcgcatcaatataatcctgcgatattgcgccctcactgagcagaggacgtcccgcaataactaacgcttcctgccagtcagtcacgctttcgacgtactggattttctcgttatttaaccacttagccaggtgtgacatcgtcttactcctcctgtttaaatgcgcaataaaatttaactaaacgcataaaccgtgtggcgtttgcctgctcccggttgcgcataacccatctcatataaaattttctcaaccggaacagggcctgttatgcattccgatttttcataaattcctgagtatgtacagtcagtttccctcaaaacccccgttatcacttttttagataaactttctgtcagcagagcgagacaaaaatcgaatgtagtaaaaggaggtaacatccttaaaagtcatgattttcatggagttattaaaaaaatattttctcattgttcagatggggttatatttcacaacggtcatcacatctgtacatgttaaaggtgtctagtcatcctgatgatgtccttcgacgtgtacggacacaacatgtaaagttaaaatattgcttatcaggcttaacatcagtgccaatttgataagttgatcacatattcagctagcggaagtggtactcatccggcaatgtcaggcagaaactgtactgacacggattagagggagtctgtccttcactcaaacgggaagaaagccaatggttgatggcattactgaaaaacaaaaagaggttgttgattacatcctcaataaaattaaggatgatggccttcgacccggagagaaactggataccgaaatatcaattgccaaaagcatcggcattactcgcgcaacggtgcgtgaagccacacgcattctggtggagcagcagagaatttaccgggttaaagggtcgggtatttttgtcggttccacggagatgagtagccaggcgaaccgatatcatgtgctttcaccttttgattaccaggcgcaaagaaatggccataaaggtgtaagaaaaatcatatcggtcagcataatcaaggttccttctgctgatatcgctcaggcgctgcgtattaaaaacagcgatcagatctataaaattttacgcctgatgtgtttcgatgacatcccggtagctctggaacatattcacctgccggttaatatgtttagcagcatggagttcagcaagctggaactgtcaaaatatgcctacattgaagaagttaccggtaagaaagtgcagctaagggaccagcatttaacggccgtcaatcttacggatacacagtcgcttactctgcttaatttagctgaaggggatgctgtcattcagcttaatgaaaccgtttatctcgacgacggcgttccctgtgaagtgaatgtggcgcttatcaacacccgatttttcccgttgaaacaaaactcgcaacggccttagaaaaataatcttgtttctgggctcaatgctttgctgtgcccggatatgaccctatcagacagattcatgcccggtttacacctcttattacagcagaggatcttaattccggataatgcataaggtcctgtaaatcatctggcagttgcaatgagtatctctgactcaattacattcttcatatgcttatttatctatctggcgacctgtgcttcaccatcctgtgaagaaggtatttcaatgccatgaattcaggctgtctgaaattcctgcagtcgtggctaacaacaactgtcatctctccatacgtaagacgattttctgcaaacctttgccagttcgccgattttactcacctgaatatcaggcaacgaatagcgttatacgcaaaatatctgcctgattccctgtttcagagcccgttttccctctttcacttctcaccgttctccattatgacgaaatcaataatgcataaaacaatatgatgttttaccaatgatcgactgcgcagcacactggtctgcaaccggaataaacaaggaccaggtgaatggcatatcgattaagtctgttagataaagcgcccgtgttgcagggtgaatcacccgccgcggcgctgcagcgcacgctgcagatggcgcagcgggcagaggagtggggttatcaccgcttctggctggcggaacatcacaacaccgcgcagctggccagtccatcacctgaggtattgattgcctggatcattgcccagacccgacatattcgcgtcggatcgggcggggtcatgttgcagcactacagtccttataaagtggcagagaactttaatctgctcgcttcgctggcgccgggccgcattgacctcggcgtgggcaaagcgccgggcggacttccactctccacccatgcgctgcaacagggtgttgatgctgctaaaaaaggaagctttgccgaacagcttcagctgctggatagctggctgaagcccggtcaggctgatcctgacgatgagggtttagccgccacgccactgccgccacgtccggcgaaccgttttctgctgggtgccagtgaagagagcgcccggctggccgccagtctgggctggcagtttgtctttgccgctcaccttaatggcgaccgccagttgctggagcacgcactgagtacctactcccgcctgagccagggtcagcgcgccctggtggccgtgcaggtggtggtggccgactcacccgccggggctgacctgctggtagccaatcttcgtcactaccatgtagcggtgaaagatggccccagcgtcaacgtcgccagtctggaacaggcggagcgctatgtgcgtcagggtggataccgcgattatcagattgagccgcgcacgccgtcacttctgaaaggcacggcggcgcaggttcatgcccagctggacgcgctgcatcataattttgacattgatgagtttgttatcgacacgccgattactgagccggttgcacgtctgcagtcacttgaactgctggccacgcatcatctggtcgcagcctgaatccccgtcagtggagagtcatcatgaaccctgagtcacaactgattgaatggcgacgcgaactgcacacctggccggagctgtcgggtcaggagtttcgccaccaccgcgcgactgcggggctggttgcaggcggcgggcatccggctgctggactatccactggaaaccggcctggtggcagaaattggcagcggagagacggtgatcgcgctgcgcgccgacatcgatgcgctgccgatccatgaggcgagcggggtgcgttttcactcccgccatcctggcgtgatgcacgcctgcggccatgacctgcacagcgcggtgatgctgggtgcggcgttacagctcaacgcacaggccgatcggttagctggccgggtgcgcatcctgttccagcccgctgaagagatagcgcgcggcgcgcgtcagtttattgaggcaggcgtactggataaggtgcaggctatcttcgggatgcacaacgagccttcgctgcccgtcggcacctttgccacccgcagcggggcgttctatgcgaatgctgacaaatttattatccgcgtcaccggcaaaggcgcacatgccgcgtatccggagcagggtgtcgacagcattgtgacggccagccagattatccaggcgttacagggactcaccagccgcagtttcagtgccctggacagtctggtactgagcattacccgcatcgacggcggcaaaagctggaatgtattacccggcggcgttgagtttggcggcacggcccgaacccacgatttacaggtgcgcgccgaactggaacagcgtgtgcgcacgctggttgagcacttcgccgacgccaatggcgcgcaggcaaccctgagctggcatcctggcccgccagtgctgatcaacgatgcgcactgggcgaccttcagcagcgaagtggcgcagcaggcaggctatcgggtgcagaccgccgatctccatctgctgggtgaggattttgccttctatctgcaacaggtgccgggggcgtttgtcagcatcggcagcgccagtgactttggtctgcaccatgccagctttaccccggatgaggcgctgattgcgcccgccgccgactacttcgcccgactggcccgccaggcgctgcaacatcttaacgcgcgatgtcgggaagccattctgaactgaattcatctgcaacccgctaaagcacgacggttctgaccaccgtcgtcgggcatcgctacgactaaaaaagagagagcatcatgaccacaagacaacttcggctgggtaccattctgcatggcgcatcgggaaacatgtctgcctggcgccatccggcggcgcaggccgatgccagtattaatctggattacgccaaaaaaatcgcccgcaaggcggagcagggcaaactcgattttctgtttgtcgccgatgggttgtttattaacgaaaagtcgatcccgcactttctgaatcgctttgagccgctgacgctgctctcggcgctggcgggcgtcactgaacatctggggctggttggcacggtatcgacctcttacagcgagcccttcaccgtggcgcgtcagtttgccagccttgatcatctcagcggcgggcgtgcaggctggaacgtggtgacgtcaccgctggaaggctcggccaaaaacttctcacgccagcagcacccggagcacgcattgcgttaccgcattgccgatgagtatctgcaggtggtgaaaggattgtgggattcgtgggagcaggatgcttttgtgcgtgataaggcgagcggacaatttttcgatccggcgaagctgcacacgctcgatcatcacggtgatttcttccaggtacaggggccgctgaacatcgcccgcacgccgcagggtcgtccgattatcttccaggcgggcgcgtccgacgacggtaaaaaactggcggcgcgtcatgctgacgccatcttcacccatcagccgacgcgtgaagaggcgcaggcattttaccaggatgtgaaacagcaactggtggcgaatggccgtcagccagacgatttgcacatcttccagggtgtcagtgtgattgttggcgatgatgcagaggacgtggagcgccagtatcagaccacggcggcgctggtgtcgattaccgatgcgcttaactacctcgggcgtttcttcgaccatcacgacttctcacagtatccgctggatcagccgttcccggatatcggtgacatcggtcagaacagcttccgcagcaccaccgacgagatcaaacgcaaagcacagcagcatgggcataccctgcgccaggccgcactggaagcggcaacgccacgcccgctgtttcacggcacgccggaagaggtggcggatggcctgcagctctggtttgaaacccacgccactgacggcttcatcattaacggcggcacgcccgatacctttgaacgttttgtcgaccgcgtggtgccgattttgcaggctcgcggcctgacgcgccgcgactatccgggcagcacgcttcgtgacagcttcgccctgaaacaacctgttaatcagttcacctcacaataagagcacaagccatgaacaaaacatcgcgtcttatcgccctgcttattctggcggccagtagccatgcgctggctgaagataccagcgtctcctttaacggccagcgcgtcagccttgaagctaacaaagcgccgatcaataccgtgaagaatccggaggcgatcgcgcaactgcctgcgggtcatcgttttgtggtgccgggttcctttaccgtggcggtcgccgcgctgaattccccgccgttgacggtgttttccgatgacaataaaaccctgcttggcagcgaagtggatattgcccggctggtggctgacagcctgggattaaaactcaacgtggtaccagcgtcctgggaagactggccgctgggtgtggcctcgggcaagtatgacgcggcgatctccaacattaccgtgaccaaagatcgtaaagagaagttcgacttcgccacctaccgcaaagattcactgggtttttatgtcaaaaccagcagctcgataaagtcactgaccaaagcagaagatattgccgggctgaggatcattgtgggatccggcaccaatcaggaggcgattctgctggcgtgggataaagagaatcaggcaaagggactgaaagcctttacgccggtttataccaaagatgatgccgctcagacgctggcgctgcaggctggccgggctgatgcctactttggtcccaatgtgattggtgcctggaaagcggcactgaccggtaaaacccgtctggtcggcagcgtcgatggcggctggcccaaagcggcgcacattgccgttaccgtgaagaaaggcagtggcctggcggaaccgatcagcaccgcgctgaacggtgtgatcggcaacggtgactatcagaaggtgctgaaccgctggggtgaaggtgttgagaagatcgatcgttctgaaatcaatcccgccgggctgggcgactaaggagctgaccatgagtgaatccacttttcgcgaagtttcacccgacgcgccggagttgcaaccgatcctgggcggcctgtttggcgaatattccgcacgctatggcgactatttttcccgtcgtaacgagctggaacaggagctgaccgaatggtatctgccgccgcaggggctgtttatcgtgctggagcgtgacggcgagatcatcgcgatgggcgcttataaaccctatgacccgcagaccgctgagctgaagcgcatctggacccgcagcgatctgcgtcgtcaggggctggcgctggtggtgttacaggagctggagcgtcgcgccttacaggcgggctatcagcggctgtttctcaccaccggcttccgtcagccggaggcggtgcggctctataccggtcacggttatcagccacagttcgatctcagcggggatctggagcgttatggccagccgccgcacgacggacgactgcgttttatcaaagtgatcggcgtctataacgtcgccgcggcaagttaagaggtgaccatgagcaaacatcaacatctgcaggtggtgccggcacgctacccggcacgcacggcaggggctatcgttgcgctgtttattctggcaggcgtggtgcagtcagtggcctttaatccgcgctgggaatggagcgtgtttgcccgctggttctttgacccggtgatcctgcacggtctgggccagacgctgctgctgacgctgctgggtacgatattcagtctgtttctgggtggtctgctggcgctggcacgtctctcctcatcgtggctgctgagcacgctggcatggggttatatctggctgttcaggtcactgccgctgattgtggtgctgatcattctttataacttctcctatctctacgacaccctgtctgtcggcattccgtttaccggcctctcctggggagcgtatcagacgattaacgtgctggggcagtttcaggcagctgttatcggtctgacgctggtgcaggcggcctacagcgcggaaattattcgcggcgggatcctcggcgtcgatcacggtcaggtagaggccgcgtccgcgctgggtctctccgccacacgccgcaccttccgcatcattctgccgcaggcgctgcgcgccattattcccaccgcgttcaacgagatcatcagtctggcgaaaggcacatccgtggtttatgtgctggcgatgccggagctgttctacaccatccagatgatctacaaccgcaatcaggaagtgatcccactgctgatggtcggtgctgcctggtatctgattatcaccaccgtgttgtccgtgattcagtacaacgccgaacgctggatggcccgcagcgtcacccgtgaaccgcaaccgtcgcgcttgcgacaatggcgcaaccgcgtcacgccacttcatccgaccgaggagatcagccatgtccgaagccattgattaccgcacctcacacactaccggtgccatcagcatcaccggcgtcagtaaacgatttggtaaacataaagcgctggatgatgtatcgctgtcactggcaccggggtccgtcacggtgatcctcgggccgtccggctccggtaaatccacgctgctgcgcaccatcaatcatctggagcgggtcgacgaaggatttattcagattgatggcgactacatcggctatcagcagcgcggcaataagctgtatgaactgaaagagaaggcgattctgcgccagcgcatcaatgtcggctacgtgttccagaacttcaatctgttcccacacctcagcgtgctggataacctgattgaagcgccgattgcccatcgtcagttaacgaaaccggaagcgatacagcgtgcgggcgaactgctggatattgtagggctgcggcataaagccgatgcgtggccgcgtcacctgtcgggcgggcagcaacagcgcatcgcgattgcgcgtgcgctgatgctcaatccacgggtcatgttgttcgatgagccgacctcggcgctggatcctgaactggtgggcgaagtgctggatgtaattaaaaagctggcgcgttccggcactacgctggtgattgtgacgcatgagatcggctttgcccgggaagtggcggataacgtggtctttatggtggatggccggattgtggaacagggcagcaccacccaggtgctcaataatccgcgtcatgagcgcacccgccgttttctggcgcgcgtgttatgagggcattaacgttaacggttctgacgctgcttccggcgctggcctgttctgcggctgagaagctcgatgtcctgcaaaacgagacgccgattcatgccccggccaatccgcaggctattgctcaaattccggacaattaccgctttattgaaccgggcaccctgacggtcgctacctcggcgaccaactcgccgccgctgtcgctgctggcgtctgataacgtcacgcggatcggcagcgatcccgatatcgcccgactccttgctgatagcctggggctgaaactcaggctggttccggcttcctgggaggactggccgctgggtctcagcgccggacgctatgatgtcgcgatgttcaatattgccgtgaccgaagagcgcaagaagaagttcgattttgcgacgtatcgcgccgacaaccacgcttttgcggtgaaaagcgacagtcatatcagcaagattaatagtccggcggatattgccggtaagcggattatcgtcgcctcgggcaccaatcaggagcgtattttactgagctgggatgagcataaccgggctaaaggtttgcctgcggtaacgccgatttacctgactgatgatgcctccgcgacgctgacgttgctgtcgggacgggcagatgcgatgtttggccctcactctatggcggcctggaaagtggcgtcacgcggacagacaaagctggttggcagcggaccgtttcgcgcctgggtcgccgtgaccaccaaaaagggcaatggcctggcacctgcgctgcaggctgcgctggatggcaccatcgcaggcgggcagtatcagcaggtgctggcacgctggggcgaacaggatgaagccatcactcagtccacggtgaatccacccggcattgtttactgagtctgcagaaccggctcgcctgctgcggccggttctgcgcacttcaacctgatgagcacagaattgaactacactctccagcgttagtgatttatcctgcccgcctgtttccgtaaaatcctcactgcgtggcggagtaattgacctggaagccccatgaaaatcagattcctttctgccaatgagcaaaagctggcggaggtgcgcaaaatactcgaacctgtcggggtcgaagttctgcccatcgcccgtcgcatcgaagaaattcagactgaaaacgaactcgacctggtacgcgacaaactgaccaaagccttttcgctgattgggcgaccgctatttgtagagcataccggcctctatctggatggcctcaatggcctgcccgccggtctgacccgcatcttctggaaccgcctggacgctgagcgctttaccgcgctggtgcaggggctcgacagccaggccgtgacggccaaaacggtgctgggctactgcgatggccgcaaaatgtaccagttttcgggtgaactgcgcggcactatcgccgcgaaacctgccggaaacgcgtggctttcagtgggactgcgtctttattcccgaaggctatgagcagacgtttgctgaaatgggcgaactcaagaatgagatctcgatgcggcgcatcgcgctggatcgcttcgccacctttttaaaaacctcgcggggcatggcatgaaacctgaactcaaacgcgcctatgattccggcaaactgattctgtttgccggtgccggtatttcgcgcaattttggcctgcccgagtggcatgaactgattgcgcatcttgctaatgagctgggttacgatccaaaaatctttaatacctatggcacgcacctgtcgctggcggagtattacaaacagaaaaaaggttcgcttggcccgctgcgcagctggatggatcgcgaatggcatcgccccgatattgatgtccgctcttctgaaattcataccatgattacccagggtaacttttcgcgtatctacaccaccaattacgatcgctggctggaagcggcgcatgaagcgcacggcgtaccctattacaaagtggccaacgccgcggacctggtctctctcaccgaagataagcgtcacatcatcaagctgcacggtgattttgatgatgacacctcaatcgtgctcgatgagagcagctattttgaacgcctctattttgattcgccgctcgacattaaactgactcacgatgtgatgggcaactcagtactgtttgtcggctacagcatcagtgatttcaatattcgcctgctgttttaccgtctgaccaagatgtggggccgcaccgggctggcaaccgcccggccaaaatcctacctgttcactaaccggaacaacccggtggccaaagaggtgctggggcagtgggggatcgaggtgatcgtctcggaagaggacgatccccgtaaggcattggcgatgtttcttgaagagctgctggtgtagccgccgaccctcgcggcggagaatgtgtcaggaaaaatgaaaaaagcctgtgccaggttaaggttagcccgtgcacaaccgataaactctattctctgctggcaaagcaggatcggcatgatatactgtatgtatacacagtacctgagggcgaaaagatggctgttgaaacaaaatttgtagtagtcagaaagggtgaagagaagatgacgtttgccaataagaaagaggccgatgcctacgacaaaatgctcgatatggccgaagccttcaccgactggctgttacagcatcaacctgcactggatgaatctcaggcagaaacgctgggtctgctgattgcagagcagaaagatgccgttcagcatattctgcgcaccagcaaactgccggaagcggcagcagcacccgtctctcagccagaagctgtctcagacgatagcgcggatgagccgcaggaagagcctgttgcaaagaaagtacgcgccgttaaagccgcgtaatctcaacagcgccggaagcgaaccttccggcgttgctgtttctgaatagcggtttgagctgttctcctgctaacttttttacagatagtcttccttccactcttttaccctgcataacgggctctgacgctcaacagaacgatttcacacattaagggcttttcgtccgataaatcaaaacattgtgatcagtgacaaaagcgttcaaagcggtgtgtttttaatcgctaaatggcagttaatgaacactgcagtctattagtcgatttttcagacgaccttcctcgcatgactatcttcctcccataacgtgagttttcattccactgagcgtcataccccttttgctgcccggaaccgcacccccggctttaatactggtctcgtccggcgggtatcgccacacgcaggatgcctgggtgactgaactcaacacggtagtcactttttaagttaataagaggatttcgatcgctgtcacgctttttgccctgacagattgaggtcacgactaaaactgatagagttcccgaactggattgttactgcttaggcaggcaaaacctgacttctggcctctgtcggatgtcaggtttttttgtttctggggttccgatgaaaatcgccaaaattcttaataacaacgtggtgatggttcaggatgagcagggacgcgaaacaggtcgtgatggggcgtggactggctttccagaagcgcatcggtgacagtctcaacgctgcgcatattgagaaggtatttgcgctgcaaagtgatctgctggtacgtcgtctggaggagttgttacaccagatccctcctgaagtgatgaccacctgcgaccgcattattgatctggcaacacaacgtctggggacattgcaggagagcctgtatatcacattgaccgaccactgctactttgccattgaaaggcagaaaaaaggtctggcaattaaaaatgtgttgctatgggatatcaaacgcctctaccccaaagagttcgaactgggtcaggaggccatggctatcatttcacgtcgtctgaatgtcgaactggcggaggatgaagccggctttatcgcgctacatctggtgacggcgcagctcaataatgaaatgccggaagtcatgcatgtcacccgggttatgcaggagattctgcaactggtgaagtatcaactgcagctggagtacatcgaatcgtcgctgagttaccagcgttttgtcactcatctgaagttttttgctcagcggatgctgacgcgtaccgtggtggacgatgacgatgtatcgctgcatacagcagtaaaagataactatcccaaagcctggaaatgtgcggtgaaaatcgcgcagcatctgcaacaaagctatcagcgtgatctgaccgcagaagagatcatgtttctcgccattaacatcgaacgggtgagaaaagaggggcaataagctccataaaccggattgttactgctttacgcaggcaaaacctgagcgcggcctctgaaaggaggacgttctcaggtttttttcatttttggctcagttaactgatgtccgcaggcatcggttgtaaggaaatcgagatggaatatcacacgctggcacaagatatcctcagccatattggtggccgggagaacatcgtaagtctggttcattgtgccacccggttacgcttcaaactgaaagacaaccataaagccgacgctgaaggactgaagaaaaatccgggcgttattatggtcgttgaaagcggcgggcagtttcaggtggtgattggcaaccacgttcatgatgtctggcaggctgtgcgtagtgaagctgggctggctgatgagctttctgcagcaacagaaggggaaaagaccgggggtaatgttttcaatcatctgatcgacattgtatcaggcatttttaccccgtttatcggcattctcgccgcttccgggatcctaaaaggtttactggcgctggccgtggtctgtggctggctttctgttgaaagtggaacgtataaaatctggtttgcagccagtgatgccctgtttttcttctttcctctggtgctgggctacaccgccgggaagaaatttggcggcaatccctttattaccatggtgattggtggggcgctgacccacccgacgatgattgcagcttttaatgccagccagcagtccggtgaaatgacggacgcgtttctcggcatccctgtaacctggtttaattacagtgcgtcggttatcccgattattctcgctgcctgggtaagttgctggctggaaaaacagagcagccggcgacttcccgcctccatgaaaaacttctttgcgccactgatctgtctgagcgtcaccgtgccgctgaccttcctggtgattggcccactggccacgggcttaagtcagatactggcgaaacggctaccagtggatttatgcgctggcaccctggctggctggtgccgccctgggcgcgttgtggcaggtctgtgtgatttttggtttgcactggggactggtgccactgatgatcaacaatcttgccgtactggggcatgactcaatgctgcccatgctgttgcctgctgtcatgggccaggttggcgcggcgctgggggtgtttctgcgcagtcgggatgcacgacagaagatgctggcgggttcatccgtgaccgcagggatctttggtatcactgaaccggctgtctatggcgttaatctgccgttgcgccgtccctttatctttggctgtgtggcgggggctattggcggtgccattgtcggcttcagcagcacccacgtttattcatttggttttgccaacatctttaccatcgcacagatgatcccacctggcggtgtggattccacgttatggggcggtattgccggaacgctactcgcgctgatactggcttgcggcatgacgctggtagccggtatgccccgaaacacgacgccagacgcagcgctcccggttacccctggtgaagatgacattctgtcaccgatgacgggcaccgttctggggcttggtcagattcccgatccaacctttgccagtggcctgctgggacagggtgtggccatcatcccttctgataataaagtcattgcgccttttgcgggagaggtggcctccctgtttcagacccgtcacgccatagggctgctgagtcacagcgggattgagctgttgatccatgtgggtatcgataccgtcaggctcgacggcaaacctttcacggcacatgtaaaagtgggcgacacgttcagtgccggcgatctgctgctggagttcgatcgtcaggccattctcgatgccggatatgacctggcaacaccgatcattatcactaacagcgatgagtatcctgaggtgatgaccgtggcagggactgcggtcactgcaggtacgcctttactcagcgtcactcgtcaataaaaggagaacaggatgaaaactttcccggattcatttttatggggcggtgctgttgccgctaatcaggttgaaggcgcatggcgtgaagagggcaaaggcctctcgacctctgacgttcagccacagggaatttttggcccggtatcggagcgcgttgagggcagccaaagcctcaaagacatcgcgatcgacttttaccaccgctacccggacgatatcaggctgtttgcagagatggggttcagctgtctgcgggtttcaatcgcatggacgcgcatcttcccgaacggtgatgagcaacaacccaacgaggccggtctggccttttatgaccggctattcgacgagctggccgcacaccacatcaccccacttgttacattgtcacattatgagatgccctggcacctggtgaagcagtatggtggctggggtaaccgtcaggtgattggcttctttgagcattatgcccgcacggtgtttgcccgctacaggaagaaagtcagactctggctgacctttaacgaaattaacatgtcgcttcacgcgcctatgaccggggtaggtctgccggaaaccagcagcaaaggtgaggtgtatcaggcgattcatcatcaactggtcgccagtgcgctggcggtgaaagcctgtcgcgagattaacccggacgccagcattggcaatatgctgctgggagggctggtctatccactcagttgtaagcctgatgatgtgctggaagcgctgcaggagaaccggaaatggcaattttttggcgatgttcagtgccgtggtgtttatccgggctatatgttgcggttctttcgcgagaataatattcagctggatatcacggatgccgatcgtcagatactccagtcgaccgtcgattttatctcgttcagctattacatgtccggctgcgtgaccgccgatgaagcactgaatcagcagatgcggggtaacattctgagcatggtgccaaatcctcatcttcagagttctgaatggggctggcagattgacccggtgggcttgcggaccttactgaatctgctgtgggatcgttatcagaagccgctttttattgttgagaacggactgggcgccaaagacataccggatgcaacgggcgtcgtgcaggataattatcgcatcagctacctcaacgatcatctggttcaggtgcgcgaggccattgacgatggcgtggaggtcatgggttataccagctggggacctatcgatcttgtcagcgcatcaaaagccgaattgtctaagcgttacggttttatttatgttgaccgcgatgataccggggaaggtttcgctggcccgcagccggaagaaaagcttttactggtataaagaggtcattgcgaccaacggggcttcacttaaagagtaattcccgcactcaggagtacatcacaacgatcgcgatgtactcccggttagcagttaaaacagcccggctcagggcgtctcgcgggtgttaacctgatagcgggtactcctgcctccgccttcaagccggtaaaggcagcctttttcaaccagatcggccagatgacgggtcgcggtggctttactcactttggcgaccttctgatactggctggcgctgatccccagttcgaaaccctgctcgccgccatccagcagccggttcagcactttcacctgttccggactcaatcccatcccctgatgccgcagccagaaacgcgctttcatctgagtgcgatcgatgacgttcatcgcctgttgcagactctcatccaggatatcaagaaaccacaccagccagtgagtgatatccaggccgcctttctgcgtctgctcaaggatgcggtaataaccggcacgctgcgtcagaatggcgggtgacatggcataaagccggatgctctgactgtcggcctgcgccagcgccagatcggttaacgcacgcgtgatacgaccattaccatcatcaaaagggtgtagagtgacaaaccagaggtggcagatggcggcgcgcagcaacgggtccagcatcacatcatgctgactgctgttgaaccactcaataaactgcgccagctgcggctccagtccctgtcgcggcggcgcttcaaaatgcaccgtgggacgatcgatgcgacctgagatgacctgcatcggctcactgccgcgcagcgtgccgacgctcaggcgctgcaccgtccactcatcggcagggaaaagccagcgatgccactgacagagacgctcaggcgtcagcggctggctgcggttgttgatggcatcgagcatcatggcagccaggccttctgaacgatcggagaccggatagggctgctcttccgtcacgcctaaccgacgcgccagcgatgagcggaccgattgcacgttgacccgctcctcttcaatcgcggaagaggagaggatattgctgagcagggtatccagcgtctgggtttcactgtctgaatgcaggctggcacggcccagcagcaatccgcgctgctgctgcagatggcgcaggcgcggtaacagcacggcgtcctgccactgaaaatggggccagtccggctgttgccagatccaggtaacgctcataatcggctcacgctaagggtggatgagccgaataaaggaggttattcggctcacagaatgagtcgataatagcgaatatttggctcacaggccaacccggctgaagtgagggcaaaaaaaaggacccgaaggtcctgtttgcttagcgggagaactgcataaaggtgtctgaatagtagtgaacgatccaggcgacatacgccagccagacaaccatcccgacagctaatcctgatttaccgatcattgttctatctccactgcgataagggggctacagcaactgttgacataaactgacagtaatggcgggcaccagtattgttgcagatcaaaaaaaggccgttcattcgcagcgccataatacctttgcgatcaacttcccgtaatcacgcgctgtgagacccccatcacggcggagaaatggccattaaagttcaaaaaaacgccgccgatagatgatctcaggagcaccataactacaaggaggtattgagccaggtaaatttcaggggaagcactatggtcagtcagttaacacataagaaaagaatgagtacccgtgcccagatgctgatcatgggtggtttaacgatagtgctgggatttaccgtgactattggggttctcagctggcaatccggtaaagagcagaaggcgctggccgaacaatatctgcagcagattgcgcagagccgtgccttacaggtgcagcaggaattgagccatgcacgtgatgtcgcgagtcacctcggacaaagtctgattgccttgccccacgtcggcattaccgatcgcaaagcggccgataaggtgatggagtatgcgctgcgtgctaaccctgactatctgtcgatgtcagtgatatttgaacagaatgcgtttgatggccgtgatgccgagttcgcttcacagccaggtcaggcaccgcagggccgctatgccttttttgtcgatcgtgacgcgtcaggtacttactcgatgcatccgctgctctcctatctgacaccgggtcagggcgattactatctgatcccgcaaaaaacacaaaaagatacgctcacagaaccctatagctatgcctataacggcgtgccaacattgctcacctccgtcgccgccgcgattatcgatcagggcaccttaaaggcgatcgttacctctgacatttcactggcatcactgcaacagaaagtgaatcagatcaaaccctggcagggaagcggttatgcgctgctgctttctaacggcgggaatgtggtctcttcgccagtgaaagatgaagccgggaagccctggaaaggcgaaaaagagggttttacgtcaaaagtcgtccagcgatttgatgccgtgctgggtgaagacgctttagtcacctggcagccggtgatgataggtaacagcgacaaaccctggtatctgggcgtggttgcaccggtcagtcaggtgatggccgcctcaaaccggcagctgatgtgggcggtgatcctgatggtcgtgagcgtttctgctggtcgggacggtgctgggcatgctgttcagccgtaaagtgttgcgtccgattggcggtgagccggctgaagcggcgcatattgcactggccgtcgccgatggcaagctggataacgcgattgtggtgaaaaacggcgatcgcagcagcctctttttcgccctggataccatgcaaagccagctccggcagattgtcgggcagattaaagattccagtgaatcagtacgccagggagcgggtgaaattgccagcggaaacctcaatctggcgtcacgcaccgaacaacaggccgccgcgctggagcagaccgcagccagcatggagcagatcagcgccacgattcgcctgaatgccgataacgcgcagcaggcaaccagcctgactgaaaacgctacccacatcgccagtcgtggtgcctcgctggtgggtgaggtggtgcagaccatggcgcagatcgatgacagttcgaaaaagatcggcgacattaccaccatgattaacagtatcgccttccagaccaatattctggcgctgaacgcggctgtagaagctgcacgcgccggtgagcagggacgcggttttgccgtggtggcttctgaagtgcgtaatctggcccagcgcagcgcgaacgcggtgaaagagatcggcgcactgattgaagagtcgagcgtgcgggtcgagagcggcgtccggctggtaaacgatgccggtaaaaccatgcaggagatgatgcaggcggtgaattcggtgcaggggattatcagtgagattgttacagcatcaagcgaacaggcgcgtggcatcagtcaggtaacgattgccgtcaatgaaatggatggcgtcacccagcagaacgccgcgctggtgcagcagatgtcggctgccgccagttcgctggaggatcaggcgcagcagctgtcacagacggtagagcagtttcatctggcgtaagcaggcgtatgtttcctgatccagactctgcttcacaaaataaaaaactcgccgctggcgtaatgctgattagttaagattagatttgtaaaggctgtcacggttaaacgtgacagcctttttttccgggcgagcgagccgcagtgcgggccagcgcacctctgctgctgccgggccgtcctcgcgccgctcacgcggtaccttcggctttgacgtcgtgccgacgaaccgttcggggatcggccctccctggtcggccccgacctgtccacgcttcccggcgtggacttctggcccgtcgtcacgcctcagcgctgcggatagccctttcagcagcagaggcgctcaggcctccactctcgtgcccttttttaacaatacacactgaagtttcagagcaggccggtgcagggcaggggcaggcaatccgcagcgctgaacagaatgagtctgccaggagagcccgcaggacgcgggcgaaaggcggggcggcacaggatgtgccatccccggcggtccgtcaggcagaggaatgaagtgaagggaccgcgcagcggcgcgaggaccgccagcccctgcccggtaccagactgcgttatcatctgtcgcttaactgactggcattagccgctggcgggtttatttttatcactgttccgtcagccgcacaccgctgctggcatcaaacaagtgcattttatccggattaacggtcaccggcagcgtgccgccaggcaaggcatcgctacggccggtcagttgcatatgcagcgggaaaccctgccagttcagatgtaacagggtcgattcgccggtgatctcaacaatattgaccaccgcgggttgcccgctggcatcaaaaatcagatcgtggggtcgtacgccaagcgtgaccggctgatcggcctgctgctgtgccgcactgtaccagcgacgcggcaacggcagccactgctgaccacagcagacgccaggcagcccatcgcgtgtctggaaacgggcatccagcagattcatcggcggtgacccgataaaccgcgccacgaaggtgtttaccgggcggtcataaatcgccagcggtgcaccctgttgcacaatgaccccttccttcattaccacaatctgatccgccagcgtcatcgcctcgacctgatcgtgggtaacatagaccatggtggttttgaaacgttgatgcagcgacttaatctcggcccgcagctccatgcgtaactgcgcatcaagattagaaagcggctcatcaaacagaaacacctgcggattgcgcaccatggcgcggcccatcgccacgcgctgccgctgtccacccgacaacgctcttggataacgctgcagcagctgatcgatgccgagaatgccggcaatgcgggcgattttgcttttttgctcctcgcgcttaacctttttcacctgcatgtgaaacgccagattctccgcgacggtgagatgcggatagagcgcatagctctgaaacaccatggcgatatcccggtcagcaggatcgagatcgttaatctgttttttatccagcatgatcgccccgtcagagacggtatccagaccggcaagcagccgcagcagggttgatttgccgcagccggaggggccgaccagcacagtgaaactgccatcaggaatggttaaatccagcgggtgaagcacgctctgtttaccgtagcgcttcgccacctgtacaagttcaacactggccatgttcagcgcacctcatttgatagttggagttgttgccagctgggatagcggcgcggagagctgcttatcgcctgtgatgccacttcaatgccccagcgcagcgccgtgtgcgatggctggtgatagagcagtgcagtaagaaaaccggcattaaaactgtcaccggccccaatggtatctaccaccgttaccggctgggcagcagcatactgcacagaggcggcagaccagagacgtgcaccctctgcgccacacttaatcacacagccgccgcgaccactgagccgggccgccagctgtttaccgctttgatccagcagtttctgcgcccgataagcccagcgcttccacctcattcagcagcagccagtcacagtccgctaaccagttgccaatctgtaagcgaagcccatcgctccagcccgcaggcggccagccggtatccacggcgacacagaagccacgctgttgcagcgcggccagcagcgccgggtagtgatcatagagttccagacagagaaaggtgccgcacagcagtacgatgtcgcccggcgtcgcctgcgacggcaactgggccagcacatcgtccgcggtcagcacggtaatatggccgtgattgctgagaaacgagcgttcgttatcgggatgggtcacgcctaccgtcagcgaggtttcacaggcatagcgcggccagtatgcagcgctatgaggaaagtgactggcgagccagtgactgaagccatcgtcgccctgattggcaatggcccgatgcggcacctgcatcgcctccagcgccagcgcacagttacctgcggacccgccgggacgtaactcgctgtgctgcagcatcacttccgtgccgcgctgcggccagtcgctgagcgtactcatgattaaatcaacatttatattgcccaccacatagagggtgggcgtgagggtagtgaccataattatcccttacttccgccgctggtgagaccgctgaccagcgtcttctgcaaccagatggcaataaacagtggcggcaccgaagccagaatgccgattgccgcgatcagcccgtcatcggtcgcgcgtcctgcggtaaaaccggcaatggcgaccggcagggtctgtgccgaaatattgctggtgaacagcagcgcgtagaaaaactcatcccaggcgagcagccagccgaacagcgcggcagcgcccagcaccggctttgccagcggcagcgtaatgcgcagcagaacctgccagaagcgcaggccatcaagccgtgctgcctgttcgatatcacgtggcagtgagtcgaactggttcttcagcatccaggtcagaaacggcaggatcagtgagcagtagaccatcaccaggccgggacgggtgttgagcagccccagttgttgcagcagaaagtagagcggcagcacaaacgccacgggcggcaccatatagattgccagagcgccggaaagccaggcatcacgaccactgtagcgtgagaagctgaacgccgcgggtatcgccagcagcagcgagatcgctgtggccaccgtcgccaccagcaaactgttacccagcgcgtgcaggaaaacgttgccgggctgatttggtgccagcgaaatcagcccctgatagcggctgaaatcccattgacgcggcagccactccagcggcacgcgggagagatcgctggcagaaactgacgctcatcagaaacagccagcccatcggggccagaatgctgacggcgaccagcagcgcagccccgtaacgcaggacccgtcgcagtttagttttcataagcggtactccggcggcgctgatgccataacatcagcagatagagcgtgatcagaagggcgcacatcagggtcatcagtatcgcgtaggcggcaccgctgccggcacgcagatagctgaacgactcctgataaacgaaaaagctcagggtcttggtgctgtccaccgggccgccgcgcgtcatcacgtagatgatgtcgaagattttaaaggcatcgatggtgcgtaacaccagcgcgacgccgagcggcgcaacaatcgccgggaaggtaatcgcccggaaacgccgccaggcggaggcaccgtccagtcgtgccgcttcaaacagatcctcggggatcgactgcagcgccgccagcaccagcagggtgaccagcggatagtttttccagatatccgcaaacatcaccgcattgagcgccgcctccggcgatcccagccagctgcgataaccgtcaatgataccgagctggctgagcagggcattgatactgccgtaatcagggttgaagttgagccgccacatcatggcattgacgatggtcggcagcgcccacggcagaatcaccagtacacgcaaaacgttgcgcccgatgaatttctgattcagcagcagcgccaccagcacgccgataatcccttcaacggtgacagacacaagggtgaaatagagtgtgcgccagatcgacgcccgaaagtcgggatcgctaagcgcatagagatagttttccagcccaatccaggcaggcgtttcaccactgccaatcagcgcagcatcggtaaagctgagccagatggtacgcagcagaggccaggcggttaacagcagcatcaccagcaacatgggtgccagcagcacccatgcctgacgctgttcgcgttgacgcaaactcagcatcataactccttaacgcagccgggcggcgcttttatcaaccgtcgccatcgcgtcctgcgccggggctttacccagcaacacctgctgtaactgctgttgcagctggttcgacagacgggaatagtcagcggtctccggacgtgacagcatcacgtttagcgatttgtccgccgcggcaatcaggctctcctgatcctttttcactgcttcatcctgataagaggatttccagatcggcaggctgagcttcgcatactgattctgtaccggctgtgaggtcatgtactgaatgtactgccacgcctcgttggcatgggtgctgcctttggtgatccccagccccattgagccgtttaccgcccccacttttcctggcgcatcgccgggcgcaggcatgatcccaacgtcgcccgccactttgctctgcttcggatcgttggccatgttgtacatgtaggtccagttcagcgcgaaagccgcatcgccattagaaaacgatttacgcacatcctcttccagatattcacgcgacgccgggttactcaggccctcatcaagcgagcttttcatcaggttaagcgccttgagtgaagccgggctggagaagttaagtttgccgttctgatagaactgaccaccaaagcctgaaacaagcgtggtgtagtcacacaccagcgcctcagcctgggaccagctccagaccagcggccaggtgacaatctttttatccttgatgatcttcgcgtcatccagcacctgctgccaggtctgtggcggcgtggtgatgcccgctttagccagcatcgctttgttgtagtaaaggtatttggtgtcgaggatccacggcatacccagcgttttgcctttgtaaaccacggtgttcatcgcgcccgggaagaccttctctttatcctctggcgtaatgcgtgcgctgacatcctgcagcaaatcgaaacgggcgaattccgctggccagatggcatcgaacagcaccacatcatagccattgccgcccgcgccacgcgccgccacaatcttgtcgtgcagcgcctcataaggaacaaactccagattgacgctgacatccgggtgctgcttctgaaaattttgcgtcatcgcgcggatatcattttcgctgtaagccgcctgggtcataaacagggcattgatctggctggccgccgccgcgctgcctgcgcttaacatcagtaaggcggcaaaaccggcttttagttggggtgtgtaacgctgtgacatggtcttctccactgtgcagcaacaggctgtcggttaattaaatcaatttgattgatttaatcgggggcgtaattttggtcagtgggtgaactgacctgtctgaatctaagcaaacggcgtgccacagtgccggagggcatagcaacaaagccgtaacaacgctgaaactcagactgcgcttttatggcaaaattgcctatcctgatgcgcgagaattgcgtgcagcatcaaagatattgtttgcccgaatgcattcggagaccaatactgtcgggtcccgctgaaatggaaaacaacatgaaaacctcgggtaccaaccttgaacatgcgcgggcgcacaaccgacgtgtggtgattgaagccattcgcctgcacggtgaactgacccgtgccgaaactggcccgcatgacggcgctgacgccgcagaccgtctcgaatatcgtggcggaactggagcaggccgaactgctgaccagccgccagccgcgccgcagcgggcgtggtcagccctcaattccggttacgctcaatcccaccagtgcctggtcgatcggcatccatcttgatcaccagacgctgctgctggttctggtcgatctcagcggcgaagtgcgtttccgccgcctcgttctggtgcaaaagcctcagcctgctgccaccctggcgtgcattgccagcgtgctggaggagatgcgcgccttcctgggtactcagtggcaaaaagtgctggggattggcgtggtgatgccagggccttttggtgtggagggcatttcatcagtggggccgaccacgctgaacgggtgggagcaggttgatatcgaggctgaactcgccaccattagcggtctgccagtgacgctggaaaatgatgctacggtcgccgccataggcgaacgctttcacggcacggcgcgccacctgaactcctttatctatctctatatcggcaccggcctgggcgcggggatcttcaccgatggtcatatctataccggccacgcccataatgcgggcgaaatcggacacattgtggtcgagccgggcggtcgcgactgctactgcggaaatcagggctgcctcgagcgctacgtctcgctgcaggccgcttatgaattctgcggtctcgatccaatgcgggcgctgcccgaagatctgttacagattgaacccgcgcgttttaccgcatggattgagaatgtgacgacgccgttacgtcaggcgatcaatattctggagtcggtgtttgatgctgaggcggtaattattggcgggatgatgcctgcgccgttgctggagcagatggtgcagcgattgccgccgctttatcagtcggtgcgcggacgctatcttaacgatatgcgactaaaaattggcatgaccggcagcgatacagccgctctcggcgccgccgctttaccgattttcgatgaatttaatccgaagtttcaggtgctgatgaagtagtcagggaaaagggcgctgctgcaggcaacagcgccacaggcattaacccgggtagataccgcgatctttacgcgccatcagaatacgctcacaggccacgatataggccgcggtacgcagcgagcaatctttctccttcgacttttcccagacgtgtaccatcgcttccgtcatgatcttgtctgagcgacgattgatctcatcttcgctccagaagaagctggccatgtcctgaacccactcgaagtagctgacggtcacgccaccggcattacagaccacgtccggcaccacgataatgccgcgggtggccagcatgtcatcggcatccggataggtcgggccgtttgcgccttccagcacgattttgcaactcaggacttcagcacgctcacgggtaatctgaccttccagtgccgccgggatcagaatatccatccctgtggtccagaaacgcctctttatcaatgctctgcgcaccagggaaaccggcaatctgcttattggcgatctgccattcggtcagggcagccatgttgatgccatcggcattaaacagcgtcgcggtgtgatcctgaatcactaccacacgagcacccgcctcatcaaacaggcgtgccgcttcgctgccgacgttaccgaagccctggaccgcaacgcgtgcgccttcaatttcaatacctgcacggcgtgccacttcgcgtccggtaataaacacgccgcgaccggtggctttttcacgccccagtgaaccgcccagatgaatcggtttgcccgtgacaacgccggtaatcgttgtgccgtggttcatggagtaggtatccatcatccacgccatcactttgctgttggtcccgacgtctggcgcaggaatatctttttgcggcccgatgatgatgccgatctcgctggtgtaacggcgggtcagtcgctcaagttcaccgtcggacagtttgaacggatcaacgcggatgccgcctttagcgccgccataaggcaggttaaccgccgcacatttgatggtcatccatgcggagagcgccatcacttcattaaggtcgacatccggatggtagcgaataccgccttttcctgggccgcgcgaaaggttgtgctgaacgcgatagccttcgaaatggcgaattgagccatcatccatctggagaggaatatcaacaatcaacgcacgttttggatgacgcaaagtatctatccaacgtgaaagatcgcccagatagggcgcaacccggtcgatttgctgtaaataggtggaccaggcagatgtgctgctttcagacgcataagataacttatccataaaaaacctttcttaatgaagttatttattgtgtggagccgtggatggagagcgcattgcattgcgccgacataatctaacactcctgaaacaaataagatgtggcatcagccatgacacaacgcagtaatgccctgttttggggcagggtaagtgaatagattagtattgctggccccttacagacgaataaagatgcgcgtggagtgcgtattttctgcataggacaggaaatatcgctatctttcaaatctttgagggcgttcaaaaagttaaataattgatcgtaaccatgttgactttactgcaccaattaagtgcatgagaataagtaatcaaaggattacataaagtaatggattggacgttaatagcgcaggctaatcaggcatttagaaaggagagagggtcagggctggggaaaggagaataacgggccagcgcagtggctggccagaatgagttttactgatgcagagcctgctcggcttctttcagttcctggcgagcgtcagccagtttatcttcgcgcttctggatcttgctggcgctgcggccttctgctttcgctttagccagttcctgttcgcgttcctgtaccttcaactttttctctgccactttttcctgacgctgctttagcagactgctttcggtacagttctgattcacttcgctcagcgctttttcaaggccggcaacctgatgggtattattgtgctggcgggcaaaagagagctgggtctcaatctcctgctttttggctgcacaaccggtcaggccagaggccgcgtgagcagcagtaaaagtgagtggtaacaggagaaggctgaaggtcagtaaggtctttttcatcttagtctcgtcaatgagtcagggttgtggcaccagtatacggaaccaccttaagagattcttaacgaaaaaaattatttactggcgcggaaaaacaggggtaaagaaggcgctgcctgctgtcaggcagcgctggaggcgttggattgggcaaattgcaggttacaatcaggtccactgagcattaccggatgaccatccagactctgctgttcaaaatagtcctgcatctgctgactgatgccggcaccacaccacatcacatgatgctgatggaggtcagttttaacggctggctgtccggttgcacgcgagtcaacctcgacattaaagcccatcgcagtaagacgaatggcttcaagccagatttcggttttatcaagtacgctcaccgcttccagaaacagaggaatagaagattccttgcgcgatgaggcgcgcatgactttatccgcctgctgctgcacgctttgctcaaaacggttgaggcgacgtgacgctccccgacggagatcggcgtaaagccaggcgctcagcggccgcagcagattaatgacgaaatcatcaccgctatagtggctggacatcgtgtgcatctgacgtgaaagcgacagcggtgtgccatattccagctgccagagcaggtcacctttgcgcgccgcccagccaaaggtggtgaccgtcgaagcagcctgctgaccttgccagatttcgtcgagcgtcgcgccagtggctgttaagccaaccagggtctggatttcactgaggtgatgatcactccagcgttcctgatactgctgcggcgtcagtaatccctgcttcatccagctcttcaggttagcgggatgggtgccggttatggcgcaaacagtatcggtggtataagaatgcatatcgtgccctctgtagaggggaaggccgccgggattaaccggggatgaaccaccactatgaaccttataacagtcaattaatagaggcagagttaaggcaaatcggcgctatgtgcctgtgacgctacgcttattcgttgttattctccgattaaatttatgctgatcagcaggttaaaagcgctgcgatcaggcaataaaaatactgtgtatttattcagtaaatattctttacgcaaatataccgggaaatcggtacttttaagcctcttttaagagcatgccgactcttatcccccttacatcctcccgctaaatcgctaaaatagcgggttctgatgatcaggagaaagagtgcccaatgcgttatcgttttagtctcgccgttgtaacggttgctgctgtactgactggctgtgcaaaacatgccgccagcgatgcgccagatgaatttgctgctggcccaacgcagattgatgtctcacacatcaagacccgcacagatgatggctccagtgtattcctgactgtagatggtaaagacgccggcagattgcctaacggcgaaagcatgctgctgcatgttccggccggaaaacaccaggtcggtggctatgtacccactctgtttggtatgggtcgggtgaccattgcaccggtagaagtgaccacgtcaccggaagatgtaaaaaaagtggcttatacggtcacacgcaacaaagcgacctttgttgagaacaaggacgagcagggctgagtggatgacggcggagagctgcgctctccgctggaagggctggcactataatcccagttcgctcagtgaaggatggtcgtcagggcgtcggccctgcggccagtgaaacagccgctgttcttcactgattttcagatcgttgatgctggcataacgctgctgcattaaaccctgctcatcaaaggcccagttctcgttgccatatgagcgataccactgccgttgctcgtcatgccattcataggcgaaccgcaccgcaatccggttctggtcaaaactccacaactctttaatcagccgatactgctgctcccgctgccatttttgctgcaggaaggcgatgatttctgcccggccggtcagaaaggtatcgcgattgcgccatttactgtccgctgaataggccagagcgactcgctccgcatcccggctgttccagccatcctcagccagccggactttttcaatcgcctgtgcagccagggtaaatggcggtagaggcggacgtgaattttccaactttctctccttaacagcgcaggcaaacgcattgtcagcattcgttacagtcgtatcagagttccagggcgtgaatctggcagacggcacgcgccgcttcctgaccttttttcacgaaatgctgagtatagaagtcgataaactcggccgatggctggaaattatgtggcgtaagtgacacagagaagacgggcacattggttgtcagctgcgcctgcatcagaccacttaccacagcctgcgcgacaaaatcatggcgatagatgccgccatccaccaccagtgctgcacagacaatcgcatcgtatttgccggtctgcgccaggcgttgcgccagcagcggcatttcaaaagcgcccggaacatcccatgtcttaatctcatatgaggtaccgcggctttccagttcctgttcgaatcctgtcagaacctgagaaacaatttcgctgtgccagttagctttaataaaggcgactttcaacggctgcatgacttactccagtaaaaggtgacatccagtggtaacgggccagattgcgcctctgcaccccgaatcaaaaatagtgcgcgcggcaggcctgtaacctgctgacagccttcactatactgtaatgtaaagagtctgtgtccaacattgtgattatatgtaaataactgagcgatggattacccgcttatgctgccgctaaagcccgcaacgcctcctgcaaagcattcaacacgcacgcttcagcccgccaaaccgcctcacaccctgttgtttgcgtaacagcttccagttacgttattgcttaaataaaatactggatatttgaacaggtatttgtataattaatcgactgcccgccgggtattggtagcgttagcgaggggtgaacccatgatgatttcaactgaaagcctcaaatctctggaacaatcggtcacaatgagcagtcgtgaactggctcagatgaccggtattacacacggagaagtgaagcggttaatcaaaagtctggagacggctcagcgtctctcccagccgctcagcgtgaatgagtatgagcgggaaggggaagtgcgtcaggagttccgtctgtgcaagcgtgactcgctgctggccgtggcacgcctgtcgccaggcttcactgcagaagtgctggatcgctggcaggaccgcgagaagacgacccatctgcctgactttaccaatccggctgaagccgctcgcgcctgggctgagcagtttgaacagcgtcaggcggcggagcagcagctggctctctcggcacccaaggcggcgttttctttgataacttcgttgaggttgatgactcgctgggttttcggcagctctgcaaaatgctgaaagtgaaagaaccggagtttcgccagtttctgctggagcgcaacattatgtatcgcgcaaaaggcaccctgacgccgcagcactaccatatgcaggccggctactttacgctgcataccggcacgggcgaaaatcagcacgctttctctcaggcacgttttacgtctaaaggggtgaaatgggtcgccagtctgtgggcagggcatctctctgctcagccaaaaggcgcagctgcgtaactgttcctgtgatcttgcgggctggcgcggatgtgtaagtgctggcagatgtgccagtaaaagtgcagatataaaaaaggccgcaacagagtgcggccttttttgatcgttaatgatcgattatcaggcgaattaccagcctttaatcgcatcacccttgtaaacttcttcggctttggccgccacctccggtgactgcagcgctgacttcagcttctgaattttatcgctgtctttattatcttcacgtgataccagcgcattgacgtaaggcgatgaggcactttccataaataagccatcgcggtgcgctgataatccagcctgagccgagaaattagtattaatgatcgacagggtcacgttgggatcgtctaaggtgcgggtcagctgtggggtgtccacttcaaccagcttcagattttttggattttcgatgatatccagtgaggtcggtaaataacccacatccggtttgagtttaatcagaccctgcgcctgcagcagcagcaggctgcgtcccagcgtggtggcttcgttagagatggtgatagtggcaccattctgcagctcactgatgttcttgattttgtgcgaataggcagcaatcgggaagacgaacgttttacccactaccgcaaacttatagccgcgctctttagactgtgattccagataaggcaggctctggaaggcgttagcatcaacttctttgttattcagcgcttcatttggcagcacatagtcattgaagttaagcacttcgacatcgagcttgtatttatctttcgccacctgctttaccacctgccagattgcttcatcaggcccggtattaatcgcaactttaactttgttatcgtcatcttttgagcaggcggataatagtagaacagaactggcgagtaatgccgtaaacagacctttcattatcagaaatccctcaggtggttgatgacttcaaagataatacagaactcacaggttgcgtactgactgaggaatatatcttataaccacaacgcaaatattgaacattaattaatcagcaattcagccagtccgctaatggccggttttcatccttttgttcgctggcggaaaattcctgttaacaggcttattaaaacgcaggcgggcaccaacgcaattttcttctaagcttacttatcggtcactactggcattctattgattattaacagggattaaccatgtcgaagcaagataacgaaattaacgcggttgaaataatgcgcagcagccatgcctggaacggtgacgtttcttgaggcctatcccaccggcgaacctgagctgaccgttatgcggctctcgctacctgcccatacgtcattgccctggcatacccatccaatgccgaatgcggcgtttattctttccggcaccctgattgttgaggataaagagagcggcgaacagcgcaccttccatgcgggtgaagccctcaatgagacggtcaacagtgcgcatcgcggttacaccctggatgagccagccgaactggtgattacctatgccggtgtaaaggggcaggaactgaccgagccactgccgggcgagccggaagagttttaagcgcacttacttcatgacgcaccacggtagtgtcgcccgctgccatttaaaaaccctgctcagacttgattcggatcagtaaagggtgcgcctgcacagaccaggattaaacgctctctgcttcatccacaccaattaaaaaggaattttcatggataagaatgttgctctgctgcttgccccaggctttgaagaagctgaggctattatcactctcgacatcctctcacgcctgggcgttcaggttacaaccctggcctgtcagccctatcgcgaagtgaacagttatcatcatgtgaaggttgtcgccgatgagctgctggaggcgaatcgggagcgattatttgatgcggtgattgtgccgggtggtcctgacggcagcaaaaatctggcggcaaatgcggcagtgatagattttattcgccgccatgatgaggcgggccgcctggtctgcccaatttgctccgcagcggccagagtgctggcgccacagggtcttttaagggggcgtcgctatgtcagttctgggacgtcatcagaaggtgtcaccgatggcgtttacgttaatgcctcggtagtgaaagatggcaatttgctgagtggacaggatctgggcgcggcgtttgatttcgccttcgcgatcgcttttatcctgactggcgaggctgatagtgccaccgagcaggctgaacatatcagtcacaagcttaaggtggatttcgctaagctttaatgagcggtgtttcgcgcccttaaagcgacatgctggcagggcgcaaagtcatccgcgacagaaaaggcatttactccccgccaaaccccgcttcccgcagtaccttttttgcctgctccgattctaaaaaatccgccagccgacgcgcctctggcgtaatgactgcacaggcgtagcgcgcaacagaattgaaagccgcagggatatcaacgactgtcagcccggcaatctgactcagggccgcccgatggctggcataaccgataaacagatccgcctgatcctccaggataatccattctgccgccagcctgcctgcaggaatcggtgcagagtcgcgcccacccaccagtgcctttgcgcgctggcgcaccgcttcaccggctttgcccatccgggtgaaaagggcctgcgcgtagtcgccagagggatcggctgtgggtgtagaggttgcgatccgcagtgtgtcgcgggtgagtagctgataccagtcgtctcccgcctgtagccgatcgctgcgaaccgtgatgcagagtttattagtcgtgaacggtatgactgccagcgctcgcccagcgttcagcaatttttgcggatgctcctcactggctgaagcaaagagatcgcagggctcaccggcttcaatccgttcgcgaagcagaccggcggggccaaaccgggtttcaactggctcaggaaagtacgccatcagcgcgggccagaccgctttcaggctgcccgccgccagtacgcttatcactctgttccctgataagcggtgcgatagaagcgctgataccacttattggccagcttattcatgtccacatcctgaaatttctgcggatagagttttttcgccatccacaattcgccaatccccatcgcttccggcattggataaccccatgctttggcgtagtccggcatcagccagacgcgatgattttttaccgcgtcgatagcctgccactgtggtgaactgttgatttcattcacgacggagggataacggtcctgcacaaaaatcacctgtggatcccaggcgatgacctgctccatcgacacggttttgaatccctttacagtcgctgcggcgacgttgaccgcgcccgcatgcagcatcatcaggccggtatatttccctgaaccgtaggtggtcagttccgggttcgccatataggcgcgaatgcgtttttccgccggaacatccttcaggcgatcgctgacgattttgcggccctcatcggtggccgtaatcagcgcttttgcttctgccggtttattgatgatctcgccgataagcgtaatcccttcacgcagtcctttgtcataggccatttcctcatcgcggatagaggggttcatttttgccttttcacccggctcgtcatgacgcagtgagatagccaccaccggaatgcccagcgcggtaatgctgtcgatcatctcctgcggtgcatagttggttacaaacaccacctgcggatgcagcgccaccagtttttcgggatcaacatgcgtcagatcccccagtgtcgctttctgattcagctcagaagccaggcgggcatagctgtcgccaagttgctgcttccagttcgccatcacaccgacgattttatcggtcgcgttcatctgcaccagcaggttaagcgtctgatgctgaagcaccacaatacgatcaacacggtcaggaatcgtgacctgacggcctgtctgatcggttatctggcgcgatgcctgggaaaagagcggaaggagtatcagtaaaccgagtgtgcatgcctgccagaagcgcttcattaactatcctcaaaatacgttatgcattggattatatagcgataagtgatgggcgtcacggtccgggtctgcattccggcatagatgtgagtacgaaaagagactgactgagggttctgatatctcttgcctgcccggcactgattatgtgcaacgcccgttactgactcaccatcacggtgccttcttgatttttctccttctatttatctgatttatcatgatttaatttctggcacgccatttgctgaagtctgaacagtaagcagcgttcgacacaattgatagcaaatagctggctagggttccggttcacgcaggtgaatgtctggtccgagagctggcgacctctgtgaggttacacggcgggacaaaagcccgggagacagcggcaccaaatggtgtcttgcgctgctcccgtttttttgtgccaaccagaggtcaaccatgaagaaatcacccctcctgacgcttattctgtcgctgacgctgctggtcagcgcgccatctttcgccgcggtcaaaaaagagttcaatatctgctggaccatttatgcgggctgtatgccctggggcaccatcagcaacgagaaaatcatcgataaatgggccagcaaatacggcatcaaaattcatatcacccagctcaatgactatatcgagtcgatcaaccagtacaccgcgggtcagtttcgacggctgcaccatgaccaacatggatgcgctgaccattcctgcggcggggggcattgattccacggcgctgatcaccggcagcttctccgatggtaatgacggagtggtgctgaaaggcgcaaacaaaaaacttagcgacctgaaagggatgtctgtctatcttcctgcgctgtcggtttcgcactacctgctggttcgcggtctggagaaggccggtttacaggaaaaagacgttaaggtcgtgaacacctccgatgccgatatcgtctccgcctttggtaccaagggcgtgcagtcggcggttgcctggaatccacagctttcagtgatcaagaaaaccccgcaaaccacagaggtgttcagctcttcggccgtgccgggcgaactgattgacatgatggtggtgaacaccgagaccctgaaagataatcccgcgctgggtaaggcactgaccggggcctggtttgagatgatggcgaaaatgcaggccggagatgcgcaggcgctgagcgcgatggctgccgattccggtactgacctcgccggatacaagtcgcagctgaaaaccacccacctgttctggaccccagccgaaacccagacatttgtttcttcccccgatctggcgaaaaccatgcaacgcgtcgccgcgttctcctttgataagggattactgggcgagggtgcacaaagcgctgacttcatcggcatgagcttccctggcaacatcaccgtcggtgatacagcgaacatcaaactgcgctttgacgacagctatctgaagatggccgctgcgggcaagctgtaatcaccgatctcaggagtatttgccatgcgccacatcaaccgctatccccggcagggaatgcgcctgacgctgatgctattaccttttatgctgctgatcgccgtctggtttatcagttcggcggtgcgtcttgaagccaacccacacgacaaactgctgcccggcctgtcacagatgatcgccgctattgatcggatggccttcacgccggacaagcgcagcggtgaatatctgctgtgggcggatacgtggattagcttaagccgtctgctgaccggcctggcgatctcttcactgattggtctctgcatcggtgttgctgcgggcgtcttcccgatgagtcgcgccgcgctgtcaccctttatgaccgtggtgtcgatgatcccgccgctggcgctcctgccgatgctgtttatcgtcttcgggctggatgagctgtcaaaagtgatgctgattgttatcgggattacgccgatgctggcgcgcgaccttgaacatcgggcgcgggaaatcccctcagagctgtttatcaaagcacaaactctgggggcgaacagctggacggtggtgctgcgggttgtgctgccgcagctcttgtcgcggctgatcacctcgctgcgcctgttgctgggatccgcatggctctttctgatctccgccgaggcgatttccgcaaccgccggactgggctatcgcattttcctggttcgtcgctatatggcgatggatgtgatcattccctatgtcatctggatcacgctgctggcgtggctgatggatctcgcgctgcgtcaattgcacaaagcctgtttcccctgggcggaaggaggccgggaatgagttttatcgatatcaaaaatatctggcaggagtatggcgaccacgtggtgctggaacgcatcaatctgcaggtcaaagaaggtgaattctgctcgctggtgggcgcgtccggctgtggtaagtcgacgtttttacgcctgctgctgggtcaggaaaagccgacacggggatcgatcacgctggatggcgaaacagctgcgcgcggaacccgatcgcagccgtggcgtggtgtttcagcgttactccgttttccctcatctcaacgtgctggataacgtcgctattggcctcgaacttccggcttcaccgtttactggccggctgtttggcacccgaaaacgccatgcccgtgagcaggcaaaacagatgctggagaaagtcgggctgggccattcgctcgataaatatccggcgcagctttcgggagggatgcagcagcggctggccattgcgcaggcttttgtgatgcagccgcgcgtactgctgctggatgagcccttcggcgcgctggaccccggcatccgcaaagatatgcatgcgctgctgctccagctctggagcgaaactcgcatgacggtgtttatggtcactcacgaccttgccgaaggcttcaatcttggcacccggctgctggttttcgacaaagtgcgcatcgatcctcaggcccccaatgcctggggcgcgcgtatcacttacgacatcccgcttaatgaaacgcggctgtcgcagctggcaacccgcaacaaaaacaacatttatcccctcaaggagaccgctcaatgaccgcactttttcattcagctccgagcctgcgcgaagagcagctgcctggcggagggcacacctcgctgattttgcgcaaagggcaaatcctgcgcctgaccgacaacgagggcggcgcgaacgtcagcatgatgatgctcaatccccacgagaaaagtgaacgtctgaatctgccggataccctgaaaggccagcatacggctcgcctgaccaccgggcactgtttctactccgacatgggacgcgtactggccgcgatcgtggcggatagctgcggctggcacgacccgtttggcggcgtactcaacgcggcggaagcgcacgataagtatggagccggacgctatcaggagctgcgcaacggcttctaccgcaacggcacagataatctgctggttgagatgggcaaatgggatctgggcctggaggatctgctgatggtcgtcaattttttcagcaaggtcacggttgatgagaagggccgcttccggtttagcgcgggcaacagccgcgccggcgatttcactgaactgtacgcacccatggacgtgctgatggtgctgaccgcgctgccacatccgcaggatcccgccgctgactatctcccgcgaccggttcagctgagctggtatcaggccgacgatatgcaggccgtcagcgaagcgatggtcacgcgtggtgaaaaccagcgcgcgcttcataacacccaactttttgccctgtaaggaggctgcgatgacccttattaactctgatcgtcgtcctgaagatgccgtctatcgccacgtgataccggcaggcgagccgtggctgttcgaagtgaaaaaagggcagacgctgcgcctgctcgacctcgaagggaatcaggcaattgataccctgttctataacatcgataacccgcgggaacgctacgatcctcagcgcacgctgcgtcgtcagggaaacgtctatctgaccaccggcagcgtgctctattcgaatctgggcaatccgctgctgactatcgttgccgacacctgcggccgtcacgataccctgggcggagcctgctcgcaggagagcaacaccgtgcgctatgcccaggataagcgctacatgcacagctgtcgggataactttctctgcgcctgcctgcacgatggccgccttcacaaacgtgatatcggtgccaacatcaactttttcatgaacgttccggtcacgccggaaggcggtctgacctttgaggatgggctatcggcgcccggcaaatacgttgagctggtagccgaatgcaatgtgatggtgctgatctccaactgcccgcagctgaataacccctgtaacggctggaacccgacgcccgccgaagtgctggtgtggaactgagccagcgttgtcatggcgaaaagcagggctgagtttctcagccttttgcgccagacctctcaacacatcaccggcgcacgcctgttacgtgccggtcagccccggggacggccccagggaatatcgaattttgcgggacgacccgcatccctgagagttcgcttatgtttgataccttactgattgctaatcgcggtgctatcgcctgtcgcatcctgcgcacgctgcgtgccatgcaggtgaaaggggtcgccgtttactccgaagccgatctgagcagtttacatatccgcgaggcggatgtagcgctaagccttggcgaaggcccggctgcacaaacctatctggtgacggaaaagattatcgccgccgcgcagcagagcggggcgaaagcgattcatcctggctacggtttcctttcggaaaacgccgcctttgctgaggcgtgcgaggctgctggtctgatttttgtcggccccacaccgcagcagttgcggacctttggcctgaagcacacggcccgcgcgctggcggaagccgaaggggtgccgttgctggaaggcagtgaactgctggcagatatcagcgaagcccgccgcgccgcagagagggtcggctatccggtaatgctcaaaagcaccgcgggcggaggtggcatcggtatgcgcgtctgtcgtgatgcgaatgcgctgtcagaggcgtttgaaacggtccagcgcctcggccagaacaacttcagcgatgccggggtatttctcgaaaaatatatcgaacgcgcccgtcatcttgaagtgcagattttcggtgacggcaagggcgaggtaatcgcgctgggcgtacgcgactgctcggtacagcggcgtaaccagaaagtgatcgaagagacgccagcgccgaatctgcccgcaggtatggcggaggctttatgcgcggcggctatcgcgctgggaaaagcggtgaactatcgcagcgccggaacggttgagtttgtctatgacagcgtggcgcagcagttctattttcttgaagtgaatacccgtctgcaggttgaacatggcgtcacggagcaggtgtggggcgttgacctggtgcagtggatgattgagctggcagcaggcgatcttcctccgcttcatgcgttagccgccgcgctgaatcctcagggccatgccgtgcaggcgcgaatttatgcggaagatccggggcggcagttccagccttcgccagggctgttaacccaagtcctctttccggcagccgacggtaaaaccctgcgtattgaccgctgggtggaagccggctgtgaagtcccgccattcttcgacccgatgctggcaaaagttatcacctggcgccccactcgcgaggaagccatcgccaccctgtcacaggcgctggcggagacccgtttctatggcgtcgaaaccaatcgcctctatctgttgcagattctggccttcgcgccctttacggctggcgaaccctggacccgctgcctggagcagctcgcctatcaggcggcaacggttgaagtggtgagtgccggaacccagaccagcgttcaggactatcccggacgtctgggatactgggcggtgggcgtgccgccgtcggggccgatggacgatcgcgcactgcgtctgggcaaccgtctgctgggcaatgaggagggtgacgccgcgctggaaatcaccctgaatggacccaccctgaaatttaacactgagattcaggcggtgatctctggcgcgccgctcactgtcacactggatggcgtcgggcagtcaatgaattctgtttttaccattccggccggggcaacgctgaagctgggcgcgataagtggcgcgggcgtcagaagttatctctgtctgagcggcggcattcaggtgccggactatttaggcagcaaaagcaccttcacccttggtcagtttggcggacatgccggacgggcactgcgtagcggtgacgtgctgcatctcgctccgcgtttctgcgagcgcaaccggatcggaactgcccgtcggactacaaacagagcttgccacggtgcgcacgctgcgcgtcatttatggtccgcacggtgcgcctgagttttttgcgccggagtatatcgagacgttttttgccacagaatgggaagtgcattttaactccagccgcaccggcgttcgcctgatcgggccaaagccaatctggacccgcgacagcggcggtgaagcagggctgcacccctcaaacatccatgacaacccgtacgcgatcggcgcggtcgattttaccggtgatatgccggtgattctggggccggatggcccgagccttggcgggttcgtctgcccggtgacggtaatcgaggctgacctctggcaactgggacagctcaaagccggtgacaaagtgcagtttgtcgcggtggatattcctaccgcccgccgactggcagagggccgacgcaccgagctgaccacgctccagccacaggaaacagactggcagcctgcaccgctgatttcgcccattgtgatgacctgcggcgcagcggataaacgcctggtggcgcgcctctctggcgatacccatctgctgctggaggctggcgagccggaactggatctggtgttacgttttcgcattcatgcgttgatgcaggcgctggaagcgcaatcccgcaacggcattattgatatcacgccggggatccgctcgctgcaaatccactttcagccggagacgctgacgcccgacgtgctgctgatgtgggtgcgcggtgagtgggagagggtctgcatgagtgatgaccttcaggttcccacacgcgtggtgcatctgccgctctcctgggacgatccggcctgtcagaaggccatcgaaaaatatatgaccaccgtgcggcaggatgcgccgtggtgcccgagtaatcttgaatttatccgccgtataaacgatctgccggatgagcaggctgtctggaacacggtctttgaagccagctatctggtgatggggctgggcgatgtctacctcggcgcgccggtcgccacgccgctggatccccgtcatcgcttggtgacgacaaaatataatccggcccgcacctggacggcggaaaactcggttggcatcggcggtgcctatctgtgtgtgtatggcatggaggggccaggcggctatcagtttgtcggccgcacgctgcagatgtggaaccgatatcatgaagtcgccgattttggcggtaaaccctggctgctgcgctttttcgatcagatccgcttttatccggtctcagccagtgagctgttgcagattcgccgcgattttcccctcggtcgctatccgctgcgcatcgagcacagcacgctgcggctggcggaatatcaggatttcctcgcccgtgaagcgcagagcatcggtctgtttcgcgatcaccagcaaaccgcgttcaatgcggaacgtgaccgctggatcgccagcgggcaggcccatttcgacagccaggaaagtgtggccgatgaaggcggcgacgcgccgctgcagccgggcgagcagggggttgaaagcccggtttccggcaatttatggcaggtgcaggcgacggcgggcagccgggtgcgggaaggcgatattctggtggtgctggagtcgatgaagatggagatcccgcttctggcgccgtgcgacggcattgttcagcaggtcagcgtgcagccaggcagcgctgtacgtgcagggcaacgcgtggcggtgattgttgaggataatgcggaaggatgatgacacctggtcacctggtcacctggcggcgcagtgataatctgatcctgtgcctgctgatggttccagactggcgggcgcaggcgagtccgatcacggcgaagggctattcgcagctcgcgcccagttggcttaaccagctgatcatcgcctcactgcctggctggctcagggtgcgttgcggccagacaaggtaatagggtttgctcagcggcaggcaaagatcatccactaccaccagatcgccccgtgccagttccgccgcgataaggcgtcgctgccccagcagcacaccagctcccgcgacagccgcatcaatcgccagcgaggtcagattaaagctgaatgcgggctgcggcagaggttcgtccatgcctttagcctgaaaccagcttcgccagtccggcagaaagcggccttcattaccccagtcgaggtggatcagcggcgcctggcttaagatcgtttccggcgtaaagcgatgtaacagagcaggactggccaccggcagtacgtcatcatgaaacaacttcagcttatctgactgcgggtaacgatcctcaccaaagcagatcacaaaatcggcgggcatcgcggtgaaatcgacctgagaatgcgtaccgtgtaacgagagatcgatattcgggcaatggtcgcgccagctcgccagctggggcaacagccatttggacgccagcgccggtaatgtgtaaacggtgagttttggcgcgctggccgcatggcggatgttttgctgaccgagatgcagaatatcaaacgcctcagtgacatagcgcagatactcttttccggtttcggtcagcatcacgccgctctgcgtacgtaaaaacaggacgctgccgagttgctcctccagctggcgaatctgctgactgactgccgccggggttaaggccaattgagcggccgcttttgccaggctgcccagtttcggcagccactttaaatgactgtatgacgctgatctttggcaaccttggcaattgggcaggcattaactcttccttatcagggcattaagtttttatcgttacgcagcgttgcaggcgaccggtagagtaacatcacacctgctcatcatgagaattgttgctatgcctggttcccttgtccgtctcgatcttcatccactggccgatcatggctggcgtcaacgttgtcgtgagcagttaaaccagtccggcgcgctggtactgcgtcagtttttaaaaccatacgctttagaggcgatcatcgaagagggcaatgcacaacgtcaccaggcttatcacacccgcagtatgcacaatgtctatctgatgaaacctgatgacgctttcagtgctgagcatccgcgtaacagagatgtgatcagcaccaaaggctgcatcactgatgatgttatcgctgccgactcgccgctgcgtcagctttataatgatgagttgttcaaacatttcctgtgcgatgtactgggtgaaaaagcgctctatccctatgctgacccgctttcctcgatcaacctgcactatgcatcacacggccaggagctgggctggcacttcgacaactcctcatttgcgatcaccttactggtacagaaaccgctggcgggcggcgtgtttcagtatgtgaaagatctgcgggatgccgatgccggtgagatgaactttgccggtgtcgacgcagtgctggaagaacgccagaccgttgacgcgctggagatagatgccggggatctggtactgtttcgtggccgtaattccctgcaccgtgtgaccccaactgaaggcgaggtcacccggatgctggccgtgctggcttacaatacgcagccggatattgcgttgtcagaaaccgcgcgtatgaccttttacggcagactatgacatcatggcgtgtctgcaagagcacgccagccgcgcagaaagatttgctgcgtgcggaaagccaccaatgcacgccagtccgcatcttctggccagaacccctcgaccagttgttgctttatcacctggccgcccgcactggcagggtcgccatagaggtgcagccagtgatcttcacgcacccgctgatgcatatcctgaccctcgtaagtcccgcattccaccaccagaggcaaaatccgggtgtcagccagtgacgtcagcagatagtgcgacagatagccggttgccgttgctgtgattccagttacactgtcacgtccggcaccagtaaacaataaggtcagccactcaccgtaaatgactttgccccagtcatgcgccggataacgctgctccgcaatagagagcagcatcggatgcccccatgcgccagccccggtatgaaggtcaaagctgatgatggttttcgccacagagagatgctggtcaacgatcgccgccatcgtaaggtgtgaccagcagggcttcttaccgccgaaaaaaaagccgtcagcaaaactatactgtccggcttctgtgacacgtttaaccgcctgccagcctgcgccctcgagtgcgtcggccagttgccgatcggcgcttgcacggtcgccatgataaatatcgtgccactgtgcataatccgggttagcaggaggtggctgactgaaatcgataaagttacggttcagatcaatattgtcttcgttcacgcgccgtaaatgcgacgcgccccatggattgagcagatgaatcagcaacagcgcggtatcagcgggcaacgctttttcatccagggtctcgagccaggctatctggcaatcggaaccataatagccttcaacgccgtgagtgccggaaacgaccagcatcagacgtgatgcgctggccggtcctatccgtgccacgtctgtatacagagcttctcccagaggaccaggcagaggatgcggataagaggtcgtttcagcacctttgctctgcgccgctgccataaaccgcgcgcgctgaacgtggtattcgggcaacgccatagtcttcatactcctgcgattcttcacgttgtgcggatcagggataaacattgaatttaaaatattttttggtgagctggtcataagtcccgtttttatgcatctccgccagtgccgcattaatcatcttcaggtttgcctcatctcctttgcgtagcgcgatacccacgccatcaccaaaaatcactttatccaccagggtccctttgatggcgtacggcttgccttcggctgaggtcaggaatccctgttcagcagagaccgcattggccaggctgccatcaagacgcccggcgaccagatccggataaacttccatctggttaggataggagatgactttaacgccctccggctcccatttggttttggcataggtttcctggatggtgccctgtgccacaccgatcgtcttaccgcgcaatgaggcaacatcggtcgtcagcgtgctggcagccggtgccagtaaagcactgggcgtgttgtacaacatatcgctgaaagccacctgctgacgacgcttatcggtcatcgacatcgctgacaggatggcatcaaatttctttgcctgaagggcagggatgctgctatcaaaacccatttgcacccactggcacttcacctttgcctgagcgcagatggcattgcccagatcaacatcaaagccctgcaatgatccatcagccgccttgaattcaaacggcgggaacgtagggtcaacgccaaagcgcagggtctgctgcgccagtgccgcgtgactaactgttgtgagcgaaaacagtaatgcaagggataagctctttttcatgttttaattcccggatgcaaatgaatttaagcgcgacattcaaatttaataacatgcgacctgttttcctgccagcgaataaaccgcaatcatccagattaaaatcttatgttattaaggtactgtgcgaattatttatacggcgttaatttttacttaatactgtgcatcaaatgactgagccataccagggtatggcgcaggtccgggcctgaagccgcaggcgctggggatgggataacaagacaagccccagcgccagttttacaggttatcgcgcagcagtgatttatcaggacagggaattaagtaatgcgcctgcgttaaactcaattgtcattagccagacagtaaatatttaccttcccgcgctgcttaaaataaagtttatggggtttaaatcagttcagataaattaacggttagcccatcagaataatgtgatggatgcgcttattttctgctggagagcgctaaacgttcatgcaggaaatctataaacgcgcgtactttttctggcacatgacgcgtattagggtagagcgcgtaaattccctgacgggggaattgatgatcgggcagtagccttactaatccacctttttcaatctcatcctgtaccagccaggcgggcagaatcgccacgccagcaccggctaaagcaaaagcgagtaaagaagaggcactgtcagctgtgatcatggcaggctgaaatgcgctcatcagcacagactcaccttcgggcgtggtcacctgccagctgagtggcgtcgataaacggctatgcgcaatccattttgctgacgcgagatgtgaaagatcccggatagacgcttcattcaggctgttgagataacaaggtgcagcgaccgccaggatatcaaactgatcgataaggcgggcgtgatgactggaatcggcaagatgcccaagtcgtatcgccacatcgaagcggccggcaatcaggtcgtcattttttgatgaagagacgtgatgtatgcgtaactgcgggtgttgggctgcaaagtcagcaagggcagggacgatcacacgagctccatattccagagtggttgtgatccggagtgtcccgcttaatccagcgtgatcacttctcacatcctctaatacgctttccgcatcctgaagcagctgaaggcaacgatgataaaatctttcacccgtatccgtggctgaaacgcgtctggtgctcctgataaggagcgagacacccagctcctcttcgagatgtttaatattgaaactcacaacggctttagttaacccgagcgtctgagctgcacctgtaaaactgcctgcctcgacaactgcgacaaaaatccccagccgttgcatattgatcatcgtgaactgtagctggctggtacggcgcatgggcgcaaaacgtctgtttatgctctcactacttattttcattgcgggcacctgtggtgtgggggcatcaacgtcagtttctcagctcatcgccttccgatggatacagggcatcggcggcggactgttgatccccatcggtcagacgatgacctatgcgttatacaggagcaatgaacgtgcgaagttatcgtcagtcgtgatgttgattgcattgctggcacccgccttgtcgccagctgttggtggaatagtggttgagagccttagctggcgctgggtttttcttgtgagcctgccgctcgcgattgcggcattgctgctggcgggatgctggctcaaagcagacaaaccggcgaacttatctgaaccgctggacctggtgggtttagtcagtggttgtgccgcgctcacgctgatccttctcgcactgacatacctgggcgatgctgacaggctttatcagggggcgatgatgctgcttgctggcgtccttactctggcgggctatgtgtgggacgcacttcgaaaaagccatccactcattaacctgcatctgataaaggatccgctcttacacaccgcaatgctgatctatcagtttataccaggcgtgttcaccggcgtcagtatgatcactatgctatacctgcaaaatcaattaggtatgcatgccagcattgtcggcgcgctcatgctgccatggtctctggcttcctttgcggcaattagtctgacaggtaagacgttcaacctctggggaccacgcccgctatttatcaccggctgtctgtttcaggcgctgggtattggcctgctggcgctgactggccagacatcggacaccttagtctttgtacttgctttcgccttgatgggatttggcggcagcctgtgcagcagcacggctcagagttctgcttttattcacatcaccgacagcgaaacttgctgatgccagcgcactctggaatatcaatcgccagctcagtttttgtctcggcgttacgctggtcagcctgctgttcaatctgattgcgaatagcggcatgcctgaagaacacgcttatcacctctgttttattatagcggcattcagcgctgtgattccgcttctgtgctgtttacgcatttcaaatcagaaggttatttctatgcttaaaagggaccaaaaatgaaccgttattttaaggaagtactggacgcccacgaattgattcgcaactggctgggtaacaaagaagcacatgatgaggtttgtgaggaacttttagcgcgttttagtcctgcatattccatggtgacaccgggcggtgccttactggatttcacgacactaaatgggtttttccgcactcagcgcggtgcacgtccgggtttagcgattgatatctgcgacatgcagatggttgctgagagtgaaggaaatgccactgtggtatataaggagttgcagcagcttccgggtcaggaggccacgctgcggttttctacggttgtgttcgaggtaaatgatgctggcaaggttttgtggcgacatctgcacgagacttcgttgcctaagccatagatgctgtcgattcgcagtgtgtcagggcgcgacgggttgagagcaacagcgtgctcttaaaccagcgatcatcgccactgtatatcctgaaccgatcgccgtgagagatacagtggtggtgaggtgacggctttattgatcgtgaaaattcctcaccagaggccgtcatactcatacaaggggcttcagcaggttgtctgaagcgcccggataaggttagcttagagctttagcctctatgttaccgccttgcctttagtgcgcataatctatcttatgttaaataacatatctcacacgtacttcattaccctttaccaccttcggcctgccgccgatatttttgcgacaggcgaccaaatacctcttccgcgtttttgctttcgccgctttttatacctgcgctgaccgctgtttgcagagcatcaagtttcatctgctgctcccgttcttccagtgccctgaggcccgcacggatcacttcactggtgttgttatatcgcccgctttctatctgttcgcggatgaacgcttcgaaataaggactgagtgctacgctggttggcatgattcctctcccgctgaattactatcagttattaactgttagtatttcagagttactcttctctatcaactttcggcttaacacccttccacaggtttgccggatgtttacctgcgtgtaactttgcgttgaccaaccccgcgaccttatagcatcgccagtatcctgcgcagatctttgcctctttcccgcatttgtgttgtcatcccgtgacggaacgctgacctgtaaagtaaaaaccccaacaatttagctggggttatgatgggtcgttactctttcgctatcggcgtctcgctcacatcaatcttcgtttcaccctgaatgcccttaatgcgtttctcaacgtcattaacctgctcgctgctgtgcagcaaggtgtacgtaagatcaaatgccgtactggcacccggttgcagctgcttcacgcgtttttgttcacgttcaatggtgaccggataggcgtaactggtaccaggttcgatgccggtcacgtagccctgtttcagggtgtcggtatttttccataaggtcagcatcgggagctgacgcgtatcgaaactgaatggatgcgccgctgttgcccgctttatttatcaccgcagcgacggtctgatgattgctgtctgaaagtggcttgatgttgaacaccatctcatcgaagtctttggtcggacctttataggtctgccactcttttaacccggctttcgcgtagtcattgaatgggctgatgccggacatcggcgccaggaagcgtgcgccctcttccagaatcggtttgccgaagttgctgtgatagatgatctggtaatcgtgcggatagtcggcgtggttggttaacacatcatgcaggctgaaactgttgctgcctggcacgtaacgcagctcggtcatggtctgcaaatcagctttcttaaaggtgctctctttaatcaggccgcgaatacgaatttcgtgtggtgccgcatctgccacttcaacttccagctgagaaaccggcgtattccccgctttaccgtgcagcgtatagattcggccttcatcggtgaccggatgaccggtccattcgtagccgcaacgcaccatcatctcgttgaaaccatccagccatcccagaccgttgcggctctcaagattgatgtaggcaggattgacgacctctttaactggtgaatcccagcccatgcgggtgccaaagccttcaacacgcagtaagttcatgccacgtgtcgggcttagcgtaatcgtcaggccatcctcactgcggatcgtcagaattttactgccttcctgcttgccgccatgcaggactttctgctcgatgctgaacggtttgccctgaaacttcagctcactgctggaaatcttccagtttccttgctcagtgccctgttcagcactcgtcagcacccaggttttcgccgctgcagagcctgaaaccagcactgccagtaccgttaacgccagtttaatcttcataagtcatcccattggctgaatcgttttttcattccgtaagggaaatttacttaatgggactgaagataaacgtgatgatgctcacctgttgagaaaaggcagtgagttagccctattattgtgggccaaatcacagtgattacggccagagaggaataactacagcgaaccaggtgaaatttgctgacattagctttatacgattcagctcaaaatgagggttctgataaaggacggctggtgaagcaccataaaaaaaacacgaaaaaaattcctcaaccgcgcaactttttccatttttaaacgaacctgttatcagggacgtcagacaactccgtctgttcgtcaatggagagagtaaagccaatgaaaaacaccctgaaaaccctggccgtcgctacgctgctggcactgagtgttccggcaacatctgcttttgcagcgttacaggtcggtgaaaaagcgccggactttaaactggaagccgcgctggccggtaaatcgaccaccttctcattgcaacaggcgctgcagaaaggcccggttgttctctacttcttcccagctgctttcagtgcaggctgtacgctggaagcacacgattttgctgaagcgaccgatgaatttaaaaagcagggtgcgaccgtcattggcgtgaccgcgggcaataccgatcagattgcgaaattctcgcagcttgaatgccgtgacaaatttaccgtcgcagccgatcccggtgccaaagtggcggcagaatataagagcaccatggagatgaaaggtcagaaactctcagaccgtacctcttacgtgattgcgcccgatggcaaaatcctgctgagcttcaccgataaaaatcctgatacgcatatccagaaagcgatggatgccgttaaaaaataccgtcaggccaatccggcataacttcatcttcagagcaggtacatcatgctgactgcgattgcagccgccttcctgggcggcattattctgaacctcatgccctgcgtgtttccggtgatctcgctgaaagcactgagcctgatccgccatcacgaatcaccttcccacgccagagccgaaggcctggcctttctgctgggcgtagtcgtgacgatggtcgctctgaccgcagtttctgttgctggccagggcgggcggtgcatcggtgggctggggattccagctgcaatcgccgctggtcatcgccgcgctgattctggtgatgcttgggtcggcactgaacctgctcggtctgtttgaagtaggattatcggttcagcgggttggcgaagtgggaggcgatcgcggtggtttagtcggttcagctctgactggcgcgctggccatcattgtcgccactccctgcagcgcgccctttatggccagcgcggtaggctatgcgcttacccagcctccgctaatcagtctggtgatctttatttcactggcgctgggctttgctgcgcccttcaccctcatctcattcttcccggtgctggcgcgaattttgccaaaaccgggtgcctggatgatcacgttaaagcaggggctggcgtttcccatgctgggcgcggtgggctggctgatctgggtacttgaacgtcaggcgggatcggcggcgctggctgccattctggcctgctgtttactgtttagtttcgccgcctggctgtatggcatggcgcagaaacgccgtatgatggggcagcgtcattgggtgctgcatgtggcgaccgcattcttcctggcgctggtcgtggtgccgttactgaacctgaacaggtttgccgaagctccggctgaagcggcaaccgcctcacaggctgctgccgctgtggcatggtcgccccagaacgttgatgccatcaaaggtcagggcaagccaatactggtgaactttaccgcatcatggtgtattacctgccaggttaacgatcgtacttcgctttcgacgcaggcggtaaaagcggcgatggcgcgaaccaacaccatttatatggtcgcggattccaccaaatacaatcccgatgttgaacaggcgctgagcgatttcggacgcggtggattaccgctctacgtggtctatccggctgacggcggtaaacctgaggtactgccccaggtgctgacgcctggcattgtgatttcagcgctgaatcaggcaacagaaaaaggaaataaatcctgagattactgatgaaacgattgcctggcgcgtggtcagggcacggcgacgacgtgctgaactgctgatgatcgatgccagaaactgatcaacgcgcacagcagtggccagcattaatggcccgggcgcaggcgggtgatagagctgcctataaccagttactgaaagcgatggttcctgccatccgggcattggtatgcaaaaaaatccgtgatgagggactggttgaggatgtcattcaggagacgctgctggcgattcatcgggtgcggcatacctacgatccgcagcgtccgatactcccctgggttgctgccatcgcctctgcccgggccatagatgcgctgcgccatcgcggccgtcgccaggaagtacaggatgaggaagagctgcaacgacaacccgctgcaagtgcagagtcctcagccgatacggatatcctctcaggttatctggataaccttccgctgcgccagcgggagatcgtcgaatctgtgcatctgcgcgagcagagcctggcgcaggcagcagctgaaactaatcagtcgctctctgcggttaaatctctgttgcatcgcgcaatggtcaaccttcgtaaatatggacggggtcatcatgagaaatcatgaccagttaattaatcagctcagcgcgtctgcccagccggtgcagcgcgtctggcccaccgcctggcgcgttgcgggctggattgcccttgccctgccctgtggcgcgctgaccagctgggcatttcacagccgtttcactgactggtcgcagcctggcgcgtttttcgcgctggttgccctgctgctgtcactcatcatcgcgggcagcacgctggcggcagcctttacgctgagtattgcaggcagaaaaccgatcagcctgcgctggccgctgctgatggcgatgatgtggctggttctgaatctgatcaatatgtcatcttcagcaccgccatcgggcgcgaaaccggttgggtgaagggatgcactgctatctgtttatgctgtcggccagtgtcccgatgatgctgatgtccgtgttcgccctgcagcgcacccgatccctctatcccgcgcgcagtctggcgctgagcggctgcggcagtgcgtttacctcatcgatgctgctgtcgttgtgccacgatacccatctgcacgccatcgatttttctatgcatctggctgcgggcatcaccatcgtggcgctgacggtgctggcaggccgccgctgggtcaggctgggagagtaatggcacgccgcttccgttcctcctgaagatgactccgcgccccgttcaatgaaattctgtcaggagcgcggattgggtaattttatgcattctcccccgcgcggctacggcccagatccagggtcagagagaccgcaccgacaaccagcatcagcgccataatcagtgaaaacgagaaagcgagatgtgtgtaatgcgccacgtagccaatcacggctggcccgctcaggacccccagatagcccagagtagtaatggcaggcacggcgaccgcctgcggcatcaccgtctgacgtccggcggcggagaacattaccggcacgatattggcgcagcctgcgccgaccagggtgtagcccagcaacgccatcggccaggaggcgataaaggtcaccatcgccatgccagcggcggcaatcagtgcgccgcccagcacaaccggtaaacgtcccagcgatgagataatccggtccccggtcagacgcgccaccgtcatcgcaatggcaaagcaggtatagcccagcccgcccagtgatgccggaatggcccggacgtcggtcagatagacagcactccagtccagcacggtgccttcggtcaggaagacggcaaagcagatgatgccgataatcagtacgctgccgcgcggaacagcaaataccgggccttcagcggggttcgcgtaggtcagtaaacccggtgcgctgaccagcgtcatgataatcaccgccacaactgccagcaaacagccggtgagcacgctaaaacccatcgccagcagcagcgtcataaagcccgccccggcaatgccgcccacgctgtacatgccgtgaaagccagacatgactggctttgccgcctgtttttctaccaagatcgcctggatgttcatggcgcagtcggtcacaccgatgccgacgccaaaaaccagcaacgccagcgccagcaacagcgggtcgctgagcaccgacagccatggcgtactgatgatgaccagcgcgacagcgaccagaatcacccggcggcagccaaagcggctggtcagccagcccgtcaccggcatcgcaatcagcgcgccgacgccaagacaaagcagcaaggtgccgagttgcgcctcattaacgccggtattgccgcgggcgaaaggcacaatcaccgcccaggtcgcggtgataaatccggctataaaaaagatgatgcgtgttgccagcgtggaagagacgttattagccattgcattcctttgagggatgtcggggagagctgacaggaccgagagatcgctattgactccctgcccggcagtgaacgattatgctcactatagctcgattgtgaatattttgaggtttatatgctcgattatgcagctttcccgcagcagcgacaagcgctgattcgtgagatattgcaggacaaaggacgggtggtctgcgctgacctggcacggcaattggctgtatcagagcacactatccgccgcgatctccatgaactcagtaaagagggtttatgtaaaaaggtctatggcggtgcggtgttacagcttcaggaggcgggcagctttgtcagccggaaagctcacgatcacgcagcaaaagccctgatcgcgcagcgctgtgccagcctggtgaaagccaatagctgcatctttattgatgccggtacaaccaatctggcgctggcacaggcgctatcaccagatttgaatatcaccgtcgtcaccaatgcacccgatattgctgcgctactgatcaaccatcctgctgcggaggtgattatgctgggcgggcagatacagaagagcaccggcggcgcggtcgggcaaaccgcgatcaaccagatccaggggattctgtttgatcaggcgtttattggcggctgtgccatgagtccggaggccggtctgaccggttttaactatgcggattgcgaattcaagaaagttgccatggcacaaagcaatcaggtcattgtcgggctgacagcggataaaatccctgccgtagcgcgattcagcgtggcgaaatgccgtgaaatttcaacgctcgtcgtggaagagaagctcgataaagaactgcttgaggcgtttgaagcggaagagataacgcttattactgtctgatacggggtgatgaaataaatcgtgtcgcagacgaaacccgatcaacgcaccctgccctggctgtactaatggtcgacaaatccgcacccgatgctgccaaattccaggctttagcgtaggctgaaagctggctggtttcactacacaggagatcacgatgcaaaatgaaatgacagcacaatgccactgtggcgcggtggcgtaccgggtgacgctgaaggatggatttaatacggtgcgccgctgcaactgctcgttttgccggatgcgcggcgcggtggtggtatttgcgacaaaggtggagctgacccggggtgaagcgcagctcacagagtatcgtttcaacagcaaagaggtgggccactacttctgttccgtttgcggcatttacgcctttcatcagagccgctcacagcccgatcagttcggggtgaatgtcgcctgccttgagggggtttcgccgtttgatttcaccgatgtcccggtctccgatggtatcaatcatccaaaagatggcggcgcgggcggtgtagccggtcatctgatctacacccccacgcaatcctgaacgatcgcaggctgaactactcccgtgtgggcttgccactgaagcgggtaatcggcttttgctcttcacggtcgatctgttgtgagaagacttcaagcgccgcgaagatggggcgcagtccgcgccacagatcctcatcattgagtaaccggataatgccgcggattcccggcgcggctttttcctgacgggcctcatcgcgcgccggtttaacggccatcgcggcatcgcgaacggccaacagcagatgattaaaccgttctggcggcacgctgcccagcgtcatcatcagtatcgagagattctgcagcgcgttctgcgtacccggctgattaaggcccgaaaccaggattttccccacctcgctgtttgatttaaccagatcgttcgccatccgcagaaaaccgtgctggtgaagattttcgattagctcatccatcgcctcccgggcggtcggctcggtaggtgtcggcgggacctgatatttcatccgttctgccattagaatttctccggtttttcgacatgttcaggcggttcccgatagccagcctgctgccatttttgctctatcggcaggtgatccagcggcgtacgactgccgtgacggaagttgtgtagtggcaccggattaggctgcgaccggcgatcaacgcgcttcatatttacggcaatctctttataagctggtgtgttgacgtcgggatcgtgatgttcgccagtcagggcgttgacgccatctttgccatgatgaatcggcataaacagcacgttgcctgccacacgctcagtgatcacaacaggcacatccagcgatccgcgccgcgaggtaatgcgtacccactctccttcgttcagcgcgcgctcggcagccagctccggtgagatctcaacaaaggcattaggcgacagcgacatcatgcggccaccctgcccggtctgattcatcgactggaaatgctccagcatccggccattattcagcagcagattatactgtgaatcctcctgctcggcgggcggttgccagctcagcggatagagtcgcgctttgccatccgggaaattaaaccgttccgtgtagagtcgcggcgtgctttcgcctgcggcgctgacgggccagagctgggactgccagccgaccagttgctcatagctgacacccgcgaaaatctctgcgatgcctgccgcttccgccataatcgcgcctgggttcgggtaatgccacggatgaccgagacgggcggcgagatcggtaaagatctcccagtcgggccgacaatcacccagcggcttcatggcgggtgaaaagtgctggatccgccgctcggtgttcacaaaggtgccctccttctccacgctgggcgcaccgggcagtaccacatcggcaaattcggcagtgcgtgacatgaaaatgtcctgtaccaccataaattccagcttgctgaaggcggcatgcaccgaagtggcatcggcatccgcaaacgccgtctcttcaccggtgatatacatcgcacgaattttgccttcaccggcctgctgcaccattttgaaattatcagcaccaggctgatcggaaagcgcttcaggcgagacgccccaggcgcgcgcccatttttcgcgcaccgctgggtcagtgactttttcatagccgggatagagattactgaggcagccaaagtcgctggcgccctgtacgttgttgtgtccgcgcatcggataaccgccggtgccaggtcggccatagttgccggtgaccagcagcaggttcgacagcgccgtactggtgtctgccccgtggctgtgctgggtaattcccatcgcccacaacacacaggcgctgcccgcctggccgatcatttccgctgcttcaatcagttctgattcactcagtccacatgtctcactggcaaaggccagcgtaaagggagcgagtgacgcgcggtactcatcaacctggttgacccgctgggccagaaaagcctcatccgcataaccgtgatcgaacatatattttgccatcgccgaggcccagaccaggtcagtacccggtcggatgcgcagatagcagtcagcacgttccgccatttcatgacggcgcggatcaacgaccagaagtttctgaccgcgatgtttgtggctctgtttgatgtgagaagcaatgaccggatggttctcggccaggttgctgccgaccagcacaatcaaatcggtctcttgcagatcctcaatcgtcccggcatctccgccgtagcccaccgtgcggaacagcccttctgtggccgggtttctgacaatagcgcgaggagttatcaacgttgttggtgccaaaaattaaacgggcgattttttgggtcagataggcttcttcattgctggccttgctggagccgataaagccaatcgcatcgcctccataattctgagcgataccctgtaatccttcggcaacccgctgtagtgcttcatcccagctggcaggccggaagtggccattctcgcggatcaacggcgtagtcaggcgctccgggctgttgacgaaatcccagccgaacttacctttaacgcaggtcgagatgccgttggccggggcttcggcaaccggctgaactttcaggatatggcggtcgcgggtccagatctcaaagctgcagcccacgccgcaataggtgcaaacagttttggtgcgtttgatctccgactggcgcagcgccacatcgattttcgaaacgccggtaatcggctccatgccgatgctgttttcaagcgttttaacaaagtcgatcagcggacgcttcagcccttcatccatcgcagtgaacggacccgcatcgggctgcatggttttttcgagcagcgcattgcacgggcaaactgtgacgcaatgtccgcagctgacgcaactggaaccggcgatttccgttccgccatcccagagcacgcgaggatgcgcctgggtgtagtcaatcgacagcgtctcattgacctcgacattctgacacgcttcgacacagcgaccgcataagatgcactggtcaggatcgtaggtgtaaaacggattggaatgatcttttgcgtagggcttgggctcatgaggatagtactgaatcggaatgtgcatatcagccacggcattatgcagcgtgcagtcaccggtattgtgttcacagacggtacagtaaagctcatgacgattgagcagccgatccattccctcctgctgcgcggccttaagcgcactgccttcactctgcacctccagcccctcttcagtgcggagcgtgcagccgcgaacccgctcgccgttggcatctacccagcagacatcacaactttgcagtggcggcaacgccgggtggtaacagacatgaggtagttttttcccttgagcatccagaaaatcgattagcggttgatcagctaacccttttaaccgttcaccattgtagataatggtgcagtaattttgactcatataagcctcatgacgacattgcgacgagctaccgaatggaatatctccctctatttaaagggttgcttcacaagcttagtgaggattaacagccacgccatgaataccgctacgcttattaaggttactcgctgacaggtaaggtttttttaaatgtaatgacttcttaccggctaaaaacgggtcagtttttacccggctgatcgtcagaatctggcagagcggtttcgcgttgataagcattggccgcacaatggtgaagtttagggttaataaccaaacacggtgtatgttgtaactatataatcaactagcttatttcgctataagacgcagggtaatgatcggcacgcttatcaatccgtcgttttgccctcaggcaaattaattatcaggaccgccgcgagttaacagactacttccgaattaattacgtaccgccactaacttattccagtacatatcaggctgaaacgatttaatctggataacgggtttatggattattttagctattaaacgggactattctcctgcccgtgagtgagcgaacaatttatggcatagctatgtcgatcaaatgacagttatccgcatttacgcccagaacagtggcgctccaccccagagttgacgctcacattttagtcatacctatcagccatttatcttaattttaacaagctgataattataagatgataatgataactgttatggtaatatcctgttaaccctgcccgacactttctcatcagggcctctttacgcgtcatgcttaattaaattatcagtaaatacctggctgaaatgaggtccctatgaatcccatcgtttatatcgttgacgacgacgctgctgtgactgctgcactgcgtaatctgctcactgccgacgattacacggttatctctttttcttcggctgatgatttcctggctcacgcttttactccccttccctgttgcctgattctggatattaatctgcctggtgcagatggatttgatgtcgcacaggcattgatcgatcgtggctacgccattcccactatcttcttaaccggcttcgggactattccggtcacagtgcgggcgatgaaaaccggtgcttatgagtttctgactaaacctgtcgatcccgatcgtattttgcaggcggttgcagaagccttacagatcgccgggcagaatatggcctcttccgaggagcgaagggagatactggagcgacatcagaccctgacaccgcgtgaaagcgaggtcatgctgctggcgattagcggcctgctgaataagcagatcgccgccgaaatgggcgtcagtgagatcacggctaaagttcataagcggcgggtgatggagaagatgaatgcacggtcgctcaccgatctggtgcgggcggcagagcggctcaatattgatcatacccgacgccgctaaggccaggcagacacctggcctcaatacgattatcccagtggcagagtgaaccagaaacggctgccgccttccgcccggttctctgcgcctaactcaccacaatgctttttgataatccctttgctgatggttaatcccatgcccatgccacttttcttcgtggtgtagaacgactcaaaaatccgttcacgcaccccatccggcaagccgcagccgctatccagaacctcaaaacgcagcgtgtccggcgtcgggtttctctgacgtcagccgcaaaagcgccgcgcgcggtaaatcgtcggacatggcatcaatggcattgattaccagattcagcagcacctgctgaatctgaacgcggtcgcaatagatatccgcctttccggccctcagtttcagctccagcgaaattccgcgtcgctccagctccactcgggagagcgccaggatatcgcgggcgatcagatggaggttttccgaggcaaagctcgattcatgattgcgggtcagcgcttgcaggccacgaattatctctccggcacgttttccctctttgataatttcatccagactgctgctggcattctccagcatcaccggttcacgctttaaccagcgcaggctggcaccggcattggccacgatcgacatcagtggctggttaatttcgtgcgcgattgaagcagtcaactgcccgactgtggtggcgcgggttacacgggccagatccgcctgtgccatgcgcgcggcatcttctgcctggcgctgcaaggtgatatctgaaatggtgccgaagtactctttcacctcggggaagttttctaccggctctccgatgcctttgatataacggcattcaccatccggcctgagcacacggaactcagcctgcatactacgtccctgactgacgctgtgcgtcaccagttcgctgatgcactcataatcatcgggatgaacgcgggtcagaaaatctgccatcgacaaccctttttgatgggctggcaggcccagaatacggccatactcttcagacaccatcatcatgtcctctgccacttcccagcgccaggtgccggtatgactgatcttctcgccgagcatcagtgaggttttgctggcgcgcagctgcttttcaacccgtcgccgatggttgttctcctccagcagttcagcgtagaggcgcgccgtctccagcgaaaccgccgcctgagcactcaacgttttaacaatgtgggagtgctcagccgtgaacgcatcgggcatcaggcgattctccagatagagcaccccaaccatattggcctgcctgaacatcggaacacataacaccgcagcgcccgaggccaccaggtaaggatcctgactgaacggactgaactcttccggcttgccagtacgtatctcctgaccggtacggatcaccgcggccagtaccgatagcggcaggtcagttgcgacggggcgctctttgacaatctgcacccgcacgccatcagccgtgctttctgcccaggcctgcgtttccggaagcgtaccatccagaatccggataagccgacagcgctgggcaccggcccgctccagcaggatgcgcatcagggtatgaatcaaccgatcaaggttgatctcctccgtcagggcgcgcacggcggtcagcacactctcaaggtcgtagaacgaggcatcctgcgtaaagggaatggtcgccaccgcgctgttttgcatcggcgtggtcagatgcggatagtgctgctcaagctggcgcaccatcgccagcgcgccccagctctcccagcttctcatcgacgctttaacgtaggcatcggcggcggtatctagctgtaatgctttgcagtagcggccagccagctgattcgccagcgcatggatgtgcagatatcccccctggcgggagagacagatcgcattttcatactgcttcagcgcctcacccgtgttgccctcaagacgcgcacattctgccctgagcagggcatatttatcagcaaagagtccgggattgaggtcggcccagcccgcaaatttgtccagatcgcagcgcagcgtgttgctgtcagccgcaccgggctgcaggctcagcgatagtgcgctgtaaaaatgcatatccatcaggtagatgtaagcgggcactgcgctggtcagcggacgaatttctgcaaaacagcgcagcgcctcccggtattctgccgcaaagaaatgcgccattccccgatacaaccccgcccagaacagcaccatcgcttttgggccagagatcacgcccggctcgcttcccgccaccatcggcaaagccccatcgcgatcgcctgccctgaacccgttgctgttccgcagttgcatcaccagctgcttctgcatgaccagcacgttctcaacatcgggataaaaggttttgcgggtaaaagcgagtccgcgctcaatggaggtcatgaccgactccaggtgatcgccgcgtgtcagcgtgttcatgatctgatgacgcaacgagaggcaggcaaaggatcggtcaccgtgcatcaccgcgacgcgaaaactttcacgggcactctctacggccacatccagcggctgcgtccagatccccagttgatccagaggcagcagcgtgcgggctttatagcgggtaaagtcatgccgctccaccagctcacgggccacccgaccacaggcatagccaaaatgccaggcctgatagcgttcgctgatcagcacgctgaaccaggcgagaccaaacgcagaagcaccggtcacgccgtgatccagcgtcatctccagcatccggcagaccagcaacagatgcagctgcgggcagtcgtaggcggagacaaagatggtgctggccatcaggttcagcaccgactcagtttcctgatcggtgttgcgtggcaggtgggaaaaagccgcttgcggagaatcgccgatccgcgccctgatcgcctgccaggcggcgtcaatctccgcgtcgtccggatcacgcctgagatgcacaccaaagacagccagccaggcgagcgcagtttccagcgccagatggttgtcggactgacgcatatgaatttcagcagagagacaggctgccatcgatttttcactgagcgtgcctggctcactcagcagtcgggtacagagcttttgcgcggtcgtgagattaccgtgcagaaattcgcactccgcctcatcgatgcccagcataaagtcattgccggtcaccatccgctggctgagttgctgggcgctgcgcagatagcgcagcgcagagagataatctccggcacgtttcgctccctgcgcagcacgtaaacagaggggataatagcgttcacgatctgcgacacttagcggcagttcagcaatcatgccgatgtgataagccgcgcggaacagcgtctcactgtaatcggcatttacaaccgcggccgacagccatgccgccgcctgctgatgaagagagtgttgctgcaggaggtcgagcagtaaaaacgctgcgttatgcacgcggtcgtgggtaaaggcgtagttcccgccagtcagggttataaaacggccgctgacggcaggctcaagctgctgctgaatccgcgatacggacgtcgcgttgatatgacttaataaagacagctcgccgctggcccccaggcaggccagcgaacccagcagctggcgtgttgcctccggcatccgcgccagctgatttaataccagcgtcgccacattgtcggtgtactgacgcgcaatcagcgcctggctgtcgtaatgccacttcagcgggttctgacgatagacaatcaccccatcatccaccgcctgacggaagaactcctgcatcgagagcggattaccgccggttttctcaaagataatctgtgccagctcacgattgccgccgggacgggtatgcagcattcccgccagccagcgggtgatgcttttaacactgagcggctgcggcgtcagcgccacgacacgtgccgctgatgctctgaggcgcagcagaaacccggcaatcatcggacagggcatcgactcaccctcccggaaggcgagcaccagcataaaaggtagatgctcattacgggtaatcagattttccagcagttgcagcgtggcattgtctgcccagtgaacatcatcaatcagcatcaccagcggacggcccggcgtggcaaatgcctggataagcgcagacgccatctgattaaactgctcgcgggcgtccggggcatggcgcaccaccggctgcactgtccggatattcagcagctgttttagttcaggcaccagttcaatggctaaatcggtatagccacccagcaagcgcaacaggcgaacccgccatttgcttagctccagggctgacaatcccagcagataaagcgtgactgtgcgaaacgctgaggcgactgcggcataaggtgcggcaggcgaatgttgatcggccttgctggcggccagcagaatctgtcggtgctgcagggttttcagggcggaagcgataatggcggacttacccgagccgggcgcaccgctcagcatcaccaggctctgcgtgccggtacggttgaccgcatccagcgtcgtcagcagtacgcgagcctgcggatgttgcgtgaacagtgtctcgggccggaaactggtgctgaaccgctcctgcagaccgggcgtgaacggcgcaatggtgttttctgcggtcagcgtcgcctgacagcggcgtaaatcagccatcagcccctgcacggtctgatacccgtcagcaggtgactttgccagcagacgcagcagaatcacagagagcatcggcggcacatcctctctgacctgtccggctggccggggtgcactggcgatgtgatgatgaatccactccgcctcccccgcatccggtgagccaaacggcaacttaccggtgagatattcatacagcacgacccccagactgtagagatcgctgaggctgctgaccggatgcggcgtgcggccggtatgttcaggtgacatataggccagcgtaccgcctgagacgcgcaggctgtttttttccgccgactgcgccgccagcgaggcgagaccaaacccgcccagccggaaccggccatcatcactgacaaaaaaatggcccggcttgatatccccatgcacgatgccctgatgatgcgcctggccgagcgtgtagcaaagctgcaatgcaacctgcaggaagtcagcgattttatcgggaggggtcgcgaggttattcgccaggctgcgaaacggaaacgtggggtagatcagcgcatagcggttgaggtaacgggtggtgcccgtcgcggtaatggcccagcggggcgaaagataagcggccagcgctcgctcatttttcaaccgctgcgtcgcctgaaacgtgacgtcgtcactctgtccggtggcgattatcagtgactcacctgagtgacggcgcgccagcatccagagcagacagccatcctgcgccagcggcgtcagcgtgtcgaaatcttcaatcgcgatccctgcgtcgtcactctcctgaaaattaaccgaaagcatgctcatcagcgcacctttccctgagataactcgcaacggatcagtgtcagcagcgtatcaacatcaatcggctttcgcaaaaaagtcactgcacctaaggcaatggcataccacagggtggtctcttccagatctgctgagataaaaatcaccggtggcacacctgcccgctgtttcaaaatagtgaatagctcaaagccggacatgcccttgagtccgacatcgatgatcagcatgcccacctctgaaagcgcatcgtcatcgctcagcagcgcctcacctgactcaaatagtcgggtcgaatagccgtctgaatgcaacagattgctgagtccactgcggaccgcgcgttcatcgtccacaatgacaatacgctgtgacagcgccatgcagttatcctctgaaacgcctcatcgtacggcacgcgaggacttaagggtggtcatcgccatcgggtggcggtgtcccactgatttttggcacacactcatggcgaaaccacttcagcgtcaccggctgacggcggaacagacgcgtacccagcggaatcaactgctcacccaccagcatgccaaacagccccactaaagcaataaccggaggtgccggagagttcacgttgatcagggcatagattaccccggcaagcagccccaccgtgagagaaataatgtaggatttcaacatgttcagcttacccgcgaaacaggtgtaacaaacggcgcatcggatcgctgcagggtggtcgtatgctcagcgggcaagactgcatgaaccagcgccccacccagcaacatccccagcagccccaccagcgcaatcgcgggcggggccggtgaacgcacctttagcaggccgtaaagcaggccaatcaatacccctgcagccagagaaagcagtaaaggattcataaccggactcctgttatgcctgctgaccggcagacgaaagccgatcagcaggacgccccttagcggaccggtgcgtgaaccggtgccagagtacgatgttcacttttctgacgtgacggcgctttgtgtaccatggtgtaggcataatccacaccaatgccataggcacctgaatgctctttggcgatgttcatcaccgcatcgtaagtgtcacggttggcccagtcacgctgccactccagcatgacctgctgccaggtgaccggcaccacacccgcctgaatcatgcgctgcatcgcgtagtcgtgcgcttctttggtggtgccgcctgacgcatccgccaccatatagatctcgtaatccccttccagcattgcgcacagcgcaaagctgttgttacacacttccgtccagagaccggacaccaccacttttttcttgccgttcgcggccagcgcatcacgcactttctggtcatcccaggagttcattgagctgcgctccagaatgtcctgacccggaaacacatccagcagttcaggataggtgtggcccgagaagctttcggtttcgacggtggtaatgatggcagggatattgaagactttcgccgccttcgccagcgcaacggtgttgtttttcagcacctggcggtcaatcgactgcacgccaaaggccatctgcggctgctggtcgatgaaaataatctggctgttatgtggcgtgaggacttcaagcttagcgttggacatgcgttcacccatagaggttatgtaacggaattttcgccaattggcgcggagcaaaaggacggtcagtgcaggtttaacgtcctgctgctggctgtctggtcgcagtgtagggcgacgggcgaaggcaaactattatctctgcgtataactatacgaaggtataggtatccctctgtataactagacgacgcattaacccgctcaccataatccggcttattcgtgccctgttatctgcggcacttcctgtcccgcactacgtcggacaaccccgttgaggaggatctatggttacgctgggtaaagcagaactgatactgacccatggcaaatttcatactgttgaccgcagcaatccggtggcagaagcggttgcgattcgtgatggcaaattcgttgcggtaggcacactggcagaggcgatggagtatcactgcgacggcaccaaagtgatcgatcttaaaggtcacaccgccgtaccgggcctgaacgattcccacctgcacctgatacgtggtggtctgaactacaaccttgagctgcgctgggaaggggttccgtcggttgccgatgcgctgcgaatgctgaaagagcaggcgctgcgcacgccgtcaccgcagtgggtgcgtgtggtaggcggctggaccgagttccagtttgccgagcgacggatgcccacgctggatgagatcaacgaagctgcccccgacacgccggtcttcgtgctgcatctttatgaccgcgccctgctcaaccgcgcagcgctgaaagtcgtcggctacaccaaagagacaccgaacccgccgggtggcgaaatccagcgcgacagcaacggcaatcccaccggcctgctgatcgcccgtcccaatgcgatgatcctctacgccaccctggccaaaggaccgaaactgccgctggaacagcagatcaactcgacccgtcagtttatgcgcgagctgaatcgactgggtctgaccagcgccattgatgcgggcggcggcttccagaactatcccgaagattacgaagtgatctctgaactgcatcagaaaaagcagatgacgctgcgtatcgcctacaacctcttcactcagcgtccggggcatgaactggaagattttgagaagtggacggatatgctgacgccaggccagggcagcgactatttccgtcacaacggcgcaggcgaaatgctggtgttctcggccgccgacttcgaagattttctggagccacgtccggacttagcgcctggcatggaggatgaactggagcgcgtggtgcgtcatctggtggaacatcgctggcctttccgtctgcatgcaacctatgacgagtcgatcagccggatgctggatgtctttgagaaggtcaaccgcgatatcccgtttaatggtctgcactggttctttgaccacgcggaaaccgttactcagcgcaatatcgatcgtatcaaagagctgggcggtggcattgcggtgcagcatcgcatggcattccagggcgaatactttgctgaacgctacggcattgaagccacccgccataccccaccggttcagaaaatgctggaaaccggcgttccggtcggactcggcaccgatgcaacccgcgtcgccagttataacccctggaccgcgctctactggctggtttccggtcgcaccgtgggcggcatgcagatgtatgacgtcaatgcccgccttgaccgcgaaacggcgctgatgctctggactcagggcagcgcctggttctccagcgaacaaaataaaaaaggtcggattcaggtaggtcttctggcggatctggctgtgctgagcaaagacttcttcagcgtgccggaagaggaaattaaaggcattgagtcagtgctgacggtggtggatggcattattgtctatgccgccggatcgttcagcgcggatgcgccgcccgctattccggttctgcctgagtggtcgccggtggtgaatgtgccaggtcactatcgcagcgctccgccggttgcgcagagccgtgcgggtatgatgcccgccgtgcatcactgcagcggcccctgcggtgttcatcgccactcgcatgagatcgcccgtggttccagcgttccggtcgccgaagataacgccttctggggcgcgctcggctgcagctgcttcgcgttttaatcatgaataacgctatcactcaatcgccccgcatcaacgcggggctgttcttcctgcgcctgaccggcagtctgctgctgttacaggtgcatggactgccgaaaattctgcatttcagcgaagaactgacgcgtatagaagacccgtttggtctgggaccgatgatgagcctgctgccagcgatagtggcagaagtcatctgcccgatctttattattctcggctggggtagccggattgcctgcctgccgatcatcgcggtgctgctggtcgcgatgctggtggtacaccctggctggtcactggcggaaggccagtttggctggctgctgctgattatctttaccacgctggcgctgaccgggcctggcggctggcgaatcggcgcggtgaaacatcagggggttcgtcatggcgcaggttaatgatatccaccagctggagcaggagcagcctgaggtccaggccgctggcgagatttcgccgttacagccgctacgcaggccggtgttccgcatgctgtggatcgccaccgtcgtctccaatatcggttcatggatgaacgatgtgggtgtgaactggagcatgctgacgctgagtgccgatccgctggccgtggcgctggtgcaggcggccagcagcctgccgatgttcctgttcgcgctgccatcaggcgtgatggcggatatcgttgaccgccgcaaatatctgctgttttcccagctatggacctttatcgccgcctgtggactgacggtgctcgcctggaccggccatgtcactcccgaggtgctgctggtggcagccttcttgctgagcgccggtgccgccatgagttcaccgccctttcaggcggtagtgccggatctggtgtcgaaaccggagctgggtgcggccattgcccttaactcactcggtattaatatcagtcgtgccatcggcccggcgctgggtggcctgatcctctcgttcactggtccctggatggtcttcctgctcaatgcgctctcagtgctgggcgtcacctgggtgctctggcgctggaaggcggagccgagcgtgcagcgcctcccgcctgagcacttctttccggcggtgcgtgccggactgcgctacgttcacgcggcaccggtgttgcgtaatgtgctggtgcgaacctttgccttcttcctgtttggcagtgcgggctgggcattgctgccgctggtggcgcgtcgtgaactcggcctgggccctggcggctacggcatcatgctggcctgtatcggtgttggcgcgattaccggcgcggtgctgttgccacgcctgcgtcgtcgcctgagctccgatcgcctgatggtactcgccagtcttgttttcgccctgaccatgctggcgctggcttttgtacgccacttctggctactgaatgcgtttgaattttttaccggatttgcctggattgccgtgctctcgacgctgaatctcggcgcacagcgcagcgccgcgaaatgggtaaaagcccgcgcgctggcggtctatctgacggtgttcttcggctccatgaccgctggcagcgcactctggggacagctcgcctcgcacttcagcattccgctgtcgctctgcatcgccgcactgggcatggtgctggccagcagcaccgtctggcgctggcgtctcgaccaggatcccgacctcaatctcgatatgattggtgatggcgttaacgcgcccgcactggatattcgtcacgaaacgcggcccggtgatggtgaattacgaataccgtattactattgatgatgcacatgcctttaccgtctgcatgcaggatatgcgtcgggtcaggcgtcgcggtggcgccatcaactggtcactgtatgaagatattctgcagcccggcattttcgttgagacctttgtcgtcggctcctgggttgagcatctgcgtcagaaagagcgctacaccatcaacgacaaaaagatagagcgacgggttttcgcttttcatcagggtgaacattcacccgaggttcgctatctggtggcgccagcgtgactggcacaccatcttttcatccatcacgtcatacagagggcaataccatgagcacctttaaaacgaccgacggcacacagatctactttaaagactggggcaccggtaagccggttctgttcagccacggctggccgctggatgccgatatgtgggacagccagatgaacttcctggcggagcacggttatcgggttatcgcctttgaccgtcgtggatttggtcgttctgatcagccctggaccggtaataactacgatacctttgcttctgacatcaacgatttaatcacccatctcgacctgcagaatgtgacgctggtgggtttctcaatgggtggcggcgacgtcacacgctatatcggcagctatggcagcgatcgcgtcgcggcactggtgctgctgggtgccgtcacgccaatctttggcaaaacggcagactacccgcagggtgtcgatatgtcggtgtttgaagggattcgtgatggcctgcttaaggatcgcgcgcagtttatcaaagaattcgctacgccgttttatggtaccaatgccggacagaccgtttctgatggcgtcatgacgcagacgctgaacatcgcgctgctcgcttcgctgaagagcaccgttgattgcgtcaccgcttttgctgagaccgatttccgtgctgatgtagcgaaagtgaatgtaccgacgctggtgattcatggcagcaacgaccagatcgttccgtttgaatccaccggcaaagtggccgcggagatgattgagggtgctgaactcaaggtttatgacaatgcgccgcacggttttgcggtgacgcatcaggatcaactgaatcaggatctgctggcgtttcttaacgcacagtgatgcaaaaaaaactgcgcggtgaaagccgcgcagttttcattttaacgggttggatgattcacttcgttgggacgcagatcgaataacaacacctccgctccttcaccgtgactgaacgacagcgttttctcattgcgaacccgcgcaccgtctccggcattaaattgcaggccatttaccctgacactgccgcgcgccacatgaatatacgcatagcggtcgtccggcagagtgattgtctgctgctcatccccctggaacagtcccgcatagatgcgaatatcctggcgcacccgcaatgccccgttttcaccttcaggcgaaataatcagtcgcagattaccgcgtttatccgcttcgctgacggagacctgctggtagcctggcggactatttttctctgccggcaccacccagatttgcagaaagtgaacaccctcggtgcccgagtggttgaactcactgtgagttacaccgctaccggcactcatcagctgcacatccccgggaacaatcacagagccggtgcccatggagtctttatgctccagcgcgccctccaggacataggagataatctccatgttgctgtgaggatgggcgccaaaaccgcgacctttggctacccgatcatcattgatcaccagcagatctgaaaagcccgcctgctttggatcccagtagtttgcaaaagagaaggtgtgacgtgaattcagccagccgtgatcgcccacgccgcgttgctctgacaatctttgctcaatcatattctgccccttcgttgattcgggaagtgcgaatgcccttcgatggaaacagcatataagtaaaccaggtagtcacacaatggcgtgaactggcaatgactgtcgcgttttagtagacaataaagacgaggttatagcggggccaggttttgcggattaatccttcagctacttgctcgcatcaccagctctccctgcatgatcacacattgtggcggagagtctggccggatgattttttgcagcaccagctcacaggcacgacggccaatctccctggagggctgagccagagtcgtcagcggcggcgataccatgtcggccagttcgctgccgtcaaaacccaccacggcaatgtcctgaggtatccgcagacccgcctgctgtatcgccgccatggcacccgctgccagcgtatcggaaaccgcaaacacggcgtccggtcgtgtctcgcccgccagcagctgattcatcgcggcttttccggcgctgaagcttaactcactggcgtaagcgatggcctgccatgccagttgttgctctttgagttgatgtgcgtagcccttctgacgcaggcgggcatatcggtagcggaggtcgtgattgatcagcgcaatgcgctgacgtccctgtccggccagatagtgcaccactgactgcgcagcgacgtcatcatcaatcccgacgcaggagatctggccattatcatcatgttcggcgcactgaacccagggtgccctgcctatcagctggctcagctccggcagcttgctgaatgcatccatggtgataatgccatccaccatcttgccggagagcagttgcaggctggatcgcgaacgggcaatatcggcgcccgagttacacaacaggatgcgatagccatttttctccgcctcctcctcaatgcctttgaccacctctgcgcagaacgggttagagatatcggaaaccagaaccagaatcattgagctgcgcgccgtgcgcagctggcgcgccagcaggttaggctgatagttgctctcttcgattgcctcaaggactttctgccggttagccggttttacgctgtcgctgttgttcaacacacgggaaacggtggcgaccgaaacacccgccatccgggcgattttctgaatagacatagcgatccctctgtttttaactcacccacagaaaacctttgaatccatgccgcctcagacgtcgcgatccagacccagctgatggcgcaccgaaggggcgtttctctgctaaagcaaaatcatcaaaagcgcggtcagccaccgggatgatatgccggcggataaattctgccccttcacgcgccccggtctcgccatccttcagacagcactcccactccagcaccgcccagccgtcatagtcgtactgggccagtttgctgaaaatgcggctgaagtcgatctggccatcgcccggcgagcgaaagcgtccggcgcgcgccagccacggctgataaccgccatacactccgctgcgtccatttaactggtactccgcatccttaacgtgaaaggctttgatacgcggatgatagaggtcgatgaactgcagatagtcgatgtgttgcagaagaagatggctgggatcgaacaggatattgcagcgcgggtggtgattcacctctgacaaaaagcgctcaaacgtgacaccgtcatgcaggtcttcgccgggatgtatctcatagcagaggtccacaccgtgatggtcaaaactatccagcaccggcagccagcggcgcgccagctcagcaaacgcctcattaaacagcgcttcgtggtgtggcggccagggatagaaccagggccaggcgagcgagccggaaaaggtggcatgtgcgcgcaggccgagtttttcagaagcagcagccgcacgctttagcgtagcgatggcccagtcggtacgccgggcgggatcgcctcgcagcgcggcaggcgcaaaattatcaaaagcgagatcgtatgcggggttcacggcaaccagttgcccttccagatgcgttgaaagctcactgatctccagtccgaaaccggccagtgttccccgcacctcgtcgcagtaagtctggctgaccgctgcctgctcaaggtcgaaaatagcgggctggtggcaggggatctgcagtgcccggtatcccagcccggcggcccactccgccagccccgccagtgagttaaaaggcggctgggtggcaatgaactgagacaggaagatgccgggtcccttaactgttttcatctgtgactcctgagttcagttaccgcttaatcacggtatttgaatgagaagaagaaaataatcgcaatcaccgcagccgccacggcagggatccaccagaatatcgcccagctctctgggctggcgttacccgccaccagctgattgtagagcgcaccggagatttgcgatcccagcagcatgccgataccgtaggtgaacatcaccaccatgctctgcgcctgccccttgaccttttcaccggcgatccgatcggtgtagatgaatcccaccacaaagaagaagtcatagcagacgccatgcagcagaatgcccagataaatcagcatgcgcgtctcatcactcatgcccagcgcaaacagtgcatagcggacaaaccacgctgtcatgccaatcagcagcatgactttcacgccaagacggcggaacagcagtggaatgatcagcatgaaaacaatttcagacatctgacccagtgacatcagggtgctgacttcccggataccggcatccgccagccaggaggcggtaaaagcgtagtaggtgccgagcggaatagagatcagggtggcacatacagcgaagaccaggaaatgacgcagtcgcagcagtgcgaaggcatcggcgcagaagagatcgcgaacttttaacggcaatcctttggccggagccggcgtatgtggcagcgtcaggctgtagatcgccagcaataccgaacagagcgccgccagctggaacactgccacgctgtcagcaatgccggttacgccgataaagatccccgccacgatccagccgatggtgccgaaaactctgacaatgggaaagcttttctcgctgctggcgaggctgtgaaaggcgatgttatttgagagcgccagcgtcggcataaagcagagcgtatagccaaataacattgcgatcagctgcgccccgttctccgcgattagcgcctggggcacgaaccagagaatcgctgcgcccgccaggttcatcaccgccatcactttctgtgagggaaaaaagcgatccacaagcatgccgagcacaaacggcgagagaatcgaggcgatgggtccggccgaaaacgcatccccaatcagcaacggcatgttgtgacgagtcattaccagccccagcgtcaccgaccagctgccccagataaagaactgcataaacatcatcagagagaggcgcggcaccagcagcttatgctgcatctgctggcctgctctctcctgcactgttgcaatcatgggaacctcacgaataagtaatcgattacattctgattgctcacaacgtaaacgaatgcagccgactgttccttcgccgcgatcacaaattattaactctgcgttatcactctggaaataataaggcgatgccgggcgggccgatcagcgactggcattaactatccgcgctttacggaagcggtaacgctcatacagcaccgagtaaaggccgcctgccaccaccagaatcgcacccatcaccgtagtggaggttggcagattgccgagcagcagataacccaccgccactgaccagattaaggtggtgtagtcgaacggggccagcaacgacgcttcagcatagcgcaggctcagagtcatcagaatctgagtaataccgcccagcagcccacatcccaccagtaacgccagctgattgccatgcggcacttcccagccgcctggcagcgtgaccagcgacgttaaggccgtggtgatagcgaaccagaaagcgatggcgcccggcttctctttgccgttaagaaagcggatctgcaccagcgcacaggccgtacagaaggccgccatcaacgccagcagaatacccgccgatgcagaaagggaaaatgttgcctggcgcgtcagtgtgagatgcccggagaacatcaccagaatgccactgaaaccggtaaagaccgcgacccagcgatggtgacgcactttttcgcgcagaaatagcgccgccagcagcacggtaaacagcggcgcggcatagttgatagccgtggcgtcggtcagagaaatgtagagcagcgacagatagctgaaatagagaccaccggttccggccagaccgcgcacaaaatgcccgcggatattgcgggtgcgaatgccatccagcacgctaccctgcaaacgcagccagattaacagcggtaccagtgccagcagcgagcgaaaaaatatcacttcgccgaccggtatcgccccatcgagttcttttacacaggccagcatcagcgtgctacttaatgcagcggtgatcttcatcgctatgccagcggaagcgttcatacgatttttgttctctcaaagggaaaataagcagaggaatcagcacactcctcatccatattgtcataatgtcgtacaccaatctgccgcgattaccttgcagacggcattttatctttttttgccgcagcatcacggcatgaagaggcatgtagtcccgtttcccggctggtacactctgccttctgccctgctttatgggcctcttctcttaaggaacgggagtcaccgatgtccacgctgcgtttactgttatctgaatccaacgatccctggtttaacctggcggtagaagagtgcattttccgccagatgccgtccacccagcgggtgctgtttttgtggcgtaatgcggagacggtggtgatagggcgggcacagaatccgtggaaagagtgcaacacccgacgcatggccgaagatggcatccggctggcgcgtcgcagcagcggcggtggcgcggtatttcacgatctcggcaattgctgttttacctttatggccggcaagccagagtatgataaaagcgtctcgactgagatcatcctgcgcgcactgacttcacttggcgtacccgcggaggcctctggccgtaatgacttagtggtgaacaccgctgacgggctgcgcaaaatatccggttcagcctaccgtgaaacgccggatcgcggtttccatcacggcactattctgatggatgccgacctctcccgcctggcggattaccttaatccggatgtgaagaaattgcaggcgaaggggattacctcagtgcgcgccagagtgaccaatctggcggagttaacgccgggtatcagctatcaggcgatctgctccgcggtgacggacgcatttttcaactattacggtgagcgctgtgagccagagaggatctctcccgacgccctgcccgatctgccgggtttcagagagcagttcgcaaagcagagtagctgggagtggaatttcggtcaggcacccgatttctcgcatctgctggaccagcgttttgtctggggtggtgtggagattcatttcgatgtagaacgcggcgtgatcagccgctgtcagattttcagcgacagcctcaaccctgcgccgctggaagcgctggcgcagcggttgcagggtgtgacctatcggcccgatgcccttgaaccggtgctgaatcagcttattgcggattttccggagcaacgcgcggagctgacagaattgcagcaatggctggtcgccagcgtgcgctgaacatttttttactggcccgcgcggatatctggcgcgggcaaaaaacatcgcgtaagcatctggcaaaccataaacgcaaaaaacccgcacaaggcgggttttaattaattatcaatatcaggcttatctgctgaggctgttgccatcacgcgttgataagcactattgataattaaggcttacatagggacaacgtttgccgctgaaggacctttagcgccgttttcaatagtgaattcgacctgctgaccttcgtccagagttttataatcgttgctctgaattgcagagaaatgtacgaatacatctttgctgccatcctgaggagagataaaaccgaaacctttaccagcgtcaaaccattttactaaaccagtcattttattagacatcgataattccttaatttatgagccactaagtggcgaagatggcctgtctttcagaaggtaacttaccaggcttttaggaggagactcatgaataagggtatcttgtgatatcgcttgcactgaggactgctttactaaaactgctttgataaggtctgtgttccaaaccgatgacgctattaagccacgcctcaccgacattagcaaacattattttaatttacttttaacatccagacgtccggagcgcccttgttgattttccgagcattttgaaatatcagggctgacagaatgataattttcgctgaacggtcagagagtaaataataatgcggttaattattgctgaaaaataatacggcggccctgtactaataaagcgcagcgataaacattatcgctgcgccctgctttatagaactcaggccagttgagtctgctgacgggcagcatgtcgcgccgtgagcacaaagaccatcagaccggccacgcccagcgcaacacccacccacgcggtggagatccagccatagcccagcgacaccgtcaggcccccaagatacgcgcccatcgcattggcaatgttcaacgccgagtgattcatcgcagccgccagggtttgcgactcattggcgacatccatcaggcgaatctgcaatgacggcagcagcactgagcaggtgccgatcaggaatgtggccagcaggccagttgccacatgctgaaccagcaccgggaaggccagcatcaccagcacgttccataacagcgtccagccaataatattcagcaccgggccatcagccagacggccccccaccagattaccgatgatcattcccagcccaaacgccaccatcgcccaggggatcagcgagggggagatgccagcaatgttaatcagtgtcggcgcgatataactgaagatagcgaacatcccgccaaatcctaccgcccccaccagcagggtcagcagcacctgcgcgtttttcagcgcgcccagtttcccgcagcggatgcgcatccacatcgccaggcgtgtaaggaacatagcggccaatcagcaggcaggtcagcagtccaattgcgcccacaaaggtgaacaccacgtgccagctaaataactgccctatccaggagcccagcggtacaccaatcagggtcgctaccgtcagtcccagcatcagtgacgccagcgcgcggccacgacgttcaatcggcaccagcgaagcggccaccagcgacgccacaccaaagtaggcgccatgaggcagcccggtcagaaaacgcgccacgagcaggccgtgatagctgtcggccatcgcgctggcaacattaccgatactgaacagcgccatcaggatcagcagcagcgatttacgtgccattcgcgccgccagcaccgcaataaacggcgcaccgaccaccacgcccagtgcgtaactggcgatggcgttgcccgcctgcggctcggtaatcgcaagggagcgtgaaacatctggcagcaggcccatcatgatgaactcaccggtaccgatgccaaagccgcccagcgcgagggccagtaatgcccagcggacaaaaccggcatcgtcggttttatgattttttcttaacaaaattgattcccaatggccagaactgaaaaaactgaagtgaggcggagagataaagcagagcgtgttcccgtccggtttaagcgggcagactataaaaagtcaggctgcgcttagcaacccatttatgtgatctggcgcacagtgaaggctgcggtaacataggtctttatccgtgccactctggcgcatagcgacctgtttaagatcacaatccggaaagctacgcaggcctgagtcgtgaatctctgtttaactgacctctcagcgcttcttttgcataacaggaatcagcagatgacgaccagagttatccttcttaccggtgccagcgggcgaatcgggcgcactttctttgcggccagccagaacaactaccgttttatcctgaccgatttacgtgagccggattacacgatacccgcaccccatcgttttattgtggcggatctgtcacaacctggtgcggcggagaaattactggctgaagagcctgtcgataccgtcatccacctcgccggtatcccggatgcgcaggccagtttcgacgatctgctgcccgccaatattctctctacgacctggatactcaaggcagcagctgagcaccgctgtcgtcgtctggtctttgccagcagtgcgcagaccattgagggctacccggcggatgtccagatacatcctggcatggctgtctctcccgcgaatctgtatggcgtcaccaaatgttatggtgaagcactttgcgccttctatgccagccagcacggcttgagctgtgtggcattaagaatcggggcgtttgaacctgcactggataacagcctgcataatgcacgggattacagcgcatggctgagtccggaagatgccgtcagattgctgactggcgctgtcgaggcagagaagatcaccttctttattggctacggcatttccgataaccgctttaagcgctttgatctgacacagacgcgagaagtgctgggctatacgccatctgataacgcattcagagcatttgcgccaggtgagctggattattagcccctcccctgagccgtgatcgctttcggtcccgagtcggctcgttattcttcacctccgttgccgccggtccctccggcggctgcttcagccctcaactgagacaacgcccaaaagaaggcagcgcctgaatcggccaaatcagtgcgtgccggtatttacccggcgacctatgtctttcagctgggaatatttttccagcagctgtgggccatcatccaggctcatggcaaacatccacatataggtcatcaccgaatagatgtgacccgcattggtcccgccacggttcgacattaccgcaatggtgacagcaaatagcagcgctgccacgctaccgatggccagataaccccaggcttcccgatcggagagacggatccgcaggctggccagcacgccataatgacggtccagtgacgcagcgttagcgttgctgacaaagctcacctctttctccagccggttattcagacgaccaaacagcacatcgtttttgcgggtaaatcccggcaggaaacaggcgaagaacagcaggatcgccagacagcccgcgccggtccagaaactcgatagccagcagcatcaccgcggcgccggtcatagaggccagcgaggtaatcagcaccggcagatgtttctcaaaaaagtcgacaaactcgcgtgacaaggccacccgcgcggcaatggtggaagcgctctggttttcgttacgctgtgccacaatcaccggcacggccagcccggcgtaaatacgggcaaaggtgcgggtatcgacgctgcgtcgtgccgctccgatggcccacatggtaaacaccatcaccgcatagagcaccgcatgccaggtcctgccggagagaatcgcattaatagcgaagcccgccagcagcggatagaggagatacataacattttccgccaccaccagcagcagcgtgaggaacagcttgcggctatggcgacggccgagcatttttaatgtcagaatagcgctgcggggttttgctaccggcaggatcgtttttgaggaatgcatagtttctgtttctgatatcatgagtcttgagcggttgctcaagaacgaaaagcagtctatttgagcagttgctcaaagtcaacgtaacactcattgagagagagatgaaagagtcagctgaagcactgagaaccaaaatcctggatgccgcgatagtgttatttatcgagaaagggatcgaaaaagtgaccactcgggaactcactgagtcggtgggcatttcacgcagtcatatttatcactatttcagcaactggcagacgctctgcctggcagcgcttgaacgctttatgcacgtggatttagaaaattttgctgactccctgactctactcacaccccgccagaggttgctgacgctgttcgaaagtcatctgccgagcgcaccggatgcaacctggcaactttatgcttcattctggcagatggctgcgcatcacgaagcctatgccgcgctggcagaacagatgacggcagcgtggcaggcgctggtggaagaaataattcgtgacggcgtcacagatggaacgctgcgttgtgccgatattccacgcaccgcccggcaaatctgtgcgatgcttaacggctatgccgatttactgactattaatccgtcggagaaaaaggcaagcgaagggatggctgacttaacgcagtttattgatcatatcctgtcataacgtggatctgacgcgttataaaggccttaacaacgccagattttaattaaatgttaataaaaggtttattattttaattagtctgcgcttttaacccgctataaatgcagcttcttcagtcaaactgacttatgctttttccatctgaaaaggctcctttttgatagcgttttgccccggaaacagctatttacacagattattatcattgacttagcacgccccgcgccgggtaagctggtgtttttacgccacttattaacaaaggactagcgaagcggcaataatgtatacgttcacaaactcaccaaatgattgattcctatagcaaagaatctgttatctgccgataaaattaaacattgagtcggaccttaaaaacacctatattggccgcgcttaaaacacatacccccatttaaatacatttattcaactgcgacgctacgcccgtcccggttgtaggagagatatgatgacggataaagtccgtattgatagtttgaatgcacagaacttaaacgcaaccaatgaaacctatttagcccgtcaggctgaatttgaatcaaacgttcgaagttatcctcgcaaattgccgttcgcgattgcgaaagcacagggtgtctggatcacagacgtcgagaataatcagtatctcgactgtcttgcaggtgccggaaacgctggcattgggtcataaccatccagacgttctgcagagcattcaaaatgtcattaccagcggcttgccgttacatactcttgatttaaccacgccgttaaaagatgcgttttctgagtacctgctctcgttattaccgggtcagggcaaagagtactgcctgcagtttaccggcccgtcgggcgcggatgccgttgaagcggcgctgaaactggcgaaaaaacacaccggtcgttccggcatcatcagcttctctggtgcgtatcacggcatgacccacggcgcgctgtcggttaccggcaacctgtcaccgaaagaagccgtcgacggcttgatgccggaagtgcagttcatgccttatccgcacctctaccgctgcccgctgggcattggcggtgaagcgggcgtgaaagcgctgacctactacttcgaaaacctgatcaacgacgttgagagcggcgttcgcaaaccggcagccgtcattctggaagcggttcagggcgaaggcggtgttaacccggctccggctgagtggctgcagcgcatccgtaaagtgaccaaagagcatggcattctgctgatcatcgacgaagtgcaggcgggcattgcccgtaccggtaaattcttcgcctttgagcacgccggtattgagccggacatcatcgtgatgtcaaaagcggtcggcggcggtctgccactggcggtactgggcattaagaaagagttcgacgcctggtctcctggccaccacaccggcaccttccgtggcaaccagctcgcaatggcgaccggcctgactacgctgaaactgctgaaagataacaacatcgctgacaaagttgctgcacagggcgaatggctgaaaggcaagctgggcgagctgcagcagcgctacccggtaatcggcaacgtgcgtggtctgggcctgatgatcggcattgagctggtgaaacctgacgaagccgttgatcacatgggcagcttcccggcagacggcgagctctccgcgctggtacagaaaaaatgttttgagaacggcctgattctggagcgtggcggacgtcacggcagcgtattacgtctgctgccttccctgctgatcacagatgcagaactggacgtgtttatggataaatttgaaaacgccctgctgtcagctggcgtgaaaccagtttgagtggagtgaatgcaatgtcccggttaaacccgattctggcggcctcagcacagagtaccgaggcctaccagcaggcgattgcccagagtagcgcggccgtcgtgaagtggctggaacaacctgagatgtatcagggaaaaaccgtcgcagagctgcgcgagcgcattaagctggacttcaatcctcagggcctgggcaaccaggccgcgattgaacgcgccattgagtacttccttaaagacagcctgtcggttcatcacccgcagtgtgtggcgcatctgcactgcccgagcctggttatcagccaggcggcggaagtgctgattaacgccaccaaccagagtatggattcgtgggaccaggcaccttcagccactctgattgagatgaagctgattgagtggctgcgttcccaggtcggttatcagtccggcgacgcgggtgtcttcaccagcggcggcacccagagcaacctgatgggtctgatgctggcgcgtgatgcttggtttgcccgccagggtcattctgttcagcaggatggtttaaccggcgatctgaagaagattaaagtcttctgttcagagaatgcgcacttctcggttcagaagaacatggcgctgctgggtctgggctatcaatccgtgacgcaggtgaaatgcgatcgctttgcccgcatggatatggatgacctgcgccacaaactggcagcctccaaagccaacggcgaaaacattctggcaattgttgccacggcgggtactaccgatgccggtgcgatcgatcccctgcgtgaaatcgcggcgctggcggccgaagagaacatctgggtgcacgtcgatgcggcctggggcggcgcgctgctgctctcagaaaagtatcgtgactatctggatggcattgagctggtcgattccattaccctggacttccataagcagttcttccagaccatcagctgtggtgctttcctgctgaaggaagcacgccactatgagctgatgcgctaccaggcggcctatctgaactctgagtttgatgaagcgcagggcgtaccgaatctggtgtccaaatcccttcagactacccgccgttttgatgcactgaaactgtggatgggtctggaagcgctgggtcagaaacagtatgccgaaatcatcgatcacggtgtgacgctggcacagcaggttgcacagtacgttgatgagcagcctgcgctggagctggtgatgaaaccgcagctggccagcgtgctgttccgctatcgtccggcgcatctggcgcacttcagcagtgcggatattgcgttgctgaatcagcgtatcggtgatgccctgctggaatcgggccgcgccaacgttggtgtaaccgagttcgatggcgtgacctgcctgaagatgaccctgctgaatccgacagtgacgctggaagatatcaaagtgttgctgacattggtggaaaccacggcacagcagctggtgtaaatagtggcgtcagggtcactatcagaggcgcctcagggcgccttttctttttctgtgtttatccctttcattcatcggtgaggccaaagcgcctgtgcgctggtttgccggacacctccgcctctgccccttttgtgtagcccctagccgatcttgtattgacttacccattcagcacaaaaatccagatacgcgagtgtgatggctgaaggatgtttgtgccggacataaaccagatgtaaaggcatcgagtgagtcggataatcgggcagcagtcgcatcagctttccactctccacatcaggtttaactaaaaaatcaaacaacagcgataccccggcaccgctcagtgcatagtggcgcaggccctgcgtgttgttagaggaaaaaaacggctcaaactttaccttctcgtctccggatacccactcaaaggaaccactgttaagcccttcccagctggctatcggatacgtcgccagcgccgccagcgtctgcggatgtccaaagcgttcagccagttcaggcgtggcaacaaaccatgcctcgacattcataaccggtttcgcaattacatcctcggtatgcaactcgcccagcctgagtgccacgtcaatgccatcttcaaacagatccaccactctttcccctgagtggcaaaacactttgatatcaggatagcgttgctgaaacgcatgcagtaactcccaccagatagtgaagtcaggcggcaccgatattcgcagtttgcccgccagtttgtgcgcagacctgaccgttttggtggcctcttccagcaattccaggccaggtcgcgattgctcaaagaactgttgtcctttgcaggtcggcctgacccctttctttgatcgctccagtaactgcacacccagtgcccgctccagctcgttcactttccgcaccagcgtagagatggggatagccgtttctctcacttgccgctgaaaagctgcctgcctgaacgactgcaataaagagttttgtcgcgttgagatccattatctttccatatctggcaaacacgtacccaattctgaccgtttacttcttattttcaactattaaactccctgttttggctaagagaataaaaataaaacggcccgtaaaaaattcttatttctaacgaataagtctggctacacagtatccggataaggaaaaactatgaaaaaccgtgtgacagaaattctgaatattcgctatcccattattcaggcacccatgtactttctgaccaatgcaacgtttgttgccgcagtatcaaacgcaggcggattaggcataattggccccaacgccgggcaggatacattgccagactctcgtttcatggcgctggagcgcatgcgtgagcaaatcagaaaaaccaaacagctgaccgataaaccttttggggcaaccctgatcaatgggccggatatgagtttctggcggcccaccgctgaaatgtttgttgaagagaaggtagaggtcgttttagttaatgaagtgcttgatgccgaaatattcgattttctgaaacaacatcgcatcaaaatcctttatcgtgcgctgacgcctgacgtagcgaattctcagcaggctgaaaagcttggcgccgatatcattgtcgccaccggatttgatgaaggcggcaccgtgccatcacgcattatcggaacgttcagcatcgtgcctatgatcgctgacagtgtgaaaattccggtgctggcggcaggcggcattggggatgtgcgtggcgtgcgtgcagccatggcgttaggtgcagaaggcgtctggataggcagcctgtttttaaccgcgcaggagaacccggcggatgagaaggttaagcagctgattgtttcatcgagcgcagaagatttgctacttttccgcaccctgcccgcttattaccgtacattgcccacgccgctcagccccaggctggcagaacttgatgcgcagggcgctgaccgtgaaaccctgttcactgcaatgaatggctaccactctttatggcaggcgatgcgactgggcaatcttgacaaaggcgttgtttcgacaggcactggcatctcgatgatcaaatcggtgcgaaccgttgcagccatcgtcgccgatctggcacaagattttatcactcagccggagaaacagaaatctgacgacaccgttctcagtctgtaatctgtttaaagttagtgatgtgaccgccaccagcgggatccggttgtcggatgagtcccgaccgggtcccgcgtgctgcccgcagtgttcagttgtgggccgttattcagcttatcctcttcacagcctgaagccatacaggttcaacccttttcagtcaaacagatacaagataaattaacagattttattccctcatttagatttcgtttatttctgaatttgcatgacgcctttatttcagcagagtctggaaaaccgtatcgcgatcaataaataaagattttatttcagccataattaatcaaaacttatgttaagtcactgataacagtgaataacatattacagataagaatagtttaatttcacaggaattaacgcttatgctcctgcgtaaaatagttatcattcttctcggtatgattatggctgctgtcatcattattgccgacaaccatgctcataaagttaattgccgcgatcaggttttcagtttgccatcatcgcaaagtgaatgaccttgtctgaatccttctctccagcatcctctttgtcttcagacctgttgacggtgttgatgaagcgtgaagaccagaaactttgatccggctgaatcgcttacgggataaaaccctgttacatcggcctgaacagagcggcacgttacgccggtgatattacagttgcatttctgataagcaggctggtttgttgcccttcccggcagacctgccaaagaaggctgcatgccacttcagcagcctgtatttcccgctcagcttgcttgccgacacttagcgcgacggtggctcatccagtagccgcagatgatcatctttgttcagggacatcaacgcaacaatactgaccagcgcagtcgccatcacataccaggcggggatatcgggattaccggtctgtttaatcaacccggtgatgatcaatccggcacagcctgaaaacaccgcgttagaaagcgaataggccagacccagtccggtataacgcacccgcgtcgggaacatctctgccagcatcgcaggtcccggtccggccagcaacccgaccactccgcccgcgataaacaccaccagcgctttcagcagcagcccggtgctctctgcctgaagtatgttaagcagcggcagagagagcaccagcagcaataccgccgctgtcaccatcaccgcacggcggccaatcctgtcactcagcatcccggccgggatgatggtggcagcaaagcccaggttcgatatcaccgcaatcagcaacgcctggttaaaaccggtgtgcagcgatgcctgcaggtacgtcggcataatcaccagccaggtgtaaccggccgccgaccagaccatcagccgacagataccgagcaggatcgttttcagcgtatcgccaaggctggcgtcaacttttgcaacggattttgcctgctgctgaataaacgccggggtctcctccatctgaacccgcagccagagcgcgataacacccagcggcagagcaatgaagaaacgggatgcgccagccccagctcagcatctgctccggcgacagcagcagtgagagcagcgctacgatgcccgcgccagccagtaatcccagcgccacagtaaaagattgccacgccccataaaggccccgcttaccgcgcggtgcaaactcggtcatcagcgataccgccccgccatactcaccccccgcgaacaggccctgcagaatacgcagaccggtcacgatcagcggcgccaggatgcccagatgggcgtaggtgggcaccaggccgatagccgccgtcgccagcgtcatcatgatcaacacaaatatcagcgtgggtttgcgcccgatgcgatcacccatccggccgaaaatgattgcaccgagtggacggaagaaaaaggcgatggcgaatgacgcataggtcagcagaagcccggtcagcactgactccccttccagccggaaaaagttctgcgctatcacggtggcaagaaagccatagacggcaaactcataccattcaatgaaattacctaccgaaccggctatcagagcacgtttacggctggcggagctgagcagattatcgacgggcacagacatggcaggagatcctttttgagcatcatcagtcgcttatgattagcacaatcgccgcacgcctgcgcactcttctgcctgtcacgttaactcagacacagaaatctgcgcttaacgcgccacggcacgccctttttcaccttcacgccttgcacaacggctttacgattgtcaggatgtgcggcattgaatgaatcaggcggatagatgatgaacgcacaaacctcaaaagatcctctgcatggcgtaacgctggagatgcagataaacagtttagtcgcgcagtatggctgggcggagctgggaaaacggatcaacattaactgctttaaaagcgatccgagtgttaaatcaagcctgaagtttttgcggcgcacgccctgggcgcgggctgaagtcgaagcgctttatctcgcctcgttaaaagagaaaccggcctcccgcgaagcaccgtctgaagaggcggatcaagcacccgcagaagatccctggggcaactggcgcggtaaccagccggagtaacgggcagacaacgcggcaataaaaaagcccgcgcaggataacctgtgcgggctttttttacgtcaggtcgctgttacagcgccatgtcgtgcttcgctgaaggcgctgcctgctcaggctgtgctgctggcgcctcggctgctttgccatccatgttgataaccggcggtgtggtcagctgcagagtcgcagcggtgtcattccatacctgctggagcatcggcacgttgtcattcagtttctgaccgtagcctgggatcatcttgtggattttggcctgccattccgctgacttaaactcttccgggaacagtttctgcatcacgcttaacgcgataggcgcagcggtcgatgcaccaggagaagcacccagcagtgccgccacggttttctgctgatcggtcacaatttctgtacccagtttcagcacgccacctttgtcagcatctttcttgatgatctgtacgcgctgaccggcctgaatcagtttccagtcctctttcttcgcgtccgggtagtactctttcagtgcttcgaagcgatcttcttctgtcagcatcacctggccaaccaggtatttcaccaggtcgaagttatccatacccacatcggtcattggcacgatgttatgagtagtggtggtgctcagcaggtcaaacagtgaaccatttttcaggaacttggttgagaaggtcgcaaacggtccaaacagcacgacgcgtttgccatccagataacgggtatccagatgcggaacggacatcggtggtgcaccggtagacgcctgaccgtagactttcgccaggtgacgatcggcaatcgccttgttttcggttaccaggaatgaaccgccgaccgggaagcctgcatagttttccgcttccgggatgccggttttctgcagtaatttcagcgcgccgccgccagcaccaataaagacatatttcgcgtcaaccgcacgctcattgccgtttttggcatctttaatggtgacgtgccacgagttatcgccgttacgtttgaaatcggtgacttcagacgaggtttccagacggaagttgtcattcttcttcaggctgccgattagctgacgggtaatttcaccgtagtttacgtcggtgccaactggcgtccaggttgcggccactttctgctggggatcacgaccttccatcaccagcggtgcccactgctcgatctgcttgtgatcggtagagaacttcatgccctggaacagcgcggttttctgtaacgccgcatagcgtttagtcaggaagtcgacgttgtcgccccagacgaagctcatgtgtggcgttgagttgatgaaagagcgcggatcgtgcatcacaccctctttgacctgcgaactccagaaaactggcgtgaaaccatgaaggcttcgttgatttccagcgctttcgtcacgtcgattgagccgtctttacgctcaggcgtatagttcagctccatattggcagagtgaccggtaccggcgttgttccagccgttagaggattccagtgccacaccatccagcttctcaaccatgatctgtttccagccaggctgcagctcttcaagcatggtgcccattgaggcgctcatgatgccgccaccaattaacaggacgtcggttttctctggtgaagtttcagcatgcagtgctgaagaaactaacaaggccgcgagggaaagagtggggataactttctttgaattcatcattttaatctacagctcagacggtactggttaaaaaaagtccttaaagtttaaaataatgttatttgtgagttaatgtgaaaatagttataaaattaaaaatagcaatttagccttaatttaattacaaaaggcttaccgaattgctcacatattttaaccacacattaagggtgtcctttgaattatacaatcccctaacacaaatattgttctccggcgattgcccgcgcgcagaccgctaaaactgtactgatgcggtcagttagcgtatgtttccgggcgatctcccacccgtgctgaacgccaatgacaagccaaccacagaaccgacatgccgtgactaaacgacccatgaaactcagtaccctgaccaccctgatgatgaccgcggttatcgtcaccgtgctgctcgctgtccatctgctctattttgtgcagatcgataactttgctcagtcgcatcttaaagataaggcgatggcagtggcacgcactctggcagacagccctgaagtccagcgtgggttactgttaccggacggcagcagccagattcagccactggctgaagctgcgcgcaaacgcaacggcctgctgtttgtggtggtgacggatatgcgtggcattcgcttttcacacccgaaacgcggcggtgattggcaaacattttgtcggcaacgatatctatccggccctcagcgggcgggaaaatgtggcggtaaatcacggcgtgctggtagaggcactgcgggtatttaccccggtctataacgcagagcatcagcagattggcgtggtggcgatcggcatcgcactaaatgatgtggcggcgcagattgccaaaagccgctggaacatcgtctggactgtcttatttggcggcctggtgggtctgctggggattcttattctggtcagacgcctgaagagcatattgctcgggctggagccgcatgaaatctccagcctgttcgagcagcgtcaggcgatcctcaattctattaaagagggtgtgattgcggtcgatgatgagtcacgcgtcagcctgattaaccacgcggcacagcagctactgcatgagaccacccgcaagatgccattaagcggcgatctgattgctgaagagagcgtaatgcaccgccatcagcaggatgcgctgcatgcaggcaaagcctggcacgatcaggagctgacgctgggtaatcgcatcctgatcagcaataccgtgccggttcgcagtcgtgaccgcattatcggcgcggtgaccaccttcagggacaagaccgagatcagccagctgatgcagcgtctggacggcatggtaaactatgtagacgcgttacgtgaacggtcccatgagttcatgaataagctgcatgtcattctgggcctgctgcatatgaaaaactatgcgcagatggaagagtacatcctcaaaaccgccaacgcctatcagacggagattggttcgctgctgcaaaagatcaaatcgcccatcattgcgggtttcctgctcagcaaaatcaaccgggtgaccgatgaaggccatcagctgattattgatgaggcgagttttctgcccgactgcggcagcgaggagcagagcgcggtactgattacggtgctgggcaatttaattgaaaatgcgcttgaggcgctggatccggaaaccgaaggggaaatccacctcatgctgcattatcagaatggctggttagcctgtgaagtgagtgatgacggacccgggatcgacggtacgcagctcagtgccatttttgagcgtggcgtctcgtcaaaaggcgaagatcgcggtgtcggattgtttctggtgaagcagcagaccgaaagcctgggcggcagtgtcagtgtcgagtcggaaccgggtgtattcacccaattcttagtgcaacttccgtgggagagaggaatgattacccaatgatcaatgtgttagttgtcgatgatgacgccatggtagccgagctgaatcgctgttatatcgggcagatcccaggctttacctgctgcggcaccgcctcaaccttacagcaggccaaagagcggctggcgcaggccgaacctcaggttgatctgatcctgctggatatctatatgcagcaggagaacggtctcgacctgttgccggaactgcgcagcgcaggacgtccggttgacgtgattattatctcgtcagcagcagatgccgccaccatcaaaacctcactcaactacggtgtggtggattatctgatcaagcctttccagtttgcccgctttgaagaggcgctgactggctggcgacagaaaaaatcgctgatggataatcatcagttctatcagcagtcggacgttgatcagttgttgcatggcaatccgccgggggccagcgagcagaagcgactgccgaaaggattaacaccgcagaccctgcgcaccctgtgtctgtggatcgacgcccacccgggtaccgagtttctccaccgacgaactggcaaccgaggtgaatatctcccgcgtctcctgccgcaagtatctgatctggctggcgcagattaatatcctgttcaccagcattcattatggggtcacgggccgtccggtttatcgctatcgcctgcagccggagtatcacactttactcaaacaatattgtcagtgaaccagccgataatcggtgtccagtaactgaaaagaaaagtgacgttgtgacgagcagatcacctgcctgtcacgggtcacaaatatcgcttcaatgcccggttgctccgccaggcaggcaatgccctgttcaacgccgaggccgtaaagcagcgtggtgtagatgtcaccatccagtgaacggtcagagatcacggtgacgctcagcaggtcgttatccagcggataaccgctacgcgggtcgaggatatggtgataacagacgccatccagctcgaaataacgctcatagataccggatgtcaccaccgagcgattattaacgccgatcaccccgatcagctcatcggcctcaccaaagggttttttcaggccgattgcccagcacgcctcttctggcggcgcacccaccgtctgcacatttccgcccagattaatcagcgcactgctgacctgctgctggcgcaaaaaagcctgcacgacatcggcgatatagcctttggcgatggcgcccaggtcaatctccatcccaggtcgcgccagcatgacactgcggcttgcgtcatcaagaataacgtcatgcggattcgtcagcgctatgcgcgcctgaagttctgtctctgatggaacacggtggccctgaaagccgattttccagcacttcaccagcgggccaatagccagattaaacaggctgtcgggcagcaggctcaccgcatgcgcgcaggcgatcaggtcaaacaccggctgactcacgaccaccggatgctgccctgccgcgtgattaatcgccatcacctcagacgccgcgcggttaaccgtgaagagattctcctgctgtttaatcaggcggaagacctgtccggccagggtctgattatcgtcgaagagtttgagcaggatgggtgaacccattaagacagcggagtaagcatagacacgcgcatcagttaacataggcgactctgctttaaagagaaaagaacggcatccgcagagcgcggatgccggagacgacccttaacgtcgggcgtaagcggcggcgttaccaccggccagaatgccgaagataatgatatcggcgactgcgttaccgccgatacggttagcaccgtggatgccaccaacgacctcgccacaggcccaggcgccgttaatcacctgtttctggctgtccagcaccgcagtggtggtgtcgatggtgacgccgcccatggtgtggtgtacgcccggtgcaacacgaatcgcgtagaacggtgcttcactcagaggatgacgcagcgcggtctgacgaccgaagtcttcatctttctgcatgataacgaagttgttgtaacgggccagcgtggcttccagcgtatgatgctcactcatgttgagtttcaccgccagttttctgccacggttggcgcgctgaccacaaagcctttggcgatatattcgtcagccgctttgttattcatccgcacctgctcgtcaaacacaatccaggcactcttctctggcaaggcgataatctgcgccgagactttatcgcgggtttccatttcgttgtagaagcgctcacccgcctgactgaccaggatagcaccgccgccacgaatggattcggagaccagataagaggtggtctgttcaaccgttgggtgaatctgtatttcgcccatatccacggtaccggcaccaattttttccagcatggcaataccgctgccggtggcacctttgtggtttgtggtgacaaagccatcgagttcagggcgatatttcactaccagttcacggttcgcactgaatccgccggtcgccacaatcacgcttttcgcgttcaggatacggctgtcgttgtactcatcgaccactctcacacccgctaccgcgccgttctcatagaggatttctgagactgaggtttcaagcaggacttcgatgttgcggctgttgatgtttttaaccagaccgctgatcaggaagccacccaccgctgaacgatccgccggacggtgggtacgatcgatgctcatcccgccggtaatggtgatgtcgttaagctcaatgccgtgattcgccagccactcgatagcctccggcgccagctctacaaactcacgtagcagcaccggattatttttaaactgaccgcctttcagcgtctcctcgtagaacagctctttgctgtcttcgatgcctttgagtttctggaaacgggtttcagcggcgttcatgcccactgaggctttaatggtgttaccgccaatggtcggcatcttctcgatgatgaccacgcgcgccccttcatcgtgcgcctgaatcgccgccgcaaggccggcgccgccgctgcccacaatcaccacatcgtaattctgcggtgcgttagggttgccgccctcttcaatcacatgctctttgctggaggtggtcagcgcgcgtgaaaccgcttttttcagcgcctcactctgggtagtcgcaccggtaatcgcatcgacgtgtgggctgttagccaccaggatgcggctacgcaggctttcaaaggtggtggtgaagtccacatccagggtgtcatccggcaccagcgagatgtcggtgatacggtcagtatccagcgtgacgttgattttcagtttcagcgcttcggcttcgactttttcctgatagacgcccgctttgtatttacggcccgattcactcatgtcgcggatcatcgcatcgaccagggagaagcgccacagcggttccgggatctgcagctcttcacgtttgttgctgtcgatgtagagatcgaggtgttcgttattaatgatgcggtcagcccagttcgggtaagcgatgcaggctttaccaatcgccaccagatcgtagcctttctccagcgccagctcagcatcggctttattgacgacgccgccaacaccaatcaccggcacttttgccagcacaggcgaacgcatcgcgacgaacttctcaatcagcggcgtcggatcctgggtatcaacaattgacggacgcagcagctgacctaccgaaaagtggacgtaatcgagtccgcgcgcggccagtttttccagcagatagagcgtgtcgtcaaagcgaatgccgggcacttcgatctcttccggcgagaagcgatagccgatgatgaaagagttatgggcgaagcgctcagccatcttgtgggtgatttccagcacttccagcgggaagcgtgcgcggttatcgcggctgccgccccacttgtcatcgcgctggttagagttcggcgaatagaaaactgctgaatcaggtaggtgttagcaccatgaatttcgacgccatcgaaaccggccttgatagcgcggttcaccgcatcaccaaatttggtgatcatggtttcaacttcttcggcgctcagcgccaggggtttggttgccccttcacgcggcgccgcgatggcgcttggcgcaaccggcgttttgccgccaatcagctccggctccaccatacggccgccgtgatagatctgcaaaatggccgtagagccttcagatttaatcgcgtccgctatgcgtttcagaccagggattttgttgtcgctgtcaatagcaatggcacccggaaatgccgggccacggttgtcaataaagcagcattcaacgatcacggttccgatgctgcctgcacgtgcgcgatagtactcgaccagctcactggtgaccgtaccgtcataaaagccggtacaggtggtcatcggtgccattaccagtcggtttttcaacacagcgccgttaggcagagtcaatggattaaggatgggggtgagagatttcattgcgataaactccaagatttaaaagtctggaaattttttagcggacgcaaattatcgcttaattaagtggtccgatgtcatgagactaatatacccttttctttgctttcataagcgataaatttacttttttaacttttaaatgatttggagtttttatttgccgaatgcataaagtgaagttatattaattgttaaccatgggtaaccaaaaatcaaccattcgtttacataaaaaataaatcgtttatcatcatgcagttaaagcaaggcattcagtttgcgtgagctggtgatttgtcgaccagcttcacagaaccgtcaaaatgtcgatgccgtaaatataaataaaaaataaatgttaaaaatggggaataatgaattaatttctttgatctggatcaaaatctatatttgcaaaaatcgcatcatatttacatggatttaaaaatgcagctcaatagctaagcagtcgattaaaaatcagtgcatcgcggtttattcacactattaagaataagaaagaaagtcatcagtgaaggtccggggcgcaaatcgcattcttcttaacttgcagataaaatactatgaaaccactctcagctgtaactgaacccccaaaagtcgcacctgcggcgccgggtaaaaagaaagctatcatgcttgctctgccggtgctcgttgccgtgctgctgttgttggtgcccacaccagccggactcgaaaccctacgcctggcacttcttcgccatcttcgtcggcgtgattgtcggattgatctttgaacccctgccaggcgcggtgatcggcctgaccggcgtggtagtcatcgcgctgttcagccagtttctgctcttcagcccggctgaactgactaacccgaaattcaaagtcgccagtgagtcgttcaaatgggcggtcagcgggttcggcaactccacggtctggctgatcttcggtgcctttatgttcgccgcgggttatgacaaaacgcagtttggtcgccgcctggccctgattctggtgaagtatctgggtcgccgcagtctgacactgggttatgctattacctttgctgacctgcttcttgcgcccttcacgccgtcaaacaccgcgcgcagtggcggtaccatctacccgattatcgccaacctgccgccgctttacggctctaaacctaacgacccgagtgcccgtaaaatcggttcctatctgatgtgggtagcgattaccgcggcctgtattaccagttccatgtttctctctgcgctggcacccaacctgctggcactggcactggtaaaaagcatcgtcggttttgatatctcatggggcatgtggttcctggccttcctgccgctgggtgtgctgctgattctgaccatgccgctgctggcttactggttctacccacctgaagttaaaatcaatgatgaagtgccgaaatgggccatcgctgaactggaaaaactgggcagactgacccgcaatgaaatcctgctgctggtgtttgtggtctgcgccctgctgatgtggattttcgccacctcgtggatcgaacctgccatggctgcgctgctggtggtagtactgatgttgtggaccggcgtactgacctggaatgacatcaccagtaataaaccggcctggaatacctttgcctggttcgccaccctggtggcactggccgatggtctggcccgcgtcggctttattacctggttaggtaaagagggtggcatgctgctgcagggttatgacccgcaggtttcggccgtggtgctgttaatcgccttcttcctgctgcactacctgtttgccagtaccaccgcacacaccaccgcgctgttaccggccatgctgaccattgcagcctccattccgggtatcaatatgccggtcttctgcctgatgttgtgtacctctctgggtgtgatgggcatcatcacgccatacggcaccggcccaagcccgatttactacggcagcggttatctgcctaccaaagactactggcgtctgggaaccatcttcggtgccatcttcttaggctccatgatgctgattgcctatccgtggatggtgtggttgttctgacggatacaacatgcagatcaacgcgttataagataccattcctgcacttccccaccgcacccgcggtggggaagcataataaacaattaattcgcctatgatgttgcgccccgcagcctgtccgcggaggttcagccggtcattaagtgagaaaaaatgtcgaacaagccttttgtctatcagaaccctttcccgctgtcccacgaagataccgaatactatctgctgagtcgtgagcatgtctccgtctccgagtttgagggtcaggagatccttaaagtcgatccgcaggcgctgacgttactcagccagcaggcgttccatgacgcctcttttatgctgcgtccggcccaccagcagcaggtcgcctccatccttgatgacccggaagccagcgacaatgataaatatgtcgccctgcagtttttaagaaactctgaaattgccgccaaaggcgtgctgccaacctgtcaggataccggcaccgcgatcatcatgggcaaaaagggccagcgcgtctggaccggcggcggtgatgaagctgcgctgtcacagggtatctacaacacctatatcgaagataacctgcgctattcgcagaatgccgctctggatatgtataaagaggtgaataccggcactaacctgccagcgcagatcgacctctacagcgtggatggcgatgagtacaagttcctctgtatcgccaaaggtggcggttccgccaataaaacctatctctatcaggaaaccaaagcgctgctgagtccgggcaagctgaaaaattacctggtggataagatgcgtaccctcggcaccgcagcctgtccgccctaccatattgcgtttgtcatcggcggcacctcggcagaaagcacactgaaaaccgtgaagctcgcctcaactcactattacgacgggctgcccactgaaggcaacgagcacggtcaggcgttccgcgacgttcagctggagcaggaactgctggaagcggcgcagcagctcggtctgggtgcgcaatttggcggcaaatattttgcacacgatatccgcgtggtgcgtcttccacgtcacggcgcctcctgcccgatcggcatgggcgtctcctgctcggctgaccgtaacatcaaagcgaagattaaccgtgaaggtatctggattgagaaactggaagccaacccaggccgcctgatcccggaagcactgcgtcagcagggcgaaggtgaagcgttgcaggttgatctcaaccgcccaatggaagagattctggcgcaactgtccgcttatccggtttcaacccgcctgtcactgaccggcactattatcgtggcgcgcgatattgcacatgcaaaactcaaagagcgcatcgataacggcgaaggattaccgcagtacatcaaagatcatccggtctattacgctggcccggcgaagacgcctgaaggttatgcttctggttcactcggcccaaccactgccggtcgtatggattcttacgtggatctgctgcaggcgcacggcggaagtaagatcatgctagccaagggcaatcgcagtcagcaggtgacggatgcctgtcataaacatggcggcttctatctcggcagcattggtggaccggcagcggtgctggcgcagcagagcattaaaagtctggaatgcgtggagtatcccgagctgggaatggaagcgatctggaaaatcgaggtggagaatttccctgcctttatcctggtcgatgacaaaggtaacgatttcttccagcacattgagcgcgcgcactgcgcgaaatgcgttaagtagcacatgcgttagtaaaatcctgcgttaacaaatcaaaaagccccgactccggggcttttatttgttacgcattcaggcgtattggctgtgataacgagcctttcttagccccgctgcaaccgctgcaacgccacatcaatctgcacatcacctttggtgagttcgatgatctgatacttaattgccggattttcaatcaggccgaccagtgtcgccgccacatcttcgcgcgggatctcaccatacggaatcgccagatcggcatgaacccgaccggtaccgccttcatcggtcagcgtacccggtcgcaggatcacccactccagcttactcgccaccagctccgcatccgccagacgcttcacccgcatgtaattctcaaatccctctgagggagttttaccgcggcccgcatccgggaaagcggaaaccagcataaagcgtgatacccccgcctgttctgctgcggcaaccgccagcttcagcccttctccgtcaatggcattggtcagctcgatcccggcaccgcccgcacccgccgtgaagacagccacatcgtgaccggtcatcagatctgccagtgccgtcacgctcagctgctgaatatcgccagccactggttcagcaccagcggcctgcagcgtctctgcctgctccggtttgcggtgcagcgccgtcactgtatggcctttactgctcagctgacgggtcagcttttggcccactttgcccgctgcgccgatgatgaaacatgtcgccataggatccaatcctccatttactgattgagtgccagagtatagctatcagtcagaaacaaaacaggcgcctgatgcggcgcctgctgggttattgcgggatcactttttccgctttcagcttatcaaacagctgaataaaggagtcgagcgtgctgcgataaccggtgaagcccgctttgcggctcttactcatatcggtaaaggcttccatcggacgtcccaggtcggcatcggtatgccaccaggaagccagtctggtgatatccgattcacgcaactgatgctgctctgcaatcgcctgccacgcactggcggcttcctgcatgcgatcttccagcggcatcatctgcgccgggtattccgctgcttcaatgccgaaatagtcagccagttttggccacatccagttccagcggaacacatcaccgtttaccgcattgaaatcctgtttagcggcattgggtgaggtcgccgcccagtgcaactgctcagccagcagacctgcatcggtcatatcagccacaccgttccactgctcgggtgagccagggaagataaacggccagcccttctctttacacagcgtcgcgtagaccgccagcgtctgacccatattcatcgcattgcccacggcataaccgatgatggtgtgcgggcgatgcacactccagcggtagtcatacttctctgcaccagcgaacacttcatcttcctgcgcgtagtagaagttatcgaccggctgacggccctgctcttcacggaacggcgtgactggcacagcgcctttgccgtaagcttcaaacggaccaaggtagtgcttcagtccggttaccagcgccacgtgcgaaccctgtaagcggtcgccgagtgcttcaatcacatttcgcaccatgccgccgttaacgcggatattctctttttcattttcctgacgcgcccagacgctaaagaacagcgcatccggtttcactgttttcagcgcgtcccggacggcatccgcatcggtcagatcggccgtcaggctggtgacaccttcaggtaccgcgccacgtccgcgtgacagaccgctgacctgccagccttccttctgtaatttatctgccagtgcgcgaccaataacgccactgatgcccacaatcaaagcatgctttttcatttgatttctcctcattttgcgtaatgctaagcctaatagagaattcagttcttatctctggcatttattcacagcattctcaacctgagttcattaatcgatgcacgatcatcgcctcaaagatattctgccgtttgttgccagcgtagagtgtggcagttttaccgccgctgcggagcgtctgcacgtgaccggatcggcgatcagtaaaagcgtcagccgcctggagacacgattaggctcgcgactgctggagcgcaccacacggagcctgcacctcaccgacgcgggcagcgcctattaccagacctgcctgcgcattctggaggatctggccgaagccgaagcggtgctggcggcacagcgaacgattccttccggtcgcctgcgcctggcagtgcccaccacctatggccgcctcaatgtgatgccgctgctgatgcccttttgtcagcaacacccggaactggctctgagcctgagtttctctgaccgctttgttgacctgtttgaagagggcgtggatgtggcggtacggatcggcggcgcgcccgacctgcctgcttcgcttggctggcgtaatatgggccgcgagcagatgcagtttctgtgcctcacccgcttatctggcacgtgaaggacgacctgaagatgaggcggcgctgctgaaccaccgcgccatcctttatgagcgtgtagatggcagcaccaaaccctggctgttcaccaccgaagatggtcagccgcactggcgcgaggtgccgtaccggctggcactgggcgacgtcgatgcccagctgcaggctgtcatcgccgggctgggtgtggcacaaatgccctcgtggctgattcagcatgccgtgaaacagggcgatctggagataattttgccgcagttgcagcccgaggggctgacgctgagcgtggtgtggccacgccgtaaacagttcctgcctaaggtcgatgcactgttatcggcgctcaccgcgctggaaatccgctaacccgccctgctatctgtttatcgcggttgggatgtttcatcctgactgcgatcatttaatctttctacacgctgatttccccttgttctgccctgcctgaaccgccagtaacttatcaatctcccctataacccgcttaaatttaatgtttttattttcgccttgatggaatcccatcaaaataaaaatggcggaagggttgagctcacataatgaaaactaagtttcaaatataatttaacccgaaataaaaatatcagtagggtgatgtcttcttcatgttctgacgttttgtctttgccgttattaccaggagtattcatggaaaaagaactttatatctcgtcgaacccggcatccggtccaaatagcaccacccgcaccgagccttttgtgaagattattgcgctggtcgccaccctgggtggattgctgtttggttatgacaccggtgtagtctcaggcgcattactgtttatgcgcggcgatctgcatctcaccccatttactaccgggctggtcaccagctccctgctgtttggtgcagccttcggcgcgctggcagccggtcatctggcggatggcctcggcagacgacgcattatcattgcgctggcgcttatcttcgcttttggcgctgtcggctcggcgctggcgcctgatgtcacctggatgatcgcttctcgcctgtttcctgggctttgccgtggggggtgctgccgcgaccgtgccggtctacatcgcagaaatcgcccccgccaataaacgtggccagctggtcaccatgcaggagctgatgatcgtcagcggtcagctgctggcgtacatctccaacgccacctttaacgatatctggggcggcgaaaatacctggcgctggatgctggcgctgtcgattgtccccgctgttctgctctggatcggcatgatttttatgcctgaaaccccgcgctggcacgtaatgaaaggccgcagtcaggcagcgcgcgaggtcctggaaaaaacccgtgccgccgaagatgtcgagtgggagctggaagagattgaggaaaccattgaagagaaccgtcagcgtggcaaaggccgcctgcgcgatctcgccacaccctggctgatgaaaatcttcctgctgggcgtgggtattgccgccatccagcagctgaccggggtgaataccattatgtattacgcccccaccatgctgaccgccgccggactgagcaacgatgccgcgctgttcgccaccatcgcaaatggcgtgatctccgtggtgatgacgctggcgggtatctggctaatcggcaaagtgggacgccgtccgctggtgttaatcggacagatgggctgcacctgctgcctgttctttatcgggctggtctgctggctgatgccggaatacctcaacggcacggtcaacctgctgcgggcttatctggtgctggcggggatgctgatgtttctctgcttccagcagggcgcattgtcacccgttacctggctgctgctgtcggaaatcttccccgcccggatgcgtggcatctgtatgggtggcgctgtcttctcactgtggattgctaacttcgccatctccatggccttcccgctgttattagccgcatttggtctggccggagccttctttatattcgcggctatcggcatcggcggttctgtttttgttgtgaagtttattcccgagacccggggaagaagtcttgagcaggtcgagcactatttctatgcgctttataacggcaacggcaaaaaatagtgcctgaaacgtccgtattgaataactcacggcccgcgtcattacgctgactacccgattgctattaacactgtaccccctacattcaaggaaattattatgagcctgaatattcccaacgcgcgcttttgcatcaaccgtaaaattgcgcccagcctcacccttccgcagttctttaaactggtcagccagctcggtatccataatgtcgaactgcgtaatgatatgcccagcggccgcgtcaccgacgatctcagcggcgacgaggtaaaagctctggcgcgtgagtcaggcatccggattgtcaccattaatgcgctctatccctttaatcagctgaatgaagaggtgctgcaacgcacccgccagctgttaagtgatgcgcaggcggtcggcgctgaatcgctggtgctctgcccgcttaatgacggcacgccgatcagcgctgccgacaccgtaagcgcgctgaaaaccctggccccgctgtttcgctgaggcaggtattcaggggctggtggaaccgctgggcttcccgcaaagctcgctgcgttcagcaactcaggctcagacgctgatccatgaagcgggtgtgccattcagattgctgatcgataccttccatcatcatctgtttgaagatgcggaacagactttcgaacaggagatcgatattcagcagatcggtctggttcacctttccggcgtcaccgacccgcgcccggttaatcagctaaccgacgaagaacgcatcatgctcagcgcggacgaccgcttgcgcagcaagcagcaggtcgagcgactggagaaaatgggttacaccggcctttacgcctttgagccgttctcctcagtgatgaacagctggcaggaagcggacattgcccgcgaaattcgcgacagcatccagctgttaaaccactcagcttaaggaattatcatgactattaatattggcgtcatcggcaccggcgcaatcggtcgcgaacacatccgccgttgcagcaccgtgttacaaaatgcgcgcgtggtggcgcttaacgatatcaaccgtgaaaactgccagcaaatcgttaacgagctgacgccggaagcgcgtatttatgacaatgctatcgatctgattaacgatccgcaggtcaatgcggtgctggtcacctcctggggcccgacgcatgaagccttcgtgctggcctgcattgaggcgggtaaagcggtgttctgcgaaaaaccgctggcggtcaccgcgcagggctgcatgaacattgtggaagcagaaattaaggcaggacgtcagctggtgcaggtcgggtttatgcgcccttatgacagcggctatcgcgcactaaaagcggtgatcgacagcggcgaaattggcgagcctttgatgctgcactgcgcacaccgcaacccggaagtgggcgacagctacaccaccgacatggcgatcaccgacacgctgatccacgaactcgatgtgctgcgctggctgctggatgatgactatgccagcgtgcaggtgatcttcccgcgtaaaacccgtaaggcgtcgtcacatctgcgcgatccgcaaatcgtgctgcttgagaccaccaaaggggcacgcattgatgtcgaaatcttcgtgaactgtgaatatggttacgacattcagtgtgaagtggtgggtgaaagcggcattgctcgtctgccggagccggtctctgtgcagcttcgcagcgcggctaagctctccaccaccattctgactgactggaaaaagcgctttatcgatgcgtatgacgtggagttacaggcatttatcaacaacgtcatcagcggtgagatgaccggtccctcagcctgggatggctacgccgccgcggtggccgctgatgcctgcgtcgcggcccagacttccggtgaagttgtgccggtcagtatgccagcaagaccggcattttatcgctgatagcaacactgcacggcgggtttccgccgtgcatttccccctccgtttcatcttttccagcggctcttcacgcatcatcggtaaccggataaagccgccaggcaggatattgagtcataccggcctgagcgtgcagcactactcattatcacggcgcagtaatcacaattgccacacgtcgattttgcgcgcgtccctgcgcgctattgttgctggtaaccggtgcactcatacctaatccacgtgtgataatattttcacgcggtatagcagccccttccgaccactgtgccgcgactgcgttagctctttttagcgacagctgttggttataatctggtttgccgtaattatcggtgtgcccgtcaattcgcacatgcttaataccggtcgacgccaggttttttgccatcccctgaatgttacttttgctggagggtgtaagttctgattcgtttacaccaaacaggatcttatctgataagcctaatccccagccttccatattttgggtgaatcccgcacgcttcatcgctgcgatctgcgcctcagtaaaacgttctttagactgacaaccgaccagcgccaaaataagcagcatcagggaaatattttttttcatctttaagccttatttgttcgcttatttttatacatattcatgtcagcgcgttcgagaatagactcaaccgtatcgccgtgttgtgaccaggcgtagccaatggtaaccgaggtatttatcggcgtaccttctgcaaggatgattttttccatgatgaggtcatggatgtcctgcatgagttgctgtaattgctcctcactgacctgactgctcaccagcatggcaaattcatccccacctaaacgggcgactaaatcctgttcagatgccagtgatagcaggcgtgctgctatcgcttttaatacctcatccccggcggcatggccccagttatcattgatacttttaaagcgatcgccatcaagaaagagtaaggcaaaacgctcctcagcatattgctggtcgagaagccgggaaaggtgagcagcaaaggcgctgcggtttgcaagaccggttaacgggtcctccagcgctttggctgccagcgagcgattatctcggataagcgaagcctttagcgattgcatttccctcagcaacgaattgagatcatctgaaaatagctgaaactcactcgtcgtgctctccggtatacgcaaggaaaaatcaccggaatgaatcacatagtgaatcgaaactggtaatgttgcgcagtgtagcgagcataccccgatgcagaaattcactcagcaaaagggagataatcagtacacatagcataccgctggtcagaatcatgaaggagtatcgaatgaaactcaccgcgccggtcacggtgccttccagcgttaatgtaccgacagcaacgtcagagtgaatgatactgacgttaagcggtttaagataaatccactcacgtaataaccgcgaataccagcccgtctgctcctgctgagcatgccagttgaccagaacaatttgatctttagtgaccagtttcgcagacgcgtacatcccttcattgccgagccgtgcaattttattgtgcgcatcgtaactgtcggaaaaaacggtcgcagcggttagcgtggtgctgagggttgcgccgattaattcaaggtttcgcttctcgtaatttttaatgaatagcagcgacgtcgaagagagcaacagccagcacaacagtaatatcaccgcagcgttgatggtgcttatttttcgcagtttattgcgtatcgatgatttgtcatttcttaatttatcaaatttcattttattcgcttctctcgcgggacagcaaaagcacgtccggactcaccctgacaccgcttctggcaagcgaatcaaggttaacggaaaaaagcgtgtggcccggatgaaaaatcaggcaaaacgcggcgccccgcgtgcaatccgcattgttctccgcgagggtaaggacggctctgcccttaaactgctgaatcaggtccacctgctgttgtgacgtctgatcgccgaaatagacggcgtcgcatctgtgcgacggcaggtcgcctgcgctggcaagataaacaacggtgaatgtggctgccgcagaggaggcattgtccggcaaggagagatgccgggctgaagaaaaaatacataattgaggcggttgttttaagcccgtccactgggtgaagctgataataccactgacgatatcattggctttgccatcttttatttcggcactggcaatatgaggaataagcagcagcaaaataagtcccgtataaacgagtttgcagatgtggcgtatgaaaagcagcacatcgacgtcatgatgaatttgatatttatcgatcatactgcgttcccaaaaattctacgcatggcaggacgccttaataagcgcggaaatattagcatagcggtgattaaatttgtacttctggtttggtttgccacataccctgttgttgtacttttatctggcgtaagaatcactgtgctatcagtcaaaataaggttttaaaatttcttcggtccagtgcataaaggctctgacacgccgcgacagatttcgtcggtgtgcgacaacaaaagaggcactaagcggctcaggacgcagattgggaaggacttcaaccagcgcaccgcgctcaatatagggcgccagtgttgagtaaccgccctggatcaagcccagcccggccagtcccgcctcatgataggccggtacgctgttgacccttatggcgccgggtaacatcagcaattgatagccgtcatccgccggatactcccagccatctggcttcgaaccaaagctccgctggtaatgaaccatctggtggccctgactgagaaggtcatcaatcgtctgcggtaccccgaagcgcgccagatagcccggactggctgcattgatcatgcgcagctgccccagcgggcgagcaataagcgtgtcatcaacgattggccccagacggatgacacaatcaaatccttcatgaactaaatcaacgcgccgatcggtacttgaaagctcgatctccagttcagggtgtgcctccagcaactgcggcagcgcggggattaccacgcattgtgccagcacggcaggcatatcaacgcgtatccggccccgcagtgacatcccctcgtgagagaacatggactgtaattcttcggcttccgataacagatcgcgggcgcgtgagtaaaaagcccgtccatcttccgttaactgcactgtttcgcgtggtgcgatgcagaagtgtcgcgcctgtctccctttcgagttcgcgcaccactagtgaggcgcgtcctttctgaatacccaggctttcagctgcctgagtaaaactcttcatttccgccacgcgtgcaaaaataatcagcgcctcaaggtttttcattcattgttccccttcagagtaacagtgcgttatttcttacgttatttatcaccatattaatgggtaatagactgctttcacaccgcggatattacagaacgcgatctgaacgttatgaaggtgaaccgtctttctgaaaggctcaacgccgttgcgaactgccatgcaggtttgtgtacataagcactggttcagatccccgcatcattcagagcactgtcggttcgcggcaaacattgctcagggtatcgggaagcactcagtgaaaaggttgttactcaccactcaatccgttgacccgaaggaagatttgaaaacttagcccccattccggatttggttaacgccagtcgcgctgccttacgctggatttcacccccctgtcaggaaggaaaagagaaatgaacaaaggttatttaatcgctcacgtgaccgtatcggaccctgtcgcatacgctgactatgccagagctgcaggcgaagccatgcaggcgtttaatccgaagatcgttgcctggtcagggcagtatgaaaatctggagggagaggcgcatgaacggcatgtggtatttgagttcgaatcttttgccgaagccaaaggtttttatgaaagccctgcgtatcaggctgccaggctgttgcgtgcaggggctgcgcacgggacgtttgtgctggttgaaggggccagcctttaaacacttcaccgtcatgtgccgatgcagactccagcgaacctggggcccgcaggatgtcaccagtatgctcagtggtgcctgaatttcccggagaaagtgacgagggatattctgacaattgacgctacctgaccaccgtgccggttaggtaacgtgcaacaggcaagggggtggctgcgtctgactttatgacttccgcagatcgcttccatccccctctgctttcattaaagctgcacggatgaggtttttcgtacagacactcactttcggggcaggcgcaggccaaagatattgtgcccgtttctcatgccggtagtaagcacttccgccatgtaaagcggcgatggcgcgtaccagcgacagtcccagcccgcttccggccgtatgacggacgttatcgccccgccagaagcgttcaaataatttttcaggctcctccagcgcttcgcccgcgttcaacacctcaatctcaacgtagtcagcgtgatgacaggtactgacctgaatcgtgcctttttctggcgaataacgaatggcgttgatcaacagattactcatcgcacgctggaacagcattttatctgcggtgaggctgcctgcggcgctcagctcaatggccttctcctgctcttccgcaaccggttcaagaaagtcgatcagcgattccagcgcgtcctgcagcaggaagtcctgtttattgagtctgatattgtggtgcgtggcgcgagccaggaagagaatgttttcagtgagacgcgacagactctccagctcttcaatgttgccttcgagcagcgtctgatattcagcggctgagcgttcatgacccagcgcgacctgattctggcccagtaacacattaatgggcgtgcggatttcgtgggccagatcgtcggcaaactgggtcagacggataaagtccgtggataagcgctgacgcatagtgttaagcgcattgccaatcggtagcagctcctgcgggatagcctgaagcggcacgggctgatttaaccggtcactggccgtttctgccacgatcttacttaaccggccgatcgcccttagccctctgcgaatcaacagcggactgactgcggcgcacagcaatatggccgccagtgaaaccagaatgctttgctggcgataacgctccagcatcagtgctcgctcccgcgcgacccgggcaagcgtaatggttaccggcccgagcgaggagtttgcctgcaggcttaacgccgacgcttccgtcttgtccgcattgatccagcggtgcagctgtttctcactgggtggcgtactgaccggcgtgggcgagatcgcgggcaacgttatcccggtatgattaatactgacgttttgctcatgctgcgagcggatgctgagaatgtcctgatggatatcgaccatccgattgaagtagagcggcagcgagctgggatgggcaccatcttcaagcagttgtcttaactgcgccgcccgattaatcagcgtttgatcgtcccgccagaccagttcactgcgtaacgctttatacagaatcaggctgatgccgccacaggccatcgccatgatcagcgtaaaaattgccgtcagccgcagcgtcagagaagggctagtcaccctcgcctcctttttctgacaggcaatatcccatgccccttaccgtagtgatgagcttttgaggaaaaggatcgtcgactttacggcgcaggcggcggatagcaacatcgacgatattggtttcactgtcgaaattaacgccccatatttcgctggccagcagcgtccgcggcagaatctcaccgtgacggctggcgagcagccataacagcatgaactctttgcgcgtcagtgcaagagtgacaccgtcacgcagaacctgaaagcgcgctgagtccagcaccagatcgcccacccgtagtacgctactgtgcggctgctgctgccggagctgatttcttacccgagccagcaactccgcaaaagagaacggcttaaccaggtaatcattggcccccagttccagccctttcacccgatcatccaccgagtctctggcagtcaggcaaatcaccggaatctgactggcggtacgcagggttttcagcacctgccacccatccatccccggcagcataatatccagtatcaccaggctatagggatgtgacagccccagatgcaggccatcccggccgtctgcggcgtaatccacgatatagcccgcttcttccagccccttacgcacccaggcgctcgccttctggttatcttcaatcagtaatagtttcatcggcgcagtttgccatgaaatttatgaccgccccagtgtttcagcgacagatgacaatatggtcatctttctgacaggcagaacgaacaaccgtacaggtataacagcggggtgattaacaccggagtattaaaaaatgaaaaagagtctcactgccctggccctcactacgctgcttgccgttcccgcggtcaccttcgcggccagtaaaaatccgctgagcgttcatgtgctgaaccagcagaccgggctgccggcctcagaggttgaggtgatgcttgagcagaaacagggagaaagctggaaagtactgaataccgccaatactaaccagcagggtcggatagatgccctttggccagcaaagccctttgaggcgggagactatcgggtgatttttaaaaccggtcactattttgcggcacatcaacagcagagtttcttccccgaaatcccggtggagttccatatcaccaataccacgaccacctatcacattccgttgctgctgagccagtacggatattccacctatcgcgggagctgaaataaatgaaacgtttactgctggcattgatgctgactaccggacctgccgtggcgctcgctgctgagccagcctccgtctatgacatgacgcaggcgctgagtaatcaactggcaacggaggccttgtccgcctgccataatatgaatcgtcaaggcgtagtcgccgtggtagatcggggtggaaatctggtcacgctgatgcgggatgacaacgtggggccgcacaacactcaggcggcatggcgtaaagcgtttactgcgctctccaccaaaacgccaaccagacaactgaccataaaggcgcaatcctcaccggaaagcgtcaacctgaatacggttaatgagctattgctgcttggcggcggcgtgccggtgcaatatcgcggccagtggatcggcgctatcggcatggcgggcaccggcggcgcggaatccgacgatcaatgtgggaccgaagcgattaacaaagtgctgggtaacagcaagcaacagtaatcatgatgaatgcgcggcgggtatattcctgccagacacggggaataaactgttccccgtgttgtttaaataagtcgctgcaagaacggctgctttgtgccaggagcggacatcagttccaattaatataatcagcgcaatgcctttgagaaacagacagcttctgccctgcctatatatgggccgtaattctcgatagggacataaccatttttcatgtagaaatttactgcacgatagttgatgtgtcgggtttccagcctaatttcgatatatcccatctcttttgcagatttttcaagaaaagtgagtaaagcaccgccaatccctgacgcacttcggtctgaaaacatccttttaatctcggctatatttttggttaatggccgtatagcaccacatcccacagctttgccttgagaattctttgctaatgcccataaagcattgtcatcactcattgcttcgacggtgaaattgcttttgccgttatcaccagtaatagcggcaagttctgctgatagagcttcgactaagcgacgggactctgaagaaaatggatctgatttttctactgttatcatggttatatcctgcaggataaatgtgaccaacttaaagcatcctgttaaggaaagcatcagcctaaaacgggtgatgggacaacaattattcaaaccatcctttggatgtcatgtccgctcctcgctcatacgggacactcataatcacatctcctaacccaatggagattgaacatgacaacatccccctggaacaaaagccgcattatcggccagaaacggcctcttcagatctttcatatctgggggattcgtatccgtcttgagcgggaaggaaaagtccgcgatttggctctgtttaacatggctctgaacagtaaacttcggggctgtgatctggttaagttgaaattttctgatgtggcctatggacacactgtttcgggcagagcgactgtgatgcagcaaaaaacggtcagccctgtccagtttgaactgacgaagggaaccagagaggttgtagccgcatggatcaaaatggctcatctacgcagtagcgactatctttctcagtcccgtattagttcatcaagacacatttcaaccagacaatataatcgtatttttcatggatggattgagaagctgggtcttgatgaaacgctctacagtacgcattccatgcgcagaaccaagccatatctgatccttaaaaaacgaaaaatcttcgtgtgatccagttacttttgggtcacaaaaaactcgaaagcacagtacgttacctgggcatcgaagtagatgatgccctggagatatcagagtcgattgaagtctaacttgtcagggctgcaacagcagcgctgtgccaaaagcggacaaaatttattgggatattatggacgctggttcagccagtgcattgagatgaacatcacactgggggccaaagcattttatctgctggcagtcaggcttaccgctgaggcaattgtgataaacgtgcatgttatgcagtctgacattaaagacggtgtccatatggataccgtaatcggcattgtcatgcacctccagatcgctcatataaacgttgatcaggtgcgaaccacgaatgccgtgcccgcgtgggctggcataataacctccgctgttttttccggtctggattagacgaacatctgcgacgcggcgaaggtagatattgtgaaaatagtccttctcagtgttgccattgttatgcaacttcagatccgtcgccgtgacatggctggcgcctttgatatggatcccatcgctgctgtttctccacctcaacgttctgaagagtaatatcattacagccggttttttcaccggcggtcgggtctccgctgcagttaaaaaagagaccaatctgattattcctcaaatcctgactgtcagaccgttggtcaatggtgccgaccagtttcacatcctttatcgtgacgtggctggcggcagtggtatagagaagcggcgcattaatggtgctcctcaccgcaggactccaggtgataaccgtacccggccccgtgccttgaagtgccacattgctgctcagcaacaggctgctggcctgaaaccaggtacctttaccgagcagtaccgtgccgccaccggcgacctgcttaatgcattcagacagtttttgtgaagatgaacacgccaccgtgccagcagcaactgcagcggggaggtaacatgccagcatgaacccagcgataaaactgacattgcgtaaaagggctttcaaagtaattttgctcacagttaacttaagaacagagggagaggtcaacactgacaaagatcatctcagaaggagccggatccccagataccccatcaccagcccactcgctttatccagccgggatttgtatttcatataggtgagacgtggcttttcagccgataacagccatgccaccaggccataccaggctgcatcaatgaagaacgccataccgggcaacaaaagataaagatagggcgagatatgctgactgagcagcgcagcaaaaatactgccaaatacaattgctgtattcggattactgagctgagtcgccataccggtaataaacgcgcggcccggacggtgtgcgttttcgcctcccaggctcagatccaggctgtcgcccgttctgaaaagcatgccacagccaagccagagaaggtaaaccccaccggcggttttaagcacggcatacagccagggaaccagctccagcagagagtgcagcccggccagcgcaataactgagaaaatcatgcatcccacgcccatgcctgcggcggcggagagcgcactgaggcgagatgagacgacggcagtacgtactatcatgatgaagcttggtccgggactcatggcgcctaccaggatagcgccggctatcgtcagaagggcggctggcgattcagtcatagtgttacctgcactgttagtttcagaattgcctcttttgagctggataatctgcgcaaaagacgatcattgacggctctggttgtaacgcccggccagtttgtccaggaatgtgaacagagcctggttcatctcccggtaatcatgtgcacgcagttgtgcaggcgtatggacaaagcggtattcacccgcccggcccagatccttttcggagtgggcaataagcagttcgactacttccggtgtcagctccatgtggcactggaaaccgaacaccagatcgctgtaggcgacgatctgacgcgggcacccttcactgtgggcgatgaccgtggcatcaggcgtcagcccaggcatatcgttatgccagtgaccgacctcaagcgtgtgtccgaaatgtgaaaacagctcatgctgttgccctgcctgcgtcagagagacaggaaacttgccgacctctttttccgggctgtgtgcaaaagaagcaccgagcgcctcaccaatgagctgggaacccaggcagatgccaataacggctttacctgcgcgcacagcggatgcgatgaccgcctgctcagcctttgcatcaaaatgcgggcactcttcaggggtggtttccgggtcctgtggaccgcccataacaatcaaaaaatcgatgtcatccacgctggacggtagagcctcaccttcataaactcgtgaataggtgacgtgattacctttgcctatggcccaggactcataagcgccgggagcctcaaaactttcatggatgatgaaatgaacgtgcatttaaagatgctcctgtaatgcttatgttaaccttaatttttcaagtttcaccctgccgggatgttatgaatcgggtgagtccaactaagataactgcaggaactaaatttgaaatgccaagtagcatagataaagcgccaagacatgatgaagcgacgggatggtcttgcaccgccatcagctatcaacgcggagagaccgatcctcctcatcatcatattgaaggacagctgttatttgctaccaggggcgttatgttggttgaaacagagggcaatcgttgggtgataccccctcagcgggcattgtggctaccgcctctgcagattcacagctacaacctgctatcccacaccgacttaagggctatttatttcagtagcagtcttatcgaagaatgcctgaattttacgaagagtcgccaggtgcatgtgattacagccaccgcactggtgaaagagctgatagccgggcttttcaatgccgattacactggaccgagccagcgtaaaatggcgctgttaattttagaaattctcagtgaggcaacgcctttgaccgcggagctacctatgccgcatgatgagcgcttaaacagggcaaccaaagagttactggtcagtcaccgctgggaagcgtctctaagcgatctggcccatattgccaatatgtctgaacgcaccttttcgcgaatgtttattaaggatacgggcttcagcttcagaacctggaagcaaagagcaagaatttgtgcgtcattagatctcctcgccaatggcatctcaattaagcaggtctcctaccaactgggtttctcatgtccggctgcatttaccgctgcatttcgttccattctggaattaacaccacgcaattttcttctttagcacacggccaatgtccgcttatcgctcatagcggactatgtcccgcaagcatgtctgatttgtgccagaagcggacatttttgagtgactcaacaacttcatggtgcctgacagacgctggagaaacaggctgcggaaagttatccggacatgctatacgtacgctggaatcagtatcgcagtggcctgaagttttaaggattgacgctgtcggatactgcgagccgtatatcctatccggaagtggtcaggtttacatttccagcccaaaagcagcccgtaaatcacttactcaattctgataaaccatgacataagtgctactaagttaataaatgcttttttagtgatgcgggagagaataggttagttgttcattcactttatgaagagaaattaatatgccggttttacatacaaattatggtgatattaattatcatgatattggcacgggtgacacgactctgttcctcatgcctggctggtgccaaccaaaaaccgtttttaaagatttctctgagcaggccgccgtctttttccgcgttgtcactatagactggcgtggtcatggaaaatcatcgaccaacggtcaggatgttgacggtgaggcgttattatcagatgctttagcactaattaaacatcttggcttaacacggatagtgcctgtttccgttgctcatgccagttgggtatctattgatttggtggaaagtttaagaaatcgcatacctgcagtcatatttcttgattggatcatgaatcagccggagcctggatttttcgactcggtcagagacatgcagaatgaagacagctggcaagatgcacgggatgccctttacgaatattggctggcagaaagcgactctccagtcatgatccatcatctaaaaactgagatggctgaatccagctatcagctttggcgacttgctggtcaggtcattgctgatgcataccataaatatggttcgccactcctgcgtctcgaacagctcagaaatccccctaaggcttctcacatctattccctggacagaagcgacaagtacctggctttacaacaacgtttctcaaggaaacataatttctttgaagtgaaacggttagagacggccagaactcatctggccgtacttgaaaggccggcggatgtgctggaggagatcctgaaattgctttgaacgtttttgtagtttttatccagttgcagtaaagaagctatcaggctacttatcaagcaactgactaacatcctgtgctcatagcgaaccctgcatctacgtttcggctgcttcgtgccagaagcggaaccagatgagagctatagaagatcaactatcacgttgcttttctaaccggatgaaagtgccatccagatttgctttattaccccagccgagttgcatgtaaaattttgccgcacggctgttttcttcggtttccagccaggcaatttcgtgatgtctgaataactcctgttccgcaagcatagtgagtctgcgacctatacctctgctttcgtattcaggatgaacaaaaagaccataaagacagcctttatccgttaagatcattgaaaaaccaataatttcgtcgttatcacaggcaacccatgcgcaatggtcgtttttgatcatatcgcccacgacgctttcggtgatccctattcttcgcatttcttcgcggctcagatgattctccgtaacagatgttcggactgagaaaattccatcaacatcagaaaattgtgctggccttatatttatactcataagacttactccatgtatgacaaagataaattctgatgataatgcagccatatcctctaaggagccacagaaaccgtcaatgagatgacaactatttatgttccgctcctcactcttagctaaccgtgtgccagcgccagacaactctatgcccggagcagcccctcacaaagttgatacatttcacgggacgaactcagtcaaaatcacggttaaacccgttgtggttaagaggcagttctttgctcagcgggttattgagaaaatgcaggagtagtaaaaactcatgcctcaaatgtgtattataaggcgctgcaccgcggaatctttaaaaaagatattttctttggctattggtaaaaacgctttcttaaattatttagtttaaattttgagacatattgatgccggtaatatgaaagccattcttctgatacagtgctttggctgaggcattattcggcgctaccctaagtccgacttcatcgatgttcattatttttagcaatcttttcatttcgcataaggccagaccaccgaatccacggccgcgccagtcaggataaatgtagaaatcacttatccaggctgatgacccggtgatcgacaaccagaggatgccaataacttcctctggttcatcaggctcttggatacaccacagctgattagccggggtcacaacgccctttgttaacactgtatcaatagattctatggctttgattcgtgctttttcggaaagatatccgcgatttttttgcagatcctgcgaatattcatggatgaaaagagaacgataatttttgaattcttcttcattcatattcctgagagtaatcacactatcttcctgatgaggtagttatgtgttgaagatatcacctggaaactgtttttcaagcttctctgttaaggaatattttctctgcacgcatgaatcaccactgagaatggtgatatttcagaatagcgagtaaaacggcacttactgattattgctaagctccgctttttgccatagcgcctgttaaccagcttcataagttaaccagcccctttgccatcacactcagtcagcaggcccggaaacgctgcgcggtccggggatgttaagctgttcgatcgagatgtcctgacattttaaaatgtcactgaaatggtcagttttgcgttccttcagctgatgatgagactctgacccggaatgcaataaccagcgcggcagtaagcatgatacaggctgcagtaatgaatacccccgtcaccccgttgaggccatatatcaggccacctattgctgcacccgcggcaatggaggattggacggcggcgaccaccataccccctgcgctctcggcctcatcgggaagagtccgggcgacccaacctgaccacgccaccggtatgccaccaaatgccagcccccacagcatgaccagcgccgtaagcccggcgattgataacggcagagtgatcatacccagtgccgctgctcccaccagagcaggcataataatcagcgtaaaacgcaggctgcgttccatcagccatcctgccgacagtgtcccgataaagttagcaatgccaaacaccagaagtattaacgccagcccttttgcgtctatgtgtgcgagtccttccagcgcaggccgtatataggtaaacagcgcatactggccggtgtgtgcgagcacgcaccccagcatgcccacgctcacgcccggcctctggagcagagaaaatacggatgctgtcctggtcctgactaccggcggcattccgggcagggtcagccactgaaaaatgaaagagagtgcgccaaccgcagcagcggcaataaacgcgctacgccagccagacatctcgcccagataacttcccagcggtacggcaacaacagtacctacagcgattccactaaaaatgatcgacagcgcccgcggtaccagcctctccggcactagcctcatcgcaaccgccgctgccatactccagaatccacccaacgcaatacccagcaggatgcgcattgccagcagcatgacaatacctgaagagagcgccacgagcagatttgagaagatcataagggcagtgaagctcaacaacacgacgcgccggtccagcgcacgcgttaatcgcggtatcagtaatccggcaaataacgcaatcactgcagtcactgttacggcctgtcctgctagagactctgacacacccaaatcccgggctataggcgttaataagctggcaggcaggtactctgcggtgagcaggccaaaaacacccatggttaacgaaaaaaccgcaagccaggctggctggattttctcatctctttgcactctttctttgtgaaccctgatagaagtttcatccgtcatttctaagtctcctggaaagtcgtttcaggagaagaagtctattcaggcgcagctggatgatctatgctctaaaaccctcacttttttacccaaaacccggaaaggcatatgacttcatccttcgctctgtcatcagaactcatcagcgagttgctttccggcctgcggctatacggcgtgcgatatcagcgtatccagacgggagatacgtttggcctgaacttcgcaagcaggcccggtcatgcttatctgcactacgtcgctgtaggggagatggtgcttcatagtgcaaacggagaaattcttacgctttcggccggagaggctgtatttcttccccacggcgaacggcatcagcttttgtcggcaacagccgccgacgtgctggatatcgacaatattgaaacggcaccactggatgaaaaagtgagtggcattgatacctgcccgagtacccaagaaacaccaggcgctgtgctgttttttggttgtatgaaaattgatctgggaagcatgcagcggctggcggatgtgctgcctgaaattatgcatgccgatgcaaaggggattcagtggccgggactcatgcatatccttgatgcgatgaagcgtgagatatgctccggacgcgtgggctatgcaggtattctcgccaggcttgccgatgtggctggagcgatgtttatcagaggatgggtggaagatggttgcggcaatagccctggcctggctgcagcactgcgcgatccgcgtctggctcaggccatcctggcgattcatcgcgaaccgggtcgggactggagcgtggcagaactcgccgccgaatcgcatatatcccgctccgcattcgccgaaaggtttcagaccaccatcggcgtcccaccgctacggtatgcaacagaagtaaagatgcatctcgctgtccgctggctgtcgtcagaaaacattaccgtcgacaccgcatcgcaacggttaggatactcctctcaggctgctttcagccgggcttttaagcgtgtaacgggcaagtctccaggcgcggttcgtttgcttagctaatggggttttatccctggcggggctagcagtaatcgcgacgtagtttgacttcctttgtgctccagcaaaggcaggatcaaataaataaatcacattaaaaacagtatccgcttttggcatataccggtcatcagcccgatgacagtttactttgtgacaggagcggacgttcacattaactgtaggcacacactgttatgtaaaatgtgagcactgagcacaccccgaaggagaagaggctggggttatgtcacaggagtcggcagaggccgggcgggaaatggatcgttgggtggtgccggataagctgccatcactcaggctgacactatgcgatgtcttttaaggaagatcgggatttactggtgccggtaaaaacgactgatatgacttcaccggctttgcatttcaggccttgcggcacggtgtctcagcattgccttgctgtctgcttagtctgtgtttatgaggtcgccggggtcatcaacctccggcaaaccacgttaactgcatagggataactatttagctccactcattccgggagaaccatcatgtcctccctcattcccgccactgccaccctgcccgccgacgccgccaggacacgcatcggctccatttgtgccgtcattttcgccatctccgccatttgaattggagcctgtgtcagcattaccgccgttacctccgttcagacggcctgtaccgggcacgccgtctttacccttttctccatcaggcgaactgccgttcccatcctgtccgttctggctctcacaggcagagagctgaatagtgtcctgcgggagtgtctgactgaataccggtagggaaaggagcagccctgcagatagtggaaaaaaatcagcgtgttgtgtagctttgacatagaagtttcatcctttaattaatggccgccctggcctcaggggcggtcatctcgcgttaccgcaggccgccgctatgtctatgtggggtttatgacgccagccgatagtgcgactgcaccagacccgaagggaagctgcggcttgatagcagtgtcaaatcgatatcctgttgcagggagccgaacagggattttcccgaaccaagcaggacaggaacggtagtgataacgatatcggcgaccagtccttcacgcaggaacgactgtatcacctgcccgccatcgatatagatgcgatgtgcgttctgtgctgccaggtcattaatcacctcctttggagtacggcgggtgaattgcactttgccttttaatgcctcgggcaccggggtatcggctagctgtcgggaaagcactagcacgggctgatcataaggccacacatcaaaggtcagcaccttctcatagctcccccggcccataacaatccaatctttatccgcgatgaatgcggcatagccatgatcttctgtcggatccgcgcgctgcaacagccagtctatatcgccatcctgtcgggcgatgtaaccatcaagactaactgcgataaaaacgtgtatggtgaccatcaggtgctccgtgttcaggctgcagatttcaggctgagtttagttgtactggcgatatagccattaaaagggcatttaccctttcatccttaccgggaatgcccctatgagtagtcaggagtagttatgcgcttcccattgatacagaccgcctgtttcgacggtgtgctgacatgcggcaaagcgggctaaagccgcccctgtaaacgcctgtcgtcagacatatcccattattttcagcagcgactgcacctgattcatcgcttcgctgcgatgggtgacgcccagcttctgatagagattgcggatatgagttttgatggtggtggaggccaccgccagctcaccggcgatttgatcgttgctataaccagaatagattaatcccagcacctgccattcacgctgcgtcagcggactggttcggatcagctccggcacgtcaggatggttaagcaaacggctgacaaagccttcatcgaaatgggcgaatttgtgacggtgatatttattgatctccagcaggatgcgccgggcgcggtggctgtccagctcattcagggtattaagctggatcaattgccgcagctgctgcgccatcatctcgccttcaatcacaaaatggctgataaaaccggtgctgcgcgccagtttcagcgcctcaatcaggacacgctgcgcctccgctttgcggtcggtctgccagtagatctgattcagcagcagcagattacggtttaaatcgctcatcaggcgcagggcacgggcattctcattcaactcctccagcaccacttccgcctgactgacatcacccagcaggatctgcgcgcgggcgatgttccgccattgtccctgcagaaaatggttattggcgaaggcaggtttaggcgtctgccgcatccagtcgcgggcgttctggctgtcgccggtcaattgccagtaaatgacccggactttgtcggcattggctatccagtcgctgtgccagttgccattgttcagcaggttttccagccggttcaggtagctgcgggcgttatccagattgccgcgtgccagtgagcactgcaccagcaatcccagacactgaatctgctgctgcggctggaaaccgttcagtactttgatgccttcccgggccgcctgctccgcctcttccagtcgtccccaggcccacagcaactgagcgcggatgcgcagcagaaactcatgcagcgggaactgcgccagatgctgttcgtcgaccagcacaaaggcgcggctctggatctcataggctgcctgcaaaaagccctgagcaaacagaatctcgctctgctgaatcaggctccagagggcgtagtgccacacttcatcgcgccgcgccatctgttcggtctgccgcatcagtttgagtgaatcatccagctcgcctttgcagtgcatcacttcaccatgcactgaggttgccacaatgcggctgtagtgacggctcgctggcagggtatcgagcgccactttcgccagccgctccgcttcatcggtattgccatcgttaatcgccacctgggcgcgcaacgcattaaattcaccgcgcagtgctgcgtcgatctcgcagcggctggcctgttcaaaacgcgccagcagactgtcgacttcggagaagcgatgctgactctgcatcagccaggcctgcagcagcaccagcattggattttccagcatcatctcccacggcagtgctttcagggagttctccagcagcggcagttcgctctgattaaacagcgtccacgcgtgcttcagcagcacgtcccgcagcatagtggcgtcgccagaggcgagcgcatgatgaatcgcctcgccgggaaagccctgcgccatccagctctctgccgcagcccgatgcagcgcaggcagctccgccgccagttcccactgacagcgctgacgcaggaagttaccaaacagcggatggtaactgaaccagcagccggagtcgtccatgcgctgcagaaacagaccctgacgctcaatctcttccagccgcatctggccgttctcttcgcgggtgacacaggcgatcagttcatcgttcattgaacgcagcagcgcggttttcagtaagaaatggcgggtaggcagatcgacgttatccagaacttcttcaaccagataatcggagaggtggctggcattaatgccagagagacgccgggcggaatgctgagccgaactggcaccctgtcgcgccgacagcacgatcagttgcagcgccgtagcccagcccgctacatcatcacagagtcggctgctctcttcgctttccagcggggccgccagtcggcagtcaaaaaactgtcgcgcctcctggtgggtaaaagccagctgctggctgcccagctcaatcagttgctcacgcacccgcaggttggcgataccgagttgcggcaggttgcgtgacatcagaatcagcgtcagattttcaggctgatggcgcaggaaaaagcgcatcgcgtcgtggatcaccggattggtaatcagatggtagtcatcaacgatcagccacagcggctgctgccactccaccagctcgataaagagctgagaaaacagggcgttgagattcacatactgccgcttctgggccagcagttcactgcgcggacagccaccgtgggttgcctgttgcagtgcagcgatcaggtaatcggcaaagcgctccggctgattatcgccctcatctaaagaaacccaccccagatcgcttttccctgccgcccactgcgacaccagtgtggttttaccgtagcccgccggactggtgaccagcaccagccgatagttacctgcagcggtgagcttttgcagcaatctctcccgaatcacagtgccttcaagacgcaccgggcggctgagtttagcgggtattaacatgggcgcgcgtttctccatttgtcgagcgcatcattattttacgcttcgtaattattacttacacaggttcagcatttcgtcagatgaatgcaagcaaacccattaattaaactttacaaaagcgtgcgcaatcacactccttcaacgatttcggattagcctcatcctctccaccctccccatcctcctccgctaattctttgcaggaggatgagcgagggtttccgcgcgggcagactgtcgccacattgatccattttccgtttttacaggacatcaaccatgacacagcccgatttcaacccgattcagttcaatgctgccctgacccgtcagtggcagcgttttggcctgcgcgatgcgcaggagatgactacgacacagtggtggcaggcactcagcggtgcgctggccgatatgctggccgcacagcctgctcccccggccccgacagaaactgcgccatgttaactatctgtcgatggagtttttgatcggtcgcctgaccggcaacaacctgctgaacctgggctggtatgacgcggtcaacgaggccctggccgcctgggatatctcactcactgacgtgctggaaaccgaaacagatccggcgctgggtaatggcggcctgggtcgtcttgctgcctgtttcctggattccatggcgaatgtgggtcagcccgctacgggctacggtctgaactaccagtacggtctgttccgccagcgcttcgaacagggcgcgcagattgaaggcccggatgactggcagcgcgaccgctatccgtggtttaaccacaacgccgcgcttaacgtgcgggtcgggctgggcggtaaagtggtgacggttgcgggtcagccacagtggcaaccggcgtttgaactgctcggcgaagcctgggatctgccggtggtgggttatcagaatggtatcagccagccactgcgtctatggcaggcgaaacatgcccagccgtttaaccttgatcgcttcaacgacggcgactttctgcgcgctgaacaacagggtattgatgctgaaaaactgactaaagtgctctaccccaatgacaatcatcagaacggtaaaaaactgcgtctgatgcagcaatattttcaatgcgcctgcgcgctggctgacattctgcgtcgccatcatcgggccggacgcagcatcgaaaccctggccgatcatgaagtgatccagcttaatgacacccatccgacgctggctatcccggagctgatgcgtctgctgctggatgagcatcagctgagctgggatcgcgcctggcagatcacgcagcacacttttgcctacaccaatcacaccctgatgccggaagcgctggagtgctgggatgtgcgtctggtgcgcagcctgctgccgcgccatatgatgatcatcaataccctgaacacgcagctaaaaacggcagtcaccgcgcgctggccggacgatgaagcgaagtgggccagactggcgctggtccataataaccagctgcggatggcaaacctctgcgtgaccagcgggttcgcggtcaacggtgtggcggcgctgcactcgaaactggtggtgcaggatctcttcccggaatatcaccagatgtggccggagaaattccacaacgtgaccaacggcattacgccgcgccgctggatcaatcagtgcaacccggcgctgagtgccctgatcacccggacattgcaaaaaccctggctgaacgatctcgatgccttgcaggggctggaagcgtttgcggatgacgccgccttctgcgcggaatatcgcgccatcaagcagcagaacaaagtcgcgctggcgcactgggtgaaacagcggaccggcattgagattgaccctaccgcgctgtttgacgtacagatcaaacgactgcatgagtacaaacgccagcatctgagcctgctgcacatcattgcgctgtggcagacgctggtcaccgatccgcaggctaaccggacgccgcgcgtggtgctgtttggtgccaaagccgcacccggctatgcactggcgaaaaacatcatctatgccatcaacaaagtggccgaggtgatcaatcaggatccccgcattggtgaccgtctgaaagtcgtgtttattcccgattacaacgtctccgtcgccgagcggctgattccggctgccgacctttctgagcagatctccaccgccggtaaagaagcgtccggcaccggaaatatgaaactggcgctgaatggcgcactgaccatcggcacactggatggggcgaacgttgagatcgctgagcaggttggcagcgagaacatctttatcttcgggcataccgtggaacaggtggtggctttaaaagcagacggttatgccccggcgcagtggcgcaagaaagatccgcagctccatcaggtcttacaggcgctggaagatggcaccttcagccagggcgactgccacgcctttgatgcgatgttgcagagtctcggcccggaaggcggtgatccttatctggtactggctgacttccagccctaccttgacgcacaggcgcaggtagaagcgctgtggagcgatcaggaggcctggacacgtgccaccatcctcaataccgcacgctgtggcatgttcagttccgatcgcgctatccgcgattaccagcagcgcatctggcaagcgaaacgctaaggaacgccatgaaaacagatccggttatggacgatttctcccgggcgggcatcgccgctgagtatatcaatgctcacggcaagccacaggcgatcccgaccctgacccgccagcgtttgctggcggtgatgcaaccttcccatccgctgagcacgccgctgccaccggtggtgatttttcgcagcggcgatctgctgagcctgtcgccacagctcgctaacgatgcccactggcatctcaccagtgaagcgggtgaaatcagctcaggtcgctgccagcccgctcagccgctgcatctgccgccgctgccagaaggctatcatcagctgacgctgcaacaggccgcgcagcagtggtcgtgccggataataattgccccggcccgctgttatgaacccccggccctgctggcaggtgagtcattatggggcgcctgcgtgcagctctataccctgcgttcggcggagaactggggaatcggcgactttggcgatctgcgccggatgctgccggaggtcgctgcacgcggcggcgcgtttatcggtcttaaccctatccatgcgctgtttccctccagcccggagagtgccagcccttacagcccctcgtcccggcgctggcttaatgtgctctacatcgatgtgggcgcagtcgctgacttccggcagagcgctgccgctcaggcctggtggcaacgtccggaaacagaacaggcactggaacaggctcgcgcagcagattgggtggattatgcggcggtgacccggctgaaaattgacgcgctgagactggcgtggccgcattttactcagcgtgacgccagcgatcccgaggtgcaggcgtttaatggatttatacgtgaaggaggcgagagtcttcagcatcaggcgctgtttgatgcgctgcacgccgatcagatagcacaggatagtgagcgctggggctgggcggtgtggccggaggcgttgcaggatcccggcagtccggccgtgcaggccttcctgcaacagcacgccgatcaggtgcgcttctggctctggctgcagtggctggccgcgaagcagtttgccgactgctgggacatctgccagcagcagcagatgccgattggactttaccgcgatctggcggtgggtgttgcgcagggtggcgcagagacctggagcgagcgcgatctctactgcatggatgccagcatcggtgcgccgcccgatattctcggcccgcgcggccaggactggggattgccgcccatggatccgcaggtgatgcgtcagcgcgcctgggagccgtggatcgccctgctgcgcgccaacatgcgccactgcggcgcactgcgcattgaccatgtgatggcgctaatgcggctgtggtggattccggccggtgatagcgcgatgcacggtgcctacgtgcactatcccatcgacgatctgctggcgattctggcgctggaaagtcagcgtcatcgctgcatggtcattggcgaagatctcggtacggtgccggaagcgattgtcgataagctgcgggacggcggggtctactcctataaggtgctctattttgagcaggagtcagcccacagttttcgtccgcctgccgaatggccacggcaggcaatggcggtcgcgaccactcacgatcttccgacgctgcgtggctggtggcagagcgatgatttgaccaccggcgcacaactcggcctctatcccgacaaggtggtgctggccgggctatatcaggatcggttgcgggcaaagcaggcgctgctgcagagtctgcatcgcgttggtgccctgccgaaacgtgccggacgcgatgcacgtcgcaccggcatgagcaaggcattaaaccgggcgatgcagcgctatctggctgatagccacagcgccctgctgggactgcaaccggaggactggctggatatggcagcgccggtcaatattccgggcaccagcgatgaatatccgaactggcgacgcaagctcagcgccacgctggaaacgctgttcagcgatcctgccactgacacgctgctgcgtgatctgacggcacgccggaagcgactactgcgcaattgaaggttaacgcgcgactcagactcgtgtctcacgcagcctgttttacataattttcagttattacagcgtgcgggccggcaacggcttgcacgctgctactgtaatcagcacctctcaacagtgaaaagatcaccctgagcacgagcgtctaaaaacactaaccggatatttttcaggatttatggatattccgaatttgtattcgcccaattctgagattgctttaacagcaatgcccagtcgtcaggtggatagccgttatgcaacattcctgaaaatactttataggcgtcacgcttactgccataagcacgtttggtctcagcgtcattcatccatgcaaggatgatggttttatgttgctcgctgaatctaaagaacaaacgatactgcatcaaaaactttgcacggaaccaatgcttattttgttctcccagcgtatcgccctggcgaaactttgcctgatgtggatcggcgcaaatctcactattgataactttaaacacagcagctaaaagattagtcgttgcttttcgctggtaactttcaggatatttagccctgagtaactccacttcattggtcagcgcaatcagctgcgattcaaaacacggatgaacataaacgtgccatccatttataaccgtgctgtcttccatacttaattactcatcgtccatgagtggagcatccaaatcaacgtccataccttcggtcaacgatgtaatgcgagttaataatcctcgatccagcgttttaatatttgcaggtgtgttgcgtatgtcagcagcaagaaaactcagaaagctcgccatcactggatcatcatcagtcaccgtttcctgacgggtaataaggactttgccgcccggcagaacagcgtattcgatattctcacccggttgcagattcatcgcatcacgaaactgcggcagggatagtggtctggctgcgggctgtcagttttgatgaagcacgcagagagatgtttgcatgagtcagagttcccatcgcggattctcactagaaaaaacaagatagcgcaacagtaatgcaagtgcattggcaatgcaaatgcattgatcgcgattgagcgaatgttttgttactaagtcttcattaaaagtttctgattacgcttttccgtatcgcctgaaaaattggcaccctgttttatttcctgccagacatcaaactcttcgcgactgataagcacagcagcagaaaccgccccgccgggtgataatcacaggctcacccgccatcacgatatccatgatttcagcaagatattttcgggcctgtgttgtcgtgtaacttcgcatttagcctccagaaaagtcatccctgaaacagcttagttagcctatattcatcaaacgctattgcccacagcatgacttacgcaatgcgtaaaaccacgcaaaaaaatcatgcaatcaggatctctgcaacaaaaaaaggtgcgccgcagcgcaccagatggaacaacatcagtattgtcggggcagcttcaccccttgcctttaacactactgataaaggtctgccgggcagaggtggaacccagccgctcggcttcatccagcagtttcagcgccttatcgatattaccgctgttcaccgcctgtctgatcttctggttaaagtaactctcggtgtcgctcatgatcggttccgcacgggcttttggcgcgggcgctgcggcgggtgcaggcgccggtgctgcgctgtacgctgccgcaggtgcggtattgccgacggtcaccgcgctcgggccggatgaaccaaacagcggcccgaccagaatggatgagccggaactggtctgcatcttcagcttgattgtcccttcccggctgtggcgggcgacgggatcgggaatatccggtaccgcatgaccggtgccctgggcgtaggccttggccgggtcaagcagcgtggtggtttgtgtcagatcgctgtcggtggtgaacaccagcaggtagattttttgctgacccagcgccggggttaatttcatcaccccttccagccgatctgccgccatcacgcccggcttctgataggtaaagtagcggctggggaaccaggccgcaggacgcaggttttcatccagcaccagcacgttcggcgcgaaaacctgaccgttcgccacttcactgctcagcgtcagcgtcagttcgccgatactggcgggcagactgtaggccgcgaccggaccggcaatgtgtggcgcgttcagcgtctgtccgctgttagcgagttttgtggtctgtgtctgagaagcagccagcggttgccagctcagacgttgcagtgtttcggctgccacgaccggtgcggacgagagatcctgcggcaccagattgacatccgccagggcgggaagcgcgtgtcctgtcagtaacgccgcactcaggcagagtgcagccagttttttcattttcattatgtctaccttattgcaggtcgcggcgtgaaccaggcaatggcacaccgcgaccaaagagatccatcaggcgcaggcgcgcctgtcagaaaaagtgctggcttaccaccagatttccatctgcgcgccgaaggtcacttcatcgtctttaccacggctgttagtcaggatgccgttgccgctggtgtccgcagaggcgaaggtggtgagatcgcctgagttatctttgttgtaaccccacttttcatcccatttggcgtaggtcgcgaacagacgcagagccggacgtgaccagatgctgtcgcccgcctgccactgctgcgccagcgtcactttgtactggccgttgcgctcgttagcctgctgtgatttgacgttgtcgtagcccagttccagcaacgtgctcataatcggcgtccatttgtacatcggacgcacacccacggtgtaccactcggtgccgcggttgttgtccagatcgatgttctggtacatagcgacgtacatcagatcccagcgttcggccagtgagatcgcaccgtggtcgaggatgcgatacatgtcaccattgttgttgaggctggtgccctgcggcacgcctttgccctgagaggtcagcgcatcggtggcatactgcagcacgaatttgttatagcccttcagcatgctctgggtatgttcagcagtgaacatccagccatctttagaagccccctcttccagacggtagtcgtcacgggcattagcgcgaccgtagtcgacacccagctccagcacgccgttggtgttggtttccagaccggccagacgcacatcaaacacgtcgttggcagtactggtggcgaagtcacggatacgatcgctggagaaggtgtaagagccgcccgcttcagatgaacgggttgcggcgaaagagagtttaccgaagccgagatcgacatcttccagaccggcacccggaccggaaatatcccagtagtagaagtcgatcatatggacgtcatgacgctgatagaaacgcttaccggcccagatggtagagcctggcagcgcgtcgatcaggtttttaccttttacgttggcttcacggaaggcgggcgatgtggcttcccagtcattctgctgtgccacggagtaagccacgttggtgtcgaaatagaagcttttgtcgccctctttccacacttcctggcctaatttcagttcggcgtaggtttcacattcgttgcccagacggtatttactttgggcaccggtggcctggaaacattgctgttcaccaccgctgccggtccagccaatgccggaacgggcgtaaccggtaaaatcaaccgccatcgtcggggcggagagggttcccaccgcgacggcaacggcgatgggaagtttgcgcagagttaacattttctatctcctgaggtcattgcttttattgtttttggcagggctatacacccggctcctgatacagcctgcggcacgcgctcccgtcctcgcggaacaggtgacaacgctcgggcggcaggccaataccgaggatggcgccctcttttaccagcacgacgtcctcctggcggtaaaccaggttctgacggatagcgggaatctcgatgtggatctgtgtttcatgccccagctgttccaccacctgcacttccccttccagggtgacgtcggcgatatcgctggagagcagatgttccgggcgaatacccagtgacatgttgctgccgacctgcacaccggcgctgtcaaccggcagccagaccagctgctgattcggcagccgcacctgaacctgatcgatggcggtggcggtcactttgaccggcaggaaattcatttttggtgagccgataaatccggcgacaaagcggttggcgggatagtggtagagctcaagcggcttgccgacctgcgcaatgcgtccggcatccagcaccacgattttgtcggccagcgtcatcgcttcgatctgatcgtgggtcacgtaaatcatggtgcgcttcaggcgcttatgcagacgggagatctcaatgcgcatctgaacgcgcagcgcggcgtcaaggttcgacagtggttcatccagcaggaagacgcgcggttccgccaccagcgtgcggccaatcgccacgcgctgacgctgcccgccagagagggctttaggccggcgatcgagcagatgcgccagttgcagaatctccgccacctgattaacccgctgctggatttccgcttttttcaccccggccagtttgaggccaaaagacatgttctccgccaccgacagatggggatagagcgcataggactgaaacaccatgccgatgccgcgttcggcgggtggcacttcattcatgcgccggtcgccgattaagagctcgccgctggtgatggtctccagtccggcaatcatgcgcagcagcgtcgatttgccacagcctgatgggccgacgaaaacaacaaattcaccttcacgaatagtgagatcgatatctttcgacaccaccgtatcgccccaggctttcgtgacattgcgtaacacaacgctcgccatgatcccttccctcttagctgcatagtcgtgtctgcccagcggcagacgagttccggggctcactatgcgagaggaaactgacggtaacatcctccaccgcactgcaatccgctgggggaggaggcgggaggaggagaaacgcaggctgacgccgcggcccgcacgctgacgcgcttttttgtgatcgctaacgcagacccgcaggaatttttgccgcgtaagcgcccgcttgaggggctttttgccagcgcgatcacagcggcaggccgaggggcgtagagcagaggaggatgagaagccgtggcggataagcacaatgatgccggtacagcattcaccacttccgctaacaggatggatttatgatgatgaaaaccggagcaagaattctggccctttctgccctctctgccgtgctcttttcggccagcgcgatggcaaaaattgaggaaggtaaactggtcatctggatcaatggtgacaagggctacaacggccttgccgaagtgggtaagaaatttgagcaggagaccggcatcaaagtcacggtcgaacatcctgacaaaatggaagagaagtatccgcaggtcgcggcgaccggcgatggcccggatattatcttctgggcacatgaccgtttcggcggctatgcgcaatccggcctgctggctgagatcacgccggatgccagcttccgcgagaagattttcccgttcacctgggacgcggtgcgctttgacggcaagctgattggctatccgatctccgttgagtcgctgtcactgatctacaacaaaaagctgctgccgaacccaccaaaaacctgggaagagattgccggtctcgacaagcaactgcgcgccaaaggcaaaagcgccatcatgtttaacctgcaggaaccctacttcacctggccgctgctggccgcaggcggtgcttacgcctttaagctcaccgacggacattatgacgtgaaggatgtcggcgtcgataacgccggtgctaaagcgggcatgcagttcctggtcgatcaggttaaagccaaaaccctgaatgcggacaccgattattcgattgctgaggccgcctttaacaaaggcgaaaccgccatgaccattaatggtccgtgggcgtggggcaacctcgacaagagcggcatcgactatggcgtcaccgaattgccaaccctgaacggtaaaccgtcgaaagcctttgtcggcgtgctgagtgccgggatcaacgccgccagtcctaacaaagagctggcgaaagagttcctggagaattatctgctgactgacaccggtctggatgcggtcaacaaagataagccgctgggtgccgtggcgctgaaatctttccagcagacgctggaaaaagattcgcgtatcgccgccaccatgaacaatgcccgtcagggtgacatcatgccgaatatcccgcagatggcggcattctggtatgcgatgcgcaccgctaccctgaacgcgctgggcggtcgtcagagcgtcgacgccgcactgaaagatgctcaggcccgtctgaagaagtaattctccccttgcagccggggcaacccggcttgagtgaccgttaaggaaaaccgcatcatgtcaggaaaaccgaaaacgcgcagtgtgctgttgaaaagcgttctcatcgggatctgctgtctgctggtcggctatctgctggtgctgatgtacgcgcagggcgaatatctgtttgcgctgctgacgctgatcctcagtgcgaccggactgtggatttttgctaaccgtcgcgcctatgcgtggcgttatgtctatcccggcgtggcgggaatggcgctgtttgtactgttccctctcgcctgcacgattgccattgcctttaccaactacagcagcagcaaccagctcacctttgaacgggcgcagcaggttttgctgggccgcaccttccagtcgggtgaagcagtcagtttttctctgttcccggtcggcgagcgctggcagctggtgctgaatgatggcaaaaactatgtttcaccgccgtttcagtttggcgctgaacagaccctgaaaatggcccctgctgctgcaccttcaggtgaacgggcgaacttcagagcgatcacgacccatcgtcaggcactgagccagatccgggcggaactgccggatggtcgtcagttgcggatgagttcactgcgccagttctccggcacccagccgctctatcgggtgggtgcgcaggatgagctgatcaatcagcagagcaacgcgcgctatcgcgctaatccgcagaccggtttctatcaggcgattaacgccgacggcagttgggcgaacgaaaccctgagtcccggctttaccgtgaataccggctggaaaaacttcgtgcgggtgtttactgacgaagggattcagaagccgttcctggcgatatttggctggacgctactcttctcgctgatcacggtggtgctgaccgtcgcggtggggatggtgctggcgtgtctggtgcagtgggaggcgttgcgcggcaaagcggtctatcgggtaatgctgattctgccctatgccgtgccggcgtttatctcgatcctgattttcaaggggttgttcaaccagagctttggtgaaatcaacgtgatgctcagcgcgctgtttggcgtgaagccggcctggttcagcgacccgacgctggcgcgcaccatgctgattatcgtcaatacctggctcggctacccgtacatgatgatcctctgcatgggcctgctgaaggcgattccggacgatctctatgaagcctcggcgatggatggtgcgggaccgctgcagaacttcttcctgattactctgccgctgctgctgaaaccactgatgccgctgatgatcaccagctttgcctttaactttaataactttgtgctggtgcagttactcaccaacggcgggccggatcgcctcggcaccaccacgccagccggttacaccgatttgctggtgaactacacctggcgtatcgcctttgaaggcggcggcgggcaggactttgggctggccgccgctatcgccacgctgatcttcctgctggtgggtgcgctggcggtgattaacctgaaagcctcgcggatgaaattcgactaagcgcctggcccgacaggcgtcatggttgcaggcagtccggacgcgaagagcgtggaacaaccgcaacctgggaggtgaggattgtgagcactgcccgggttcagactgacaaataaaatagcctgatggaccaggctcagaggagttgttatggctatggtacaaccgaaatcgcaacggctgcgtctgttcaccacgcatctgctgctgctgttatttatcgcggcgattctctttcccctgctgatggtgattgcgatttcgctgcgtgccgggaacttcgccaccggcagcctgatcccggagcagatctcgtgggagcactggcgtctggcgctgggtttcagcgtggaacatgcggatggccgggtgacaccgccgcccttcccggtgctgctctggttatggaactcgatcaagattgcggcaatcagtgcgctgggcatcgtggcgctctctaccacctgcgcctatgcctttgcccgtatgcgctttaccggccgtgccagcctgctaaaaggaatgctgattttccagatgttcccggcggtgctgtcgctggtggcgctctatgccctgtttgatcgtctcggtcagtatctgccttttatcgggctgaatacccacggtggggtgatattcgcctatctgggcggtatcgcgctgcatgtctggactatcaaaggctatttcgaaactatcgacgggtcactggaagaggccgccgcgctggatggcgcaacgccgtggcaggcgttccggctggtgctgctgccgctgtcggtgccgattctggcggtggtgtttattctggcgtttatcgccgcggtgactgaagtgccggtcgcctcgctgctgctgcgcgatgtaaacagctacaccctggcggtcggaatgcagcagtacctcaatccgcagaactatctgtggggcgatttcgccgccgcggcggtgctctccgcgattccgatcaccctggttttcctgctggcgcagcgctggctggtgagcggtttaaccgcaggcggggtgaaaggctaaaacgatcatcattgtacgttgccactacttacacaacgcctgttgtggttgaaggattcggcggcctgcgggccgccttttttatgctaatccgattccgacgcacggctgcctgccaccagcgccacgaccatggcagtgatcgcctgttctccttcccgtttgctgacatcgccgcgtgccaccgcacctgcgatggcatccgcgccccccagcaagccccacatgcctgcttccggaataccgctgctgcctgccagagggacaaaccagcgctgacagcgggcgataaagtcgagctgatagtggcgtttgacggcagccagttccggtgaggtgctgagcgctgacagcaactccggaatctcacgcccctccgtcatcacacaatccacataacaggccgcaagcacttccgctttttgttgcatcaccatcggtgcggcattcatcgccgcttccatcttttcggtctggcgacgatcaaaatcgtcatacaacgccgccagcaatccatgacgggtggtgaagtggtcataaaccaccggtttactgacccccgccgcgtcgccgactctggccagcgtcagtgcctcgctgccttcggtttgcattatctgccacgcgacgtctgacaactgcctgcgtcgtgcttcgcgtgacagacgcttacggggtgttttttcaacggtcatgtttttcctgatgggcgaaacagacgctggcccagttgatgcgccagctgatagtgtgactcaggataaccttcatcgccgctcagcaacagttcactggtcaccaccggcgcaccgcaatagtcaaagatgccgtgatcaatctgattccgcatgctggcgaaatagccgcgccgcagaaaggttcggttgtcagccgcgccaatcgcaagcagatgcacgggaagatggccgaggcgttttacgatatggccatcctgctcatcaaaggcccagcccgcgatgaaaacgcggtctatccagcctttaagctgagccggaaatgaccaccagtagaccggatagaccagcaccagcgcatcggcacgatccagccgctgctgttctgccagcacatcgggcggcgtcggtgccagaccgttgaaatgtctgtgatcgctgagcgtaaaacgtggatcaaacccttctgccgccagatcggccttttcagccgtatggtggcctgtcgcgataatgccctgcgccagctggtccgccacgcgatgggtgtgagcgtcctgattgggatgggaagtcactattaatgcatgcatcgtcgtcaccttacctgattagccattaagctactaaaggtaagttactattggtaggttagcaagcggcgaccgttgatcgattcgctgaccgcacttactgtttaaacgcagaagtcgccagcaaggcctgctccagcagagggtgatcgaacgtaaagggaaggtgcgccaggctggcggaggggaaatggatctgctgcgcaatctgtctcatcctgtccgcgttaatcgccgcaggcagcgtcagaggcgagtggaaacggcgcagcagcgccagcagttcaggctccacctgcttaccctgctgttcaatccaggattgtaccagcaagctaaagccgaccttttcaccatgcagccagtgatgcagctccggctggtgagtcaggcgatcgtggatgatgtgggcaaaaccgggggttgccatcgcatcctgaatactgttagccagccccgccagcacaatgttggcttcaatcactttctccagcgccggggtgacctgctgcctgatgttatcggccaccgccgtgtcgccccagcgtttcagcaccgtcaccgcctgccaggcggctgcgactttaagatacagcgccagctggtgcggcgtctgtcgctgataaggctcaaattcaaaccatttggccagcgcatccacgatcccggcccgcagatagcgtacctcgctgcgggcgatgacctcgctgtccaccagaatccgctccggcatggcattaagcggctggctgcgcagatggccgccgcgctcatcatagataatcgccagcggagaccaggcggcacaagtggcggccagcgtggcgaagttcaccagccggatatccggcagcgcgtcgttgaccgctttggcgcagtccagcacccgcccgccgccgactgccagaatcagggtagcgccgtgcgtctgcacctgctgttgcagggcagcaatcgccgcgtcggtacactcaccggtcagggtgtcgagctgccagcggatccccgcccgttccagacttatgctcatgtcaggattcaccgcctgccaggcccgcggcgaggtgaggatgtgaatatgcgaggcaagcggccggataatttctcccaccccggcccgcagccctggccgttgcagatagcctttcggcgacatcacgcgaaacatcgttcccccttatcgacgataagccagcgagcgtaccagccggtcgccgagtttctgaatcagcatcacaagcgccagcagcaccacaatggtggccgccatgatttggttatcgaaacgctgataaccgtagcgaatcgccagatcgcccagcccgccaccgccaaccacgcccgccatcgccgagaagccaatcaacatcacaatcgtcagggtaacgcccgccaccagcgcgggaagcgcttccggcagcagcacacggctgacgatatgccacagggtaccgcccattgataccaccgcttctatgcggccgcggtcgacctcatccagcgcgtttctccacgatgcgggcaaagaagggaaatgcccccagcgtaatcggcacaatggcggcagtgctgcccagcgtggtgccgaccagcagacgggtaaaggggatcagcgcaatcagcagcaccacaaacggcaaggcgcgtccggtatttaccagcgtattcagcagcagtgaaatcgcgcgattgggcagaatgccttttggccgggtcagaaatagcagcacgcctaccggcagccctatcgcgaccgtgaaaagggccgccagcaacaccatatacagtgtttcgccagtggcgttcagcagcagttcctgaaaccgctcactactcatgctacgcatcgggttaacacctcgtgctgatatttttcgataaacgcccggtctgcttcgccatccttcagcagcattttgcgcaggcgtccctcttcacgtcccatgatctggctcaggctgccgctctcaaccagctggccattctcaagcagcgccgccccgtcacaaatccgcttcaccaccgccatttcatgggtgatcaatacaatggtgatattgagctgctgctgaatatcggccagcagatcgagaatcgaagtggtggtttcgggatccagcgcgctggtcgcctcatcgcacagcagataacggggtcgggcggccagcgcgcgggcgatgccgacgcgctgtttctgtccaccggagagctgcgacggccaggccgccgcaaaggaggccagccccaccagtttcagcagcgatgcgacccgctcgcggcgttcagccgcaggcacaccggcaatctccagcgccagatcgacgttgtcctgcacgttgcgcgaatgcagcagattgaagtgctggaagatcatccccatctgctgtcgctgctgacgcagttgcgccaggctcatcgcggcgagatcctgcccgtcaatttcaatcaggccgctggtgggactctccagccgattgaggcagcgcaatagtgtactttttcccgctccgctccgaccgaggatgccaaagatggtcccttcttcgatggtgagcgagatgtcgtctaacgctggcgcagatgcgccaggatactgtttgctgagatgactgagtttaatcatgctgctggtccgcaaccggaatcactgagccctgataatttttacggataaactccgctacctgcggcgagcgcagatctttcgccagctgtaacacgcggggatctttcgccagtttctggcgtcgttaccagcaggttggcgtaggggttatgtgctgcagactccagtcccagcgcatctttcgccggggtcagaccggcttccagcgcgtagttgccgttgataattgcggcatccacatcatccagcgagcgtggcagctgcggcgactcaatctcaacgatcttaattttcttcgggttttcactgatatcttttggcgtcaccagcgtcgaacccgtttcaccctgcgcgttgagtttgatcacccctttgtcctgcaacagccagagtgcgcggctcaggttagtggtattgttcggtaccgcaatgctggccccttcaggtagcgccgctaaacttttcactttccgcgaatagatacccagcggctcgatgtgaacactggcggccacggcaaaggttttccccagcgccttctcctgatctttcaggtaaggcagatgctggaagtagttggcatccacatccccggcggccagcagctcattggcattcacgcccccgctcagctcaacaattttgagatccagtttcggatccagggttttgacatactccaggatttccgcatggggcagcggatcggccgctacgcgcagcggcgcggcctgtaaactctgggcaatcagcagtgaaagaccggcaagggccagaaagcgctttttaatcatcatcatttatctcttatcgttatcagtgggtgttgtgttcggggtagaaacgctgggcaacttccggatgcgaacgcagccggcctttaaggtagttccagcccacttcgcgcagcagcggattaagcggatcgctgctcggtccctgtgccagttcagccagctgaggaggcagttgatagatcggcaccacggcgtcgagttgcgcgccaaggaaaaaggcgatggataagcgctcgctgctctgcggtggcgacaccacacggtgcaccgttgcgcgaagataaccgttggttgccagctccagcagctcgccaatgttcaccacaaacgcgcccggcagtggtgaggcatcgatccagttgtccggcgtcacttccacctgtaagcccggctgatcgtcctgcagtaacatcgtcaggaagcctgaatctttgtgcgcgccaacaccctggcgtgattcgccctccgtgcggcccggataacggatcagtttgatatgttcgttgggatagtcgccatagaggttatcgaaggcgttgcgcggcagattcagtgccccggcaaaggcgcgcagcagctccagcgccaccgctgtcatctgctgctgccagcgggtgaccaccgtttgcagttcaggtaaggcttcaggccactgattcggcccctgcatccgttgccaggtgggtgaatcggcggtaacgggcagcgcttcccgttccgcaccaatatcaaactgctcgcgatagtcaggctggctgcgggttatttcaacccccgccaggttatagccgcgaaaatgcggcgagttcgccatcgccactgcggatttatccgcctgtggcagggcaaaaaatttccgcgcgacgtgctgaacctcatctaatagttcacggtcgatgccgtgattgattaaatagaagaaaccgacatcacgcgcggcctggcttaatttttccaggacctgttgctgctgctgttgattacctgacaataatgcgaaatcaattaccggcaattctgctgtggttaacgcgctcatgattgacactctgttggcatggaatcgctttacactgccatttcatttatgcgttaactaccaactaatcctgctatgtatatgcgacggatgggaatatcctaccacgccgcgggctttaaacccgcagattactctgcgctccacgccacgaatgccggcggtaaccatgccgtaatctcaggcaaaggctgttgataaagcgcaatctcgacaaaacaggtctgcgcactgcacccctggccgagtcgtgaactgccgctatcctgggtcagcacattgggattgccgtgtttatccagcggctggccctcctgctgatcgagcgggtcataccaggcgccggtcgacatctgtacgacacccggcaggatatcctgcgtcagatgcacacccgccagcagcgcgccgcgtccgttaaagacttttacgatgctgttctcctcaatgccgcgcgcagcagcatcttcaggatgcatccagagtggctcacgcccggcaattttggtggcccggctgacccgtccatgatcgtactgactatgcaaccgggtccgtggctggctggagagcagatgcaacggccactgctgcttttcctgctgttgcgcctggtattccggcgcataccagcaggcaaatccgggcgcttcgtcatacccgaaatcggccacctgctgagaaaaaagctcgattttccccgacggcgtgctgagcggggctgactccaggttatcgcgaaacgcttttagcaggatctgcggcgtctctggcgcgggatactccaccactccctgtgaccagaacgcctcaaagggcggcagttcgatgccctgcgctgccgcgcgtggccgggaatcttcatagagtgactgaagccactggcgctcatcacgcccctgcgtaaaggcgtcagcaaaaccgagccgctgcgacagagcggcaaaaattgcgtaatccgattttgcctcgccaaacggcggcagatgctgcggcatggcgatgataaaaccgtcgttgctggcgctgccaatatcttcacgctccagcgacgtggtcgcaggcagcacgatgtcggcaaattttgcctgcgccgtccagaactgctcatgcacaattacagtgtccggccgctgccaggcgcgtatcagcttgttgatatcctgatgatgatgaaagacattgccgcccgcccagtagaccagccggatgtcgggatagacccgctgttgcccatcaaactcatagtgccctccgggattgagcaacatgtcggcgatgcgtgccaccggaatcgtctcctgaaccggattatgaccggcgggcagacgaggcccggaaaactgtcgccgggcggcaccggccagattggttgaggcgtaaccaaagcccagcccgccgccgggcgtgccgatctgacccagcagagcgctagtcgcaacggtggcccagaaagcctgctcgccctgccgcgcccgctgcactgaccacgcaatattcaccatcgttttatgcgccgccatctgccgtgccaacgcacggatttccgcggccgccagcccggtcagcggagcggcccattctggcgttttagctataccgtcgcgttcacccagcaggtaggcggcatagtggtcaaagcccaccgtgtaacgttctgtgaatggcgcgtcatagagagattcagtaattaacacctgcccgattgccagtaacagcgccgtatcggagccgggctgtatcgccagccactccgcatccgccaccccagcgagatcgtttctgaccggactgatgttgataaaccgggtgccattctgccgtagcgtggttaaccaatgagaaagcgcatggtcattagccccgccgccattgacctgcgcattgcgcagcggcaaccccccgatagccacaaacagttcgcaatgctctgcaagaaccggccaatgggtatggtgacgttgtaactcatcgaggttaccgatgatgtgcggcaacgtgcgttcaccggccgcaatgctgtaggtgttggtgctggcggtgtagccgccatagtggttaaagaaacgatgaagctggctctgggcatgatggaaacgtccggcactcgaccagccgtaagagccggcgtagatcgcctgattgccgtgctctgttttgacacgccccagctcctccgccaccagttgcaacgcaacatcccaactcacttccacaaacggctctttgccgcgcccgttgcgggatgcgcttctgtttctggagataaccgagcctgacggccggatttttgacccgggtttcgctttgcaccgcgcccggtaacgactgcccgatcgcagagggattacggtcccacgccaccggcctgaccgacgtcagcgtgtccccttcggtggtgacgtgatacgtgccccagtgcataacagctaaatcattctttttcatggctcactcgcgtcggatacggcgcgagagacgcgtacccagggtttgcagtagctggacaatgacaatcagcaccagcgcagtcgaaatcgtggcaaaggcatcaaagcgctgatagccgtaagtgatggcgaggtcgccaatgccgccgccgcccaccgtgcccgccatcgccgtcgcacccagcaggccgatagtggcggtggtcagggctaacaccagcgacgaggcggcttccggtatcatgaaataccagatggtctgcagcgtggtggcacccatcgcattggctgactccagaatgccctcatccacctccagcagggcattctccaccagccgtgaaatatagggcgcgataaatatcaccagtggcacaatggcccccgccgtaccgatggtggtgttcaccagcaggcgcgtcagcggcagaatagtgatcagcagaataataaacggcagtgaacggatgatattcacgatcgggttcagcaactgatgtaccagtcgattcggctgtatcccacccggacgacagatcaccagcacaatgccaagcggcaggcccagcagcgaaccaaagcccagcgacagcgccaccataatcagcgtgtcctgcatcgccgtcaggaactgatcgccggtaacggcggtttcaaagagttctgacatcactgattttcactccggtcgcgatgagaaactggatggccgcctcgcgtcttgcgggctcgcctttgatctgcacaatcatgaaacccagaatggtacgctgtacttccgtcatgctggcgaacaggatattcacttcaacctcatgttcacggatcaggcgattgatgatcggctgttgtgccgtgctgccgacaaactccagccgcaacacgtcgacagccggatgctggcttaacagcgcaagggtctgctgtggcagacgatcgtggatgacggactgcacaaagctggcgctcaccgactgttgcggttcagcaaacagcgacaggacatcgccctgttcaacgatacggccctgctccatcaccgccatccggttgcagatcttctggaccaccgacatctcatgggtgatcaggacaatggtgatgccgtaacgctgattaatctcctgtaacagcagcagaatctgtaccgtggtctggggatccagcgcggaggtcgcctcatcacacaacagaatcgcgggattggttgccagcgcgcgggcaattccgacgcgctgtttttgtccgccggagagttcatccgggtagctgtgggctttgtcgctgaggttaacaaacgccagcagctccgctacacgggtggcgataaaatctttatcccggccctgtaaaatcagtgggatggcgacgttgtgaaacaccgttctggcattgagcagattgaagtgctggaagatcatgccaatctgctttttgacctgaattaagcgctttttgctgatcccttgtaacgcttcaccctgcacctcaaccgagccggttgtgggggtctccaggtgattaatcaggcgcagcagcgtactttttccggctccactggtgccgatgacgccaaagatgtcaccctggctgatgcgcagattaatctccttcagcgcctgcacttctgcaccgttacgcgcaaacgttttgctgacatggcgaaacgcaatggctacctgactcatttgaaataatctggcagcagatagcccgcatactgcgcattaccggtgatatagcttttaaattctgctgagtggtagccggcaataatgtcacgggcaaactgagcctgcttatttttaccggcaaccgtcaccacgttaataaactggctggttgccgcttccagtttcagtgccgaattgagtttcatgccactggataccgcgaagttgccctgaatgactccatagtcaacatcggggagtgcacgcacctgctgagcgttatccatctctttaagcacgattttgtagggattttccgtgatatttttctgcgaaaaagtggcagcatcgctatcggggctgattttgagccagccgatgctctggagtaacagcgccgcccggtactcatttgagggctgattgggcacagagaccgtgctgcctggcgcgggttgagtcagcgttttcacgcgcccagagtagagccccattggcggggtcggcacctgcacaatcccaacgttatcaatgccaagccggtcattaaccgacttaagatagacgggatgctgcatgatattggcgtcaatcgtcccgcgatgaacagcatcattaacctgaattccatcactgaaatctttatactccagagtatacccctgcctgattaataagggcgcgacgcctttttcaaattgctctttataaggccctggattaaatccaatccgtattttcttctggtcggctgcctgagcggcagaaataaaaaggctggcggtggtcagtgccagaataattccccgggatgtgatctgcattgtttgccctgattcattattgtgagagcgatcgatttaatcacaggcatcgcggagaggaacaggcaaaacccagccccgactttggcttatttatgctaacgatagtcacatgctggatattcgaatccctgcaaagaacagcgttatttctgctaaagattttaatgtcagctgtgtcatccttcctcgcttaacactgtttattgcgggagagatatggcggagtttgcagcttcagagatggtcgcagggctcgaagagaacctcttcagcatgctggaaaagcaggcagcacaactggatgatgcgctgttaccgctgatcgatctctcttccggcagtccacgtcagccaacgccgcccgcggtaatcgcttcattacaggctgcggcagcgaaaccggagaaccatgagtatccctcgttctggggcaaacccgcgctgcgccgtgctatcgcagccttttaccagcgtcactacggcgtcacgctcgatcctgaaactgaagtggcgctgttccagggcgcgcacattggcgtcaacggttttccccgcgccctgcttaatccgggtcaggtgttgatctctaccgatccctgctatccgctctaccgctcagcggcccgtcaggcaggtgccgatttttatggcattccgctggaggcgtgcaatgatttcctgcccgatttcacccaggtgccagacgatatcgcggcgagtgccggtctgctgctgctcaattatccccataaccccaccggcgcactggcgacagccgcgctgtttcgccgacgcgctggccttcgcccgccagcatcatgttccgctgattcatgacttcgcctacgccacgctgggcagtgagtcgggcgaacagccgctgagtctgctggcacagcccgatggcaaagcctggggcgtggaaatctacacgctgtcaaaaagcgcactcatggcaggctggcgggtgggatttgcggtgggaaacgcctcgatgattgcggcatttaaaaaacttcatactcatagctacagcacggtgtatggcgcggtgcaggatgccgccatcaccgcgttgtcgctgcccgctgaacaactcagcttgctggcagagcattaccatcagcgccgtagagtgattttagccaggctggcagcgatgcactggccggttcgcgcccgtcagggcacctttttcctctggctggcagcgccagctggtttcaccggggagcagttcgccgccctgctactggcccagtgtcatctgctggtggcaccgggtaacgggtttggcgcagcggggcgggattttattcgcatcagcctgacaaccgggacggagcaattactgcaggcgctagatcgcatcgacgaactgaaactgtttaagtagcgcatcagtatcgggaaaatcagttccagatataaccagagcaccagccgcaagctattaccaaatgttcagacccgtaagcaggcgtgaataagttcactatgctgggtttgtcagtaaatgcagttatttcggctgaaaacttgcaaaaacttacaatcgtagtctagagtttaccggctgcggtttctgccgcttcacttaaaacttattcggcttcttatagctttcatttccacggtttcttctgaacattgtttgcggctgcgaaagctataagactccttcattgatgcacctgaggagaatatggacaccagaaactcatcgtctgaacacccaaagaaacatttctggaacaggaagccaaaagagctgactgttgacgacattaccgtaatcgacaacgacatgctgaagcgtgcagttggcgcagctgcgttaggtaatgcgatggaatggttcgactttggcgtatacagctatctcgccgtgatcatcggcaaagtcttcttcccggatgccaacaacgcggtgcagctgatcgccacctttggtacgtttgcggcggccttcctggtccgtccgattggtggcctggtatttggcccgctgggtgaccgcatcggacggcagaaagtgctggcgatgacgatgatcatgatgtcgattggtacgttctgtatcggtctgatcccggcttactcttcaataggcatcatggcaccgattctgctgctggtggcacgtctgattcagggcttctcaaccggcggtgaatatggtggcgcagcgacctttatcgcggagtactctaccgataaacgccggggctttatgggcagcttcctggaattcggcaccatcggcggttacctgctgggtgccagcctggtcacggtgatgaccaccgtgatgtcgaatgaggcgatgatgtcctggggctggcgcgtgccgtttctttatcgccgcgccgctgggcctgtttggtctctatgtgcgactgaagctggaagagactccggctttccagcagcacatggaaaaacaggaagcactggagcaaagcaagccgcgtctgacgctgatgcagatgctgagcaaataccgcgcaccgatgatgaaatgtatcggtctggtactgctgtttaacgtctctaactacatgctgacctcgtacatgccgagctatctgaccggcgtgctgggtctgccagagttaagtggcctgctgctggtgatggtggcgatgttcgtgatgatgccgctgacgctgctgtggggtcgctggaccgaccgcattggtcgtcgtccggtgattgcctttggtgcggtgggtctgatcctgctcgccatcccgagctttatgctgatcgggtcgggtaatatgtgggcggtatttggcggcctgatgattctgggtgtactgcacacctgcttcagcggcactatgccttcgacgctgcctgcgctgtttactaccgatatccgttacagtgcgctggccatcggcttcaacctgtcggtttcgctgtttgggggtacgacaccgctgattaccgcgtggctggtggataccactaaaaacaatatgatgccggcttactacatgatgggcgcgggcgtgattggcctgctcaccattctgacggtacgtgaaacagcccgtcaaccgctgaccggttcatccccagcggtggcgaccaaagcggaagcgcatcgcctgatcgacaagctgcgcaagcggcacaagccatcagcgaccactgcgaaataactgttctggcaccctgctctgcagggtgtttttttatctgccgtccgatctgtttacccagctgatttaactgccctgaaacgcgccactttcgcccgattgccacacagcgccatgctgcaccagcgacggcgatgcgctttggtgcgatcgtaaaaccacagtgtacaggcgggatgttcacagccacggactctgctgaaatcctcctgcgccagcaacatcgcagcctgttccgcaacctgtcccagccgctgcatcacactctggcccgcatagacccgcctgatttttaaggcacccggctccccggtcatttgcagatggctggtcgcttcacccagccaggcgttcagcgcctgaatatcaacgccctctcccgctttgtgctgctgcacgttatcacgaatgatctgacgtaagtgacgcgctgcttccaaaagcgcacccggttcatgctgcggagccggggcatctggtgccagtccggcctggtgtagccaggcttcaacatcctgatcggtttgccagaagtcgtgcggctggccttccacgatggccagggtattgatgaaatccagcgccggatgatcagccagaaaccacggtccctgggcggtgtgtgattgcgtttccgccatgatattgcctcccttgttaactctgctgatgccactgtaaccgacaaagtactatttgaatagttacaccgcaccttttgtaaccattataaattgatttgacaggttacattctggctgcataatgactcttagtaaccgcataaacatcatttaaccagttacaggagttcagcatgcgtgatcaatccatttcgtatcgttaccagcaggccgatggcgtcaatattttctatcgcgaagcgggcgatccttccctgccggtactgctgctgttgcatggctttcccacctcttcacatcagttccgcaatctgatcccgcttctggccgataaatttcatctcatcgcacccgatatgccgggctttggcttcactgaagtgcctgctgagcgcaactattcctggaccttcgacgcgctgggccagacgctgaccgcctttgtcgatgcactggggctggaacgttatgcgatgtatgttttcgactatggcgcacctgccggtctgcgactggcactggcttaccccgatcgcgtcagcggactgatatcacaaaacggtaacgcctatctggagggattaggagaggcctgggcgccggtttcgcgcctactgggacgatcccagcgaagcaaatggtcaggtgatccgtgacgccatcctgacgctggaaggggtgaagtggcagtatctgcatggggtgagcgatccgcagcagatcgccccggaaacctataccctggatactctgctgatggagcgccccggtaacaaagatattcagcaggccctgtttctcaattacgccagtaatctgaaacgttatccggaatttcaggcgttctttcgccagcagcaggtgccaacgctggtgatctggggcaagcacgatccgttctttattccaccgggcgcagtggcctggcagcgggataatccacaggcggtggtcgagatgctggatagcggtcacttcgcgctggagacacacacgcatcacattgcgtcgcgcatccgcgagatgttcagtggcgactaatccgctgcgcgcagaggcaggctgttcagcgctgcctctgcaagcgtgcaggtcactcattgctaaagcggccaacggtgctggccgcgcccagcgcatggcctttcagctgtgcaaccagctctgcctgggttaaccccgctttcaactgacccaccggcaaatcggtggcgatcagcacaaagttatagtgatgcagcccactgcctgcaggcggacaagggccataatagtgcagcgtccctggggtattttttccgccggtgtagtccttgccctttgtcagagccccctgcgcaaatgacgagcggctggcgggaatgttataggccaccatgtgggtaacgccgagccctttggccccgaccggatcggtcatcagaagagccagactgcgggtgcccgccggaatcgcagaccagttcaattcgggagagatattctcaccggtacaggaaggattacttttattcgcaccggcaaactttttatccagtagcgcattatcgctgaagtcttgtgattgcagcgtaaataccgacgctgccagcgtggtcattggcaaaacggccagcaccgtcgcgcagagtaattttttcaccagccactccttatcagattactcaagagattatgttccgtatggattgcgtcactgcctgattactataacggctttaacgcgattgacccgactgaccgcctgttcaggggtaaggaaacggcaaatctatgatctccgtcgcgctggctgagagagctgacgcgttgccctgtgacgcattacccgatataagttaacgcatctggctgaagtttcgcctgaatcatcgtcactgtcaccgataagtggacactatgcagattgaagatctccggatttacgttgcggtaatgcatgctggcaactttactgcagcagctgagcatctgatgctatcgaaacagtatgtcagccgccgtatggctgcgctggaggcatcattaggggtacgactgttgatccgtaacacccgtaagctgtctgtaacggatgcaggtttactgttcgcgcaacatgctcagcgcattctggatgagattcaggaagcgcaactggcagtgtcagagcagcagcaggcgctgcgcggcaccttccgaatcaatctgccgatgtcctttggcatgagccacctctcccccctgattgccgagtttctaagccaccatccgtcattgcagtttcatattgagctggctgaccgctatgccgatgtgattggcgaaggcgttgatatggcgattcgcatcggtacgctggctgattccacgctgattgcccgtccgctcggcgagctgaagcgggttatctgctgcagcccccgctatctggaacgggcaggcgtgccgcagcagccagaagccttgctgcaacatgcctgtctgcgctacggacgtgaaggtcagaatggctgggaaactgcaggtcaatggtaaaccgaagtggctggcggttcagggaccgatggtgagtaacaatggcgaggttctgcgtgatgccgcactggcaggcttaggactggtattgttacccgcctttattgttgagacagccctgcaacgcggtgagctggtgaccgtgctggacgactatctgccgcccccgctctccctgaatgcggtttacccgcagcaccgtcagcgcagcgaagtaaaccgccagttactggcctttctccaggcgcgtttagcgtcgtgacagcactaaagtttttttaatgccgcaaagaccctggcgacagcaacggcacccggatcagacacgccgttgaggttagcactgttgagataagatgatcggcccgcttttgctttccccatgctggcggttgcatcactgccctgctgtgccgcatcagccgcctctgccagcgatttacccgccaccagcgcctcgattgccggttgcagcgcatcaatcagcgtgcgatctcctggttgtgccccgccatactgcttcatcttctccagaccctgttgcagggccgcgggcagcgcatcctcttcagccagctgctgcgcagcagcggtgaagaagatcgccatcagtacgccgctggagccgcccatcacggtcgccagtcgctcacccgtcaccgcgagcagatcgggcaaggcatttaacggcagctgattatctgtacattcgcgctggatctggcgtgcgccagcagcaaaggtcgaaccggtatcgccatcaccgacctgcgcatccagtttgttcagctcgctttcgctggcgatcagggtttcacagatgctgttaacaaacgcagcgacggtcgggttatctgagggttgcgccggatgcgctgttgcctcttttgtcgcgtttaccggctgcagcggtgcgattttaaccgcctgaacccagccggtgacctcaaccggcgcacagatcgcctcttcgaacaacggcgtcagcgtcatggaggtgacggaaaagcccttcatgtccagcgcggtcatcagcggagccgggccaatcagataatcactgccccggctgagcggcgactcaatcaggtcgcgtgtgaccagactcatttccagcgcggacatgccgccaagattattgattaacagcgcgcgtggctgatcgttgtccggcatcactttctccagcagatgctgcacaatctgctgactgttttgcgtctgcatgacgtcaacgcccggttcgccgtgaatccccagccccatttcaacgctgccgtctggcactcgctggccggtctgttcatccggcagatggcagcttgagagcgcaacgcccatggtggcgatagcacgactggctgcctctgctgcctcggtcaccgccgtcaggtcatcaccccgctctgcgacgaagcccgccactttatgcaccagcaacgtgcccgcgacgccgcgtggctgagggttatcgggcaacgcaacatcatcaccgacaatcaccatattgacgccgaatcccgctttgcgcgctttttctgccgccagaccgaagttgaggcgatctccggtgtagtttttcacaatcagcagacatcccgcctcaccggtaatattgatgatggcgttgtaaaccgcgtcaacgctgggggaagcaaaaacatcgccacagacggcagccgtcagcatccctttgccgataaagccgacatgggccggttcatggcctgaaccaccaccggaaatcagcgcgacctgctgtttttgccagtcattacgcatcacgatgcgaatgcgcggatcgacctgcaaccggaccagattgcgccacgggctggcgtaaatcatgccatctaacgcgctgtcgacgagatcatcctttttattcattacgaatcgggtcatgtcttctttcctcataggcatgcgggtttgctgatgacccagtgttacataccactgacgacagtgagaaatccattaacaggtctgtagtctgatttcagacataccgcacgaaaaccagctgacacaggcgcagtgatttttactaattgattgatttttatcaaatgtctttacctgaaagtgagaggtttctgcgcagaacatgaaccggggatcacggatggtaaaaattcatttgttaacagaggatgttttaatgacccaacgtatgattctcaatgaaaccgcctggtttggtgctggtgcattgcgccatttgccggaagaggtgcaacgtcgcgggatgcgaaaagcattgatcgtcactgacaaagcgctggtcgcggcgggtgcgctgaagcgggtgactgatctgctggcgcaacatcagcttgactgggcggtgtatgatgaggtggtgccgaatcctaccattcgggttgtgcagcagggtgttgcggtgttcagagagtcaggtgccgactacctgatcgccattggcggcggctcaccacaggataccagcaaggcgatcggcattattattaataaccctgagtttgaagatgtccgcagcctggaaggcgtcagccccacccgtcatccatgcgtgccgatcatcgctatcccgaccacggcaggcaccgccgcagaagtgacgattaattacgtcattaccgatgaagagaatcgccgtaagtttgtctgtgtcgatccccatgacattccgaaagtggcgatcattgatgcggagatgatggcgagcatgcccgcgtcgctgaaggctgcgaccggtattgatgccctaacccatgccattgaaggctacatcacacgcggtgcctggaccctgaccgatatgctgcacctcaaagccattgagattatcagccagtcactgcgcgaatcggtggcaggaaatattgaggcggttgagcagatggcgctgggacaatatgtggccggtatgggtttctctaatgtcggccttggtctggtgcatggcatggcacacccgctgggcgccttttacaatgtcccgcacggcgtagccaatgccattttgctgccgcaggtgatggcgtggaatgcctcaggcactggcgaaaaatatcgcgacattgcccgtgcaatgggtgtgaaacaggttgagtcattgtcgctggatcaggcgcgggaagcggcggtcgccgcggtgcgtcagctctgtcgcgatgtgggtattccccgctcactgcgtgaagtgggcttaaaagaagcggatatccctgcactggcacaggccgcgctggatgatgtctgcaccggcggcaacccacgtacgccggacctggaggacgtggtggcgttataccgccagagttaaagcgcataccctgtagtgatgcagtgccgataacaggcccgtccacgctggcgggcttttttacgtcatggcaacgcttaatccgggagccttcgccagaggttgttcagtctggcttacagcatcagccaaggttttagccgcgtttatcctgcctggtttcagcctgaaatcgcccgctgttacgatgaagttcagcgagcgaaccaactgcctttacccatgatttctttagatgctaaaccctgattcacttgatctggatcacaaaaatccgcatcatgcgcagcgaaaaccttaatgacgctgcggagatatcaatgacactgtaccagggtatgctaattttctatgccgttgttgcattgatcgctacgctgatcacgttcttcatcgccaaagataagctgagcatcaaactgctgagcgcctttctggtgggggccacctggccgatgagttttcctgtcgcgctgatgtttgctctgttttaattgacattatccccttagataccacactcaggtaagacgtccctgacctgcaaaccgccgatcaccgacgtggccttgttcatgacggttaataaggagcggatatgcgcgttatcagtgtgatgattctggtttctcttctcagtgcctgtagtgccccatggcacgctgaaaaaccggttccggcggccgaaacccgccagcagacctgccagccaggctccaatcccagccagaaacgactgcggtcatttccctgaacctgaattccattgatcctgtcacaaggcgatcgctgctgtgagatctcaattacgctatttcatcgcataacaaggctttacacgctgctaaccggtcagtaaagtagcgcccagacatcaattctgatgcgtaagcgttaacgtcaaccaacgcccccgcagcactgctgcatgtgatgatccctgccatgatgcctgtacaaaacccagctaaacctctcgctgcgtattccagcgccacattttttttgttcgtcctgctgctgaccgcggctaatcttcgtgcgcccattactgtcatcggcccggtactacaggatatccgccagacctttggcctgagtgtcggtgaagcaggtctgtttaactttattccactgatgctgtttgccctgctcgccccactggccgcctggctgggaaatcgtgtcgggcttgagcgcagtttatggggcgcgctatgcctgatcactgccggttcgctgttgcgctggctgcctgatgaagcggcgttgtggagcggaacgctgttgctcagcgcaggtattgccgccgccaacgtgctgctgccgccactgattaaacgcgatttcaccgcccacaccgctaaatatattggcctttatgccgccaccatgtcgattactgccagcctggcatctggcattgccgttccgctgagccagctttcagcggcaggctggcgactctcgctggttgtctgggcgctaccggggctgattgcgctactcgtctggctgccgctgttacgtcaacggcggtcaaccgcagcgtccgctgacgcgcccgttacatatcgccatccgtggcgaaacgcccggcggctggcaaatcgcactgtttatggcgctgcaatcgctggcgttttataccctgattgactggtttacgctgtttgcccaggataacggcttcagtcaggcccacgcaggctggctgctgttctggtatcaggcaattgcgatcgtcgctaacctgggctgcatggtggcgctgaagcgggtaaaagatgcccggcttaccgcgttcattgcttcatcaggcattttcctcggcatgctgggcctattgctcaatccgcagtgggccgtcatctggctgacactggccggactgggcgcaggcgcatcactggtgctctgcctctcactgtttaatctgcgagccactcatcaccgtcaggcgtcacagctgtcgggcatggcacagtgtgtcgggtatgcgctggcggcacttggccctttgttctttggcgtgctccatgagcagagcggtaactggacgctgcccttcagcgtgctggcaatgctgagcctgttacagatgctgctggctccgctggcagcgcagtcaaaacccattagctgaaaatgcggcggagccgttaacaataaatgactcgccgatcgcggatgcttagcatcacgggtcggcgggaatcgacgggagaatgtgcgtgtctgaactgaataatgctctgctgcaggagatcctggatcaggtgcgtccgctgatccatcagggaaaggtggctgactatatccctgcgctggcggatgtggctgccgatcatctggcaatagcggtttgcctgcgtgatggcaccctctttcaggcgggcgatgctgagacgcgcttttcgattcagtcgatctccaaggcgctctctctgaccgtagcactgacccgctatgaggacagcgaaatctggcagcgggtcggcaaagagccttctggccagccatttaattcattggttcagctggagctggaacagggcaagccgcgtaatccgtttattaatgccggtgcgctggtgatttgcgatctgctggaaacccgactgaccgccccgcgtcagcgaatgctggaaattgtgcgccagctgagtcagcagtccgatatcaattatgatcgccacgttgcccgctctgagttcgaacattcggcccgcaatgcagcgatcgcctggctgatgaagtcgtttggaaatttcgataacgatgtcaccagcgtgatgcagacctatttccactactgttccctgtcgatgaactgcgttgagctggcccgcacatttatctatctggcgaatcagggcaaaacgctggatggcagccagatgattactccacgtcaggcgcggcagattaacgcactgatgatcaccagcgggatgtatgacggcgcaggcgaattcgcgtggcgggtcgggatgcccgcaaaatcgggcgtgggtggcgggattattgccattatcccaggtgagatgagcattgccgtctggtcgcctgggctggatagcgcgggcaattctctggccggtaccgctgtgctggaattgctgaccgagaagctggggcgatcgatattctgagtctgagcgcgcaagtcacaggctcgccgtggtgaaatgcgacggggttcccttgatttcaggaagctgattttgcattttccgtgtagtgcgctggcgatttgagtcgtcagcgataatcagaactcaaaaaattaattagtgcgaaatctgcgccagatcgtcttcattcagaccagtcatctgcataacggtattgcgatccatgccactcttcagcatggtgtgggcaattctgaggcttgctccacgactaccttctgtacgtccctgttcaataccctgttcaatgcctttctcaagccctatctgctcaagctgttgtgcgatagtcataagtgcgtttctcgtgttggggcacacgctgtgccagctcccgtacaaaggctttggcgtccgatgtttcacctgcctgtacaatgtagtgtaccagcgttatcacctgtgatgaagagtgatagccagcctgcaaaatggttaccagcctgtccatcatttcagccagatcacgctgccggatatgcttctgcaacagggtcagagccgccatgctgcgatgttgcatgatctcatcgtcaggaatcaccgtgacatcgaccagcggaaaactacggctgtaaagcctgtccgccagcgccggggcgtcgaactcatccagccaccgggtcgaatagggatagggagtgcgtctgccagtgtaaaacaggacgggaatcaccagcggcaaccgcttatgccctgcttcaagatggcgttgcatggcagccactgcataacgcatcagccgaaatgccatatgtttgtctggcacagattgatgctcaataagtacatggatatatccatcgccagcggttgttttaaggctgtaaagcacgtcgctaaagtactgccgaaggtcatcctcgacaaacgaccccgactccagtttcagcgtgctgagatcacagcatatgcgcagctctggcggcaaatgcagctccatgaaatcccgggcaatatccggctgagtcagaaattgccggaatgtggcatcatgaggcacaggcgtgctgttcttctttttcactggccagaatcctttctgttcctgaagcgcttacaacggctgattcagccagtaaaagacgttaattcctgtagcgcactaacgtttaaagtcctgatggaaataacgaaattaataccctgatgactaaagcgcgtaaaaggcttttcctgaaatctacgaggttgctctgaatatcaacccatgtcgggcattaaaaactattccatctgactcagctcaccacattaattggctcgccctgaataaaggccgcgatattggccatcacgccagccaccagattctccacgccgctgcgacttgcccaggcgatgtgcggtgtcagcagcagagttggcagatccgccagcagcggattatccggagcgggcggctcgctgctcagcacatccagcgccgcaccaccaatcagcccctgctttaacgcggcagcaagatcggcttcgttaatcagtccgccacgtgccgtgtttatcagcagcgcctgtggcttcattttatccagcgcctcgcgatcaatcatctggcgggtgctgtcactcagcgggcagtgcagcgaaatgatgtcgctggtcgccagcatctgctcaaagctgatataaccgtcacgcaccctttcactgccttttcgctcggcgtactgcacctgcattcccagcgcctgggccagcctgccgaccgcctggccgatgtcgcctttgcccgcgatgcccagcgtggcaccgccaatatcccctatcggctgatgatgcacacaaaagtgcttagcctggggccagtcgatgcgggtattgctggcataagccatcagctgacggcgcagggcaaaaatcgcggctatcaccgcctctgaaacgctctgagttgaatagcctgggacattactgaccacgatgccgcgtgcgcggcaggcctcaagatcgatacagtcatagcccgtcgctgcgacacagataaaacgcagttcaggcagttgttgcagtgtgtcagcccgcaacggcactttattagtgatagcgaccgttgcgcccgccagcgaagacacaacgtcttcagccggagtctgcgcgcgaatctcccagtcagcctgctgttgaccggtcggcaggggtaccggcagcgtgtcaccatccagcattacaattttcattttttattccttcattgggtatggttaaaccgcaggcgaatgattaatgttatttgtatgtgcaccgcgagtaacaactaagttaaatgatgctgaaattaaagtgaaaatgttcaaagagtgcgaattttttcggaacagatgccactttatttaacccttttattcccttcgcgttacactgccgccctgaattctgacctcatacgaccgttgaaatcatgccgggatcttcactcagacaacgactcaccgccggtattgcgatactggccgtgctgctgttgtttgttgcaccgatgatctcaaagaatctcgctgaacatcatgccaggatgcaaggcgcttcgatcatgagcgcagagatgccgatgatggatcatcacagcgagatgtcgatggctgatcacgggatgatgatgggcccgggctttgcctgtggctactgcgatctgctggtgcatgttccgctgatgctctgggtttttatcccgtttatctggtggatgtgcctgatcagccgcgccccgccgccagcggctatcaatccaccccaatggcaacggctgttgcgtcttcatcgaccgcgcgcgccaccctttatctcgtcacactcactgcttactaatccgattgcgtgacaacgtcacctgatcgtctttgtcttttgaaaagtgtggaatgctatgtcctcttctcaggaaatgtcccctgcaccgcgcggcacggtgtttaatctctttcgccgcctgcatttttatatcggcctgtttattgcgccgtttatttttgtcgcggcactcaccggcacgctctacgttctgacaccgcaactggaacaggctatctaccatgatgccctgaccaccgacgcgcagggtgtggcacaaccgctgtccgcccagattgccgctgcgcgagcccgtgccggtgaatcagcacgcatttacgctgtgcgtccggcacccggcccgcaggatacaacccgcgtgcagtttgccgagccacagcttggcccatcggaatcacgatcgctgtttattgacccctacaccctgcaggtgaaaggcgatatgacggtgtatggcaccagcggtgtgctgccgctgcgcatgtggctggatcagctgcatcgcggcctgttgctgggtgattttggccgaaactacagtgaactggcagcctcctggctgtgggtcgctgcgctgggtgggattgtcttatggtccggcacccggccgccgcgcacccgcagtaaagcacggagcggcttcgcggcaacccgtcactggcatgtcacgctggggctgctgctggcaatcggactggtgttcttttcagtaaccgggctgacctggtcacagtgggcgggcaataatattgaaaagatgcgcagcgattttggctggaaaacgccgcaggttaataccgcgctaaacggtaacgcgcccgctgaagccgccgatccccatgctgaccatcgcggtgcgatggaagggatgacgatgtccggaatgaccatgccagcgaaaaccgctgcgccggtgattctcaatcagccgaatgccagctgggatcaggcgctggcagcggcgcgtcaggccggactgcacgcggcgaaactggaactacgtcagcctaagaacgctgaacaggcgtggacggtttcggagattgaccgcagctggccaagccaggtcgatgcggtttcaattaatccgactgattttagcgtggtcgaccgcgttgagtttgccagcttcccgctggtggcgaaactgacccgctggggcgtggatgcgcatatgggcgtgctgtttggcctgcctaatcagctaattctggcgctatctggctttggactctgcacaatgattgtgctgggctaccgcatgtggtggattcgtcgcccggctgttccgcagctcaacccctcgcagacgctgttatccgcctggctggcgctgccgcgctatgcgcagggcaccagtctgatagtgatgctggcactgggatatgccctgcccgttatgggtatcagcctgctggtgctggtgctgctggatattcagcgctggcgcagcgcacagcgcgccgcggtcgtccgcgtggatgtcgctccggacaagcagtcgccgctggccatcgtccagtcgcgttttgccgggaagcgcaaagagatgcgctattttctgcgcagcgtgacggtgctggcgctgattgtcattacggtgatggcgaatgcgatgattggcggagtgatcgatcagtaccagatccccttcagtcactggtcgctgaccatgtatatcacccaggcgatgatgatcctgctctactccacggtctttaccgggctgttgtcgattccactctggtatttcttcctcggtgagagcgacgaacagggcaagtaagctggcaagacgccgaacactctattattcaaaataactgacgaagccgggcaaaactcccggcttctcattctccgcctgaggtctatgatcgttgttatgagtcactttatttgagagcaaatcatgaacattgtgcgagctaatcctgaacaactgtttgagtacggtccttttaccgtccgtcgccagcgtcctggcgaggcgttaagcccgctggtcagtgttgatctgatgtcgctaaaactcgatgcccggattccgatgcagcagcatcaggatgaagaagttttcacctacctgtggcgtggttcgatgcagcatcaggacagtaatggcgaacgtacccagctctctgcaaaacgcgtgatggtggtgaacgcgggtgatggcgttcaatatgaagagtcggtgccgttatatgaagcggagctgttacaggcggttatccgaccggcacttcggggcggtgaagcaatgacccaggtgctggagcgcgatcagggcattatgaccaatggctggaccgaactggccgggccggaagagtctgatgcgccgctggaaactgcgccaggaagtctacatcttcgacacactgcttgagcgcaaccatacgctggacgtgccgtcgatgccgggctttgtcgcttatcttaccgtgcttgaagggattattcgcgtcggcgatctgcgactgagtcgcggtgatgccgtcagcgggctggattccagcattgagatcgtgggcgatcgggatgccaatctggtctgcttcctggtaaagcccgataattttgcataaaaaagcgcgggaaattcccgcgctcatctcttgctttaagcagattaaagcgtgctaccttgctgcatcgcctgaacccgtttataggcatgatcgaactgacgtacatcatcgcgcagccagtggcgttgcgtcagcggtgcatcatccagcgcctgcggcagcggcacacccgccagcgatccccggcagcaaaaggcgcgcgccagcgttggggtggcaatgccgatataacgggcaaattcaggtaatgtcatcaatgctgtactcatttcccacctcctgtaaacacaatctcccctgcattttcaggccaaatcctgaatgcttttattgatctgaaacatagatgtggtactaatcttctgcctgctaatgagagcgttcaccgcgcctgacgcaaatcgagaaagaagtgaggaacccgtgcgccattatggattgatgattgccctgctgttttccggctttgccaccgcccacaccctgacccccggtcagcctgtaccacctgtcttcgttgccgataaaggcgaaatggtgctgaatcagggcgacataaattatcagcgctggaacagtcagactctgaccggaaaagtgcgtctggtgattcatgtggcgggccgtctttcagcgaaggatcagagtgcacgattaatcgaagccattcagcaggccagcctgccgcgtgaccgttttcagaccaccaccatcgtgaatactgacgatgcgctgcctggcagtgccatttttgtggtgcgcagcatcgcttccagtaaaaaagcggcaccgtggcagcaattcattatcgacagcagtggcgtaaccgcgcacagctggcatcttaagccggaaagcgcgtccgtggtggtgattgatccggcaggcattgtgcgctttgctaaagatggcgcattatctgcggaggatgtcgccagcgtgatgaaacagctgcgcgcattactgggttaaatcacgcataatgcccgtccggctatcgccgtaaaacgcggaaggctgctgaattctccgacatttttattatcgtgaactactcttagttgtaatggattaacccgccgttctttgaaaacctgccaactatgctatggcagtcggggacgattattgaagatggcatcgaatcattcgacctgctgtgacttcctctgtagataaggacagccatgatgacggtctgtgcagaacaacacgtcaatttcatacacagcgatgcagccagcctgttgaacgacattgagcaacggcttgatcagcttttaccggttgaaagcgaacgtgacttagtgggcgctgccatgcgcgacggtgcgctggcaccaggaaagcgtatccgtccactgctgttgttgctggcagcgcgcgatctgggctgcaacgccacgcctgccggcctgcttgatctcgcctgcgcggtagagatggtgcatgccgcatcactgattctggatgacatgccctgcatggatgatgcgcaactgcgtcgcggacgtccgaccattcattgccagtatggtgaacatgtcgcgattctggccgcggtggccctgctgagtaaggcattcggcgtggtcgctgcggcagaaggcttaacggcaaccgccagagccgacgctgtggcagaattatcccacgcagtcggcatgcaggggctggtgcaggggcagtttaaggatctctccgaaggtgacaagccacgcagcgctgacgccattctgatgaccaatcactataaaaccagcaccctgttctgcgcctccatgcagatggcctctatcgtggctgaagcctcaggtgaagcccgcgaacagctgcaccgtttttcgcttaatcttggtcaggctttccagctactggacgatctcactgacggcatggccgacaccggtaaagatgctcatcaggatgacgggaaatcaacgctggtgaatctgctggggccacaggcggttgaaacgcgactgcgcgatcatctgcgctgcgccagcgagcatctgttatcggcctgccgggacggttatgccacacaccattttgttcaggcctggtttgagaaaaaactcgctgccgtcagttaaggatgctgcatgagccactttgcggtcattgcaccgcctttctatagccatgtgcaggcgcttcagcatcttagccaggccttaatcgcacgcggacaccagatcactttcatccagcagacggacgttagcgcgctactcaccgatagccggatcggctttttcccgctgggtttagcctcgcatccggcgggcagtctggcacacaccctgcaactggcggcgcatcctctcggcccctcaatgctgaaactgatcaatgagatggcccgcagcaccgatatgctctgtcgtgaactgcccgtggtgctgagcacgctggcgattgatggcgtgatcgtcgatcagatggagcctgccggtgcactggcggcagaagcgctgaacctgccttatgtttcggttgcctgtgcgctgccacttaaccgtgaagcggatttcccgctggccgtgatgccgtttgactatgccaggaccgatcaggcacgggaacgctatcgcaccagtgaaaaaatctatgactggctgatgcgacgtcacgatcgggtgatcgcccgcaacgctcatgcgatgggattagcgccacgggaaaaactgcatcactgtttttcaccgctggcgcagatcagccagctgatcccggaactggattttccccgccagacgctgcccgatcatttccattcggttggcccgctgcgtaccactgagccggcacccgccgaggcgcagcctcgctacttcccgcatggcgacagaccgcgcatttttgcttccctcggcacgctgcagggacatcgctacggcctgtttaaaaccatcgtccgcgcctgccaggagatcgacgctcaattattgctggcgcactgcggtcggttgtcacctttccaggcggagaaactggcgcaggccagccatgttcaggtggtcgattttgccgaccaggcggctgcactggcgcaggccgatcttgccattacgcacggcggcatgaatacggtgctggatgggattaatcacctgacgccgctgctgacgatcccgctggcctttgatcaaccgggtgtggctgccagagtggtctggcacggtatcggacgtcgcgcctcacgctttaccaccagccactccatggcgcgtcagctccagaccttactggcggatgaaagctacgttaagcagatgaaaacgctgcgtagcgcacttcgtcaggcgggcggaacttctctggcggcggacattgtcgaacaggcgatgctgacccgccagccggtgctcaccaggagagactatgccgcggtatgatctgattctggtgggtgcgggactggccaacgggctgatcgccctgcgcctgcggcagcaacggccttccctgcgtattctgctgattgatgccgaacgtgaaccgggtgccaatcacacctggtcgtttcatgcggaagatctcaccgaaacgcagcatcgctggatcgctccgctggtagtacattactggcctggctatgaggtccgctttccccaacgcagtcgcagcctgaacagtggctatttttgcgtgactgcggagcgcttcgcgcaggtcatccgcgacaggtttgcgccggatctgctgctgaatacccgggttgcgggcatcgcttcacgcacggttacgctggacgatggccgggtgctggagagtgacgcagtgattgatggccgtggctaccagcccgatgccgcgctgcgcatgggcttccagtcgtttgtcggacaggagtggcagctcagcgagccacatggcctgaccgcgccgatcatcatggatgccacggtagatcagcaggcaggctatcgctttgtctacagcctgcccttttctgcagacaccctgctgattgaagatacccactacattgataacgccacgctggaaggcgatcgcgcccgtcagaatatccgcgcctatgccgcgcagcagggatggcgattagaccggctgctacgcgaagagcaaggcgcgttacccattacgctgactggcgacgtggccgccttctggcagaaacgcgatctgccctgcagcggtttgcgtgccggtttattccatcccactactggctattctctgccgctggcggtcgcgctggctgaccggctggcgcagatgcagacgtttacctctgagaccctgcacgccaccattcagcaattcgccagtcaggcctggcagcaacagcgcttcttccgcatgctgaaccgtatgctgtttctggcgggtccggctgaccagcgctggcaggttatgcaacgtttctacggccttcccgaaggtctgatcgcccgtttttatgcgggaaaactcactttgcctgatcggctgcgcatcttaagcggcaagcccccggtccccgtttctggcggcgttacaggctattatgactcctcaccgtcaacaggcgatgcaatgaatagaactacagtaattggcgcaggctttggtggtctggcactggcaattcgccttcaggcgtcaggcgttcccacccgactgctggagcagcgtgacaagcctggcggccgggcttatgtctatcaggatcagggcttcacgtttgatgccggccccacggtaatcaccgatcccagcgccattgaagagctgttcaccctcgcgggtaaaaagctctctgactatgtcgagctgatgccggtgaagccgttttatcgcctctgttgggagtccggcaaggtgttcagttatgacaacgatcagcccgcgctggaagcgcagattgccgcgtttaatccgcgtgacgttgaaggatatcgtcgctttctggcctattcccgagcggtgtttgctgaaggctatctgaagcttggcaccgtgccgtttctgtcattccgcgacatgctgcgggccgcgcctcagctggcaaaacttcaggcatggcgcagcgtttacagcaaagtggcgagctacattgaagatgagcatctgcgtcaggccttctctttccactcactgctggtgggcggaaatccgtttgccacttcctcaatctatactctgattcatgcgctggaacgtgaatggggcgtctggttcccgcgcggtggcacgggcgcgctggtgcagggcatggtgaaactgtttgaagatctgggcggcgaagtggagctcaatgccagcgttgcccggctggagacccaggaaaacaggattaccgcggtgcacctgaaagatggccgggtcttcccgacccgcgcggttgcctccaacgcagatgtggttcacacctaccgcgaactgctgagccagcatcccgcttcgcaggcgcagggacgatcactgcagaacaaacgcatgagcaactcgctgtttgtgatctattttggccttaatcatcatcacgatcagctggcgcaccacacggtctgctttggtccacgctatcgtgagttgattgatgagatctttaacaaagatggccttgcagaggacttctcgctctatctgcatgcgccctgcgtgaccgatccctcactggcaccggaaggctgcggcagctactacgtgctggcgccagtttccgcacctcggcaccgccgatatcgactgggccgttgaaggtccgcgcctgcgcgatcgtattttcgactatctggaacagcactacatgccgggcctgcggagccagttggtcacgcatcgcatcttcacgccgtttgatttccgcgatgagctgaatgcgtatcagggttcggccttctcggtggagccgatcctgacgcaaagcgcctggttccggcctcacaaccgcgataaaaatattaataatctctatctggtcggtgcaggcacccatcctggcgcgggtattccaggcgtgattggctcggccaaggctaccgcaggattgatgctggaggatctggcttgaatagtccgtcactgctcgatcatgccgtagacaccatggaggtgggatcgaaaagctttgccaccgcgtcaaaactgtttgatgccaaaacccgacgcagcgtgctgatgctctacgcctggtgccgtcactgtgatgatgtgattgacgatcaggtcctgggattcagcaacgatacgccatcgctgcaatccgccgaacagcgtctggcgcagctggaaatgaaaacgcgtcaggcctatgccggatcgcagatgcatgagcccgcctttgctgcttttcaggaggtggcaatggcacacgatattctgcctgcttacgcttttgatcatctggcgggctttgcgatggacgtgcatgagacacgctatcagacgctggatgatacgctgcgttactgttaccacgtcgcgggagtggttggcctgatgatggcgcagattatgggcgtacgcgacaacgccacgctggatcgcgcctgcgatctcggtctggcgtttcagctgaccaatattgcgcgcgatatcgttgaagatgctgaagcgggacgctgctatctgcccgctgcgtggctggctgaagaggggctgacccgagagaatctcgccgatccgcaaaatcgcaaggcattaagccgcgtcgcccgtcggctggtggaaacggcggagccctattatcgatcggcgtcggctggcctgccgggtttaccgctgcgttcagcgtgggcgattgctaccgcgcagcaggtctatcgtaaaatcggtatgaaggtggttcaggcgggttcacaggcgtgggagcaacgccagtccaccagcacgccagagaaactggcactgctggtggcggcatcgggtcaggcggttacttcccgggtggcgcgtcacgctccacgctccgctgatctctggcagcgccccgtttaacgccatgacgttctcgcagcgtcgcctgcagttttgacagcggcggcgcgtaaagaaagccaaacgagacacagccctctttgcctcgtaccgcatgatgcatgcggtgcgccatataaagcctgcgtaaataaccccggcgcggaacatagcggaatggccagcgctgatgcaccaggccgtcatgcacaataaaatagagcaggccgtagagcgtcatacccgcgccgatccactgcaagggccagacacccgtgctgcccagataaatgagcaaaatcgacagagcggcgaacactacggcatagaggtcattaacctcaaaccagcctttatgcggttcatgatgtgacagatgccagccccaaccccagccatgcataatgtatctgtgcgccagtgcagccgttatctccattccgataacagtgaccagaacaatcagggcattccaaatccacaacatagtttctcccgaacatgcatcctgcaaagtggcgcagaggttcaattttaacagagattggggaaaacagcgggtcgggttgtgccggttttaacgattgctgcaggagatggcccggataatgattgtgtcagcgctcagggtagaaacatgtggcgcattcagcatgcattacaccgtccccacctgtaatgcaccgtctgaacaacctagttataaaccaggttaaaggtcaccgtgctgtccgctttgcccgccataacctgcccgtcggtctgaatatattgcgcgttaaacgccatcgacttcgtctgattgggtgaggagatcgtcgtcagcaccggcagttgatcggtcggcacattcagagggacccgctggccttcaggaaacctgcaggcccgacccataggtcagggcaatgcccacacctgaagcagagttgctctgtggcgtcaggctaagggcatccttatcacccgcagtagccataccgaagaagcccactttaaccgctgcactgtgttcacacatcacctgaatctgaaaacctttttcacttcccgcccggctaccgataccgctaaactctgccttactcacttttcccatctccacattaatcacggactgggaggtgacaacggcacagctgccatattgcacggtaaagctggagaggaagatctgcggcttatcattgatcggctgactactggctgcactatcccccacctttaagctggcattgccaatattcacctcgccgacattggccggttgattgcctggattaagcggcgattgctggcccgggattttatagaagaccacataggactgaagtgtaatgtcatgtgcagaattcaactgtgggccggtctgggaattacagatcgagctgattttgcccttgccgctggtatcagagaaggtaccggcgcaccaggagggctccctgaaaccgatagcgaatccgatgctatctactcccggcacacgatatattggcgtattatgaccgcccgcaatattcgtctgtaagccggactcttcggcgttaatctcaaaccccagatccttgtagttatagccctgctcaccgctgtttctattgcaggtaaaggcattactgctttgcaaaggcatctgcgccgagatggccgtgccatcggctgcgcccggcacatagttgacgttttgcacctgtaccacaacctgactgataccctgacaggactcctgccccagcgcctgcaaacaaaccagcgccgggatcatcagtatgattcctgtcattaatcgctgaactgatttcatcttaaattcctgtggattactgacaaaccgcagagaccagcctgaccgggttagagccagtggcggctggcaggcggaacggtgcgcgacagcttttctgccctccctcatcctgccagttcacttcgatgatgccctgagccggtacaccgctcagataaaattcccctttttcggccacgatgccgctggtactgctctctttacccgcggcagcaagtgcgacctggccagcagcaccgaagggcggaaaagtatcctgccaggtaagggtgaacaacaccctgttacctacgtgggtggtatagtcggtcatcacaattgctccacgcgtagggatagccttttgcccatccagttcgacgtcaacgttgtcgggcagcgtatccgtttccagttcgatagcgttttcctggtagggcgagagtgaaggcacaatcgcatagccgcggccatcagtgaccactttgctgccgctctggatgcccacatctgccgtatccggtacccgaacaatcgcgaaggtatcgcccagcggctggctcaacgtaatgccgtgttcatgcgcgacgatcccacccgacaggccatagttaaactggctgctgtgccgatcgtggctgaccccgacactgacgctgccgcgactgccgcgatagtccagcgagccgttgctgttcacgtttctgtccctgactgtcatggccctgttgcaggttgtagtgcaggttatcgtcctgcaacgcgctgcccgacaggccgacctgctgagacatatcgccatcattagtggcattcatgctgtagctgacggagctttctggcagcagtgcgctgaaggggatggtgacattgaaagagaccgcgcgatcagctttacgggcactggtcgagtcggtgtaaaaccaggcgacaccccaggaaatggctttgtaattgctgtagaagcccagatgtaatgtgcgatcttcattgtctgatcgccagtagcgctgaacatacgcggaggcactgaggctgccataatcaccgataccctgagagactgaaatttctgagcgactgcgtttatttgccacatagcttgccggactggtcatcgcattggcctcgctgaaggcgtaaaaaccgctggaagagtagcgatagcttgccatgctgaaggtcgtattggtggaggagaaatttttctgatattgcactcgcgccgactgaccactccggctttgtccttccggcatacgggtttttgccagagtcacatcggttcccagcgagccaaaatcacccaggcttttacccaggcccgccgccacagcgtgatagttttgcgcaacctgcaggccaccaaaggcggtaaagtcatgcggcagtccgtacaacagcgtggattgcacaaattcaggcgaacgcaggttgctgctgcctgagtagtgataacgaccgccactgacactgtatttcagatggccctgacgcagcatataaggcacggcagagtaaggctgagtgaaggtgcgcaccgagccatcactttcatgaatgataatctcaaggtcaccgctctgggacgtgggatagagatctttgatttcgaacgcaccgggtgcgaccacggtttcataaatcacatagccgtgctggctcaccgttacccgcgcattgctatgggcgatgccttggatcatcggggcgaagccgcgctggctttccggcagcatggtgtcatcagacatgatctgcataccgcgaaactgcacgctgtcaaaaatatcgccggacgtataggtatcccctacccgaaactggcttttcagcgtcttaagatcccgctccagaaatgaggtctgagactgccattgactgaccagatcgtagcgccatgtggacgtgttacgcagccgccatgcaccaagattagccccgctgcgcaggctgagtaacgtcgagttccagcggtccctgtgattgcggctactgctgccagacaaggtatagttcacaaaagcagccgataccccctcatcccagcgtgctggatcgacataatcgcgatctttcaccatcagcgcgatctgtggaattgaaaggtttaactgctgatgcgcgaaatcaaagtgggtcgatgcatcgggaatgaaatcgcctaactcttcgatggcctcatctttcttcagattagtgagggcggaaaaaccgttgacgttcactcccatcgcggccagctctgccaccgtcagttgcggaaccagccccgctctgccctgtacgaagctgacatcgcggctatcaataactctgttgttgagcaacagcgtgacatgataagtgccgggttgctgtccgccctcacgagcaaaatagtggagatcggtggcgtgatgttgatcggatgagaactccagtgccgccgggtcaaaatagtcatccgcacgagcaccacgcagcgggcagaacaaaatcagcattaaccagggagaggcgtaaagcggctttgcgtaccttctctttcctctctgagcgtgctgattaactttcactgatgatggccccgggtttaaaacaaaataaattacaaataacaactagcgcgtacgttgttcggtaatgccgccatagtcgttgattgcagaccagctcactgcgccggaatcagcgacgcgccagtgccgatcttctccagggccaatcatgccaggatcctgtatctcgtgatgattaacgctgagcgaataaaatgagacaaagtaaggcgttgggttatgcgcaatcagctgattgccttcatggcggaatgagagttgctgccaggcatcagccggattacccggcaaatcttttggccgataaaaaagcttaaatttcgatttaatattgacctgaagctggttacttttatcgcgcggcgtcggtgaaatagatttcacattcagccagaataccgattcacgatctttcggcaggggcatccccagataattaatccttaacagattctctttttccgcatcaagccggaatagcggtggcgtaacaataaatggtacccgggaatgattattttgatcaaagttctctatccaggattcaaccagatacggcgtatttttatcctgattggtaaccgaaagtgttgcctcctttttgccttccacaaaaataacacgcgtccctcccattaccacacccgcatgggcagccatgcccagcatgcacgcagaaaagagtgaaataagtcttattaccttaaacatagatatttgtgccatcgatatttcggaggggaagcagggttacccctgctattaatcagttataaatcatcacaaagttagagactgagttggcagcaccgacagcaatcggcgcaccatcacttttataatcggcaaagaaatttaagtccgcagaaaccgccctcgtcagccgttaccaggctgaccgctttggagacggatccgatagcaatcggtgtgctgcggtcagcttcataaagtttaattcctacgccggacgcaccaccgctggtgactttcagcagggagttgtcaccgctatctttatcgccatcaaacagcacagccacggttttaactgatgaaggacaatccttaacagagatagtgaatggcgtttctgtagtttcgttacggctttcgaaatacgatttcgcccatttacctaaatcaacgctctggtttttactggcggtagaaacgtcacaggaaacatcggtaatttcgccggtaaatttcacttcaccaccggcaccctgtgtaccggctgctgctcccggattaggagtaatcggtgatgggccatcagcaggcgttgctaatgctgatccggacaccataaggccagccagtgccacgggcagaatatgttttctgatattcatcaaacctgtctcttttaatacatgcaaagtggctgcaatgagtcacctgatggataaatatgcatttacagaaatgcgccaacataacaacctgaggtttattatgttgctgctatattagcctctctcggctatataaaaattaaacgagacgttcaggttcttacacagaagagatacattggtagccttccttgatctacatcactttaagaaggtaaaaagattatttattgaaaaactatttttactaagacggcacttaatataaaccttaaatatatattcattccagaatgcgaatatataagttggccgccgtgaaaattatgcagtgccggaaattctcagcggtgattagcagcggctcacctcgggttttacatcattagccacaccaggttttcgacttgcgtgatttttactgatgccgcgagccagtcagctcaaagcaaatcgtgacctatgggagtgcgaaaagcgtggcgtgccgcggtcattaactgactggcggtgacggtcgtgggtaagcgcatcagaattttgctcgcctgccagtaacagagcagcataacctcatcctcctctttttcagccagttcatgcaggcgggcgcgcagtgataacacatcaatggtctgctgctcgtcaagcatgtcagagatcgtctgattgatgacgtgatggagagttttccaggtgagatcggtatgcaaaattaacctcttctaacgcttatcagctccgggcaaacaaacagcagtgaagcagcttaaatggctgcatcctgcaaaagattgcacactgctgacaactatagctgttcgtgggcggctacgccgtgccagcagttgaaaatgccaaagttggcaattctaacgactaatggacctgcctgtcgcgtattacacgcgactcatcagctgattgctgttttttgtaacaattgcagctgattcttaactggctgatgtcagagggatttgccagggtaaacaggtttcccgtctcgttaatgttcaaggagttgtcgatgagtcagcacgctaatgtactggtatggggccacggccctgagatatttgaagtctttctggaacccacctgtcctttttcggtgcgcgccttcaataaattcgacgcgttactggcgcacgcgggtgaagagaacatcaccctgaagatccgtctgcaatcacagccgtggcacctctattccgggctgatagtgcgctatatccttgccgccgcatgcgaaagtaaagaggccgcgaaaaaggtgatgcaggcggtggccgatcaccgtgaagagtttgagttcaccgatcactgtaccggtccgaaccgcgatgccacgccgaatcagatcctcgcccgcctgaaagattacagcggcgtgaatgccagcgccgcgtttgatcagcccgacctgcagaaacgccattaaatggcactgcaagtatgcccgtcagaacggcattcacgtttcaccgacctttatggttaacggtctggtacagcccgaaatcagcagcggtgacgatatagcgcactgggcaagctttctgattcgttaatcttagtgcgcggctgtgcctggccgcgccagactgagtctctcctttgcgaccctactcacgcgcaaactcaatatcctgataattaagcctgttttcccatgtggaggccgggtaagctgtaccgctatcagcagcagacggtgggattaaagccgctgctgttgttcatcttaacggcaccgctggcctgcatggcgataacctgacgttacgccgggcccgcacgcctaattcattgaggatttgctgatgacgatgacgctgcaacaactgcaggacaaatatccgggtgccttcacagatgcatttggtgactccccggaattagccagcgagctcgcaacgctgattattgccggtaagaaagtggccacctgcgggtcgttgcggagctggcaggatcaggaagtattgcctcaaccgggcggttacagcattgttctcaacggcgaacagcagcccgtctgcgtgatccgcaccaccggattgtttctgacgcgctttgatcgcgtcacgccagagatggcgatgctggagggtgaaggcgatctgagcctcgaccactggcgtcaggaacatcagcgctacttcgagcgtgaaggctattttcacagcgaaatggagctgatcttcgagacgttccagctggtcgaggtagtctaaatcggcacgctacagggtgtttgccgccaccagcgcaagccgcgcaatcccccgcgcggcaaggttatcagccgcctgggctgcgcgcatgccactggcacacaccagtaccacacgctgattgaccggcggttgccaggccgctatctgctgcggcagaattcgcaccacccgctcggccacactgaccggtgcctcttccaggctgcgcaactccactatgcaatcatcctccatcagcatggcccgatcgataaagggcgtgccgggcgcgtcaggttcaggtgcgtcatcaaaacgaaactgcctgatatgccagtcaacaaagtcacagtggatcatgcagccgagcggcgatggcgtcagttttaacaatacgctcagcgccatctgtgcctgcattgcgcccagcgtcgctaccgccggtcccattacgcctgccgtattgcagttacccgaggccgtgggcagctgcgggaacagcgcgcgatagccaggcgcaccgccacagaatccgccaacatagcctttgcgtcccagcaccgaagcgcagatcagcggcaggcctgccggataacaggcgtcggagagctgataagtaatagcgaagttatccgccgcatccaccaccagatcgattccctccagcgcctgcggcagttgactggcgcttagcgcgtgtggatgcgcctcaacgtggcagtcaggattgcgctgcgccagcgcacgctgagcgcaaaatactttctgctggcccacatcgtcgacgccaaacagcgtctgccggtggaggttgtgcagttcaacccgatcgccatcgtaaagacggataaatcccacacccgcgcctgccagtaacggcagcagcgtcgcactaagcccgcccgcccccaccaccagcacctttgccctgctcagccgctgctgccccgcttcaccaatctctggcaacatcgtctgtcgctgataacgctccatcgctgctccttaactgaattgtgccagaccaaaaatgggcgtagaggcagacgccatgtcgcgctgctccatcaatcccgcctgaaacgcctcgtgtccgccgtggatcgcagcagcaaaggcaccggccatgcgcaccggatcgcgcgcttttgccaccgccgtgttgagcagcacgccatcaaaacccatctccatcgcctgagccgcctgaccaggcgcgccaatgcccgcatcaataatcagcggcacatctttaaaccacgcacgcatagcgcgcagcccctcgatattacgcagcccctggccggagccgatcggcgcgccccagggcatcagcacttcacagcccgcttccagcaatttttcgccgacaatcagatcttccgtagtgtagggaaacacctggaatccgtcagcgcagagaatccgtgcggcctcaaccagggcaaaaggatcgggctgcagcgtgtcggcatggccaatcacctccagcttgatccacggtgtgtcgaacagttcacgcgccatctgcgccgtcgtcaccgcctctttcaccgtgtggcagcccgccgtattcggcagaatacgtttgttgagctgttgcagcagcgtgcggaaagcgccgccttcactgccttcccgccgcaggctgacggtaataatctccgcgcctgacgcgttgatcgcctgatgcagaatgtccggtgacggataaccggccgtgccgagcagaaatcgggattgcggagtaaattgatagaacatggttaacctccctgcatcggtgacaggatttcgagctggttgcccgcctcaagttgctggctggcatagcggctacgcggtacaaactccccgttcagcgcggtggcgacggtccgcggatcgatctgctgctccgccataagctccgccagcgtcgttgcgccggtttcaatcgtgcggccattcagttcaacgcgcatgagtcatctcctgagtcagttgcaacataagtttttcagccatgatcggggccagcaaaaagccgtggcggtagaggccgttaagtgagaaacggccattttcgtagcggacttccggcaggtttctgccgataagcaggacgcagaccggtgccactctccacaatccgcgcttcagccagcgccggatgcaggctgtaagcggcgctgagcagttccatcatcgcccgggcgctgatcgagctgctgtcgtggctttcgaccatggtggcacccagcatgaagtggcccccgtcacgcggtaccagatagcagggaaagcgtgggtgcagcagccggacaggacgggagagttgtacgtcggatgtgtgcaggatcaccatttcgccccgcacggcgcgcagggctggctgccgatcggtggcgtggatgccacggcagtcgatgattttgccgccgggtttaacgctgtgaaaggggacgccagcctgttgcagtttgtcgcgcagttgctgcaaggcgcggcgcggatcgagatgcgcctctgcggcgaaaaacaggccgcgggcaaagcggttttccagcgcgggttcgatgtcaccgggagagacccactgatgctgctgcgtcatgctggcgaagcgcgtcagttcacggctgtcacgcggcggagccaccaccagcgtgccctgctgttccacgccatcaacgcgtttcgcccaccagctggccgcgtgctggccccattcgatcacctgtggcggtgcgctttctgcttcacaccagggcgcgagcatgccgcccgcccagtgcgaggccgcaagacagtcaggctgagtaataacttcgaccgtttctccccgctccagcagctgcgtggcgacacaaagcccggccacgccgctgccgagcaccgaccagcggctcatagtgtccaccggacaggaaaagaaagattcaggatgagatttttcaatttggcctcgttatccgttaacgaagacccgtgatacagagggaaaaggcaggaacgttgcgaatgcgcccctgcggcaagtatctgatgagatacccgtcttcctacgccagtatcaactgggtcaggttctaagggtcgctaagccgcgcggtgcgctattagcctctcagtctctctggcgagactcccctgacgggtttagttgtaggttaagcagacagcttcgtcaagcagactgcatggaaccgggtcagaaaatcggacttaaccggcagaaccgaaatgccagtcagttgcggttgccagcgtcacaaaggggcccgccagcgtctggttgtgatgcgcaataatcttctccgcagagaggtggggattatcgacggtggtgtgcgcatcggaaatcagtacgacgttaaaacccagctccggggctgcccgacaggtagtatcaacgcagaactccgttttcatccccgcaatcaccagttgcttaatgcccttttgcctcagctgaagctgcaggccagtatccctgaaacagctgggatatcttttggtgaagacgacatcactctgcgggttagcctgcaattccgggatcaggcgcgtcagcgggctttgctcgttaaaaggggaatcatccgggccgatatgtcgtgcgaaaaagagggggacggcagaagcccgggctttagtaatcagaagtgagatgttcgacaagatcgaatttgcggcgaagggagcctcgggaccattaaaaaggccctgctgcatgtcgataattaaaagtgcactttcagatgtagccatgacgtgtctccattcagttttaagaacggagaacagctccccgtccggttcggcggggagtgagaatcagttgtgtcaggtgcctgtcacagagtcgctcacgccgccgccaggggcggtggtggtggtgacggtggtgaaagactgaactgacataaacattttctgaccctgagttaatgcgttcggtgagatcaccatcagaaggatggcgctgacatctacattaccctgtaagccgtcgcttttaaagcgcctgcagcgattgggttaccgcatcggttatttcacgaatgcgcggttcggcgcggcgatagtaagtccatttcccgactttgctggcttcaaccagccccgcattgtgaagtgctttcaggcataacgaggtggcgggctgtgataagcccgccttgtcctgtatgaggctggcacagacgccatactgatcgaaggggtagagctgggtatagcccgcaaacgcttcgtcaggatttttaagccacttcagcactgccactctggtcgggttggacagtaacttcagggcattttcgggggacatgccgcctcacagaatatcaggatgggtaaaatgggtagtcagtatagcctttctcagtgccgccatacagggaggcgtgatcgacctcattcagcggatatcctgatttaatccgcgcgggcagatcgggattagcgataaatgagcggccaaaaccaaacagatcgccccagcctttttccagcacatgctgcgctttttcagccgtgtagcgacccgaatagatgatcggagagcggaatgtttcccgcagcgcgacacggaagctctctggcatctccgggctgttgtcccagtcggcttcagcaatggagagatagccaacttccagctcgttcagcagggctgctgcgcggatgtaggtcgcgtgtggatcactttcaaccagaccgagatagacacgctcttcgtcggtactggtaaacagaggcgcaaatctgacgccaacgcggtggctgccaaataccgagctgaccgcctcaacgacttctcgcaggaagcgcagacgattctcagcagatccgccatattcatccgtacggaagttggtgtgctcagaaataaactggttaatcagatacccgttggcggaatgcagttccacaccgtcgaaaccggccgctttggcattctccgccgcgcgtcggtaaagctctacgatctctttaacttccgatgtagtcagtgcgcgtggctcgctgggtgcggtcaatatgccggcgccgggtccggtttcaataaatacccggacgttatcggctgcgatggctgaaggggcaacgggtgcctgcttgcccggctgcagttcattgtgcgacacgcggccaacgtgccagagctggcagaaaatcgtggccccttgctgatgtactgcctctgtaacctttttccagccggcgatctgcgcttcgctgtggatccccggcgtccatgcatagccctgcccgcgaggctcaatctgggtgccttcggtgatcatcagtcccgcgctggaacgctggcggtagtactccaccatcatctcgccgggaatgttgcccggttgttcactgcggcagcgcgtcagcggcggcagtacaatgcggttacgaagctgaaggtcgcccagactcaagggggtaaaaagtgacggcatgacaaaaaatcctctgatgtgtgaagaggcgacattatatttacacatttaaatttgtaaatgtgtaatctgtgctttttgtccagggcggtatctgtggtttctggcagagggtcactatctggatggagtgctgacagcgcgtgggattaacagtctcacatcgcagcgcctgactgcgtaaagtcaggaggtgatcctgcagacgccgctttcaggcaaattgcttcgccgggacggaggtgctgcctgcaggatcataagaacattaagaagcgtatttttcagtgaaacgcctgccactgctggcgataaacctccagttgactgagtgcgccatcaatggagggctgtgctttgttgtcaggattcggcgtggtacgaatcaaatcggcaaaggtgttgaagacagagtccatatcacggcccgacttcatggcttccatcatcccggccagctccacctgtggccgtgcggttgcgctcttaacctggctgagatagtcacgtgcgctctcctgcatgtcgcgtgttccatgacgtatggctaacgccagcgtatcctgtgctcccagcaacgtctgacgttcacgaatggcgactttgacgcttatcatctcatcagcaatgtcattcgcctgcttctggttatcgccggagacatatttttcaatcagtttatggagcttagactgcgtcagggtcagcgccatggcttccgaggtatccgaattatcgtactgattacggcccacctggccttcagccagcacctcatggagtgcagcggcaaactcatccatagcggtctgcgtattggcagccgtcatactcagaagcggagtaaatgttctggcgtcccagctggtgtagggatcgttgaataacgcatatccgaggttaacggacggtccctgaccggatgactttgtctttgccagttcctctgaatttttggcctgctgctctgccgtaatgggctcagcgatagcctgcaccaggcgcgctcttgcctcgggcgagatcaccaccacactggcaggtaattcttttccggtaatagtttctttagtcgtgttctcagatctgtttgttacggtgagcgtggctaaatatcctcttgccacctctgttgtcacgccattgattaaccccataatgccctctacggtttgattggttgaacaatttatcggcaaaatgtaaccaatctttaccgaaatcttattgctgcctgggttaagacgtctcagggcaagtctggctatcatcgccgctgcggcctgactttgatccagaaaaggctcagaatccccaggctgaccagccaacggctcccggcagcgtttaagactttgcggggtgcacaggaaagtttcagagcagtacgcatttatccattttcagacagggttaattcagaggaaacgttgtgaatagtgcacttccattagacgcgcttgggccacgcatttgtattatgggtccatcgaacagcggaaaatcgaccttagctgaggccattgctcgcaaaacagatctacccgcggttcatctggaccagcttcaccatattccggacagccaatggatgcccagagcaccggcagaatttcttcgtttgcatgctgaggcggtgagtcaggaaagatgggtgatggagggtaattacaccaaatgcattgaagaacgattcgcgcgtgccacaggcttaattctgctggatgtaaaagtgacagtggcactgctgcggtacatttgcagatgttactcatccacgccgcgtattggcggtctggggataggcagagagccgatgaacctggagatgctgaaatatattctccgtactgccccgcaaaatcgaaagcaccataaaaagctttacgaccaggtcagactgccaaaacttctgcttccttctccccgcgatgttaaagcctgttctgactactggggattacagctaacgaataatgatcgatgaacacaggctgcaggaataacgtctgttttccgttaatagggtcgctctgactcagtaaccctttttgaataacaaagaagcaccactgccatcaatcaataagctttaagctcgtcagaagagagtccagcgattctaccggtccggaatgatttgtcttggaacggattgtgtcccagggcatggcgtcatcagtacaataatcacctgtgcactgcatatcggcaggctcactgagtaaaccaaccggaagccagatataaggcctgccacgcaaccggttaggcactgtggagccacagctggcgcaaaaatcgttgcgataaccggtgggtttgcgccatgacgcgatctggctctcaccggaaatccagctaaagtcactctcttttacgatcgttgccaggttatagccggttccactctgttttctgcacaaagaacagtgacaacggtaatagcgcgtgggggttactgatatttcgaaagcaacggtttcacacagacatgcgcctttcatttcatcatcctgttcactcagattcctggtttgtctgactacttgcctgatcatagtggtgttaaagtaaggggctgctgaagcgctaccgcaaccttgttaatttaatgccgctccggctcattacatgatcttttgcggatttgagccagaagcggataacccctcgtacaccttcatcagtattaactgcggctgaataccagtttcagccctgccagcgcaaagcagcaggctaatagcgcatcgagtccgcgacgaatgcgacggtagaatgcgcccatcatggcggttgagaaacagcagagcataaccgccgaacacaaccacgcaaatcaccgcacagccgcagatgattatcggcagcgtggcggcgaccacatccggcttcagtgcaaacgacataatggccacccaggtaagaatcgctttgggattgccgatatgcatcaggataccctgacgaaacagtctgccatatgcgacccgctcatcgctggctttaaaatcgctggcctcagtgcggcgtaacgcagatttgccggctttaaacgccagccataacagatataaccctccgccaatttttagcacgatcagcaactgtgcgaaggtggccagcacggtcagcacaccgcaggcggccagcagcgcccagagcatcgaaccactcacgacacccgcagccagcgccagtgcggcccccctgccctttttcattgccgttcccattatcgccatattacttggcccgggactggctgtagcgacaaagtaggtggtgaagatcaggattaattcgtgcgaaagcgccatgatgtcctcagcgatgggttgttatttatctgttatatcggctgacgtgcaaatttgctatctcctggttcgttgcggcttcgtttctcgctttaaacgatctgcagcaatcaaacatttaccagacatagctttcttctgcggggatcggcatcctgccggaagtatcatcaaaggattcgctttaagggacaactcagggtcgtttaagttcatccagacgcagctgcaaaaatgtcaaatccagccagcgtccaaacttagttccaacctccgtcattctgccagactcaataaatcccagttttttatgcagggctatggatgctgcattttccgattcaatcgccgccaccataacgtgcttcccggcttcgcgagcaagctggataagcccctgcatcagggcggcacccgcgcctttacctcgtacatctttatgaacgtaaaccgaatgctcaaccgtatgacgatatccgtcccagggacgccagtcaccataagaggcatatcccagcacggtatcatctttgtctgtcgccacaatcacaggaaaaccggcctgctggcggctgtttatccacgcgatgcggttagccacatcaatacgattttcattccagatcgcggtggtgttaagcaccgcgtcgttataaatctctgcgatgatttcagcatcgctctctacagccgcacggataatcatggtggacacccctttgctcactcactaaagtagatgaattgttcactatgatagttatccattatgttagataaaaagtccagcaaagaagacagcctgaatgtccgcatcggtcagaaggtaaaagaggaaagggaaaaacgcggctggtcacttaccgagctggctgataactcaggcgtttcacgggcgatgatccataagattgagcgtggggagagcagcccgacggcggttctgttagcgcgcctctcaggctcgtttgatatgactatctcacagctgcttgctcagactgaagtgcaaaccgggacgctggtcaggcatgaaaatcagccggtgtggcaggatccggaaaccggctatctgcgtcgccacgtttcaccgggcgagatgccggtcgatctggtcagtgtcgaactgccggcaaataccgctgtgccgatgccggcaatctcctatgtttcaagacgccagctgatatgggtaattgaagggacactgacttttgaagcaggttccagcacctatgagatggctgctggcgactgtctggaaactgggcgatccggctgactgcgtgttcagaaataaaacgactcagggctgtcgatatgccgttatcgtactccggcctgcctgagcaggcagacggcataaatccctgagtaaatcgaccattggcagagggatgattgtcactcagtccggctatcgatcgctttcagaaatcaaatcgccagccggactgaatctgctcagggaaagattatttccccagaatctctctgcggacaatctcagcgcccgcacttaacgcatgcagtttgccattggcaacctgacgcggcagtggaatcatgccgcagttggttgaaggatagagattttcagcatccacaaactgcagcgctttgcgcagcgtattcgccacttcttcaggtgtctcaatggtatgggttgccacgtcgatggcaccgaccatcaccttcttaccgcgaatcagctcgatcagatccatcggaacccgcgagttctgacactccagtgagacaatatcgatagctgaacgctgtaatttagggaagacctcttcgtactgacgccactctgtacccagagttttcttccagtctgtattcgctttaatgccgtagccgtagcagatatgaaccgcggtttcacacttcagaccttcgatagcgcgctccaaagcggcgatgccccagtcattcacttcgtcgaaaaagacgttaaacgcaggttcatcaaactgaataatatccacgccagcggcttctaattctttggcttcctgattcagaatctttgcgaattcccaggccagcttttcgcgacttttatagtgattgtcataaagggtatcgatcatcgtcatcggacccggcaacgcccacttaataggacgatcggtcagcttacgcaggattttcgcatcttcaacaaatacgggtttctgacgtgagacttcacccaccacggtcgggacgctcgcatcatagcgattacggattcgcaccacttcacgcttttcaaaatccacaccgctgaggtgttcaataaacgtcgtcacgaagtgctgacgggtctgctcgccatcactgacgatatcaataccggcccgaaacctgatcgtccagacacagacgcaacgcatctcttttgccgtcaactaactcttcatcctgcagtttccagggtgaccagagcacctctggctgcgcaatccaggagggtttaggcaagctgccagcagtagatgtcggtaataaggttttcatagcaggtgaccttttatatgtaattaatcaaagaacgaattcagcagaccattgcgcgagaagtgtctgattcggcttaatgaaatgcgtctcagtaaacttaccctgttcgacggccaggcggctgcgttcttcgcgatcgtaaacaatccgggttaacgaataatcctgatgctgcagcgtgggttgatagcactgtcccgcagcagaattcgcgttgtaaatttcagggcgatagatcttctggaaagtttccatggtgctgatggtgctgatcagctcgagattggtgtaatcgctgagcaggtcaccgtggaaatagaaagccagcggcgcaacactgccctgcggcatgaagaaacgcactttcagacccatttttccgaaatagaagtcagtcagggaaggttcatcctgctgatattcaatgcccaataccggatgctgattaccggtgcgcacgtaggtgtttttgctcgatacactcaggcagataaccggcgatttactgaagttctctttatagaccgctgagttcacgaaacttttgaaaatattgccatgcagctgaccaaaatcatccggcaggctgaattcagtctgacctttgttatgttctgacagaacaacgctgaaatcataatcacgcacataggaagagaagttattgccgacaatcccctcggtgcgctgaacggttttatgatccacgatatgcgtttttaaaatctcaatcgccgggaacgtttcgtcgctgcttccgggacgaagattcagctcagcagaaataatctcaagttcaactgagtagcggtcgccctttggattgtcccagtgcgccagagagttgaaacgattgtcgatcatcaccagggcgttgtgcaggttttcctgacgtttttcgccgcgcgctaaattagcgaagttagtcgtcgcccgcgtatttttcgaaggattatagttttcgtcgaaacgaatgcgcttgagggtaaaggctaagttgttcatcgctatcgggtatcctggtcgctgatatgcgttgttgcttttaagggttacccagcgtggctatccctttacaactattcatatgactcaaagttattaacaattcttactttatgcctcaacacccggttgaaaaaaagtgattaaatttcaacgaacatgaaggaaattcatgttggggcagtaaagcggggaaattttcatgaggctgcgagtcttttaacacctgatgtaaaatccgggtgtaaaaagcctcgcacaaagagggcttagcaagagatgtcagaggtggagtgatctttcgcctcaacttaaggcgcggaggctttcatgatcccataatcaggcacgccagcgtgctgttagtcatttagcggaaatcaatcggtttcccacccgcagagcgttaaacgcagcatggatggggcaactgaaacgttccggtcacagcaaagcaagacgactaaattttataaacgttatcacacatcactttatgtgcgcctgattttaccgaaagcctgcacgctgcctctttcatcagttttcccatctcactgtcgcgcatcgactgcgtcaggcgtgaagccggaccggttaatgccagcgccgcgagcagtttgttaccttcaccaaacaccggtacggagaatgccgcgatatgcggatcgcggatacctgacgtgaacagcgggagttcaggtacagagtcaaacagaggttcattcagcccccagtaacgaagcacctgcccgatggccgaattatccagcggcagataagtgccgggcagacgtgtttcacgcagtccttcagagggctccgctctgaaaagacagagtcgttgaccgttttcaatcacataccatgtggcgctttcgcctgtcgcagtcgccagtgcgtgaagttcaggctgaacgatactggccagatgaaaggattgttcatagagcttgcccagataaagcagtcttggccccagggtataaacgccattgtcgcgacgaatgacatagttcatgcgctcaagtgagttcattagccgataaactgtcgttttatggtaccccgaaagctgcgccagcgcggtcagcgtcagtgattcctcaccaggcctgaaacaatccagcagcgccagcgctttttctacggcaattacgccttcattccccatcggtacgtcctcctgtttgcgacggcaggcagtttaccgcgcattttgtgattcacatcgtatttacatcacaaatgaatgcttaacactggtgcgaactcaattaacatcgatatagtagttttatattgtacaacttagttgtaccagataaaacaaagaggattaatctatgccccatgcagagaataccttcatcaatcgcgacattatccgtatcgcaccagagcgcgtaaaacaggctgctcagtttcaggcggcgattcttgctgatgttgccggacgacgcggaacgctgcacggtcgcgtaaaacctgtgtcccccacaatgaaagtcgccggaccggctatcactgtcgaggtgagaccgggcgacaacctggcgatccacgccgcgctggcgattgcccagccgggcgatgtcattgtggtcgatggcaaaggcgatatcagctgtgcattaatcggtgagataatgtccacccaggcagaagcctccggcatcgccggaattattattgatggtgcggtgcgtgacgccgatgcactgagcgcgaacggctttccggttttctctgcgggcctgaatccctgcggcccgaccaagtccattgcgggacgggtcaactaccctgtttctgtggcgggcgcagccattcagccaggcgatctcgtcatcggggatattgatggcgtggtggttctgccgcgtgaagacgttcctgcgttgctcgaactggcacagaaaaaactcgatttcgagaccagccgtattgcagccattcgtgatggcgaccttcgcgcgccgtggttagaaaaagccctgcaaaccgctggcatgctggacgatggggagacgctctgatgacaacctcttctcccgtgatcctggtgacgggtaatgacctggcaccgcaggcaataaacctgcttagtgacttcagcattgtttatgccggcaaacagcccagcgaagatagcctgttccagttctgccagcagcataatcctgtggcgattatcgtccgatacggaaaaatcaacgcccgcattatggatgccgcgcctgacctgcgggttatttccaaacacggcagcggcattgacgttatcgaccaaaaggcggcggctgaacgtcatatcagtgttcagtcagccccgggggccaacgcagcggccgtggccgagcatacctgggcgttaattttagcctgtgcaaaatcggtgataccgcttgatcagcgcatgcgccagggacactgggacaaatcgacccataagtcggtggagctggagggcagaacgctgggtctggtagggcttggtgccataggcggtcgtgttgcccgcattggccgtgcttttggcatgaaggttctcgcttatgatccttttgccagaacctttcctgatgagtgtgaatcctcctcacttgacgatctgctgcgacaggcagatgtcatttcgctgcactgcccgttaaccgaacagacgcaacagatgattaacgctgagaaactggctctgtttaaaaaaggcgccatcctggtgaacacggcgcgcggtggtctcattgatgaagaagcgctgttagccgcgctggataaaggcactgtcgcctgggccgcactggacagttttgccactgaacccctgactgcgccgcatatctggcagactgttggaaatgtgattctgtcgccacacatcggcggcgtcagtgataactcctacgtgaagatgggcaccgtcgcggccagtaacatattaaacgtactggcagaaccattgaaaaacgaaagtccggtagcctgaaccgccctctccagccgatcagacaggtaacagcgctttctggtcggctggttaataggtaaatctgctgcattagagcgtaatgcttagcggtcagggtttccgatacgaatctcattctgttctatgccgtcctggcttacttccttcgcccacataaatgggtttattacccttcaatcgttaacgactcttcccgcgtattgaatgaggtagctgcctgcagcggtttcattgaagtgttaattgaagggcatgtgttatgaaggatatgtccgctatgagcaaggagcggatgactagtttgcagcaagacgggggcaagacttattggggttatatccactgtttttttggattataacgcgatatccgatgagttcagcaaatgtccttccgttgatgtttaagtataatgataatgtttatcaacaaaaggatattgttatgtatgggtttatgatgattctggctgttcttgtactcaatgcatgtactacttattcacctgttaaagttgaacaacccaagccccttcgacaagatcggcccgtttacccatactatgcggctaagaaccggatagaaggtatggttaagtttaactttgacgttgatgcagaaggcagggtaagtcagatgagaattatcgagtctacgccagaccacttgttcgatgatgctgtaataacagccgtatcaaaatggcgttttgaaaagggcaaacctgccaggaatcttcccatgactgtaaaattaaaagtgcaaaaatagatttaattttaaggctgcatgaatgaaaattaatgactgtaattcaggaggttattatggctgaatgttgttcttctaaatattaacataaattattatccgatgtccgcttctggcacaaagcggatatctgcatcagataaagtccgatatgtgcaaaagcgaaaacacaagatacggattaatccagatcaaatcctgatagcatcgcgaaccgtatcaaacgtttttcccgggcagatgtagtattttctaatctcggctctgtactcctgagccggaatgacgtcgccagagcactacggaaatcgccgtaatgaacagtgtcaggaaagctgaaataagcagcgtaccgcctacgccgtcccgttccagcagcatggcataagcagaaggggcaagtgccgcgagaaaaaatcctggtgataacagcatgcctgttttgcgggcgtaatgttgcggatcaaacagcacgagaggaagtaaggccttcacgaccgtgcacagtccgttcacggctccataacccaggacgaagagggctgtagccacaggcgtaacgtaccccgcaaggccggtcataaaacagagtggcagcaggataccggtaataaggttcaggcgtagtgcggagattcgtgcgccggaggccacgtccagcaggcgggcactcacctgtcccacgccccaaagcatgccggccagagcaggcatgctataagcggccagtatctgggggaaatgcgtagacacgccggtggagacaaagctgagcagcgctatcagggcggcataccacaggccgctgataaatccttttcgttcctctgcggtccctgccgccggaagctcagatcgaccagcagcgggaggttttacccgacggcctgccggaacggcggtcagaaaaagcaggcccaccagacccgcacacccgtaaacgagtaaggcatgccgccagtcggtaatgtgcagcagggccgcgccagcagtccagaacacagctgacgcgaggccgcccagcagtgtaaccagagagactgcccttcgggccccggcacctgcggtttccacaagcagggcaaacgcagcgtcatacaaggcaaggcgcatgccgactcccgtcaggacccaaaccgcaatccatgccaccgtggaatgggtaatcgccatcagaaaacacccaatggttatggcgaaggttcccgccatcatcatcatgcgtcctccggtccgggccatgacggaaccggtcagcggtgaaaccagccccataaccagcatggcaacagtcagaccagagaatgtcaccacgggagaccagcccgtctccgccatgatggcggctccgaaaacgcccggcatgtagaacgtaataccccagttaataagctgtgtcataccgatacagaaaatgctgaggcctgtcagatgtccggctgtcaaactatgctctccgcaagcgtggagtcgccctgtccaagcgtgcgctgcagaatgaccgtatcgagccagcgcccgtgcttgaatcctaccgaactgagtgtgccagtgatgctgaagcctgcggcgcggtgcagggcaagggaggcagtattttcgctattacctaccacggccacgagctggcgaaagtcacgggcttctgcccaggctatcgcacgggataacagcattttgccgtagccccgcctctgacaagtggcgtcaatatagactgagtcttccagggtaaaccggtaggcgcgccgttccctgtaaaatgacaggtagcagtatccccggacttgcccatcatcaaccgccacaaaccagggcagtcctgctgaacgcacctttttcaggcgggctgccatttcaggtacatctggcggttcggtttcaaaagtggcggtgccatgtaatacgtgataagcataaatctgctggatagcagtaaaatgtctttcatctgcttcagttatttccatcggtattgctctttatccggtcagaaacaaagattaacccgggtaaataatttcagacaggccgcgggacttatcagcggtataaggaaaactttggcatggcaaacctgaaccttgatcaccttgctactttcaggatggtcatcagccggggcagtttctccggagcggcagaagctctcggactatcacagcctgctgtcagcctgcagataagacagctggagcaggcgctccatgtccggcttattgagagaaccagccgggggataaggcccactcctgccgggctgactttttctgagcactgtatgaaaattgattcagtggtaaatacggccattgaatcggtgtctctgcattcagacgacatcaccggcaccgttactgttggcactggtgcaacagcctgtattcatcttctgcctcccttactgcaacagctgcgacaggcacatcccctgctgaaagtagacgtacgcacgggcaatacttccgatattgttcggagcgtaggggagaatcgtatagacattggacttgtaacgcttccagtaaccggcaaatgcctgagcgtaagcccgctgggtactgatgagtttgttgttatcatggaaaaggatgcatcagagcagagtgcgaacccgctgtctcccgacgcccttttgtcactgccgctgattatctttgaacccggaagcgggacacgcgccctaatcgacgaatggttccggtatgccgggcatactgccagccctgtgatggaacttggcagtattgaagcaatcaaaagaatggtacgttccggtctgggctacagcatcgttccccttatgtccgttgctggtatggaagaaagtcagggtctcagcctttactctgtgacgccctcgcttcaccggactctggggacagtaatgcgggaggatcggattgtcagcaggggcataagtgaagtgctgaaaagactaaacgccagttttgcaaaagatgaaagcagttaaatatcactcaatatatttatctgacagatccggcctgctcagctccgaaaaatatccttgctgcttaagcctctgatgtccgcttctggcacaaagcagaccatcgtccaggcttatgcctgctatgagcgaagagcgattactctcagatccgaggcttgataataaagcactctcgattttaataagatttgtatttacccatccataagccctctctcgttacaggcgtcatacttgaagagttcccccttcatttttccctgccatcggttgataaactctaccgtgtcggtttttataagatgggctttgagcgcgtcctgatctatccatcgttctgatataagcaatcttccggtctgatagtcctccacgacagcgttatatgaaaggtttccatcacgttgtcgaacggcattcgccaataacttaagttctcccataaattgttccaggacagaaggatcaatgtacatataaccggaaatgataagcgtcttatttttcctttaactgactgctactcgccctcagaaaatggctgatcaggtatggggttatcagaagttagtcagcacaattttgccctggatacttcctgacgaagcgcgccgatgtgcggctgatgccatggctaacggataggtgctgtcaatcacgacgttgataatgcctttttccagtaaaagccccgcttcggatagctgcagaccacttgaacgcacttgcgttgttgacacagtaatccctttttgagcagcctcagtctgcccggtaaaactcaaaggattcaccagaaatagtgctccgccctgtctgatgcagcttaaaaagcgctctatatgctttccgccaacagcatcaataaccagatcgacgtttttcactacattctcagcggctactttggtgtagtcgataaaatcatccgcacccagttcgcgcataagcacttcatgacgggaagaagcgacggcgatgactctcgcacctttccacttcgcgatctgaacagcaatgtgccctacgcctcctcctgcaccgttaaccaacaccgtccggccttcaagcagaaccggtttatggttgaaagattgaaacggattgggcgcatcatggccgacgtcgacaagaaattgccacgcggtgagcagtgacatcggggcacccgctgcctggatatggtctattccatgaggtttgaacgccacctctgatgcaggaaacgcttacatagtcggcataagctccactaccggccattaccccatcaggaaaacgcaccattgaatagacttcatctccggtgctgaatgcggaaacattttcgcccacggcttcgataactcctgaaacatccgttcccaggattaagggaaagtggggttcgggccgccactcagccggaagcgcccgataaccatcacgcagatacaagtctggtgggttcagacttgcggcatgcacgcgcacaaggacttcgtcagccccgatagttgggcggggtgcatcttcatacctgagattctccgggccaccaaacgcatgtagctgtactgctttcatcatttcagtcatggcaatttcactccaacacagattcaggtgccagaatatgaccaattgtgatgattgataatggggcttgatttcgctttaatattgccatgaaggaacaaataatctttgaaagactaacaggtctgattgcattcgctcgtgcgggatcgctcggcagctttaccgctgccgctcgctcgctggcagtatccccttccgcgataagtaaaagtatccagagactggagcagcgtcttggcatcacattgttcacccgaaccacccgttcgctggtgctgactgctgaaggtcgtgaactgcacgagcgcacgctgcagttattacgcgatgctgaggagcttgagcaggtcgccatgcgatcgcgagaggagccagcgggaacattacgcattgcggcatcgtttccgattggtgttcatgtgatcgcgcccctccttccgcaattctgtgcacttcatcctaaagtgacaatcgacttaaagctgagtgatcgcgtaattagcattgttgacgagagtattgatatagccatccggatcggcgacctcgcagattcaaatcttctgtcgcgtcgactgtcgccctatcagataggttgttatgcttcgccagattatttgacccgatgcccggaacccgaacaccccaatgatcttatcggtcataaaacggttaatttgcgatatcaaaatacggggcagatttttcgctggccgttccgggttggcgagcgggagattgaaattgtgccatcatctgctgtcatcgtcgatgcaagcgaggccgttatcgcggctgtggcggccggtgccggaataggcatggtgtcaagttttatggctgcttcctgggttaagcgcggggagttagtgccccttctcactgatttttcagtagagcggcataatatttctgcggtatggcatgcgagcaggcgttcaaatcctgctgtacgcgcctttattgatctcatgcttaacagttctgaaagctcttaaactgggtattgtcagtaaatccccaaaggtaagttctttccgcatctgacacataacagacatcaacaaccagcagactgattcagttaatgacaggatgtggaatttttatatggcagagataaagccggaagaaacccgcctgcagaggcgctgataagcgtctgcaggcgggattactttatttactgactgacgaagcgctattttcaacgtcgatggttaactcttttttgcggcccatgaccagcacggcaatgccgccgatgccacagaggatagccagtggcaccatagccagcgtatggctgccggtcgcctgattgataatgccataaacgttgaccatcaccccaccgccgatcagattcgccatcgcaccgatagccgccagacccgctgcagcggtagtcgatgacatccatcccgatgccagcgcccagaaaggtcctttcattgagtaggctccgattaataccagcgacaggatcactacactgccggtcagactattggtgataaaggctgacagcaggccacctgcaattaagaacagcgttaacgcggtgtgccagcgacgctcgccgctgcggtcagaacttctcccccagataatcatcagaatggaggccaggccgtagggaatcgcattgactaaaccggtggtgaagttatccagtccaaacgatttaagcagttgcggagaccagacgctcagcgttgagcccgccgcagacgcgcctgcataaatcagcgccatcacccagatatgtttgtgacgcagcaactgccacaaagagatatgacctattgccttcttcttcgcattttcggcttcgagagtgctgttcagccactctttttgttcctgatttaaccagctggcattagtgggacgattgctcagtaaaaagaaggctgcaattcccagaatgaccgccggaataccctccaggataaataaccagtgccagccacgcataccgtaccagccatccagtgacaaaatcagaccagaaatgggcgatccaataaagttcgccgcaggaatggccaccataaaggtagcaatcacgcgtgcacggtactttccggggatccagtaagtcagataaagaatgacgccagggaaaaatccggcctcagcggcacccagtaaaaagcgcaatatatagagtgtattggcactttcaacaaaggcggtacagacagagataataccccacgacaccatgatgcgagagatccaaatctttgcgccaattttctgcatggccagattgctgggtacttcaaacaggaagtaaccgacaaaaaacagactactcgcaaaaccaaataccgctttcgacaaccctaaatcttcgttcatctgcaacgaagccatcccaatgttgccgcgatcgataatggcaatcagataacaaacaatcaggaagggcaaaatgcgccagaccaccttcttaacggtctgctgctcaatatcggcagagaaagtcgtgatgtgctgtttttcagacatgatgatcctcacaattttgtcatcgctttacgtgcaatccgcaaagcgttttgttttactctgtaaaactgtaatgtacttggtaaaaccattatcacgataaaaattctttcccgccggaagatgtaatcaggttgtgttatttgtcacaaaaaagtattcgtcaaccttagtttatgtgacgagtatgtcgttaccgggtggagttcagcgttctttttaatgaagtgacgacagaagaacgggaaagagtgagggggaacagagtaatttgagcgcctttgtcgggaagtgaggccttagcacttgtgtgcagatatcagccagcgtctgagaagtttcgcagctgatgaagcactcgcctgccactgtcggacggccacatcataaaattccctgaccgataacggcgagtttctcctcacagtattcgataacgtcattattcgcggtgttacgatgaaaagagagggatgctatgaaatataaaatttctggcctgaacgccgggcaatttgctcatctttttggacagagcgatgaatatctgaaaaaacaccatgcagtacgacaaacggtagagtgctatccgggttatcccgacagaatctcattgtgcgatatccccgctggagaaagcgccctcctgattaatcacatctatcagcctgccgacacgccctattttggcactcatgcaatctatatatgggagggatgaaccggcaaggcatttacatcaatgaattacctgaagtcctgctaagcagaacgctgtcattaagggcctatgacggaaagcattttttaaaagaagcggatatagctgaggggaaagttgctgaagatctcatcggccatttttttgccgacccgcagattagttatatccagatacataatgcgaaacgggggtgctattcctgctgtgcagaacgttttgaatgacggtttgtattaagaagtcctatccgcaacaggaaattattcgcctccagggtcgctttcgtatcatgaccctgttctgaagagggggctaagaattatgtcagtaatcctgccctttccaatatggcaaaaggagtgcctgtttctggagggtcagacgtcatgaagcgcgatacccttttttatactggcaataaaattatcacggattatatcctcgtggttcgcgttccaggcaatgccaactttccagcttattgactcacctgttaacggaataataaccagctccggcggtgcaatatgcataacactgtatggcacaagggcaacacccgtgcccgcgatgaccagcgcgacaatagtttgtatatcatcactcaattgaatggatgatatgaaaagcgcgttgtcatgaagaaaacggtcaatttgcgcatttaaaccccgtcctcgcccggcatgaagtcgcaacagaggacgtttcttcagccagtcatcagcaggcaatgacggtgaacttgcaggcgcaatcaaaaccaatcgatcggtaaacaatggcaggtaatccagcgctacaggaggcggaaactctgacaaaaccgatctggagctcatcattttgcaaaagttcgtactgctggaaggaaggaagatctgtcaatgacatctctatccccggacactcccgacgaaattctgccatacagcgtggtgcaagataaaaacttgagagaccgaaccccacggctaaatgcccttcaatcccttttgaaacccgctctgcatgatgcataaataatcgggtttgcctgaccactttttcagcctctggcagcagacgcctgccaccgcccgtgagtgtggctccatgacgcccccgcgaaaacagtgacgtttccaccagggactcaaggagattaatctgcttggtcaatgcaggttgcgaaataaacaacgcccgtgccgcgtcggcataatttcttttttcagccagcatcaaaaaggccttaagcaagcggatgttcattttttacattccaaaaggttatcgaaaccggaaatgttttgattatacagttatcagcaatggttatgtaattcagtttcgattactaccggagaagtaccatgagcaaccatacatccttaaaagctgccaccgtgcaatttcagcatcaggcaaataacaaaaattataatctgctgataatggagaaatttattgaacaggcagcgattgagcaggtgaaaatcctcacattcccggaaatgtgtattaccggctactggcatgtactcaaactcacctcggctgaggtaactgctctcgccgagccgatcgaggggagtccttcccttacattgattcgttccctggcgatgaaacatcaaatgctgattggcgccgggcttatcgaaagagccgatgatggccgcctctataatgcatatgttgcctgtatgccggacggatcaatgcacactcatcgcaaactccacgcttttgaacatccgtcaatcagcagcggtgaccgctttaccgtttttgaaacgccctggggagtaaaagtaggtatcctcatttgctgggacaataatctggtagaaaatgtgcgtgcaacggcattgctgggtgcagatattcttctcgcgccacatcagacaggcggtaccgattcccgcagtccttatgcgatgaaacccattccgctgacgctctgggcggaacgggaaacgcgaagggaggaaattactgctgcattcaaaggggcaaatggtcgggaatggctgatgaggtggctacccgctcgtgcgcatgacaacggcttatttattctcttcagtaacggcgtaggtgcagatgatgatgaggtgcgcacaggtaatgcaatgatcctggatccctatggaagaatcattaatgaaacctgggcagcggaagattttatggtgagcgctgaccttgatttgagtctgcttgcaatgagtacaggacgtcgctggatccatggtcgccgtcctgatttataccatattctgacacaaccgcagggctacgaacgtgatgcgattagcgcccgattttctgatgagacgccttaaataggctcggcgactgaaatcatccagtcgcgagaaagattgtcagggcgcggcatcgtgaaaaccctgccctgacattaaagcttaaactacgccggcaaatcccggtacaacggttatcgtcacggtaaagcatggactttatggctgggggaagattgatggcataatttcatgtaaataagcgtctctttttaagctgactttggctgaagagaggctatgaattaaagtttaagctgctggctgctccgttttgaaaggcactattggtcgttatcaacaatcaagtcatcacaaatactcgtgttgttaaagcagaaaaatgaggagagtcagcaagcttgctaacgctatgccgcttttaacttgtgtaagatcatgccggatatcagttttgtgcgctgaatcacgcaggtagcgtgcctgatcattaaatccgctctatgcggaattgataatcagtcactgggcatcccgtcagcaatagactactcagagattttcttaataggataactaacgagtggtttgatctctttaagcacaaacatactctgcatttctttaattcctggcaatctgcgtaccactgacattgcaaaatcagcataggagtccagatctgaagccacaacctgtagcagaaagtcagcatccccaccgatgctataacaggcaaccacatcctccagggcagtcacttcctcttcaaattttctggcctccgcttcgctatggctgtcaatgacgacccgaatgaaaaccattactcccagcccaattttcttgcggtcaagaacagcacgatagccctgaatcactttatcttcctcgagcttacgaaactttgcgccagcagggagatgctgaaatgtttatcttctccgccagcacctggttagttacccgggcatcgtcctgtaaaatttcgagaattttcatatctgtcgaactgagcgtcataaggggaaattcctttctttatggaggcggtttagggttacttttacctaaaaacaggcgttaagtaaataatataggtaacaattttccgctttcatgctgcataatatctttacttttccagcctgttattacaaacaatataaggaaaaactgaaccctgatttaatgcatatggttcaatttaatttaaagaatgcagggagctgatcatctcttgaagagaggatcggatagagcactgcgcgcacatgaaaattaaacttgtcatctgcgtagttaaattaatgcagcaatatccgctttggaataatcgaacctccactttcaacgttaaaccaactgataaaaaggatgcatatctttaacccttaattaagctttttatatgacaaccatcgctcagaaccaggcatttttgaacaactaactctgttcccttttaccgaagtgcatttcaacaggaataactatgtcaggaactactgaaatactatcttatattgctgcactcggtttagctgctgcaattccgggtccggggatgactgcattagtcgctcgcagcgtgagtgggggcgcaataacaggctttacgatgctggccggtctcattctcggagatttgatttatttatctgtggcggtatttggtctggcggtgatcgctcatacctttacctctctctttacgctgattaactgggctgcctcactctttttatgcctgctggcatggcagttttctggtgccaccagcctcaggcaataaatatcgatcaaaaagcgacaaaacgagaactggcatcagcctggttttcaggactgaccataacgctgagcaaccctaaaaccatcgctttctatctggctatactgcctctggttatctctctcgataatgtatcttttcagatgtggggaggactgctggttccgcttaccgtgttagtccttttgagtgtgggagccgtttttatttttgcagccctcagaatacgccatctcctgaccagcgctaaagcgcaacgactccttttccgttcagccggtaccatcatgatgctggccgcggctggaatggtggtaaagactctttagcgttcattaccacctcctctgcctcaggaaaagggggccggtctcgtggtcttgatagaaaatgatcaagctctggcctgtttatcaggcaataagcaataaatagtaaaagggattccagccagaaaagcctgagcgtcaaaagcagctatcttctgatagctgcttttttgcctttcagatatcccattttttactgcttatgttcctgcttcaacgtttcctgactatccaccaggaccgcattagcggctaaccctgtacttcacatctataattcagtgactcaggcccatgcgcccgatccggctagccgattaatcagtttgggggtggctggacgtcgtagtgtcagcgatacatcaaaattcactttcccgatgataccggccgggtttaagacgctcatcatttacagaaataaggatgcctcatgatcttttctctcaaaaatcaggttgcgctggttaccggtgccagctcgggtctcggctatgcctgcgcagaagcactcgctaaagaaggggcctgtgtagtgattaactaccatagccaggcggaaccggccgaggagctggctgagaaaatccgcgccgatggaggccgtgcaattgctgtcaaaggagacgtgtcgaaagaggcggatgtagagaatctttttgaccagacgatcagggaatttggcaggctggatatcctggtggcgaactcaggactgcagaaagatgccccgtccattgagatgacgctagaggactggaataccgttctggacgtgaacctgactggccagttcctctgcgcgcgcgctgcgctgcggcagttcaagcggcaggagcatcgccaggacatcagcaaagctgtcggtaagattattcatatgagttcggttcaccagctcattccctgggccggacacgtcaactatgccgcatcaaaaggcggcgttgacttgctgatgaaaacgctggctcaggaagtgggtgaagaacgtattcgtgtcaatgcagtggcacccggcgctatcgctaccgccatcaacgaggaaagcacccagggtgaagcgggcaaagcgctgttaaagctcattccttatggacgtatcggtgcggctgaagatgtggcgaatgccgtcgtctggcttgccagtgatctctctgattacgttcatggcaccacgctttttatcgatggtggaatgagcctttatcccggattccgcgacaacggctgagtgatgcgtcactgtcccaggtggatggccgactgattgatagcgcgttgatggaaatggtatccggaacgggaagtccggattacgcattcccgccgttcataataaaacgccagcgggctggtgcgttcagtccaggccgcaacggcttcagtaaggttgaacggcaagagcatcgattcaatctttacagtcattcgggctgagcagacgcgtacggcagacctccagaatttcatcagcaagcccggaattatccgggcaggcacgcgaaagcatcagggcacccacaagctgcgcgagcgtattgatgagatccgcacgcgtgacctgttccgtttctaaaacggcaagctgtcgttcaattccggccgcaaaggtctcgcggatggattcagactggcgcgctgcatcggtgcccaaagccgacatgacacacccctttgccatatcatcgcgatgctggcgggaaaggtaatattcaacgaacttttcccgactcacaccctgagttttttccgccgattgcgcgaagccgcagctcatcgcttcggctaacaaatcggctttcgacccaaagtgcttatagaacccgccatgcgttaaccctgcggctgacatcagttcagcgacgcctaccccatcgtaaccccgctcacgaaaaagttctgacgccgtttcaacgattcggttcctgttttcgcgaacctgctcttttgacactttcatcttttcctcctgaaactgagcttaagtatacattgatgatgatcataatcaaaccagttgactttaatgattacgatcatcatcattaaatcagttaactgacccgctaatccgcaaaggaataaccatgacgaatcaatccttatttcagccctatgaactgggatctgtcacgcttgcgaatcgcatcgtgatggctccgctgacgcgtaaccgggcaggcgcaggcttggtgccaggtgaactggcagcgacttactacgctcagcgtgccacagcagggttactgattaccgaggccacccagatttcagcagaggcgcagggctatcaggatacgccggggatctacacgcaggcccagattgagggctggcgtaaagtcacagacgcggtacatgacaaaggcggacggatatttgtgcagttgtggcacacaggtcgaatttcacatgtcgatttacagccagaaggtgccgcaccaggcgcgccgtcagctatccgtgctgaaaccaaaaccttcgtgaacaaccattttgttgatgtttcagaacccagagcgcttgagctgaaggaaataaaaggcattgttgccgatttcagaaaggcatcagccaatgctattaccgcaggttttgatggtgtagagatacacggtgcgaatggctatctgcttgagcagttcctgaaagatggtgctaatcagcgcaccgatgaatatggcggttcagttgagaatcgtgcgcgtgtgctattagaggtcgtggaggccgtgaaagatgagatcggcgcagcgcggacgggcgttcgcatctcaccggtctcacctgctaatgcgatttcatgcagcgatccgcagcaacaatatgactacctggcagagcaacttgatgcttcaggtatcgtttatctgcatgttgttgaaggcgcgacgggaggtccccgtgatgcctcaccgtttgattacgcttcgctgcgtcgccgctttaaaaacacctacatcggtaacaatggctatgacctggcgctggcgtctgaccatcttgcacaggacaaagccgatttgttcgcattcggtcgccccttcatttctaaccccgattttgtcgaaagacttaagtcgggagcgcctctggccccgcttaatcctgaaacactgtatggcggaggtgcggagggctacaccgactatccatcgcttagcggtaacagttaattactcttcaggtatcacggttaaccctgcttcgctaacagcgatttttatcaaacaaatgaagaagataaaattatgactcgtacttcagtcctcattacaggcgcatcaacgggtattggtgctgtttacgctgagcgctttgcacgtcgtggacatgaccttgttctggttgctcgcgacaaattgaaattagaggcgcttgctgaacggctgcgacaggaaaatcatatttccgtcgatgtgctgcctgccgacctcacgctggcgagtgatttaactgctgttgaagcacgcctccgggaagacacgcggataggtattcttatcaataacgcaggtatcgctcagtccggcacgtttaccgagcagacgcctgattccattgaacgccttatcgcgcttaacgtcactgccctgacaagactggccactgctgctgcaggccggttcgcagaagccggagaaggttcgatcgtcaatatcagttccgtagtgggtctcgccccggaatttgcaatgacggtttacggcgcaacaaaagcctttgttcttttcctctctcagggaatgaacgttgagctctcttcaaaaggcatttatatccaggcggtgctccctgcaggtacgtacaccgaaatctgggatcgtgccggtatcgacatcagtaacgcctcaaaaatgatggaagtgggcgaactggttgacgccgctctggcgggttttgaccgccgcgaacacgtgacgattccgccattacataaagctgatcgctgggatgttcttgatgcctcccgtcagggtctgctctcggacatccgacaggaagaggccgcagagcgatacaaaaccctttagctaagccctgctcagcagaaccttttacagggttctgctgagcggtaaatcgaccaagaatgtcttaatggcggcatgagcatattaaccggcaaaaccttattccattatttattacgttgctccccggagccgcttttttgctcagcaacagaggcacctgaaagtacgtcagtgctaaacatcagaggataaacaccaaatgaaaaccaggacgatgcgagcctttacgtttaaacgctacgggaagtcacctgagctgggatttgaaaatgtagattacccttcccccggtgccgatgaaatcctggtaaaagtctatgccgttggtctcaatcccattgataacatgatccccggcggaattttcaaaccgattatgcattttaaacttccggcaacgctgggcagtgatttgtcaggcgtggtgattgcaacaggaagtcgggtgacacgtttcaagccgggcgatgaagtcttcgccagcattttcgacaggggaacaggttcactcgccgattttgcatgcgttcctgaacgtctcgcggctattaagcctgaaaatctggatttcattgaggctgcttcgttgccgatggttagcctcaccgcctggcaggcgtttacagagagagcacatctgcgggcaggacaaaaagtgtttattccggcaggttcgggaggaattggcactattgcgattcagctggcgaaacatcttggcgccagggtagcgacgacgaccagttcagccaacgtggagtgggtgagtcggctgggcgcagatgaagttgttgactataaaaagcaggaatttgaaaccgtgctgagtggctacgatcttgtactcggcacgctgcggggggattcaattgaaaaatccatgcagattcttaaacctggtggaaagattgtttctctggtcggtccattagacgttaatttcgcacgagcccggcagctgaatatcttcctgcggatgatttttgccctgatgagtcgcaaaattatgcgcctttcaaaaaagcgcggtctggattattcatttctctttgttcgttctgatggcaatcaactcacccaaatcggcaaacttattgaagcaggacatatcaaaccggtaatcgacagggtgttcccatttgcagacacaaaagatgccctggcttaccttgaacagggacatgcaaagggtaaagtcgtggttaaaattcatcaggaataacaaccagatctgaagtgagaaataatcattaagccttgtggtagcgtctgaagccaggatgcctgacctgctaactaagcatctgcttcccagaccccgctgtcgttatgcactctgtggtaatgttaacgtcacacggtttttgctctgaggattgcgacatgtctcccttttatcaactcactgccaccagtctgaatggccagcttattccgatggccgactacgctgacaaggtggttctggtggttaataccgccagccattgtggattcacgccacaatacgcaggtcttgaatcgctctataaaaagtacgccgcgcaggggctggtggtgctgggttttccctgcaaccagttcgggaagcaggaacccggcggtgccgaagaaatcgcgcagacatgccacatcaactatggtgtgagttttccgatgttcgggaaagttgaagtcaatggcacctcaacgcacccgattttccgttacctgaaagatgaattacccggcgtgctgggtggtcgtattaagtggaacttcactaagttcctgatcgggcgcgacggaaaaccgatcaaacgctttgccccgaccaccaccccggagaaaatggaatccgccattcttgctgctctttaagtgaggtgttttaccatctcactgtcaatgacgggattaccagtaaactgtttctttccgctccatctggcagcgcctgtaactcatcgacgtctgttcagggccagaagcggacgttactcactgtgagaagctgaacgcatagcagcgctatgcccggttttgtcagtcagtccggatataaccgccagaatcagcgctataaccgagagtatcgcgcctgcccagtcaggcgactgaagaccaaagccggccgctataactgcccctcccagccatgcacccagagcattaccgagattgaagagacctatgttaacggctgcagccagcgtcggagcccctgccgcccgcgctttgtccatcaccagtttctggatgggggacacggtcgcaaacccaaacgcagccatcagaaaaatacagaccgctgacatgacctggctgtgggcagtaaagttaaataccagcaggactacggcctgagcggccagggtgacgtaaagcatcggcatcagcgcgcgatcggcatatctgccgcccagctgattaccgacaaatagccccagaccgaacagcagcatcagccatgccaggctgctttcgctgtatccagccagcccgatcatcatgggtgcgatataggtaatggaggtaaaaaatgcacccggcccaaagaccgttatgcccatcgccagcagaacattgacgttgcggaaggcattaaactcgtgtgcgaaattatggttctccggacggggctgatgcgggataagcataccgacgctaataaccgtaacaactccaattgcggcaataaccataaaagcatctcgccaggaaagatgctgcccgatccaggtaccgacgggaacaccaataagatttgctacggtcagtcccatgaacatgaatgcaatcgcccttacccgcttagacggcgcaaccatatcggcagcaatgatcgaaccaataccgaagaaggcgccgtgagtcagcgacgtgatgatcctgcccagaatggcaatgcccagcgtgggcgcaaaggccgtaacgaggttacccgccacaaacagcagcatcaggaaaaccagcatggcttttcggggcacttttgagcccagaataatcagggccggcgcgccgacaaaaacacccagcgcataagccgttgccagatttccggccacgggaatagtaacgttgaaatcagcggcaataacgggaagcaggccggcaatgatgaattcagtcgtaccgataccgaatgcaccaatcgccagcgcccagagagcaagtggcataacaaatatcctgtcagttaacctatttttttgtctgagctgcgcataacacgtgccggctttcgtttagagaaccggcacatgacacggtgatggcagcaggacagaaaggatataagcttgcttagagttgataaacagccctgaaatcgcctgagaggtgacaaaaattctacttaagagtgccaaagtatcctttttcggctttactcagcagttcatcgacaataagcctgaccttggggatcagatgccttgtccggggccagacaacgttcagcccgacgggtacgggcatatgatcgggcataacagcaacaagcctgccctcatcaatatggctgttcaccatcgattccggaaactgggcaatacctgctcctgcgaggcaggcctgaagcatggcgtctccgtcgcttatctggtgtgccgaggccgagataaactttaattcccgctccccggctggccgcagccgccaggcaagcggcgccccccgccggtaccccataatgcagcagtgtttttttagcgcatcgacatcaaagggctgaccatgccgctcaacataagcgggagatgcgcagagcatgaggcgctgccggctcagacgacgcgcaatcagctcatcggtactctgcagttcgcccaggcgcagtaccaggtcaacgccctcctcaaccggatcaatcagacggtcgttaaaggtcaacaccagacgcagggctggataacgattcatcacttcaagcagcaccggcatcatcagattgcgtccgaatgatgctggcatgtctatacgcaccgttccggcaggattgtcctgccgccggctgagcgtattttcagccgagtccagaatttccagcgcagagaggcaactggtgagataggcctctccgtcgctggtcaggcttagcttacgggttgagcggtgaaacagccgcgtttcccagcctctcctcaagccgcgccacgctttttccgacggcagattttgtaatgcccaactgctccgcagcttcagtaaagctgctggacctggccgttgtgacaaaagtcgtgattcctcgcaaggattccgctgtaaaaccggtagacataaagttgactctctggcgactcatagcgtgtttatcgatgtgtaattctataccaggcttaagtcagttcgaaaacaaagtgccggcacctgtcggcgtatccatcttaaaaacacggggagcagtcatgtcacagacaagacctttgaaatttgtctcactgctgggcagtcttcgcgcggaatcttttaacgccgtcgtagcccgcaatcttagcctgctggcgccggcaggcgtggatgtcagcgcgctcagctctgtcggagaaataccgcattacgacgctgacctgcaggctcaggggtttcctgaatcggttgtggaaatgggacaagcgatagcggcagcagacggcctgattattgtcacacctgaatataactattctgtgccgggtgccctgaaaaatgcgctggactggctttcacgtcttccggatacccctgttgccggtaagcccgtcgccataatcactgcgtcacccggtgccataggtggtgcaagggcgcagtatcacctgcgccagattctggtctttctcgacggcagagtgcttaacaagccagaggtcatgattggacaggcctcatcccggcttgatccaaaatccggccacataacggatgcggacacccgtgaccatatttcggctcagcttagtgcgctcgcgacaatggcggcccgccagggctgattaataacattactcacatctgaacaaccacagggagaaaactatgtctaccaacgttattcgcggtatggaccatgtcggcattaccgtttctgatattgatgaggctacccgcttcttttctgacgcctttggtgcagaagttatttatgactccgtctcgccttcagacgatgacgtaaaaggcgaagaaacggaaaatattctgaacctgttcccgggaacgaaaattaccacggtcagaatgatgaagctgaagcacggcccgggactggaactttttgaaatgaaggggccagagcaaagtcagcccgtgcgacccagtgattatggcctgcagcattttgctgtttacgttgatgacatcaacgaggctatcagcctgttcgagcaggctggcgggaaaatgtttacttctcctcagcccctgatgtttccaactgaggtgggagagaataactttttctgctacggccgcacgccgtggggtagcgtcattgaactgatttctttgccttcaaagctgccgtatgaagaccatacctctctgcgccgctggaagccctgagtgtaaccgggtgcgccagcgcaggcgtacccgtaaatactaaacgtccgctcctcgctcatagctgacttgcccacgaataatctccgactcataccctcgtacaagacagttgcttgcagctggagtagcgggtttccaggcggcccctataacgccgccccggcacgtatcacatacatgtccgagagggcccacttctggtttcactatgaatgttgacacctgcaacaccctgctcccaagcgtgtgaaaatcatccctgaaaccgattaaggttcacaagttgtcgcagcatctcgatatgaatcggtttatcattaagcgccggtatgtaagtaaacgatgtaccacccgcatgcataaaaatctccctgttctgctcatcaagctcctcaagcgtttctaaacagtctgatgcgaaccccgggctgatgacatgcaggctttttattccttcattcggtaggtttttaattgtctcatcagtaaaaggcgttaaccatggctctctgccgaatcttgactggaacgtcatcaatattttcaatgacggcatattgattgcttcaatgagtaattttgtcgttaactcacatctttcctggtatcggtccccctctttgacaaaccttaccggtataccatgatatgaaattaacaatgcatctggaacgccgttagcttcgaaagatgcctgaacggatgctcttaacgcttcaatgtaggcagggtgatcggcatagtcattgatgaaatttatggagggtgtataccggttcttcattatctgcaggtgacggctcacgctatcccaaacagaagaaacggtcgaagatgaaaactgtggatacaaaggaatgacgataattttatcgacgcctttttccagtagcctgtcaattgcaccacctatactcggctcgccataactcatccccagctcgacgggcatacctgtcacttcttcaagcgcacgggcttgcctgacgctgtaaaccatgagaggggagccttcctccatccaaatcgaagaatataatttcgccactcgccttgcacgtaatgggataatcacgccatgtagaatggggcaccaaatgattcttggtaagtcgaccactctgtagtcatgcagaaatttagataaaaatttctttaccgcaacaggcgttggttcttttggtgttccaaggttaacaatcaaaacaccctgtttattcgtcatcaggtgggaccctcaaagccattgtcactaactcactcatgccagtcactccgtagcagcttgtcttaaaggcctcaatttgacctcattttgtagaaataattgaaatgcagattgactgtttcacggcttatgatgctatgaatctgattgcagccatcgtttttactcaatgatcatgattttaggacatatcatcagtgaaaacattactttctcaatcgtcagatttaaccggtgtggggctacgcgacgtcatcattgaagtcggggtgtggaggagttagctggaggaggtgagaaaaccgtatctggatgcccgtgcagatgcatgccttaggcttgatctttttatgcgtataagtgatgaaggcgactgacctgctccctgttaatccttacagcacgcttttagcaatgtctgttactcgctcaaagcggactgacacgcatcaacagcttaccactgcttttaccaggctggacgacgttgcctgaactcgtttcggatatcgtcgtcagcaggcgagccgcgcagcggtgcgagagcagaatttaatagttacaatatactaatgcgatttaataacaggcgcaggattaggccggcgaaccggcctgaggcattatcagatggcgcaataaacgcgcgcttcacgtggcgtgtagataccaaacgtcaccacgctcagtaagccattaacaaacgtctgctgcacttcaacccggttaactttttcctggccgccgcacacctgcgccgcatcaatgctcttacgctgaccgatacctgaaacaaagaaacggctggctggtggttttcgtcgccgcgccaacttgattctgtttcattacgaaagtctgctgcgcacagccggttaaactcagagccaacaacgccgcaacacaaagcttgttcataaatatccttatcgcctgaaatgaaaaaaatgctgagtgaaatcatcactcaaccagcaatcaggttatcgacaacgaaagcggaaacatgagaaaaatttttaagtacccctaacggatacgttttgctgaatagtacagcaataaaaaaagcccctgcacagcaggagctttttatgtttaccgcagcgtttccgcttagcgagtcaaatcgtagaagaactttttgacgccatcgagaaagctttttgaatgcggactgttcttctcgcccgccgcaccaccaaagctctattccggcttacgcagcagcgacttatgcttctcgctcatagcggaccctgggctgccgtcagtccgctttgtgccagaagcggatgttaataacattttttggtataaaaaattgatatcatttttattacgtgttattaaaaataatatgtgtttactacccacttttcgtctatttgtgaacgaaataaaattttcgctaaaacatttttgtaaaaaaacaaactattttgttgaaagtaagttaagcagtgatggcagaaaaacggaatttatttttcatacgttatttaatctaaccagagccctacgataaaggaaaaaatgaatggcaagcaaagctaaccttgttaatttggatgcgatgatttcaagagaagatttctctgctcaatccgacaacgatttatctttcgaatctatacaaaacatagcgatgagagatatcggcatgttatctggtttactcagaaaaccagattttcagagggaaacaaatcactggactccagaacaagtagtatcattgctaaagagttttgttacaggtgatttaataccatccgtgattttatgaaagagttcttttgtgtttgttatagacggtggacataggcttagtgtcttaagagcatggaaagaaaatgactatggtgatggcactatatcgcagaaattctttgggaacagtatttccggagaacaaagaaagatcgcacagaagacaagagaattggttgactccacagttggtaaatggtctgagatagaaaggaaaatgcaggattctaataatgaccatgatgagagtagaaggcttacaaatatttacgtaagagctttgcaagtccagtgggttaaaggtgattctgataaggcagaaacgtcatttttcaatataaataaaaaagggactcctttagatgaggttgaggaaactttacttcgacataggaagaaacctatatccattgcagctagagcaataatacgcgcaggaaaaggacatagatactggtcctctttccctgaggataaaactaaaaagatagagcaactctcctcaaatataaactcctctcttttcgacccagacgttaaatctcaaatcaaaacactcgacctacctctgggtggctcacgcggcgtgaggttggctcttgatatcctaatagatcttatgtctatttccgtgtcccagagcgaaaattatcaaaaagaattgcttaatcaagtcgaagattcagatggcagtgaaacagttattgttttggaaaaaaccacaaaattactaaattggattactggaaatgacaagggcagtttaggattacatccggccgtatatttttatagtgcatcaggaagacatgttaaccctatgtttttagggacaactctgttgatagcgaaaaaattaaaatttaatgacaaggatttcttcaaaagattcacaaccattaggtttaatctagaaaaaacactaataaataataagccaatgctagcatcgttagtgaatagagcaggacataagaaaagaactgaatattactctaatttatttgagtcaatgattgatttccttcttgaggtgaaaaagaaacgcaagggtatgagtgatttcagccttatagaaagtgaaatactccagcttgctcactttgaaggtaatatactgtctgggacaagtgtcagtaatgcaactaaaattagtgaggaagcgaagaattctgtattcattgatactgcattagcttcagcaattacatgccctatctgtaggggatatttagatccttcaaaatctgtctcgtatgatcacatcaaaagagttgcagatggtggtaaaggttcggcaaaaaatactcagttaactcacccgtattgcaatatgtctgtcaaaaattagcagtgagtaaaatttttatcaaataacagccttctatagttgaaggcttttcgcatgattctttctccaagaggaatgttgtgtatgatggaagaattctaataatgaattgttatataactccgtaggcttaccgttctacacaaaacgttgtgtccgatcctcgctcatggctgactttaaaacttacatgaaagctttcgatgtccacggacatcaaatttttcatctgtaagtctttcaaccacctccaatacgtctggattgccatgccaggccatgcaacttaaacagtctcagccacagtcaaaattcaatatgtctggtgtctcactcagtggctgattacaggtctggcaattgttttctttcactggaagtggcatccgtttttagatcttcatttctatgttacctaacatatcatcctaaagtccgtttctcgctcatagcggaccatggggccgcgtcagtcagctttgtgccagaatcggacgcttgctttcacggcttacacggttgcttaccacgatatcatatcgcacttactgaattcagtatttggaacaatgagcgccatatggttttctgccatgcactgtttaaaaacctgctctttgtaacgccccacctgtaaacccagcatggtgctggaccgtttccgctgcgtttttttcaacgtaatagccgcaaatttccttaaaatactttggattatcgctataagtcaccggccatctcagctgagcttcaactgattcatctgattgatgctgggggaccgcttttgctgttttagagccagaaaagagtggatttcccagtaatttctgtgcaaagcgttggttttcaccggttatatggccggttttacacagctgcaaataggcctgcgaaaggcgttgctcttcagcatcggcagtatgggtgcattcctccagaacctgttcattggtcttagccggttttttttcagtggatctccagtaactatttttaaagtccggaaccgtgccttcagtggtgccaaaagggcaaagtgcactggcgcaacccagtaaaagcattggcacacacgtcaacgtcagaacacgtaacaggggaaacgctttaagactgcttttgttcattttattttcactttagtcagctgcagatatggggtctgaacaatgccattttttagtgtacatagtgcagatgatactcggtctgctgcacaaggtattctaaactcagtgtttctggtgctgtactcatcggctggccacaagtctaaaaattactcattttcattggaagcaaatccttattatattttccacaccatgctgcctgacataccccttggtggtccgcttttcgctcaaagcgaacatcaatagagttgcatatcacggaaccggcagaagcactcatcctttcccaatggagatacatacactcactcaggcgtaatctttcataagaaataaagtttctgataagcgaaccgataaaagctatgcctgtcggtatgattgcctctgtcactgacagcgtttgtgcttttagaagtggttcccggctttgcttcccctgtgccgggattttttatttctgtcaccagacctgccggagaaacaccggtttaatcttcaaaaaatcatcacagcatgaataggtaagtgcatcgatatgcattccctgtagtccaacattttgcgcaagccgcatacagcaataacccccaactgcctctgaatgaccctacaaaaataaaagataagcattaatccacatgtaaagctctattaattaaacgttatttcagctaggaaccttatgaacaacatcagaatcggcacgcggcttggcgctgcgtttgccttcatccttcttcttctggttatcgttgcgtttaccggatttacccgcattcagtctctgggagagacggcggatacgcttgcaggcagccgctatcagaaggcctcgactgcaaccaatctgcgttactattcaactgaccttagccggctggtccgtaacgttgtcctggcggatgcacctgaccggaaggccgtctttaaaaaagattatgacagggtacatgataaaattaccgctacggttgatcaggttgatgccctgctgaaggcacccaaaagccgggagctgattgcgcaaatcaggagcaccggcagtcagtatcttgccttttctgatgacgttgtcgcgctgggaatggcaggcaagcgggacgaggccgcacaacttcttcttggtccgcgctaccagacccaggttgactatctgaaaactattgcagacctggtatcttttcaggaacaacagatgcaaacggcgcgtagtgctgctgaagatgaacaacatgcggccaccattctgctgacttcgctgagtgctgccgcaattctgcttgccgtcgccgcagcctggctcatcacccgcagcattacccgcccactgagcataacgcttgccgccgcacaacgcatcgcacgcggagacctgagtcaggccgtccctgtcagcggacgggatgaaaccggtatgctgctcaccgcagttgctgagatgcaggactcgctggcgcagacggtcagcacagtacgccggaatgccgagagcgttgccgcagccagcctgcagattgcgcaggggaacacagacctgtctcagcgcaccgaggagcaggccagtgcactggagcagaccgctgctaccatgagcgagctcagcgtcacagtcaaaaacaatgccgacaatgcccgtcaggcggcacagcttgctgttaacgtgagagaggtcgcccgtcagggcagcgaggtgacttccgacattttcggaaccatgaaatctatcggcgaaagttctggccggattgcggacatcacatcggtgattgacagcattgccttccagaccaacatactggcccttaatgcggcggtagaggcggcgcgtgcgggtgagcaggggcgtggttttgccgtcgtcgccggtgaggtgcgcacgctggctagccgcagcgccacagcagccggtgagatccgtcagctgattgaggcaaactctgcaagcgtaagtgcaggcagcaccctggcgagccggtctgtgaccacgatggcggatatagtgtcatcggtcggtcagttaagtgataccgttgaggaaattactgctgcaagtgccgaacaggcccgcggtattgagcaggtcggcatcgccgtaacggagatggatggtgtgacgcagcagaatgcgtcacttgtcgaggaatcagcttcagcctcgcagagcctgcgcgaacaggcatccctgctgctgcagtcggtgtcggtgttcacgcttgctgcagtctctcatcctgcagccacccggcatgcaattgtatctgtaccagccgtagtgaagaaagatgcgcctgctgatacagacggaaactggacgaccttctgatatctggctgcgtcctgcagagcgcagcctctctccttttccgtattgactcttaagaatgtccgctttgtgccagaagcggacatcaatgcatccttaagagatgacaaaacctgattagcgattatttatttcctgagcctttaagaaagcggggcgactcgttgctcttgatatgtagctatcaagctcttcggtgatttccaatccgcacagttttgcccataacaacgtatgagaaagaaaaatatcggccagtgtaaagttgttactcgcaatccatgtttgagttgggttaaacctaatctgagagataactttatctgcttccttactgaggtaattcattaaatctggggaacgttgattttcgggagtgaagacaacatgtttgagcagactccagacgggggcttccagatcggatagcgtgaagcttaaccacgaattaacggaggatttttcttcagcagttgcgggataaatagagatgtttttatgttgttcacacaggtaaatacagatcgctaaggtttcactgattgacacttcaccatcggtcaaaaaaggaacttttcccaatggatggggtgatttaacctcagaagcagggttcaaaagatcgactctgatagactcgtaattcactcccatttcttcaagagcccagagtactcttaatgatcggcttttggggtaagtatagatcttcatttcaatatccctttgttgtgaaaacaattttataaggcaagtgggtagctcatgtcaaaatttctgctcctcgctcataccgaatcttggcctgcatttagtccgctttgtgccagaagcggacgttgctgagtctgcattccattaattatgaggagcagttcagagtcagcaatctggatactgaaactaaaaatgcatgcctttaatgaaccgggtggttctgttaacatgagtctgtttacagggagaaaccacatgcgaacactgactgaaaagaaacgaactgacatccttaacgccgccacgaccgtctttctcgagcagggttacgaaacgcgcatccatggatgctgtggccagagcagcagagtgctccaaagccacgctctataactatttctcctccaaggaaagccttcttgacgccgtcgtcagggcctacggcaccaattttctgacgcgcgcggcggacgatatttacagtcaggacagtcgtcatttgcccctggctgaaaggctgcagcgctttggtgagggcatgctgggtgcaatgacatcggactggaaggggctccagctgtatcgcatggttatcggagaggccggacattccggcatcggcgatattttttatgagtccggtgtccgcgaaagcatgaacgctctggcagcgctgatgaaacagcatatcgaggctggtgaccttgttcccgcccgcccagaccttagggcgaaacagttttctgcgctggtaaaggccgaggctgatgagctctttctccggtacaagatgccggtttatacacacgaagatatcatcgcgatggtgaaaagcgctgtagagatatttatatcgggtgcatcaccacgctgacctgacgagcagagacggattactcaccataagcagttgactactctccgggtgcatataaactgatacgtacagtttacttatagggaggttatatcaatgctaaatcgttttattttggtggtaggcctgaccgtgtgttcgcttctgctgagtggctgcgtttctttattctgaggaggtaatatgcgtcttttttacagcctcattaccggcatgaccgtattgatgctcaccgggtgtctttccatcaacagccacatctgaactttaccagcccgccttcaggcgggcaattttctgataccgcctgtgcacggctaaaatgatacctccgacagcatgaccacaatcagggtgcttatggccatagccaccataatttctgcaacaagcagcgtcattaacgagttctggtggactccccaggccccctctgtatattttcttccgcggcgggctttcaggcgccggatatgaacgatttcttttacgttaatgatgacgtgccaccacataattatgacggtcaccgcgagagcaccaaataaaatcaggatgctccagtccatccaggaacccccgccgttaatcactgacagtttcttcatcattgtattctctttcatgtaaagtcttccattgtgggattctgaaaacacgaatccctttgagccgggacagatgctgcaggattttcaccagagggtgacatcgctgagcatcagtagcagcagcacagaaagcgcattcacaatgaggcattcagccaccagaaatatttgcaccggccctgatgaggccccccacaccctgacggcatagtatccggcccggcgctgcccgaaccggcgtagacggcccagttcagagagattaccggcggttctgaggagggtacctgccacgatcagtaacatgaccccgtatacgaaccattgccgcgccgacgtgttttccagcgcaccggccatcagccagccattcatcagctgacctgggcgtcaaatgcagtgagaatgccgccggcaataaacacaagcgccagaaacggtcctgataagcagcaccttcatgctcctgcacctgccgcatacagcagcagaaaatcagttgttctgcgcctcacttctttacggagcagcggcttatccagctgaaggccagccatcaggctccgtaactcctccgtctgcttcaggtaggcatgagccatttcgccagagggccggcagcgcaactctccacgcagcattgccgtatcaataacgctccgcgcatagtccgctgccggtgtaaaggcgtctcgtcccgggctgtcagggctgatcctggcttcgccatatttttgcagcgtcagcatcattcttatcagcctgcgccgcactggcagaccggaatagcggagcggcaggctcaggataatacagtagcgctcagcacccacttcccgcatcgcctccggcctgccctccctcagtaccggcgcgatggtcagccgagaacggagcctgcacgtgatgcctgacgacgaaacttccgggtttaaataaagcattccgcactcctcatgtgaaagttaccgacacgcgatgaaacattttcttgacagtgtcaggataaaccatattaactataccgtacagttcattatatcaaaaagtaaccggagaatatttatgattcgcctcactaaacagctgtcccgctcgcttatcctgatcgccgtcattgccgccgcgggatgttcgtccacgtcaccggtaaaatattccggcattcaggccacgtcccggatgacgcccaacacagctgatgacagcgaccggatcccctttcgctacaccgccccggttgacttgagcaaataccgcagcatcactatcgatcccgttgaaatctatggcggcagcgacgcacagtttaatgacctgtctcaggaagaccgacgcaatctggcagattacatgcagaagaagtttgccgacgtgctgcgggagaagtttactgtcatcaacagcgccgggaacaccccttctctccggcttaagctgacgctgaccggcgcggacaccacgccacaggttgtgggaacctttacgaaattcgacctggcaggcggcccttataatatcgttcagtctgttcgaggcgggcgcggactgatgagcggttacgtcaactatgccgtagaagtgaaagatgccgcaaccggtgaactcctgctggcctacgtggcggaacagtaccccaatgctatgaacgtgggtgcaacgtttggctcaatgagtgcggcagaaacaggagtggacaaaggcgcagagcagttactggaaaaactgcgccaggacaagcaataaacagaacgtgacggcttatgggcatatggctttgtcagtgtagctatctctgcactaagaggagatggtttcaggcatcgttcataaaagctattctcgcgtcaaaaaaggctgtgttatgaatgcccgcttttcgctcatagcggaccttccggagcgtaggtccgctttgtgcctgaagcctgctctctccgcatcatgatgtgttgatcaattgcggcagttcacctgcacctttctgagtgacctccggcatgttcattccgttcgtctgtaattttgcaggcaacttagcgataatttgttaagcggaaagaagatcttaaaaggaggcactgacaatgactttttctataggtgtgcttgcaggaatgggaccccgctccacagcccccttcgttgatatgctggtaacagactgttacatcgggtacggagcgaaatatgatatggattttcctaaaatgcatattatctcgttgccgacacctttctggcctggcaagaaagttgatgataatgcgatgatcgcaaccctgcagcagggtattaccgaactcgtcagggccaaagtgagtctgatagctgttccctgtaatcttgcgcactgctactttgccgaaatgaaggcggtgagctccggtatcccacttctgcatatcgcagacattgcacttgagtcactgcctgcagaggcaaccaggattgctgtactggctacggaacctacactggaagcgggtttttatcaggcgcggatagaagcttctggcaaagagattattgatccacttctgcttcgtgagatgaccacatcgctaattggacggattaaaacgaaaggttttcatgactccggtgtacaggcagagtggatgaatttaatgtctgtagtggcaaatcttaatgtggaggctcttcttattgcctgtacagatcttagtcccctgataactgaaaacactttcagctttgtcatcgtagatacggcagcaaccctttccagtgcgaccattaaaaactacagacgtctgtccgggaaaattacaggcggcacccataataccggctaacctgatgtccgctcctcgctcatagcggcctctagctcagttagcttgtccgcttcgtgctaggagcggacattgataatatttcaatggcattaaaaattaggaagcaggacaatctctcgggagaggttgcgttggctttgatatttttaatagattcagaaatattccgtttcgtgattagagatccatatcaagattgagctacgatagtcgtctttagtggaggcgatcagcgagcatttatctgcattaccatcagcggtgtaagcacagctttgcttcagtcggacaattaagtcccctgtttttgatacgctctctgagtcaacaaattgcgcacttccggatggataaaagatacgcgtgtccttccgatctttatagtttcttatacgcacaggaaattggctattgtgatattcatatcgctttacaacttcgcccgtgtctttgtccgcgattgtttcaagcaatccgcgcacattatagctgagtacataattgcctttttcattctcaagctcagtgatttcgcagcgttcattgatttttccggtaatactctgacctttaaaagaggtcagtacaccatctttgtttaccaaatggaattcatggccatttgccttatcaaccatgttgatattagtaaagcacccgttacgatcgtatctaacttctgtcatcgcctgaagtttaccgtaaatatctcggatccactggaggctatgttttacgttcccggtagttgcatcatgctcgaacaaaagagcagcatttaagactgctggtttgaattgagtaaatgcagcgacattaaatgacattgccaaaagtaatagacttaaaagcaaccttgctttcattatttattcctttattagtaggatcgcactctaaggtggtggggcaactcaagttatcaaattctatgcgtaaagacacgaacaatcgagatgcttccatgtcacaatttaagcgaccgctcctcgctcaaagcagccagtcgatgcgctaacatcacgttttcaatcagtcaccgtttactgcgctggcgaaaaccccccgcgatgtctgttcctctgggcttctttcttcccataatctgccgattggcatgcagttctgcgcaggatttaatcaggagaatttaatgctggcactggcggatcagcctgaaagcgcttatccgtggcagacaagaaaaccagcggggagaggcgaccggctcataaagtcacctggaaaactttagctcactgctcacggttgacatgactctccgtaacaggcataccactttgtcagttttgccgttagtgaacaggtgaacaaccgggaacttccgctatcgaacgatctgatattgtgagtatttgcgctcgtcgtcagaagcggaataatatcgatatcggtggtttagactgttgaagtaacaactcaggtctgaaagatcaggagattaatatgcaatcagttcgcctcatgggtgacggatacgaacctcatgtgacacaggaggaaggtaaactgacctactcattgcctgtcgattctggttttatcagctatgaatttgcctttgagatcagccggcacgatctggatattctgctttccgatgattacagacgtgccgtgctcgaaattactgcgcataccttgctccagcgttcgacgctaaaaggctatgaccgctttacccagaaagacttcgataaactggtcacgaacacccttcactccacacccgatttcctgcaaacattcatttctcagataagccatgaacatcacattgttattgagcattacgtgaaagaaatcatggaccgacgttctgcctcacaatgagtacaatgagtacaatgagtacaatgagtacaatgagtacaatgagtacaatgagtacaatgagtactaaattttggtctcctgaaagtgaaaaaccaacagaaataatgaactgacgcaatataattttacgctacgaagttacttctgagtctgaacaataaagggggaccagaacaaatccaggaataaaataccagtcttagaaatgttcttagctggaatagcatggggagagcttctcaatgagtcaaaagcctccccgccatgccatcgagcaaccccgcaacgtccgccgctaatcccctatgcagtcatgccgccatcaatcaccagttcggtgccgctgacgtaactgctttcatcggaggccagaaacagggccgcagccgctacttcatcaggattacccagccgctttgccgggatccgttcgctgagtgtctgcctgacttcatcgctggcctggctaaacatcggtgtatcagttgggccaggactgagtgtattaactctgatgccacgcggtgccagctcgctgttccaggtgcgggcataggatcgcaccgctgccttgctggcggaataggcagcatagccaggattagcaatgcttcccgcgatcgaccccaccagcacgatgctgctgccctcccccatgagccgtaccgcgtgctgcaccgtcaacaccatggcacgcacattcagatcaaagatgcgatcaaggtgctcctccgtggtctcttccaggctcgcaggttctgacacgccagacgagttgacgaggatatcaagtctgccagccctggcattgagggtttcaaacagacgctcaaggtcgcttgtgtgggtgatgtcacccgcaatcgcctcgacctcaccgccaatccgcgctacagcctctgccagctgtgcttcacgtcgacccgttataaaaacccgtgcgccttcctgaacaaaacggcgagcaacagcgaggccaataccgctactaccaccggtgaccagggcgatctttccacttagtttcatcattaccactccggataggggttagacacctgatggtatatttattatatttagtgtcaattacgcacctgatgtacaccagatatcctcaaggaaaccaaatgaccactgatatcaccgtagtgctggccgagatcaacagcacgcgccctatcctggaacaggtggcaaacaagtggtcagtactgatcctgaccgtgttgtgctcccagccctcacgttttaacgccatcaagcgcaggctcgaccccatcacacataagtctctgacggaggcattacgacgattggaacgcaacggattagtgagccgccacgtgattgcctcctcccctgtggcggtggaatatgcgattacgccgctgggccgaacgttgcaggatccttttatcgcgctggtgagctgggcaaagcaacatgggggagcgatggaacaggcgcagacggtttatgattatggacgggatatcgatgagtctgtatgaactccgcccgggtggcgtttcctgcatgtcgatagcgtcaggttaatgaccagatgattccagcaggaataatgagttaccgtaagcggagatccgtaaagtcactcaggccaattcatcacagacgtttgagggaattcagtagcctgtctcgcacatagatgttggtcatcagcaacagacttctttttgagcctgaaacagaaaatctttctgctgtggcgcgcggtttcagaatattaggcgggttaatcaggcgttcaggaaatgtatccttgcgggaacaggcggcaaagcgttaaacgtaagatccattaccttcaaatccggaaggtcataccagcaatcatatgcatcgactaaggctcttctgactcaaaaaactgatacgacccatcacgtcgggctttggcctggtacatcgctttatccgcgttttcgaataatattttggccgatgccgtcccgaagcgggcaaggctgataccgatagccgcgccaatgcgcacgtccatattatcaatggcgaatggcgcgtgtagactttcaataatacgcagggcaatggcagcggctgtatcgcgatttctgcactttgccgccacaacaaattcatctccgcccagtcgcgccagtgagtcgcccggacgcatacagcgttgcagccgttcactgacctgctgcagcaaggcatcccctgtcgcgtggcccatcaaatcgttcaccgccttaaagccattcagatcgataaacatcaccgtcgtataggcctcatcatccaccttcgccagcatgcgcccgacctggtcgttgatccaggtacgattatgcagcccggtcagcgtatccagcgttgccagcttctccagattgcgcatcctctctttgtctcgcgtaatgtcgcgcgacaccagaactgcaccgatatttttgccggtagagggattgatgacgccacaggctttggtgcccagaatgatgtagtggccgtcacgatgcagcttgcgcacctcaacgacgtccggcagtactcctccgctgaagatgcaggcgagtgcttcagaagcagggccgcggtcatcgggatgcaggaaatccaccaccagctgaccgacgacttcttcggctgtccagccaatcatttcgctataagagggcgagattgaaacgtaccggccatccgcgtcgcaatgggcaatcagatcggtgctgttttcaattaacagacgatattctgccgccgtgcgcagcgcatcttccagcgctttacgctgtccggtcacatcaagaatgaagccgttatactgcagacgggacgtgccaggctggcgatccggcaggccagacacaataacccgacgcgtcttgccatccagacaatggattggcacttcaatatgaaaaggcgtcaggaaatcaagtgctgcggtcagttgcagcgcgatctttgcatcgtcgtcggcctgtgccagtctcagccatgaactctgcgtcacacccttcagttcaggcatcagaccagcagggctttcctgactggcgacgcagataccctgggcatctgtagaccagacagcggtgaaagagggtttgatcattgtgttcatggcggccgactccgacgtagctgacgatattaaacaggctcaatactcgtcgctacagacctgattataaccgttaatgtccgcctgtagctgaaggaggatccggagacaggttcaccattgcgagaatacccgccattgacggcggctgacgctgcgcttatccgtctgcagctgctgaggtgccgccctgcccgcacaagagtgagcgaacccgggattcagtgtcagaagtacgagccagtgtttatcggccgatcgggccagaatctttaatgataccacctctgccaaaagcgctggggtatgattatttcgcagttgattggcgcggccaccgcgctggaacttgcgcgccatggcttgaatattgtagcggcagtagtggatcagaacggcctcgataagctggtacgccagattgtcggggttgccacgccatccactctgtcctgatgctgattatcagggcaatactgccccggcatggctcgcacgccctgatgctattttccttcaattttcgcctgattaagccgccgggctatcactctttgcatcgcctgaaaattaagaagaaaacagagtaactcagaattaattcttataggttaacagggaaaacagcccaaacactgcactccgacagagcaaatattacattaaatcaaagggtaaatgccggtttagtgagtgacaagctgtgatcaaaatgcctgtcatagttttctttagtttaaccttttcttaagattaatcttataacatcgtctctgtattagcccatgttgggctgttccggagtatcaccctatgcaaaataacaacacagcttctcacgctctcagtaaagttccggccgttaccgcggctttctggttaaccaaaatcgctgcgactaccctgggtgaaaccggcggcgatgcggtgaccatgtcgatgaatctcggttacctgaccgggacattgattttcgccatcatctttctgatcgcggtggtggtgcagataaatcgccacagtttcaacaaatggatttactggttcaccgtggtggccacaaccaccgtcggcacgacgatggcagactttgccgatcgctcactgggcataggatatttagggggcaccttgctgctgagcaccctgcttatcctctcgcttttcctgtggaaaatcacctgcggtacagtcgcggtcagttcggtgaacaacggcgtcacagagagtttttactgggtcactattatgttttcacaaaccctgggcacggccttaggtgactggacggcagacactgaagggctgggctacgatggcgggatactgctatttgttggcgcgctggcaatcatctgggcggccagtcgctttacatcactttcgcgtacggggctcttctgggcggcctttatcctgacccgaccactgggtgccgtggtcggcgactttctggacaaaccccttgcctcaggcggactcgctctaagccgctacggtgcctcgctgacactggcgctaatcatcatcgctcttctggtgatactgccccagcgcccggcaatcaagaccgccacggcgagttaaaaaacgttactggcagatttacagataacgcatcgacttaaacgtaatcagggccgccagcgatggcggcttttttattatctgatgcgtaacaggctacatcagacagagcgctcaaaggagacgatttgaccatcgggtgcagcagcgagtaccggcagactctctgctggctcctgcattttcacccgaaacgccgtgttgctggcatcaaggaaaacggttctcagatgacggttacagatgaaccatatttcatcgcggtcatttgaaagaatgtagtaagcatctgatgtttcagaggggttaaaacagcccagcgcgcgataagccgtctgcggggtaaaaccgctggaaagcggcaatggcctggggccatgcgctaactcttcaatcctgaggtaaagcccctgttcaagccacaacataatgtcactccctgaaggtagagaaaccgggctgaacgtgtcggctgcattaccgcgaagcagaatgcccgttcactgaccgatttagtgatcggataatttttccgacgtgcagaatcgttatcctgatctgagcatagcagcggcgcgttcttatgctttttttatctgcttacggggtttctgctactcaaggcgactggcgagcagccgcagctgctcagcaatctgcttcaaatcacgttgctgctgaccggcgatacccgtcgagctgcgtaccaccagttttgccggaaggatagaagaggaacgctgctcatcctgctcactggctaacaacagacgcgcgaccgcctctttgccctgtaaatcgagatccagcgacaccgtggtcagcgccggatggaagaaggcactttcataggtgtcatcgtagccaatcaccgaaatctgccccggcaccgctacaccacgctgatgcagcgcgctcagcacacccagtgccatctgatcatttcccaccagcagcgcgctgaactccggcgcttcacgcagcagttgcagcacgccgttgtaaccactttgcgcatcccagttaccgtggctgacgctgaccggcttcagacgatagctctccagcgtatccagccagctctttaaccgcagattggcagaaacggactcctctggcccggccagcagagcaaattcccgatgcccctgctcatagagatatttgacactggcacgggtgccgtcagccgggttaaacgaaacgttaaacaccgcactgtagggatcaacatcaagaaacaggcacaggatatcgtcgttctcctgcacgatctgctccgcatcactgctctccagcggaacgttgataatcaccttatccacgcgctgcgacttcagttcattgatacaattctgcagactttgattgacgttctcatcaatcatggcgatcagcacctgatagtcagcggcattggcatatcgtttaaccgcagcggccacctgcgaaggagcatgcaacgccagcgatgtggtcaccagacccagcgttgtgctctgcttacccaccagctgttgcgcaagtctgtttggcacgtagcgcagggtttcaatagagttctccaccttgcgccgcgttgattctgagacgtttgccgacttattcaaaacccgcgaaaccgtctgataagagacgccagcatggcgggcgacatcctctaaggtggcattttttgatttcataattcgcatccctgattaccgatggcggaatggtatcacagcagccgaataagccaggttaccgcagtcacattgcgcagataaaaagtaaaagtcataccttcacatcacgagatttggtgatctgattcactaatcgttacaaataccgccactttatttgcactgcatcacacattatcgcgattttgtttgtcactcatctgacaaaaagcgttaactgccgctgtcatgtgaacgtattacaaataaaattgaggataacatggaaacaaggttacgtactgctgctgtggcgctcgctgcggccctgacctctccgacgctctatgctgctatcgacaacattgatttccatggctatctgcgtggtggcgttggcgtatcgcaggatggcggtattgaagagtatcaaaagaacaagattggccgtctcggcaacgaagctgacacctacggcgaggttgagctgggcagcgaagtctacaaaaaggatgacgtcagtttttacgtcgacaccatggtcagcatgttctccgacggttctaacgataacgaaaccaccttcggtgacgatgcgcagtttggtttgcgtcagcttaatctgcagatcaaagggctggtgccgggtgacaagaatgcggtgatctggggcggtaaacgttactaccagcgtcacgatttgcacatcattgataccaaatactggaatatctccggctccggtgcgggtatcgaaaattacactctgggcccgggcgcgatctcctttgcctggatccgtggcgatgccaatgacgtcgattacagggtggatggcgataacgacgtcaacattaactacctcgatcttcggtatgctggctggaaaccgtggagcggtgcctggaccgagtttggtattgattacgccatgccgaacaccaccaaaaagcaggaagagtatggtggcctgtatgatgcggaaaacggcgttatgctcaccagtgaaatcagtcaggatatgtggggcggctatcagaaactggtattccagtatgccaataaaggcctggcacaaaacatgatttcacagggcggtggctggtatgacatgtggaacgatacccgcgatgccaccggctaccgcgtaatcaataccggcctgctgccgatcaccgacaagttctccctgaatcaggtctttacctggggttcagcggatgacgtcaccgcgcagaccagcaaaagcaccctgctgtcgctggtgggtcgtggtcagtatcagttcacgcagtatgtccgcggcatcggcgaagtgggtagtttctggcagaaagatgagaacaaagtgggcagcgactacaaacaggcgggtcagaaatatacgctggcgctgggtctcgcagctggtcccgaatttatgtcacgcccggaactgcgtctgtttgcctcttacctgaatgactcagaagacggacacagtttccaggacaacaccagtaacaacacctggaacttcggcgtacaggtcgaagcctggtggtaaccgagcagtctcctcattgtgatcattgttaagctcttatgcaggggcttatttggataaccggcgacggttatccattttttttactccggctgaagcggcttaaagaatcgggcttccagcaactgacgcagctgatcggattgcgtaccaaagatggcatgaacttcctgccccagaatcaccacgccaatcgcccccgccttctgtaatcctgccgtatccaccgccctcagcgatgtcaccttcacccgcagccgggttaaacaggcgtccacctgctgaatattttcacgcccgccgaagcactctacaagacgctccagcagcgcactgtctatctcaacctcttccgccgtcagcggctgccgactgaaatattgcttaaacgatttcagactcaccatgttgttctcctccagataataaaaaggcgggctgatgcccgccactcacgactgataaacgaaaacgagggggactggcttcagggcactcacagaaaatacactcttcctgccctcaaaccctattcctccgccacaaagtccgcaattaaagccggtccaaaacttccaacagacaactcccatgcgcaaagcgatgggggccagtacctgtagcaaagcatcacgggccagggacaaaaacgccgggagcgtttttgaacaacgcaacgcgttggcccgggaacgggcgcacctcagggatgaggtgcgtaattgcccgtgttgagctggcagggatgccatcttttgcgtctttgcggaaggtactggccccctgagcctctgctcagactggcaacaaacctaaccaaacctgctcaatatcaacggttcccgcccctgccacagacaacgcccagactcaaagcgatgggggcatatgcctggagcaaagcatcacgggccagggatggcccgtgttgagctggcagggatgccatcttttgcgtctttgcggaaggcatatgccccctgagccagtgctcaggctaccagcaacgtccacctgacctgctccatgccagcaaacggcattaaactaactttaaaggcttgcgccctcagttagcggcacactcagaacgcgacatccccatggcgccagcaccagcgattcccccacaaccgagccatcgatcaaatcgctgagcccagcaggcaacgacagctgctgcacctgaccggtaaaattctgcacaaaaagaaacgcctgttcgccatcagtgcgccgctgaacaaccacgcccggtggcagatcaatcgccagcgcgcgcggcaacgccagctgcttaatcaacgcaccataaaaatcccgctggaacgacagatcattacgcgacgcgatataccaggctttgccctgacccacgcgattcaccgtcaccgccggggtaccggcataaaaatcgctctcatagctggccagcgccgttgccccttccagatgaatatgctcgcaaagctctcgcgcctgataaggcccgctcagacccagctcattgccgcgtaccccgcgtacgccattgaactcctcatcagtcagactatcgatctcttctgaccagatgccgagcaacggccgcaacggccccgggaagccaccgggataacacagatcgctctcattcacgatgccgctccagtagctggcaacgaaatgcccgccccgctcaagatgctgttccacccgcgccgcaaaaccatcccgcaccatatacagcatcggcgcaatcaccagatcgtaaccgctgagatcgcagtcgccgttaattacatctaccgccacgccctgctcccagaaagcacggtagtgctcgttcactgtgcgctcataatgcaggccgagattgcgcggcccctgcgcattatccatcgcccagcgactctcccagtcgaaaataatcgccacccgcgcctcaacccggctgcccatcaccggcgtcatcgcggccagcatccggcccagctcacttacctcacgaccggtgcgcgtatcaagatgacccacatgatcgactactgcgccatgaaacttctcgaccgaaccccggctcttgcgccactgaaaatattgcaccgcgtccgcaccatgggccaccgcctgcagtgacgacaaaatatgcatccccggcttcttcagcttgctggtcggctgccagttggtggcgctcggcgtcgactccatcaacacgaaaggcttgccctgcttcagggtgcgcatcaaatcgtggtacatcgcggtataacaggcgagcgtggtctcatccttctcgttatgccacatcgggtagctatcccaggagataaaatcgagcaccggtgccagcttccagtaatcgtagtcgtagaaatattccataaaattggtggtcgcaggcagatcgggattggcctgcttcagcggtttaatctcctcacgacagaagtcagtaacctgatcggtcataaaccgccgccagtccagattcagaccgtgaatcgacatctcaccctgtggcgctggcgacacaatctgtgaccagtcgctgtaggtatggctccagaaatcactccaccaggcgagattcaggttctccagcgtctcataacggcgctgcaaccagccgcgaaatgcctgctgacagcgatcgcaatgacattctccgccatactcattggaaatatgccagccgagcaccgccggatgatgcgcatagcgcgccgccagccgactgttcatcgcctgcactttctggcgatacaccggcgaggtcatgcagtggttatgacggccaccatgcagagccggcacgcgatcgcgccccacacgcaatacctccggatacgcctgcgacatccaggctggtctggccccgctcggggtagcaagaaacacggatatcccctgcagccagagcgtatcaatcacctcatccagccagccaaattcatagcgcccctcttccggctccagcttcgcccagctgaaaatacccaccgacataacgttacagttttcgcctgcttcatcatcatgacgtcgtcatcaataatgcccggctggtgcgcccactgttcgggattgtagtcagcaccatgcagcagccggttaacccgggcgctgagcgggggaaatttattcatacctgttcctcagaggtagacatcagcgtttgcgctaatggttaatgaaaaacctgcagcgaaggcagcgccttgccgtgacagtcaaacagcgcctggttttcgcgggcgttaccctgtttccattcgtcgtggatatatttcatgccagcgggcgtcgcccaggtattgccgggcgcagggatccacgccggttcccagtagacgacacccttgccgcgatggtccggcaccgccagcaccgctttgatcagatcgtgcagataggccgcctggcctgctacgctgccgggatagccgcccgcctgctcctctttggcctggaaactgttctccgcgctatcgcagttttccagcgtgtagccataggccgcttccaccaccatcacgtctttgtcatagcgccgggagatatcatccatgttggctttcagggcgctgatggggccgttccagtaggtgtacatcgacaggccaatcacatcgaatggcacatcacgcttaacgatctcgtcgaaccaccagcggaacatgtcgttctttgtgccctcagccaggtgcagcatgatcttcacctgatgcgggtcgctgaggttctcacgcaccccgctgatcccggctttcagcagaccggccagccgatcaaactcaccgccgttctggccccagcttttgccttccggccagagcatgccaccgttaagttcattgccaatctgcacgatatccggcatcacaccgtccgctttgaaacgggcgatggtgtcgcgggtatagtcatgaacctgggtttccagctgcggaaaaggcagcgactgccaggctttgggcttgaactgcttgcctgggtctgtccagaagtcgctgtagtggatatccagcagtagcttcaggcccgccgcttttacgcgcttcgccagcgccagcgtggtcgtcagatcgttgccgccaccaccgtaggtctgaccgctgccgtcgcggggatccacccacagccgcagccggatggtgttgatgccgctggctttcaggatggcgatggcatcctgctgctggttatctgcgttatagaatttcgcaccctgcttctccagttcggccagcgatgagatatccgcacctttgataaaatcggctggccacggcccggcagagccgatgacaggctgatcggcggcgagcagcggtgtcgcccaggccagcgccagggcgagaatcaatgtttttggcgtcatgatttatcctttagtactgcctgaggccaggccagaaacgaagtatttctgcagggccagatagaacaccgccaccggcacggctatcagcacggcaccggcggcataggtggtgtaactggcgcccattttttgcgacaccaggttatagaggccaatcggcagcgtgaactgctctggcgttcgcagaatggtgctggagaggatgaaatcacccagcgggccggtgaaggagaacagcgccactaccgccaggatcggcttcgacagcggcataatgatctcaacaaagatgcggaagttgcccgcaccgtccatgcgcgccgactcatccagatctttgggaatcgagtcgagataccccttcatcagccaggtgttcatcgggatcatcccgccaacgtagatcagcaccagcgccagatggctgttgatcaaccccagcagctgcgacagcacgaaaatcgcgatcagcgccgaaaactgcgggatcatctgtaacaacagaaacagcattagtccgtttctgccgccccttgaaccgaaaacgggaaaaagcgtaggcggtacagctgacgctgatcaacgtcagcaccatggtcaggaaactgattttcatcgaattccagtaccacgtcaggtaaggcaccgtgccattgaacaggtcgcggtagtgctgcagcgacgcattctccggaatgatcgaactgctgagcaggctgttacctgcattcagtgatgctcctactgtccagaccagcggatagataatgatggccgagacggccagcaccaccagccaggtcagcgacaggcgtatccacctttcgcgtttaatactgccggacttcgccataactgcttccttacgccatctcatcttgtttaaacgaccgggtcgcgcggaactgccacagcgccagacctaccacgaaaatcgacagcaaaatggtgatagtggcggcgatagcatattgcgacgacgacatggtgagcttgtagatccacgacaccaggatatcggttcctccggcattcgaccccgccaccgccggaccgccattgttaaacagatagatgatgttgaaattattaaagttgaaggtgtattgcgtgatgatgatcggcgcaatggcgtagagcaccagcggcagcgtgatggttttcagccgcgtccaggcgctggcaccgtccatgatcgccgcctcatagagatcgtcagggatcgcctgcaggacgccggtagtcatcgcaaacacaaacgggaaaccgagccaggtctgcatcataatcagcgcggttttggtccagaatggatcggtcatccacgctttaggtgcaatgccaaagaagtcgagaatagcgttgttgatcaccccaaagctgtcgttgaacattccggcgaagaccagaatggtgacgaagcccggcaccgcccacggcaggataaagatggtgcggatcagcggcttaaagcgcaggtctttctgattgaccagaatcgccagcatgacgcccacggtgcactgcagcgtggtagcgagcagtgtccagaccaccgtccattgcagcacgtcaaagaaggtggagcgccagatcgacagggtaaaaatgttgatgaagtttttgaaccccacccagtccaccagcttcgccggtggcgtgtgatagaggttgtagttggtgaaggcgatggcgaaaccgaacagaatcggaaacaccactacaaacaccagcagaataaagcctggcgaaatcatcagataggggaagccatcgcgcagcagtaactgatactgctggcgcacgctgttcagctgctgacccttgtcgcgcctgacgccattgacccaggcgtcgcgcattgacactccccagaccgccacgccgaaggcggcaatcagtacgctgataatgccctctgccagcagaaaaattgagttatcacgcggcaccgattcgcccagcgtatagagcccccagaatccctcacgcagaaaatcgtggaagacgccggtaaaactgctgagcaaaatcagaaaacagagccctttagcccactggcggtggtaaaactggccgaagccaggcagcagtgccaacagcgcaccggaggtcgcatgacgacgcggacgcttagccgtcaccagattttcatcggaagatatagccacaccctgatccttatcctgtacggttatcccgtgaacctgcattactggttgctggcctgcatcgcttcaatctgcatggtgatctgcttcactgcattatccagtgccgcttttggctcctgcttgccggatacgctcagctccagggcagcattagctggcccccacacttcctgcatttccggcacgcctggcatcgctgacgcacgcgccgcctgcaccgcgaccgcgttggccttctcatcatctttgataatcggatcgttcatcagcgcggtgaccggtgggatctcctgggttttctgataacgctctttcacgtactgcggctggttgatgaaggtaaggaacttctgcgccagcgcctgatctttactccaggtagagaccacatagcctttgacacccaggaaggagctcatcggcttgccgttaggcagcagcggcagcggtgccacgccatagttgattccggcagcctgataaggctggaatgcccacggcccattgatcaccgccgccgcttttttctcggtaaacagcgagtcgatggcgttgaggccgttgtcgcccatgatgccgcctggcagcaatccttcactgaagaagcgcttgagatatgtcaccgcttccacgctgcccggggtgttcagacccatatcctgagtgttaattgcgcctttggcgtctttgccaaagatgtaagagcccatcggagccatcacaccccagctgtaataaatctggtcaaacttagcgagcaggccatactgcttcgcctcacgctgcttctgggagaaggcacggtattcctccagcgttttcagcggtgacggcagcagatctttgttgtagatcagcaccagcgtttccaccgctttgggtacgccgtagaccacactgtttctgtgtgaaagccgccattgctgagggggtgtaagcgccctgctctgctgcatctattttcagcggtgccagtaatccctgtacgaccgcgctaccgagctggtcattagggatcaccaggacatccgggccaatacccgccgggccatccagacgcagcttctcaatctgctgtgcaaacggcatctcctgaacttttacttcaacgccgaactgtttctgaaaatcggcgatcgccgttttgatgccgtctgattttttaatgtcttcccagacggtaagttgctgagcggcccaggcggattgattaagcatcaatgcggaaagaagtagcgtaacgctgattttgattttcattactggcctcatgtgaaggtatgacattttaagctgtcatttgctgatattttttttcaggcacatgctgaacaaggaattattgagcatatgcagtgtgagtaacgtatcgcatttgagccatacgctacgcggaatgcgtaccgcgctccagcccgttcgcatcaatgtgtgatcgctattacagaaatcaaaatcagcggtagggcgcactctggcggagcgatatagtcagcgcaggcaccatcagggctgacgtgtaaaaagacaaactgttatacgtcatacatttcagccgccaaatcccttgccatgaggatcagcatgtccagcatcagattgagaaacgtcaccaaacgctttggtaaaacagaaacgctgaaaaatatcgcgcttgatattgaggccggtgagtttgcggtcttcgtcggtccgtcaggctgcggtaaatccacactgctgcggctgatcgccgggctggaagagatcagtgacggtgagattttgattggtgatgaggtcatgaatgatgtcgcaccctcgcaccgcggagtggcaatggtgtttcagtcttatgcgctttacccgcatatgacggtggcggaaaatatcggttacggactgaaggtgaacggcgtgccgaaagcgcagattcagcatcaggtagagatggtggcgaagacgctacagcttgcgcatctgctggatcgtaaaccaaagcagctttccggcggtcagcgtcagcgtgtcgccattggtcgcgcaatcgtacgcaatccccgggtgtttatgtttgatgagcccttatcgaacctggatgcggaactgcgtgtcgatatgcggctgcacattgcgaagctgcaccaggagctgaaaaccaccatggtctatgtgacgcacgatcagacggaagcaatgacgctggccgataagattgtggtcatgaactacggcaaggttgaacaggtgggttcaccgatggagctctattacaacccgattaaccgctttgtcgccggttttatcggctcacctaagatgaacttcctgcctgcgcgcgtggagcagtgtggtcctgctggcctggtcgccctgatcaatgacggcgagcatcggctgcagcttccctcgcccatccgccagttgcagcctggtgatgagatcacgctgggtatccggccggagcagttgcagatcaacggcgatgcgccactgaatatcaatttccactgcgaagtggttgagcgacttggcaacaacacctatctgtttggtcagagccacggccacgacggcttcaagatgctgctgcccggcgatgtgcatttccgtccttatcagacgctgcgccccaccttccatccgcaccactgtatggtgtttgatgctgaaggtgctcgtatcagcgcggatatagcgatgccgcaggtttcgcgcagcctgaagtagatgtttgcagggatttaacgagaggccggagacggccttttctgttttcaggcctggcattacgccagaagaaagaggtcaggaaagggatttgcgggcaagccgtgatgacgcgcagacgcgtcagcctgagcattgttcagacaaggcattgcaggtgtgttctgagtaaactcatgaaccccaccggcaaccccttatccgggtcgatcagctaaccgggcttagcgactgagaccttacttaccgaggatattgtttactgctttcaggtggccagccttgtctttgtggtttgaaaccacctgaataacggtgaatttcttgttggcgaccgccagcagcgtcgcctgttgcacatcgttgccacccattttgtcggtggcttcaatatgataaaccggcaaaccgttggtattttcagttttctcactgatcaccgtataagaaggtgaagcctgcttctgcttgtctttgatagacttcccgccttcaagaaaatcagcgtcactgccaccgcgcgcaatcaatgggatctcttcttcgccaatgatcaatacgcgtttttcctgcttgttcacatacatggtgcctggtccgccgcccggcacaggctgcttttcatagccctgcagtttgaacgtctgtttgccatccagcaaagagatcgtctgagtctgcgtgtttgcagctggtgctgtctcagctgctgatgccatcagagaagtaccgccgatggcagttgccaggcagatcgcacccataatgtttaatgattttcttaatttcaccatgaactccttcgtattgatgatatttccatttcgctgatacagcatcagtatggcctgtatcagtgatgtgaagtgttatcgggtcaggtcgtaaatacagatccctgagccgagcagaaacagaataatcggccagtagagaacgggaataaaaaagaagttgtgggttttttcaggggccatcattggctggcttttcgttgcttgtgcaagggagtccagccatttttcctgccgaagcacccagacaaaggccgcacaaaaaagggcagaaacgatcagcgtagcccctgtcgcccatagatgggcgacaaagaaaccgtcgtagtaataaatatctaacagccatttacacaggaggtaggcggcagaaattaatactgcgacgaaaaaacccactccgctccatgcgatcatctttatatccttctaaggtgtgaggaacgaggaatattttttttgaaaattaacatatttttatcattgtggcgatattttctttggtgctaatatcaattacatccggcgcaggagatatccggcctgtgcaattttcacattactgattctgatggatttattttcaaatattgttgtttaacctgaatccggcacccgtgcagctaatagcgcacccagggtgtagcatggctatttgtaccgtaccgatattattttggtgcgaattaacgcggcttccctgtttttaaaattcttatgcgctgttctggcggtcgataagcaccattcatgcggctgtcatccgtctgaaacagtgtcggtctctgtagttttctgcgcaggatattgaggtaatcatgaatcaacctattgaaaattataataaagtaaacgcaactaaagagtacagtgcgaaatggcagacccgatttgattttttcgaccttcatggtgctcccagtacaccaggcttcagacaggcattgaaacaactgcctttcaggcaaaaattaaaagtgaacatgaatttaattgccttccttttcggcccgatttatctgttcgtactcggcctgtggaagaagaacatcatgctgattttaattatggtagttgtttatactattttgatcatcgccttagcgatagcgggcatggaatttccacggtatcttcaggttggcctgggctatggctttaatgccctgtacggcatgagcaccaattacagttattacctgaaagagaaaaaaggcgataacggctggaatcccttcaaagggatgcgctggtaattttttcgcaccgctctgatggtaaaatataggattatggtgtatcggatgcagacagatggcggggattagccctcggccaggagatcggacagaataagttatgagcactaactcaaattagtgctgtcgtggcagaaccaccgggagccgccagaaaaataacctgacggaaaaggaaaaaatcgccgaaaatatccgtctataccttttcaaaacgggttcaggctggcttataatcgctctgcaataattataatatcgtgaagctcgcataaatgtttccgcaccgtttaaccggggccaggatattcttttcggaatttcctgatagcagcagcttctccctttcatagacatgcaggaagttactattttgaatacattaacggaattgaaaaagggttatctaaaggtatttttctggctgctgttcacactgtttctcgtccctgtcattaccctgttttttgctgaatatggcaacaaacaacttgatcagcaatacacgcagttcttcatggacgatgcgcgggaacaacatcaggatacggacaaactacaggcgtttctgcagcagaacccgccttccagtgtctgcggtccggtagatgaaaatctgcaggattacaaaaacgccgtctgcgaaccgcaatccgaactgtggcagttctacatgatggataaagtggcattctggacactgatcggcagcggcgctgtcctgctgatggtgttgctgttcagtgcgctggcctttaaaagccgccagggacaggttatcagtctggcgctggcccgcaagtttcctgatgctggcctgttcgctggaagtcatggtacagggcggcatgctggtatggctctcattctggggcaccgccttcttcacgcaaacctactatcccaaactggtgatggcagtaggactgctggtgctggccggcatgtattacatgattaaaggcatcttcaaaaaactcccaccggaagagagtattgaaggcgaagtcgtgacccgcgaagcggcaccggcactctggtcacagattgatatgctcgccgcaagagtgggcaccacgccacccgatcatattgttgcgggtatcgacaccaacttctacgtgaccgaagctccgctgaacgtgaatgggaatccgctcaccggccgtaagctctatgtcagtattccgctcctgcgtcagctcaccgttgcgcaggctgatggcgtgatggtccatgagctgacccacctgcatgaaggcgacaccgcctccggcgcattactgggaccgaaactgcatcggtttgatctctatatgcagctgatgggtcagaatgtggccacgctgatcgtcttctatccgctctatctttatcgcatgctgtttgaactggcgtggcagcgtaacagccgtgaacgtgagtttgtcgcggatcgcaatgcatcaacgctggtctcccctgccgcgattatcgaatcactgatcaaagtatctgcgtatgccagctaccggaatgaagttgagcgaaacttctttaataatcagacgctgcacgaaaatgaactggggatcagtaaagctattgctgccggtctgccagaacatgtcgcctctccggactttatcagcgtcatccgtgagcagaatgtgccgcacccgtttgattcacacccgcctctggcggaaaggatgcgtaacgtagggtatgagattaacgaagctgactatgcagcgatcgccgccgatttcccggcccagagctgggtcgatctgatgccggttgccaacgagattgaacagcagttgtggcagaaatatgagcgcgacttttcttctgtgcatgaagagagcctggcctggcgctatcagcctgacggtgaaatggaaaccgcgctggtgctgaagcatttccccaatgttccttataccctgaaagatggctcgcagatcgtcatcacctggcagggcatcgtgtcgccgaaaaccggcgaagtgctggagtgggataacgttaaaaacatcaacgtcattcgtagcttcggccgggataagctctacgtgcaacatgtgcagccaaactcgcagggaaaaaaacgcagtgagatccctctgccgggcctgaaaaaggagattgaagcctttaaaaacaccctcggctattactggcatcgtcatcagacagtcagggcgttgctgaaagaagaaacggcggcagcgacgcaaagcgcataacccgtttgtcatcggctccctcctcgcagctgaaaagggagccaatgcgaacatttattttcattctctatttctgaccacataaataaaggaacgattgtgtttaaaagagcaagcagggccatgatacccgggatgctggtgactgcccttgtgctgccgctggcagcatgtgacaacagtgacaaagcggatgcaaaacccgccccgcagagtcaaccccaggctgttgcggaggatagcgctgcgcaactcaccacaaaattaaacgcctatgtgggttgctttaacactacggatggatcggttcgcgatagtgccctgcgctatgtgagctggatggcgaatgctgaaaaggggccaaccggcaaagagcgcagcgtcaacgtactgggcgaggtcacgccttatgaactggagagctgcactaaagccatcaaccaggcatcgaaagctaaaccgacgttaccggcgctggatgctgcagcaacacagtatctggcggatttaacgacattgcagccgctggtttcgcaggctcatctttactacagtcaggaagattacaaggatgatggcttcgcgaaagccaaacaaatgcatccgccactcatgaaggcgtttaacagctttatgaaatccagcgaccagttcggtgccgaagttgaaaaagagaacaatgaggtcgttgctgcgcaactcgttgagattgaaaagtctgagggccgtcatagtcgctactaccgcctggcattagtcacacaggccaaaccgctggcgaccctgtttacctcttccgctcccgacgtgacagagatgacaaaagcgattgatgcttacagtacgctgctgagtgaggcagaaaaggcaacggccagcgaagcgggcaagccattaacctggtccatcttccaggataatgccggaaccttcctgaaagactgcaaggatcgcatgcgtcggattcgcgataaaacaccttacagcacgggtgagcagagtctgctgaaaggaagcggcaattcaggctggatggtatcgggttcaccgatgcgtgttttaaaatcctataacgaactggttgaggccggtaaccgcctgtaagctgaatacctgccccgcatgcctccgggcaggcttcgtcagtcgggctgctgcgtgcaacccgactgacgctgtcacctgccgcgaaaaaaaataaaaacgttcacgcgccagcatttcgttaaaacgttatgccaggctagtgtgctggatggatctgagatccgtggcaaagcgcacccctgagcaggatgcgcgctatatcagattttctgactgtaaaatttttgactgagaggagcgagagtgcaagcaaaggtcggcgatatctacagcgtgttttccccgcagttgcagcagtatgtcgcctgtcaggtgacacacctccagcagcctgctaatgccagaggcaaagtccttgcagccatactccagctcgactgggcaggtgatcatttgcctgacagggcggaagccagccgtatgcagcctttgcgctgtagctactattttgtcaaagacagcttcgatcacggttatgtttctgccaatgtcccaccgggacatgtattaattgccaacctgccgccgctgtcagatcaggaagtaaacgcctacaagttcggctgggacgtgggagacagtcttgtttcgtcagcgaaactgggagaagatcgacccggccagccgtgcgcggttcaaggctgcttcaggcgcgcacaacgtggttgtcggcggccagacacttcgccaggacaccacccgtatcaatgaccacctcctgcaaaccctgaccgatctctctgaactggatcgcctgccctgcctgatgaccatcgaaacccgccatggcaccccggaactgatggcctatatacagcagcatgacttcattaatgagttgcactggcaatccgctgtcgtcagcgaaatcgatgtcggggcgactcgtttgtcgcgttttattctgcaccctgaaggcgtcagctgcgtgcgtctgaatcctgatctctccctgctgtcactcaccgcaacgccttcttcaggctttcaggtagaggctgatcaggagggacgcaatctgtgcctgcaatgttcgcagactttgcctgtgctgcagggtattgaccggctcagggcattgtcactgacaggcgttaaagagattgacctggcgtcagtcgttgagcgctttacctgcttaactgagctgcgcatctggggaaatcccggcgtagccagcaatatgcatcgtattgccgcactgccacagttgcagatgctgaccttcttcgacctgtttggcttcagcgcggctgactttccctcaccagaagcgttgcccaatctctcatgcctgtggatgaccagcgtcccgcttgacgtgatcagctctgtcagaaccgcttataaaaaggcgacaactcaggggttggatctctcgctgagtaaagcacgcaagccggaatggctggctgagaatctgcacaatcctttccgggactgggatggccgcgaacatatttcggccacttatgccaaaaaagcagcgctggcttacaaaaacctgcgggctgccacgaacaacatcgatagcagcatggatgtggcgagcctgttaaccgccgccgtaaccgcctataccgaagcctttaatctcatcgaccggcgttcaaaagcgattgagacggtcgagcgtgaggagatctacagtgtgctgttcgatgttctgaacccgctggagcagaaactgggcgagcaaggcgctacgcttgtggatcagccgcggttgtatcaactcttcgaccagttacgcgaattctgagccatcccgaagattcaggcgtgttccgccacgccataaaaccgttattcgccgcgatcaccttatgtggcaaagcgttaagacgtgagttgagaaaggatcgcgggcgggagagtctgcagacctctctttcccggccagccattctgctgtttatgatcgggtaacggcagataaagtcagctgtgtagtgggtttatccggagatattaccctgccctttacgcagtccgttcaggagtgcctgcgtcgcgccagaagcttttccggaaggcgaacaaaccagcccgaattcccggtgcagaggcgggatgaccggcatcactgacaggccgcgccgttccgctggcagggctgattccggcaccagcgcgacccccatgccttcacgcaccagcatgcaggcgctgatccagtcgcggacctttacgcgcacgtcagagaggtggaatcctgactgttccatcaggcttttgccattaacgacgcatccgcctgttgcaagcacaaagggctggtctgccagtttcctgcagggttataccgttcgcgcctgactgaccgatgtgcggagcgctggctggcatgacggcgacccaggcgtcttttcccagtatcacctcagcacgtccgggtgtggggttcattaccacccccagttcaacggtgtccgctgcaagccactcctcaacttcttcatccgtcccttccagcaccaccacctccatgcccggatgcagacgcctgaagttacgcaacagcccaggcaggagtgtggacgtcacagagggaaagctggcaagccgaatgcgtccgccctttaaaccccggctctcatcagccagcacgcggatcgcgctgagctgcgacagcataattctggcatgttcaatgacctgctctcccagcgcggtaacaccgatgtgccggcgctcacgcacgaataccgggaacccgagtgacgactctaactgggcgatagcctggctggcaccggactgtgtcatgcctgtcgtttcagcagcacgcgaaatattgctggcatcggccaccgccaccagcaagcgccagtgcagaagattcatcatggttatcagtagctcagctaatagttaacttttgaagcattaattttacagaattctctgcgttaagcacagtctgttccgtaacgacaaagagaatctcacatcgctttcaatgttaacggagaagacatgaaactttattacgccccggatacctgttcgctgtcaccccatatcgtgctgcgtgaactcgcactggagtttgagctggttaaagtggataacaggagcaagctcacctctgacggacgcgactttcgccttatcaaccccaagggctatgttgctgcactggaactggacgacgggcagatactgactgaagggccggcgattgtgcagtacctcgccgacctgaggccggaaagcgggctggcaccgccagcaggcagctgggcgcgtgttcgactgcaggagtggctgaacttcattaccagtgaaatccacgcgggttccgctctgttgtttaaccaggcactgcccgacgctgtcctgtcactgtttcgtgaaaagctcttccggaggttcgactttctgcaggatacgctcgccgaaaaagcgtttctgatggggccgtcattcagcattgctgacgcctaccttttcaccgtactgggctggtgtaagttcttcagcattgaactggatcgctggcctgcgctggtggcatacagagcaaatatcagtgtgcgccctgctgtgcaggcggcattatgggcagaggcgacgcagtaagcgcggacagattggtggcctgaggccagagtatgaataaccgatccttgatctgctgctggcgccttgcgtaacggtagtctggagccagaagcagacggaaatttatcgtttcaccgggaacgggttagtatctccagactgaccttttagcggggagtcggctttatgattaacaacaccagggcggaaacctctgtcatcaggcatgccgacaggaattttgacgtcacgttattgaaggtgaatgaggccagccactgcatcctttttgcggcaggtgctggcggaagtccattgcgtcatcttgagcttctgcagatctttagccgcaatggtatttcagtggtagcgccccatttcgaacggttaacctcttccacgccctcaaaggctgacttactgcaacgcagccaaaggcttgtcctcgcccgcgatgcgttttgtcaacattatgcctcgattaccggcatcggacactcactcggcaccgtgattttgttaatgcacgccggggcgacggcctggactcgctccggagagaaggtgacatatgcaggcagacaggatttgaatcaacttgtgctgttagcgccacctgcggattttttcagagcaccctcggccctcgcctccgtgaaagtgccggtcaggatctggagtggcgagcaggacaccctgacaccgccatcgcaagcgctattcatcaaagaagaattagataatcgaactgagacagaactttgcgtggttaaagatgccgggcattttaccttcatgaacatcctgccgccgcatatcactgacacccacccatcacgcgacgcctttcttctcaatctgggagaagagatcgcccgttttgtcactggcttgttggctcagccagttaatgaatcaccttaattaaaccgatccctctttttcaatcaccagcacgcgggcgacgccctgtggacgcgcaatatgctctgtcccttcactggcataaaaaatatcaccggcgttgagtacacggcttttaacttcgccctgctctttatattgcatttcaacacacccatccatgacagcaaaaacctcctgaccatcgttgatgtgccacttataaggctgatcggtccagtgaagtttcacgctgacattatcgaagctggcaatatgctgtgagtcccaggccttcgaaccggtaaattccttactgcaataaaaattcattttagctctctcaacaggagtgatttaacgccatcgacatcatcaatatcagagagagttgatcgattctatacgtcaggcatctgttgtcctgatctgtcctctggttgtccgtttaggggcagagcgggaaggtcgcaatgcttttcaggcaaacccggcaccgcacatgtccgctttatgccagagcaggcgttgagcgtatggtaatgtgttcacgattagccacagggatacttctgaacagttatgggctgaaatcgcatggatgacgaatcgcctctgttcataccaatgccaaaggtctgtaatgaaatcgataaatctggaaagcttgtatcgctctgccaacgagaacaccctctccatctggtcggaaaatgcaggagttggggctgttaaagaggggaactactatgatcctgtaaggctggctcttgcagcgggcattcagccgccggtgacctttgatgtctcacgtcttatttgtgaattacagcagctcacaaaggatgatccccttgccgatattctgcccacacagggtttccattttaccttcctgcccctgactctgccgctctataacaaaaacgagccattgcccgaaaaaatcgatgaattgacgaatatctggagcgaatttgatgcgataaaaattgttatcagagatctgcagttagttgcattgcccagtcagttattgcttgcggggatccctgatagtttcggcaatagccatgcgccactcattctgcgaaaaagttctggattcgcactggaaaaatgagttgctgatgcgtcataccggcagcccattaccggcacccttctggcacagcacgattctgcgctacggcgctgattttttacctgcacccgtgcgtgagtttatttttgaacgtcagaccattaattttggggatgtagatggagaattaaaactggcgagggttaactacaactggacaaaatgttattcgttggcggattaattaagacgaagaaattacatgataaataagatactgcctgccctcgcgtaaacgtttcagaagtgggtaatacgccccttttttcgctcataacagtcattaacccgcacacattccgctctatacctgacaaccccctccggctgaaaaaacagggcctgcgcgcaacactttctgcctattacaaccctgatgtcgttagctctagggtgtctcattcacatcatgtcactttttacacgagtaaaaacctcaggaaatttaaaaaatcgccgcgagctgccgataacctcaggtatcgaaactctgtacgcaggaaacaacatccatgtcaccatccgacacccatagtaagcatcaggaaattggcgaaattacggcgcgtgctggcttcatcctgcggcagcttcgcgacagtctgcaacagctggggcttgataaaaccatcgccgatgtggcgggaagcatcccaaacgcccgtgaaaggctgggttatgtcgtcacaatgacccgcgaagcagcagagggcgtaatcaacagcgtggaaatcacgcagcctctgcaaaccgatctgggagaaaaagctgagaaactctcgcaacgctgggatgccacttccggtacgctgtcagacaaagaacagacccaggcattagcggcagataccgttgccttgctgaatgatgtcccccgcgtcacgggtctgacgcaacagcagttacacgcgattatgatgtcacagggcttccaggacctcacaggacagattgtgcaggctatgatggccgtgctgaatcaggctgagcagcagctgatacaggtcatccgcgataataccggctcacacagcaccgccgagcgcactgcgccgtctaaaccttcctccgcaccagagactcctgccagtcaggatgatgtggacgacctgctggccagtctgggaatgtaagccgacccgaagaaaatacgcgatttaaaatgacgattaatgattaaaggtctgcgcaggacaaacagttcgtctgacagcaaacacgctattgcggctaaatgtccgctttgcgctattagctgacgcgatttaactatcggcccgttgataaacaaggttctgaccaggccagattgcagaatctggcatttcagaaataagagcataatgaggaatggtatagtctcttattcgatttattttcccatatttattatatgacggtaggaaatatatatggcataagagcattaaaagaacactcaaaggagtgacgttatgtcgctttatgaccttagaattgaatcacatgcattaccagaggcctggcactctcaggtattaggccacattggcacagcgaatctcaaagttttacgaatggatgaacgctctgttattgaagaggtacatgagtatgatgaagggttactggtcattgacggtcgtcttgaactgagcgtgaaaggaaaacaaatctctgtaacttctggccagctttacgtagccaaggctgggattcctcatgatgtaaaaaaaggcagttttggcacactggttatcatagatttgccagaaacatgagtagcctaacgatagtttgtcagatatttgatcagaagataatttgcctgatgcagatgtccgccttatgccataagcggacgtttatgaaaatgacagtagattacacgctgcgatatttctccagtttgatatcggtatcgttaatctcttttttattgccccagccgagctgcatgtaaaatttcgccgcgcgactatttttatcggtttccagccaggcaatctcatgatgtttgaataattcctgctcggcgagaaaaaccagcctgcgacctatcccctggccttcatattccgggagaacaaaggccgcaaaaagacagccttcatccggtaaaatcattgaaaagccgactattttttcgctttcagccgcaacccaggcgcataaattcttttcaatcatatccgccacgacgctttcggtgatccccatctgacgcatttcttcacgactcaaataattctcgagtactgaggttctgacttcgaaaatactgtcaacatcagaagcccgggctgttcttatatttatattcattagtcttactccttgtatgacaaaaatattttttgatgatgcctgacattcccttaaacgaaccatagaattttaagcgaaaaggctgttaaacggcaggccgtcaaaggcggcactacctcaaagcctgcgtaatgaatgaagccgttatgataagaacgttgtgcaatatgagctcagccgaccttaactccgctctgtttcttcatagtgacgcctcattaactaatttgagatagcgggaacccgatatgtttctaccgctcaccacacagacaactttacgcccgctcagttcttttgcataacggatggctgccgcaactgcgggtacgcctgaaggctctacaacatggctgtgcagattaagcattaacagcatcgctgctttaatttcagcttctgaaaccagaagaacacgatcgacgcgatcacgtataagtggccaggtcatcgcttcaggctctatatagccacttatgccttcggcgattgacgacgatatttccactgggatcgcctcaccagcttctttccagcgcgcaaacgtcgggcttgcttcactctgcactgcccacacttcggctgcagggtttatgcccttgatggctgttgcgataccggaggccagcccgccgccgccaatgttcacgagaataacgtcagcgtctggccagtcttccatgatttccagaccgacggtgccgcctccggcaatcatctgctgattattataggctgagacgaaacgttgcgccggactgttgcgctgcaacaatggcttcctgccttgcatcttcaatattgtcaaaaaacgtaacctgcgcaccataactcttcattgcagaaaccttaatcgggtctgctgaaaacggtaagaatatggatacgggtatgcctgccgcatgtcccgcacaggcaagccctaaaccatgattccctgccgtcggagcgatgacgccggcacgtcgctggtctgcattaagactggcaagaacgtttgcagcacctctcagcttaaagctacccgtatgctgaagattttccatcttaagcctgacctccgtcccgacaagagcagacagcgggtgcgaaagctccagcggagttttgcatactgttgatttaattcgcccggaagctgcataaatatctttcagcgtgacactgtctgttagcctttgtctgtggtttgtcatagtatgcccctaaagttatataagaaaatgactatataggcgattgactatatgcacaactcaaagacattaatggccgatatttttcgtgcccttggtaatgagcatcggctcgtgattgttgaatggctgtccgatccagagtcacattttccggtgcagcaggacggcgatctggttaaggatggtgtgtgtgtcggatttatcaccgaaaaaattggtctgagtcagcccaccgtgacaggccatctgcaaattcttgctaaggctgggattgtgacatcgaaacgtatcaagaactgggtgttctataaacttgatcgacaacggatggatgaagctacggcaatgttgtctggatatgggaagcaggcgactgattcacctgaacagccataattggtcagtatgtgtatttacagggcagtaaatccagtgtgtgtgtatctcgctcgtggcgtgaccgcatttcagataaatttattcggtcatcgttatctgttgtcatcttttgcaaaactgccgtttaacttcggaaactaccccggctgatgaccagcctgtaggtctgggtccacttttcattcaaagcggaccttatgacctaattttctgtacgatccgtgcctgaggcggccattaattacattcagatgcgctaagaaacattgagccgcttattttccttcaggatgattcggacatatttgagaaccgactgcgcacgacacgcctggcgtttctgccgcaacccgtcaaccaacctgccccattcaggcaggtggaatgcttttattagacgagattcaccagggtgcacgctctccatccaaaaagaatcttgcggtgattttctgggatacttcagcagcgagccagacgatccccctggccgcctgggatacagttcgataaccggtatgtccgttaaaatcggtggccgtatatcccgggtcaactgcgtttacgctgatgccatactcagacagtgaattggcaaatgccaccgtaacgccatttaatgctgtttttgaactggtatagcccagtgccgctacctgagagtagggatgcgctttgtcagatacccattccagcgatcccagcccgctgctgaccatgataatccggggttcctcacccagtttgagcagcggcagaaaagcctgcgttactctgatgacgccgaaaacgttggtgttatacaccgtcataatatcgctgatgctctgcgactcaggcgcgatgggccaggttccgggaatacccgcattattgatcagcacatctagttttccatcttctgactttatctgcccgacggccgcatcaacacttttctggtctttcacgtcaatgatagccagccgcactttaatgccttccggcagcaaccggctgtcgccgtctttgaaaactggctgcagccctgctttacgacgggtgaactgctgcatctgcttccgaagtggtggcccgaatttgaaggtccctggctctactttcccagccgctttatgtcagcacctctgcgcgcttttgtggatttcctgaaagaggtccagtcaatgcctgaaccgctcgattgtctgcagtagcaggcccgccagtcgatattgagctcggctaacaagcgcacctcttttttgacaggttgtggcaggttaaaacgcactgaaggcatggggccgcgtttcagaccgctttttgccagaagcggacgttaaggagtagaaggagggtcatattcccaggcagatggatcgctgtaaatattaccatcgtcgtccattacccgagcgccgaggaacccggcaatgtctaacatttttctatatagctgcgtgtctggccatttggtgtaaatattgccatcgttccagtcaagccatgactcatcatgcgataaagcacccgaccacaaagcatgataatcgccatttttaaggtctatcgttaattcgttatcactatcaatgagagaaagccactcctcaggagttatttttgcttcttcattttcagcccaaaaatcagcccgtgttatatataactctacgcccatgatctatccactaaccattcaaacattggttttgcttaacaggttcacttacaaattaacactggggattgttttacgcgagttacatgcaaactcaggtatatgatgacgtccgcttttcgctcatatcgtacgttagccagacgctaatccgcttgtgccagaagcgtacgacgccagccagtccagggctatctcgtgctaatagcaagtttagccgcgaagcataaaaataagccccctgttgctctgtccatcacccggacaacgcgacttttcttcaatacggctgacgcaaaatgcgtggataaaatgagagtgactgaccatatagtcccgatagcaacgtggatgctgaccaggataaaagtccatattaaaggtgagtgaccggctggtatgaactgcggcaaaaaagagacatagaaaatgcccattttgggattgagcacattccccagcattcctctgataaaccagctcccctgagaaacgttgttgtcatcaccattactgaaagaagatcgaggacgtatcagcagttgtaagcccagccagctcaggtagaccgcgccacaaactttgagcacagtgtaagccatctctgaaaccgccagaagagcaccaagacctaacgcgaccagcgcgccccatacaaaacagccagcatcaatgccaagcgcagcgtgaaaagcctttttgccgccctcagcacaagcggtgcggagaataagtgccgtatcaaggccgggagtcagggtaagtaacagtgctgcgagagagaatgcgaagagggaatcgttaacagtcattttctttgtccgaaagagcagatgctaatcatttagttccctgcaatcaatctatcaaatattactttttaaaagtccgcttctcgctcatagcggacatgggccaacgtttaagtccgcttcgtcccagaagcggaagtagcgcatgaactgttatggtaaatttgaacgtccggcttaatcacttgaggataagcagagtgcttctggagaagctcagattgcttgagtgcagccttcacggcgacaggcgcaatgatccggagtggctggaactgattcttcatcctgaattccgtgaaatcacccggtcaggtgtgacggtcgaccggtcagagaccattgcgtcgctgctaagtgaaaaggctgcaccttatattctcagcagcgatttccgtcttacggagatgggctgcggttacgctctgcttcactatcggacgttttacgctgatggtagccatcatgcactacgttcctcttgctggatttgttcggatgagggccagtggactctgttttttcaccagggaaacgccggctgcaggcaatgccggggttcagggttgagttgcacacttaggacagagagaatgtgtttatgcggaagattattgttgtgccatacgttgatagatggcctgagatgtttgaagctgaaagtttactgataaaaacattgctcggtggaatggctaaggatgtccatcatattggaagcacgtcagttcctggtctctcagcaaagcctgtaattgatatgctacttgaagtttccgacatcaatgaactggataagtaccattcagcaatggcccacgccgggtatgttgctcgcggtgagaacgggattgcggggcgcagatatttcattaaaggtggtgatcagcgtagtcatcaagtccatgcgtttgcagtcggagatatgcaggtattgagacatcttgctttccgtgattatcttcggagaaacaaagacattgcagaagagtatgctgagataaaacacgcagctgtattagtcagcaggaacgatgctcatcgctatagcgccctcaaagcgaaatttatagagcgtcatcaacaactagcgctagctgtctgagaacgattgagattgagttcgttgccgggagggtatgttcaataacgatgaattcactgagtagtcatcagtcaacgtctgctgttcgctgtgagttcaacgggtcgatgcaacgctatccttaatcaaggggggcgtttccatgaaacgaagaactcggattaactacacgccagagcagaaggcgattatctgggacagatataagcaaggtgattccctgcatgatatcgccagaatgttcgacagatatcattcttctattatgcccactatccaccagactgatggataccgcccccctgtccgaaagcggcatccgttagcgctttcacttgatgaaagagaggaaatatccagagcgctggtagcaaaatcagcatcagggcgatcgcaaacaaactatcgagagccccctcaacgattagccgggagataaagaggcacggtggtgcaaatcaataccgtgcatcaaaagcggatactgctgcgtgggaaaatgctctgagaccaaaaccttgcaagctaattgaaagacccacactgtgtaaaatcatcgcagagaagatgcatcaggactggtcgccggaacaaatcgccggttggctgaaacgctgttatccggataatcaggaaatgcatgtgtcacacgaaacgatatataaacgctttttatacaaacccggggtgcattaaaaaaagaactgcagcaatgcctcagaagcggaagagtcgtgcgtagatccagaacatcatcgcttaaagggaaaggattagggtcaatccgggatacgatctctatcagcgaaagaccacctgaagccgctgacagagccatacccggtcactgggaaggtgacctgatccagggctctaaaaactcctatatcgtcaccctcgtagaacgtcattcccgttttgttatgctggccaggatcagggacaacaagaccataacggttatatctgcacttatcaaacaagcccgggaattacctgctgagctttataaaacattaacatgggaccggggcgctgaaatgaccagccacacccggtttactgtagccacagatatccaggtttacttctgcgatcctcaatccccctggcaacgcggctccaatgaaaatacaaacagattgcttaggcagtattttccaaaaggaactgacttatcggttcacagccagcaaagactagacagtgttgccaggcagctcaacgagaggccaagaaaaacgctagactatgaatcacccgcagagcgttttaaccaatgtgttgcatctatcagttgaactcacagccagaagcggacatttttgctaaaggtgatgagttactgggtcaggctgtgcagagtaaaagcaatgagcaacaccccgccggcaatgttgacgtattttttgagcattaatggatttgttttttttactgaaaatataagtgtttgactgacagcgaaaagccaaacgctcatgaccacgacatgtactgttgccaatgtcagatagttgtagacgcctccctgtatccctgcgaactgcgaaacgactgtcagataaaaaatgatggctttaggattcaaaatattagctatccaggcctctcttaaagtcaccgaatgtttcgtaacagcaagcccgctggcatttgaccttatcccgctgcggatgagcattgctcctaaccagagcagataggcggttccgaaaactttcaacaccgcaaaagttgctggagacgagatgatcacagcggttatacctagccctatgagaaaccgcatgtgtgtatatacccaaggctgttccggcaagcgttctgaatagtcctttgtaaccgccagccagagctccattcataacaagagtgaagcttgctccgggggacagtgcaacagggagtagtgctggcataaagccataaaggtttatttccataggtttggatattaattgatgctctacttgatttccattaaggcgcttcgccagaaagtgatatttaaagcaattggaatatataaatctttgccacaaaaggtccgcttctcgctcatagcggtcatccgcccttttcagcaggaagttttgtaccagaagcggaacttgcttacattgctatgtcagtttgctgggagcaggtcagataggtttttatgaccttttcagacagggtcgtatcaggattaatttctgatactgacaggcgtggttttttacatcattgaacgtcagactccatcaaccagggaggatgaatcctctcttttttattacgtcagctgcacccagtggcacgccacctgatggccggggcgcatttcgcgcagttctggaatttctgtgcggcagcgtactgttgcctgcgggcagcgggaagagaagcgacagccagagggcgggcgcgaaggatccggaatttccccctgcaccaccggcacggataagcttccaggggcaagcgtcggcaccgccgccagcagcgcctgggtgtaggggtgaagcggctggctgaacagcgcatcgcggctggcagtttccaccagtttccccagatacataactgccacgtcatcacacaaatgctccacgacaccgagatcgtgagagatgaacaggaaggtgacgccatggtcatcacgcaaatcggaaaacaggttaatgatttgcgcctgaatagagacatccagcgccgagatgggttcgtcggcaataataaaatccgggttgagaatcagcgctctggcgatgccgatacgctggcgctggccgccggaaaactcatggggaaagcgattgtaatgctgcggcgccagtccacagattttcattacctccagcactttgtcgcgcagttcttctttgctgcacagcgtgtgttccagcattgcttccccaattgcatcacctattcgaatgcgtggattcagcgagctgtaaggatcctgaaataccaactggattttcgggcgcagcgcgcgcatctgtttcggcgtcagatcctgcaactcctgaccacgatacttcacgctacctgccgttttgtcataaagccccagcagcgtgcgtcctacggtggttttaccgctaccggattcgcccaccaggccaaaaatagtgccaggtcgaatgttaaaactgacgccgtccacagcgcgtagctgtcctgtttcctgaccaaaaagcccgtcgcgtagcgagaaatgctttttcaactcgtccacttcaataacatattgctggctcatgcgatcggctccgctaactcactgtgaatacatgcggcttgccgcgtatgcccgatcagcggcggaatgaccgcgtggcactgcgcggttctgcgttcgcagcgatcatagaacgcgcagtacggcggcagtttcggccaggtcaggcacctgtccgggaatggagtagaggcggcgtcggcgctcgcccggaacagggcgcgatgcgataagccctttggtataagggtgcagtgggttgtgtagcacatcggcagtcgggccttgctcaacgatgcgcccggcgtacatcaccacgacatgttccgccatctgcgcgataacccccaaatcgtgagtgatcagcatcagcgccatctgctgcgcccgcgcctggtcgcgcagtaagcgcaggatttgcgcctgcacggtgacatccagcgccgtggttggctcgtcggcaatcagcagcttcggctggcagcttaacgccatggcaatcatgatgcgctgcaacatgccgccggaaagctgatgcggatagcaacccatcagactctccgcacgcccgagtccgacatcggtgatcagttgcgtggcgtgcgtccaggccgcttttggtgtttcgccgcgatggcgtatcagcggttcacaaagctgctcgccaatggtcagcaccggattgagcgctgtcatcggctcctgaaagatcatcgctaactgattaccacgcagatcggccattttcgacggcttcagggcaagcagatcggtgccctgaaagcggatttctccgccgtcgatacgcgcaacctgcggcggtaacagtcccatcagcgacatggcggtaacgcttttgccgcagccagattcaccaacaacaccaatggtttgccctgcctgaatggtaaaggagacatcctgtacagcgcgcacacgcccctgctcgctggcgaaggagatggataagttattaaaggtaattagcggctcgctcatttcaggctccgtttcatcttcggatccagcgcatcgcgcaggccatcgcccagcacattaatggcgatgacggtcagaaaaatggcaatgcccggcggcatccacagccatgggcgacgctgaaagtcgatcaggctgttggccgcgtccatcatattgccccatgagggcgttggcggtacgacgccaaggccgaggtagctaagcgcggactccatcaggatggcgttggccaccgccatggtcgccatcaccaccagaatgggtatggtgttcggcaacagatgaccgaacaggcggcggcgcgaagagaggcccaggacctgcgtcgccagcataaaatcgcgttcgcgcagtgacaggatttgcccgcgcaccagccgcgccagcttcggccactccagcaagctaagcatcactactaccatgtagatgcgcgaatcagacgaaaaatccagctcagacaacatcgctccggcaacaatcagcagcggcaggctggggatcgtcatcaccagatccgccatgcgcataatcagtttgtccgtccagccgccggcatagccggataccgcacccagcaggtagcccagagccaccgaaagtagcatggtcatcaggccaataatcagcgagatacgaccggcaagcagcaggcgggtataaatatcgcggccaagaaaatcggtgcccagccagtgttctgcgccaggcggtttgttgatcatcagcgcatcggtggcgtcatctttccacggcgaccacaccgggcccagcacgcaccagatggtcatgattaccagcagaaccaggcacagcatcgacagatgattgtggcgcagcgctttccacgcctggtgccacggagaaggtgtggcctgcgccatcgccggaatttccgccttgcgtaagcggcgattcgtagagaaaagggaaccgaacatcacgacctcacgcgaatgcgcgggtcggcccacgcgtacaatatatcggcaatcaggttgcccacaatggtcaataccgcaagaaacagggtgaaccccatcagcaccggataatcgcgggcggccagagaatcaatatgaatatgccctgcgcccggccagttaaacaccttttcggtgatgatcgcgccggaaaacaaccccggcagctcaaaacctaacagggtgatgattggcagcaacgcattgcgcagcgcgtgtttaaggatcactgtacgttcgcgcaaccctttagcacgcgcggtgcggataaaatccatcttgactacgtcaagcatgctggcacggaaatagcgcgtcaggctgcccgcctgcaacatcaccagcgccatgaccggtaacaccagatgcgccgcaacctgcatcacccacacccagccgttatcgtcgctgccggtgttggtcatgccgcccactggcaaccagtgcagatcgactgcgaaccacttaataagcaacaggcagagaaagaaggttgggaaagacatggcggcgaacaccgacacgctcaccagatgatcgaacagcgaattgggtttcagcgccgaggcaatgcccaccgcaagcccgatgctccagtaaaacaccagcgcaacgcttgccagcaggaaagagttccagatgtactggttaagtagctgactcaccggaatttggtattgcagcgagaaccccaaatcgccgcgtagcaactggccgagccaatgcagatagcgggtaaggatcggttgatcgagtccataaatagctttcagttcggcggcgcgcgcagcggtgagggtaatgttaccgtcgataaagtcgcctggcgttttcgcgaaaagcataaaaataatcagtgatgcgagcagcagcattggcagggtttgcaacagtcgcctgaggataaaatttcgcatagctttctcatgacaactgccgggagacccggcagttgttactgttatttaatgattttcacatccggcaggctaccggtcagcccgttgtagatatctggtttaaagccggtgacgcgggcactactggccgataaaatctcgcggttacccagcagaatcaccggcggatcgtccgccagcactttatacagctggtgataaattggtttgcgtttttccacatccagcacagcattaccttcgttgatcagcttatcaacctgcggattgttatagccggactctttcgcttccgtgctgtagtaatcccacacgccatcatgtggatcgttgagtgtgctggtgctgaaagaggccaggtcatagttaccggctttacgctgtgccatgagggcgttgaaatccaccacctgcggcttcaacagcacgccaatctgctgccagtttctctttggcgatggggatcagcgcatcattcagcactttcttgctcaccagcagcgtcaactccagacgtttaccgtccttcacgcggatgccatcaggccccggtttccagcccgcttcatcaagaagtttcttcgcctgtgtcgggtcaaatttgtatggattcacgccatctgtgttatacgcccatgaaatcggggcaataggttcaattgccacttttccatagccctgataaaccacatcaatcaacttctggcggtcgagaccataaatcagcgcctgtcgcactttcacgtcctgcaacgccgggcgacgtacgttgaattccactttgctgtagtcactggagccaaacaggttgatattggcgaagcccagcattttcagttgttcgatatcatcagggcgagaagtaaacgagtcgtaatcggtttcgccggtctggaacaactggaagttagtggacgggttggttacgcggtagataaagcgcggcgtcggtggtgtgccacggtaaaaatgggtattggcgtggaaacgaatctcctggcccggaatatatttgtcatagacatacggtccgttgcccagcggtttaccgtgcaacatgcgcagatagtcgagattgccgcgctgataccctttcccataatacgctttcgacaacaccgggccgccaattttcgccagcgttgtcgcgccaggctgcccggtggtgacctgtaatgtcagcgggtcgatcactttcaggccactgacgctatcagcttttccggctttatactccgcgccgcccacaatgttggcgagtgtgatgtcagtatcgccatcatatttcgggtcatgcagcacggtcagggtaaacgccacatcttcggcggtgaggggcgagccgtcgctgaaagtcaggtgtgggcgcagcttaatggtgtagacattgttatcctgactaacgctccagctttcggccaggcctggcaccagcttgccgtggctatcccagtcaatcagacgtgagaaaatcacgttggtgacgttttcgtcccagccgttaacaaagaaataagggttaaaaataccctgcggttcagagataccagccaccaccgtgtctttacgcagcttagccactgccggaatctggctggcatcggtggctggtgtaatgccctcttttaagggtacatcggcgaaagaggctgaagagaaagccaccatactgctgagtaacgcgattttaagcgccagagtaaaacgcgtgggttttgtttttatgcttttcagtaggatggacaaaatggctccctcatcaaatgtttgtatggaatttacaaatcatgacgaaagataaaagccgcaccgcaccctgtctaacaacgaaacaatctggcttatagcaaattatcattagtagatttatgagaaagcaatgcttaatttcatctaaagaagatgagacattacgcggggcagtcgaagagttctgatatcgtaaggggtttgataatcaataatgtgaaaaaccacggcacagcgcgccattgtttgtcgaacaggcgcttgcgcttgtcaggcgcgatatcaaatcccgtatatccgacgcggatcttcgtcagcatggaatcagcccggagcggatgcggcgctggttcctgcaacagcacggcatcacttttcaggccttccagcgaatgcagcgggtaaatattgccctgcaggagctgaaaagcggacgtgcggcgactgacgtagcactggacaatggctacgaatccctgagtgggtttggttacatctacaagcggctcactggcgcagctccctctcagattatagtcattcaccggtttaccactacactgggcctatgtttgtctgtgccaaagagcaggagagagtgtgcctgctggagtttaccgatcaccgaatgtcagagacggaatttcacgatatccagcgtttacttaacgccaggattgtcacaggtgaaaatagtcatacccgacaaacatgaaagaaatcagagttaaatgagtcaatacagaatgcttgctgtatgaaacagtctttttccgatcctgttactttttacatgcagttttaaggtatttgaaatccccacgtccgctcctcgctcacagcggccgctcatttttgtgaccagtaatgatgccgataccagtctgcttcatgggctgatctaaccgctactacctcaccccgtggcccttgcgcttccggactatcttcctgttggccagcaaccagtcggcagcaattgacaatatgtaactcacctgaaaacccgtttgaatcgagcctctccactcatttgcatttttcaaccctccggcgtcattctcccccaccttcagctatgcctccgctgaaatatcgtatcaagcacgaagatcgccaaaaaattaacctaacaagtgttagaccggtgttgacgtgtgttgatttgcccgctaatgtttgcctacctaacgttagttagataccccaaccatcaacctgtaggatcgaccatgactgctaaacttcagctttttacatcaccttcggcctttcctaatccacagcgcatgcggcttttcatgcacgaaaagggcatcgctgaccagtttgccgagaccatctatgacatgtcccctggaggagagcagcgtggctggcgacatttgaatatgaatccgtggggcgaaacgcctacccttgaactggctgacgggagttatatttctgaaacggctgccatcgttcgctatcttgatcaggagtatccgggccgcaagattatgggagaaacagcactggaacaggggctggataatatgtgggataaccgggtgtgggtgcatatcctgtaccgcatcgttacagcgttccacgtgttgcacaccggcctcggcttcaagctggaattgaccaaaaatgaggcctggggtgaacactgccgtaaagaagctttggctcacgccgcgctggttaatcgccatctgtcagacggccgcgaatggctgctcggcggcgatgcgccgaccttctcggatattactctggcaaccgcgatcgccttctcgaaattcccggtcaatgccactccactggacgagcgttttgagttcttagatgcctactggcagcgctggacaaaacgtcctgccttccaggcggcctacgccgatcgcaacagcggcattcctgagctggattcgccagcccggtaatagcgccactcaatgtaaactccggtacgccgggttcgttatctactgactttcccggtgaccagagtgcttatgatagcgtcggctgtcgatgttacttgctaaaccatgatggaatgacgtctgcctgagcaccctggatgcattgaacttactgtttttcatggcaatcaccctgtcacccggtaagcgtttgctgtaaattagcgttctctatttaagagatcatcccaataccaaaggcatcaagatgagcgtcaacaccagggaagccattttgcaggcggccaggaaaattgcccaatctcagggctataacggtttgaatttccgcgacctcgcgcaggatgtgggtatcaaagcggcgagtatttactactattttccaggcaaagccgagttgggtattgccgttgccagacgatactgggaggacggtgcgctcgcgctcgagatgatcgaatcagaaagcccctcacccattgatgcgctgggtcgctttcctgaaatcttccgaagatcacttgaggccgaaaatcgtctctgcctgggcagtttcatgggcgctgaaaaagagactttacctcctgaaatgaatgcagaaatacagaagtttgctgatgtaaacattgcatggctgaacaaactgctggtggctgcgaaggtgtgcgattcaagtgagagtgaatccagagcacgtgcaattttcacggccattgccggtgcccagcttatcgccagaagtcgctcagatatctcgctttttgattcactggtggattcataccgcgcctttggacctctgccagcatagcaactgcccgcaatccgattcagtgaatgggcggttttctgcacgcgcgcccaatgcggcgcggcgtccggtagcgtatgtgcttttccactcaggaacccacccctttgaatcaatgcgcgacgggccagggtaaaagtattacgccgtgtctcatcatcacctgcgataaaggggtgaaacctcggttcaggaaagcgtttatttcagcggttcaggcagctaacaatccacaatttgatgtccgactgcggtttctttagcggcttctggccaatagtcgtggcaatcagcttatcatcaaccgtaagcgtcccctgctcggtcacccgataatctttaagcttcttacctttcagcaatgcgggtgatgcggtacccctgagagtacagcagtaaagcctgcctgcggggatcgcgttcgtcgggggcggatgtcatgttcacgcagcccaaatacggccttgatactatttgatcataagaatgcggcagattgcgcagagtttcccccctcgcctttgatttacgctgttatatcctggaaaagatgtttacatttgttcagcaaaattatcggccgcttagcagagcgtcactgaccgacacgcggattgatcgcagggaagaacagccgttaacttcatcatcaaagtcatacagctaacagaggcagggaaagaatgagggagcttgcacccgatggcatcaccgggatgccgtcacggacggcagagtatctttgtcgccagatcgcacgcctgctgaaaggaggaatcctgaccccggagacctgccagcgtatctttgctttctgtggaatcagaccgtcagatgctcagtggcgtcagtttcttatcccggtactttcctgtctgggattactatcactggttgccggagcggtgttctttattgcctggaactgggcctggctgccgaaaatggcgaaatttgccctggccgagctgttgatcgtcgcgctggcggtgattgtctggtggcgctggtacagcacgctggcacgcaacgcattactggcgacagggttaagcttcggtgccctttttgcgctgtatggacagatttatcagaccggtgctgacagctgggagctattccgggcctggttatacgttcttctgccgctagcgctgattgcccggcaaaacagcctgtggttttgcagctggctggtcgctaacctggcgttccagctctattacaacaccctgccgtcgtcactgctggatctcgccgcgtctgacagtttaaccaggctcccgactgctgtgctctacggatatctggcgttgctggcagcctgcctgattgtcagggaagcgctggcgtggcgcgcgataacgcatcagcccgagagctggctggcaagccgctggttctcgcgagtcatggcgggatttttactgcttcagctaaccgccattgtggccggaaacctctctgactggggcggcggtgaccaccttccttatatcacgggcggttgggtgatcaccctgctggcaggttattacctgtaccgtgaccgctatccggatctctgcatgctgacgctgggcatcgccagcctgaccgtggttggctgtgcgctaatcatgcagttatttcttttagcctacgataccggtgatctgtttttaaccggcatcctgatggcattctgggtggcggtaaatggttcaattctgctgaaatggcaacgcaaactggttgaaaaggggccaatcgatctggctccggccaggctgaccttactgacagacactttacgtcagcagggtttgctgagcgcctcgcaggttgaggaaattaagcagcgcggtcacgcatccgacctgccctggtatctgaggctggcgctaagcgtcgggggctgggtggcagcgatcatcattctgttactgatgatactgatgctctatgccactgatctgctggaagacccgaatgctgccacccttattattccttcgctgctgcttgccgccattgcacgtggcctgttaagcagtcagcgtgacggtaaacatcacctcgggctggcatgggcgattgcggcaacgtgcgggctgataaccggtgttctgctgcaaattcagagcaataacgtcagctttattatgctgagttcactgactgccttgccgatcctggccgcaatggcgatggcgatgcccgaccgcacttttcggtttatggccatcactgccctgacctttttcctggtgctggcgggctactctctgacccggatctgcctgtctccgatggctgcacgacttgctgtgtccgtactggtggcggcggttatatttttgtggatgtggactgtcagtcatcagttgaggttacaggcagggccgtatgctgacgcgatacatcctctgctgtatggcatcccgtgtggtctgatgttgctgagtttcctcggtataaacgcggcgtatctaacggatttcctctggtcagcatcgcaattttccacgctgcagtcttggacaggcacagggatcgcggctggcttagtgctgagtgcgctcagtcagaaaagacacagcaagccgctgttttcgattatcactctgcccgctgcacttatctgcggggctgccgccctctatgcaccaggtatagggctgggattgtggttaattctgatggcacgttatcagggaagtttggggttgctggtggtcagtggcggtttcatggtgctgtatgtcattggctggtattacttcctggaggtaattctgctgcagaaatccctgctgctgctggtcagtggtctggttttacttgggctggcatggggagtcaaaaaagtattacctgcacaaatcggaggtgccagtgaaaatgcataaacagagccgatggctggctggcgctgtgatagcgctggcgctgatagccgtcaatgtcagcatctggcaaaaagagcagttgctgaagcaaggtgcggtcatgattttacctcttgccccggttgacccgcgatccctgatgcagggtgattacatggcgctgaactatgccctcacccgcccgctggaaactggcgttgtatcaacaggctgagtcctgcggcgcgaccctgtcagcgccatgcctgcccaccagcggaaccctgattattgacctcgatgcgcagcgtcacgcgactcaggcacgttttgatcagggtgaacctctgcagccaaatcagctgcgggtaaaataccatcaacattatggctcgctgaccatcggcaccaacgcttatttctttcaggaaggtcatgccgacagattcgcgcaggcacgttacggggcatttcgggtgggaagcgatggcacagcactcctgacggatctgcttgatgagcagggtaaggtgattcagccttaactaagcgagacgtacactgcactgccccaaaaacctgacaggcggccttaatgttcggatgctccagtcagatcgtcaaacgtacaacctgccgccgcaagcgttgttgtcagatttccaaaggccagttttacctgagcagcaaaatcgggttacggggtgccattggctcggatgcatttctgacccaggacaaacagcagatcgcctgaacggatggcagcagcataaacatgctgctgatagcgggcgaactgaagtccgcgttttgccagaagcggacatggcttacctcatgctgctttaacctcaagagtaatgtctgactctctttctgacttgaactacaacacgtacggactacattaagatttctcatttcattcaggagaactggtgatgtttagtcatgttcacgttggcgcaagagatctcaacacattagtggctttctatgaacctctgcttgcgaagttaggctttgaacagatgccagagggtaatggcggtcaggctaaaggggttggctggaaatatcctgataaacgatggcctcagttttacgtgcaggtgcctgaaaatggccttccttcaacctggggcaacggtatgcaagtcagttttatggtcgcttctcaggaagaagttcaggagatttggcacctcgccatgaaaatgggaggtgccgacgagggtaaacctggtttcagagaatacgcttcagacttctacgcggcttattgtcgggatccggaagggaataagctgtgctttgtccacgctcctgaagaataaaagcagaagaccaggccactgttctcatattgtctgtacaaccatatgaattacggtaactattgcataaaaaaaatggcgcccaacctgtaattcctaagggagagagtgaatgcaaataccctcattaaaaacagaacgtttactgttaaagccattagttatcgaagatgcaccatcaatccagaagctctttccgcactgggagatcgttcgttatatggtgtcatcagttccgtggccctatcctgacaatggcgcagagcattatgtaagtaatgtagcactgccagctatggcacaagggttctcatgggtctggagcatacgttatcggggtaaaccggacgagctgataggagttattagcctggacgatgcagaggacaacaatcgcggtttctggcttgtgcctgaacatcagggacggggattagcgcgagaagcaagtattgccgtgacagattactggttcaataccttaaaaaggtcagtattacgtgttcctaaagcagctgaaaatatacgttctcagaaaatttcaatcagtagcggtatgcgattaataagaactgaaaaaaaacactttgtcagtgggcttctggactcacaattgtgggagattacacgtgatgagtggaatgcaaatcgtcactagcgcataacatccgcctggcgctcatagcggacattagcatgacgtcagtctcccttctttccggaagcggatattttcagacaagcaatagcccggtgaagcgttatggacattgctgggctggctcatcatgtcacagactgccagatagaggttacctgcaggtattgctcctttcaggccgcccacgtgatacgggcgttcctaagacatgccatacctgaactgcctttgttgtccagccagaaagtgatgaagcaacggttgataagggcagtattgcagtggcgccggttagtgatcctgacttctgctttgccagggagactaactgttttgcgatcaagcctcgtgccgaaaatttaagcgagtaagctgcatcaatatagctgctcagacatagagaaaattatgccgaacattattgacgacaactggattaggatatctgtgatatcagcaatatttagtagtgtcgtgggttcattactggttttaacctatctttccttgggaaaaagcagtacacccgtagtgggtttaatttttacttattttttcatcgttatggtgagtattattggcaccacgatgggctcaatgataatcggcatgccattagcgatgatttcaaagcgattttatcctgacgatgccctgaaggggagcttttttatcgtgtgctctgcgctcttcatgtggctggttgtactggcatggcctgttatcaggatatgtgaaacgccttattcggatattttgcttttaagcccctatgccttctgttcagctgccgcacttgcttatctggtttactgggattgatgagtattatatcaatcaggatcggggcagtaggaccgttaatgaaaagagctaatggtatcatttttcagccagacatatagaaacaggtgagtccagagtgtcggaattcggatgttccccccccctgagagcagttttaattacagactcacctggatgttaattagataatgtttacgagacagcacgtgatcacattttgcctgccagataatcatggattctgctcgaaatactgtttatccatctcgacaagtttcttttgtaatcctgcctccccttcaaccacttcgtaaaatttactgtgagtataaagataaatacgctcggatgacgcaaacataaacatgtctggtgaagccatatttgagaagcgactgatcacttcaggctgtaaaaagatgacatcattcccgatgtcaccaatcactccgcgcccccagtttcccgcacgaaaaaaggtatctggattgctatatcccgtgcatctggtgagcccatgctccggacaggagacaacagaaagaagatgaaatttactcagatctaaatcaccaacattatagccaccgacataggttgagccattacttttgaagacattgtaaatacgccatttatcatcctttccaaatggaaaaataacctggaaatcttccgggttaacctcttttatcttctcgctccggaaatatacagacgattcatctttcgcgtagctcgctaattgttccgattgccagtatggccgggtagtcttaacgtaattaaccggtcgaaacgtagaggagtatttagccactaaataaagatcgcgcttttctattttattgacctgcatgggctttgctgttaagcaaccccaggaagtgatgttataaattaaacctgaagtatcgcccgtcccagtaatgcagggagagtgttcgtaattaattttactcacccagtaaatattgttcttaatggatacatagttactgaaaacaggccgtatatcatttgaacattgctgacttacctgaaataagttatctctctcaccattctggttaaatttaccatgaacagattcgctacagacattaaggacaggcctgccacgcacatcgctttgcattggccgacttgcatcgaaaatatattttaagaaaataaaaatcagaaacactccagtaattaaccctatcctgacaaagatactatggtttgacttcatgtgttattccctttaaccgctatcctggtatcacatcagatagtgcagaccgaaggtaaacggcaagcgcgccgcctggcatgaacgctattcaacataattaatgtttttctgggatcatgcattctgcagcatagcccgcatttaattttatatctgcccacataacactgtttctctggggtacggagcgtaaatcttcagtgtaatcattttctcatcttcccatgcttacttgtctggtggcgcaggtttaaaaaccccggtgtgctgggcacggctaatgaacccggtttacagatataaatagatgatgagttttagcggacacattatattttacctggtatagaggtcaggcctgtggttgcttaccaccctatcaacttgcattgactgaattcagtccttggtacaatgagcgccatatggttttctgccatgcactgtttaaaaacctgctctttgtaacggcccgcctgtaaacccagcatggtgctggaccgttccgctgcgttattttcaatgtaagagccacaattttctttgaactcctgaggattatcgctataagacatcgaccatttcagctgagcttcaactgaatcatctgattgatgctgggggacggcttttactggttccaggccagaatagagtgggttgcccagtaatctctgtgcaaagcgttgattttctgcagttaaacgtccggatttacacatctgcagatagatctgcgaaaggcgttgctcctcagcatcggcagcatgggtgcattcctccaggacttgttcattagtcttagccggatttttttcagtagatctccagtaactatttttcaagtccggaatcgtgccttcagtggtgccaaaagggcaaagtgcactggcgcaacccagtaaaaacatgggcacacacgtcaatgtcagaacacgtaacagggaaaacgctttaagactgcttttgttcattttattttcactttagtcagctgcggacatggggtctgagcaatgtcattatttttaatgttccgcttttcgctcatagtggacctaccggaatgcaggtcaggtttgtgcctgaagcaggcgttgcaaatactcagttaagttaacacctggcgcgcagtccttaccttaagacaagccatagcggtgttcataattcgtcagcaggatgaaggaaggtcagaacgatctcctcgcgtcgttgggtgcgaaattacaataaattctacaggaaactcagtgtcgtttctggcttgatgctttgaccccggtggaatttctagcccctgcagggctttaatattatgcatcttaccctccagtttccattgaaagaacaccatcgagaacaaagaaaaattgtctggaaacggagtgaaagtgtcgcttttcagaagtgccggcaggcattttctcatgaataaccagcatatcctgacggtttaccagataccaaccatcgcaattgtcgccccagaaataatgctctgcattttcctttgaaatcatcatccttctcctgtttacacgcgcccatctatcaacatcttaagaaagtgataccgagatatagtatcgattctcaacaggttatgcttttgattatttacctaaagatctgaactgcatcgttcaatatatctgatagttatcaatgtattgggaaagcagaattttatctgcctataatgtccgcttttcgctcatagcggaaattagcctgacgttagtcttccctataccggcagcgtaggttcgcacgccattagagaatagctacgctgggcactcgtatgcgcttcactggcaatcttaattgcggaaaatggccagggaagaaaatccgccccggccatctgatttaagccagttgtaagtgaagattatgttgcatcaggatatcagccagcgaaccttcatggctggcagaggcattgtgatacaggtcgtactgctgaccgttactaatacgctgcccatcctcgctccagacgccgccttcaatgttacttagcgtaaccacattgccgtccgcgtcttttatcgtcggcgactcactcgcattgtcgttcattggcaacggctctttttgccccagattgacgctattactgctgaaagcgcccagattaatgacctcagcgttgcctgatctcagcccaagcgtggcaaaatcaaacgcctcatgagcaccattcagctgaaacgaatcgtcatcggcagcaccgttcaggctggtgtgcagatatgaatataaaagcgagagcgtttcactgtttactgttccagagagatggagattgtcagccatatcaggatgaagagacgcgtgctccagtgtgatagcactatggctttccgaattgctgccatcttctgtgttgctgctgatcacagttgtggcattgatcaggttgtcctgcgctgcggttgcaatactcagcttcggctgcggctcggccatataaagctcgacgttttgcgaaacgtggttaacgtttccggcagcatcaagaatagttgcggttatcctgtgctcgcccggttcaggcgtgagtgcgtccagcgtttcaagctgcacggcccacgtgcctttgctggtcacactggtttgccactggtggtcgccaggcctgacagtaacaatatcaccggcttcacccgtacctgatacatgctgatcatggctggaggcaaggttgatttgctgcccctctgtgaggtgagtaaaagcgattttgggtgcgcagacatccacctgatagctggtcgttatcgtagccgtatggccagccgcgtcgctagcagtcacgacaatgtcatgctgccccttgccgaaacctgttttcatcgtccccggcgccagtggcaggctccagtgaccgtcgtcgcttactgccgcattgtgatgtttaccaccaataatcaccgataccgtctgaccgctgccagtgacgcccgttgtgccggtcagcatcgagccctcttttttctccgcacggttcagccagccgtcaccaaatggcgtatcaatttcaggtgcaggctgacctggaatatcgaccactggcgtagtattgcttccatcggtgggattatcgggggtgaccggtggcaacggatcgccgctgttatcactgaccggagaagtcagatccgctgtgacgtaaccactctgttcaaaccagtttccggcgccatccagcacgccaaacgacaggaagttgccgccctgggaaagctccgacgcgctgatttccgcgcgccagctgccatctgcctctaccacggcataattccagtggaaggtatcagaaacctgcaccgcaaaagtcttaagcggcagcggcgcttcaagcgtgccgctgataacgtaccaggtctgaccgtcatgctggaccgcatccgccagcgtaatgtcgttaacggtgactttcgggttgctgctgttgtagtgggtaatcagcagcagattctggctgaggctggtactgtttccattcagatccgttgcgctgacctgaatggtgtggttgccgtccttgatagttttcacgtcgctgtcagagagctgaacctgccactgattctgatagacactgccctgccaggttctgccgtcaagggtcagttcaaccggcgtgccggagggaagatgagcggcggtaccggtgaagataatgccgtatatcccctcctggtaactgaccgcattgtcgccggtgatcggatcaagggtcagctgcggcaacgcctcagtagcgaagatttgcacacctgctgaggcataacctttgttgcccgcttcgtcggttgtttcagcaatggcacggtagctcccttcctccattccctgcagcgtttccgcgggaactgagaactgccactggccattttgatcgacgatgccgctccagtgggaggccccaaaactaacctcaatcgtgctgccggcttcgcctctgccggagatcaccagcgggctgctgatttcatgactgtcgatcaccccgtcccctgccagggtattaatcgtgacaagaggatcctgcgtatcggtaataaacgtcgtctccgtgataccggactggccccagcgatcggtggcggttagcgtaacggaatgactcccctcggctaaatctgcttccatcagctgcccggtggagagtgagacaagccagttgcccagactgtccacagcgcccgcatagtgaacaccatctacggtcagatcgatcttctggcccgccccggtcacaccagtggagccgctcagcgtaacaggctcgaagcgttcatgtgcgttcataaacccgtcgacaaacggcgtgtctatagtcggctgtggcgggatagcgtctgatggcggtgctgacgcctctacggtaatgactttgtttgcggtggtcgtaccgccaacgctgttttcaaaggttacgctgatgtggttagaccctaccggcagcacctgcagatcggcagacggcagggtaacactccagctgccgtcagcggccagcgttgtggtataggtctgaccgttcagcattatggtcagcgtgctctctgcggcgaggttcgctgtggtgccgctgaacgtctgtggggagagcttctcctcagcgcttaacacgccgtcaccagtaaaactgttaatggttaaagaagggggcgtgctgacaggcggaatcggcgtgccaccatccgttggattgtcatcgataaccggcggaaccccattgccgccttcaacgggcgtaataaggtcggctgtgacattgccactctgctcaaaccagtttccggcaccatccagcacgccaaacgacaggaagttgccgccctgggaaagctccgacgcgctgatttccgcgcgccagctgccatctgcctctaccacggcataattccagtggaaggtatcagaaacctgcaccgcaaaagtcttaagcggcagcggcgcttcaagcgtgccgctgataacgtaccaggtctgaccgtcatgctggaccgcatccgccagtgtgatgtcgttaacggtgacttttgggttgctgctgttgtagtgggtaatcagcagcagattctggctgaggctggtactgtttccattcagatccgttgcactgacctgaatggtatagttgccatccttgatagttttcacgtcgctgtcagagagctgaacctgccactgatcctggtagacgctgccctgccaggttctgccgtcaagggtcagttcaaccggcgtgccggaggggagatgggcggcggagccggtgaagataatcccgtatatcccctcctggtaactgaccgcattgtcgccggtaaccggatcaagagtcagcgccggtaatggaatggggctggccttcatagcgtcggaggtggcgggggcatctgaagctgttgctgactcaacctggggcgtaagcgttaaggttgaatcagcttcgctggtcgtcgccctcagggcgacagctgctccgtttaacggcgtgcctgacgggatcagaatctggctttgggaagactctaccactgataacgcgggatctgactctgaactggcagggtatggcattggagatgttgcagaagctggagattgccagacaggtgtcagcgtggtgacagtctgagcatcgccggaaacgtctgtgctgaactgtgcctcctgaaataaacttccctgctggaaaagcattttactctgctggcctgcaacctcagtaaagaaattctgatagcgaagcgtatcgctctcgtgcaggttaagaatgagatcgtcaccctgtttctgaaaagaagaaatctgagaaggtgagctttgcagcgtgataagagcgggttcgctcagaatagattgtgattttccttcagtggactgagacaatgggtgaccgcttttcagcgatatgaccgtggcgcggcccgttcctgaaaatgccatggaaatctccttatataccagttattaagtaggcaatgccgttggaaataaagcgacgctttacttatttcaggcacgcaacggccagcgccaataaaggtgctgaggcagagccggcactcaacgcattaaacgcaattcgtagcaacaataaagggcataaccagagccagattaaatattcgtttttgaaaacagattatttctgctggcaaaataaaaagtaccattctttgcaagagtccgggcatcggctcaattaacctttactgacttcaacgacgtatcgtcaggaaaagtgaatagttgatgctggatagacataagctaaacttcgttttcatgtctggctaccaggtaaaatctggaaatgtcccctgttaatagcagatgcttcctgatgatttaactgccctgctgtctcagtttagtaacgacttccccatccctgtaagagcaatgctgatgctattgcaccattttaagtggcaggtgagatattgcattaccgatataagtgtccgctttatgctaaaagcggacactttaatttaaataggaataagtcagcgtcaatccttattaatcaggtaacgactgagccagttacttcaccaccgggttctttttaagtgaaagcatgttcataaactcttcatccagatgcaggtgttgccggacaagttcaggtggtgtactggcgagccactggttaagcgaaatatcggcatagtaatcacttttaaaaagctcaagaaaacgcagtggtcccttaccggtgttttcgatgtagtgtcccatagcaaaaggaacatatcccacatcgccggcgcggtagtcaaaagtccttgcctgaccggatgatgcaaagacccccatccgtccctctccttcaaggtaatactgccattcatcattgttaggatgccagtgcagctcgcgcagtccgcctggctcaatttccaccagtgcggcagcaatcgtttttgaaaccggaaaattggatgaatccgtaatcctgacggttcctcccggcgcgcggaccggatcctgagccagcatcttgtgggtaaagcggattttcgacttcaccccgccttttatactgtctgattccaggctgcccggaacgttgccggcaaaaatgtactcatcatcaggtgaaggcaggtgagaaaatgaagataccggaaccctgaagtttttggcgagaatttccgggggaatatgcctgaaccagtctgacagcagaaaagtgctatcctcatcaaaatttccgtcgtcaaaagccagtaaaaattcacagccgtcgggaccgagaccctgaatcgaatggggaataccgggcggaaaataccataggtcacctgcagcgatatcatcaacaaaccatcctccgctggcgtcaaaagcggtaatccgcgcgttgccataagtcatgtaagcccactccccctctttatgccagtgcagtttcgcgaatacctccggcattgaggcgcatgtccacacccgcaatcgtcgtagatatgcccagctcccgctgcgtcacctgacgcgtccagccaccgcttcctttgcgtacgtgcgcatcactgaaagaaaagcgaaggtttggcagcgttccgctgtcggtaacgggcgaatttacgatgtccggactttcagcctcacgaatagggtcatgtggtccgggatctcgtcctccgctccctgccggaaacgtctttacgccgttgtcatgtgccatggcctgacccgccgcaagcgcgaccgttcctcctgccgcaaaagccataaaatgtcttcttgtcagtgttttcatattcatccctcttaataatctttttataaacggtattatttttgttaccgccataaagttataagcgggctgaatgcggagggaaaaacaactttgtaacactgtggaaagagtgcagttttcacgcaaatagtaaagatacttgaatgtattaagaaagattaatgttgtttaatcaacgtatagttataaagggattatcctgtgcttaagcgcactaatcgtcaattaatgtgggtctttttgattttcatttacccggtgatcggtaactgctgataagaatttttacgaattgaggggtttaacgaggcctgagcctttgatgcgtgagctttcacgcacgtactcagatagacgaggcgcatatgcagggccgctctgttacgcctgattaagcccgaagcataaagtccccttctcgctcatagcggacatagataaatccgccctggatcacctatttcagtcactatcactggcactgttgaaaccggagatcaaagtcacccccgatttactacgctggttacaagacaacattcagaagccgttcagcgctcagcgtccaaacacgccctttagtttttgcttcatgctccgaacatagaatggcgtaaactgcgacctgatatgtgagtccagacctttgtcgttctggccaaggcgcatcagatccaccgcctgcccatccggagaggtgtccgctgcgacaagacccgcaccacgcatcacctcttgcacatcaccgctcatttccacccccaccagataatgcggtttatcatcgactgacgggtcgtgcattaaaaccaggaatgcacggctgaccccgggacattttgcaaaccaggcagataactctttcagaagcctgtccggaacaacggcaggtactcccactaatacctgtgtttcttcctcaaccacccttgtctgcggcaggcgacccgttccttccgccagcatggcttctatttcttccggcacaaactcctttccgtaatccgaccctggattaagaaacacaccctctccccgcgtcatttcaaaaaaggctctggcaggcaacttcatatatttactttcctggctgatggcgcgctgcagggtggcaagcgagctgaataccggaatgacaggcgttccatccggtttttcccagtgctgaatcgagatattctcacccgcctttagttcgacctcaccatcacccgttgcccctccggaactacccaggacgtaaagcgatgaatctaacagaaacccggtaaaactcaggtcgttctgctggatgatcggccgccagttttaaagcagtctccagtttgattgccttttcgtcagacatttaaccaccttaggcaggattggattaggatcaatttaacaagggtttatgagcataatatagataatttctactcgccagattcctgcacgtaccgggggactgcctttgagggctcgttattacgattaaggacatgcgtttgaatgggtaaatggcagaacaggcacgatcttttccgttttccagacgcttcccttaaacttcaccgcacaggccttaactattaaacttacctgactaacatcctgttctataaactcatacgtcagaaccgttaccagcgtgttcaccagggtatgtttaaaaatcatgttcacgctgaagtgccttactgctacagagaacgatgtaagttcagctgttcaaaccaggaaaataagatgtttttaccggatgcacgattcacaaaaatctttcctcacttctcatttctggcatgagtaggcagctgtttgtttctctggatgggcccaagggaaccggtaaaaccaccctgctggagtccattacgcaagtgctaagagcagataacaggaaagtgatccgacttagcgagcaaaaaagcgatcccttcagagcggaaacaatggcgctggttaacaggctcgccagaaatccctcagtggatcttgaacgggaaatttgtgaacgttttgccgttagccgtgcctggatttcacagaatgtactcactaaacagcccgggaactgcattatcctgatggatcgctggtatccgtccgatgccgcatttcggcggatgatgccctttgcagagattttgcagcgaaatattgaactcaatgtgcgagtaccagacctgcatgtcggggtgatcacggcacccgagatttcatggaaacgagccgcggcacgatcgcgtgggctggggagtacagtgattcaccggctggaagagcatgtcgcttgcaccagagcgtttcgagcaggagatgaccaaccacggctggtttttatgtcgcaatgaaggaaccgtagaagaggcaacgatgcaggtgaatgctgaaatctataaaacgctttgatgccgtgcatgcattggtttaaggggctgattctcactcgaaattgccagttaacagcgtgacctgttccgtttcgctctcccctgctcgcgctttatgaataccgctttgcatatcactggtttcggtctttgacaccagcaaataaaacacataacagtcgcgttataatctcttcttcgaatattcgcgccacctttggttgttaaatcaagaatcatccacctgaattttacttgtctgaaatcaacaatagtcagattatcgctggcacagatatcccgctttgacttataaaattgttctattttttagataaggcacagggaattgcgctacgcatcgataccatttaatcacaatcaactgggctggcctgcgggtgagcattgttttacgccgcagcccatgctgcgagaggatatcactgccgactgggttatcgtcggcgcgggatttgcaggtgttgcctttacgcgccgcctggctgaaatcaatcctggcctgaaaattatcatcgtcgacgcgcacagcacacgggaaagcgcatcggcacgtaattccgggtttgttatcggtctgcctcataatattggcagttcgaccgctgaattaaaaaaggccaacgcttaccgtaacctgcttcaggaaggcattcgtcagctggagcaggttatttctcagcatcatcttcagtgcgactgggaacaggtcggtaaatatcactgccaggctgaacgtggcagtgatcgtattttaaaagagtacgccagccacctcgatttaatggatgagccgtggcagatgtcagacagcgaggagctttacttaaaactcggcacgcgcttttacagcaaagggatatatacacctggctgtgtgctggttaatcctgcgcagcttatcgccgggctaaaccactatttacctgaaaatgttcaacgcttcgataacacgccagtgctggggattcgctacggcagcatggctgaagtgctgacaccgtttggcatcattaaaacgccaaaagtgatgctggccaccaacgcattatcgcccgagttgcgacccgggctttcgcggcaggctgcaatggcgaccttcgccagcattaccgctccgctgacggatgaacaactggccaccctgcctcctatgcagagctgggggcttacgccggttaatgcgattgccggtgcaaccttccgttttaccacagaccgccgtttcctgattcgccagcacgtgatacccgcactcaacggtcaggtgaatgtcgcgcagacctggcaggcaacccagctgcatcagcgcttatttcataaagtctatccgaccctgggcagtgtgaagataacgcatacctggtccggcaccatcagcgttacgcgaaacagcgcgcctgaatgggggatgctgaacaaatttatctgtacggcgggtggctgtaacggtgcaggtgtttcaaaacagaccgtagcgggcagtctgctggcggatttcatgatgaaacaggacaacccatatattgcggatatgctgtcgctgggtaaggccagttttatgccgccatcgccggcgctggatatcggcataaaactgtcactgatgaaagagtgttatctgggccgtaaagagatctgataatccgtaactgtaatcatcgaaacacggaatattgctgaagtagcggcaattgaactgataaggcgcgaccaggccagcgaagaattaccggtcgaaacgctcaatctcgtggggccggatacgctcaacggagaagaggcagcagcagcctggcaacagcttctgggccgtccggtaatttatggaggagataatccggatgcattcgaagccaatatggcggagtttatgccgcgctggatggcgtatgaaatgcggctgatggctgaacgttacgtcagtgatgggatgattccacaagagggcgaccgggaacgtctggtcaccctgcctggtcgcccactgcatacctatcgtgactttattaccgcactcgccggagagtaatctggatctctcaggcttaaggacaagcctgcagagcaataccgtggaccagatgcctgagccagagccactatgcaaaaatattctcagaacaatctttatccagaacttcaatgcagacagattatccttgccgggcgatttaaaccggccagtttatggcacgattgttttcgataatatcctgatgagaaggtgcatcacccagcgtcgcgaaactggcataaagctgtggcaaccgagcctggccttctccctttctggccaacgccagagctcgcagcatcacgggcgcttcccagtcacagcagtaacaaggcgtgcagggctgctgacgccatgattcagcgatagtcccagagaacacaggatcaaaaccggtgtcgttaaccagtgacatggccgtctgcacaggttcaggctgatctcccgctacggcaaccgccagacgaccccgacttccctgcggctggcccagatcggcgagcgagtcggcaaggatattattaaaagctttaaccacagggtgcccgatctgctcctgaacccattcgctttcggtctgcccattatccagtgcagtaatcggtgcgtcgcgcaggccaggatagtagttgctggtgtcgatcaccggaacatggggtggaaggtgatcgaaaagcccatcaggcaggctgctaagtgccggcagcggaatggagagaatcacggcttcgacgtctgtaaccgctcccctgatgtctgtgggttctgcattaatttcacccgcaaaaacacgcacgccatcaactccacgtgaattagcgatttttaccttgtgccccgcttcactgagcttacgtgccagggtaccaccgatattacctgtgccaattacgccgattttcatatttcgctcctgattctgtggtaagtgagataccctacatattcactgaataaacaacaagaaccgacaaaatagtgggttactaacctgaaggtaagtatggaaagagactggcgttgtgatattccggagcagcgactggtgtgggctcaggctaccaccgaagcgctgaagattattgaaggtaaatggaagacaattattatctgtcagcttttcgccgctaaaagcccgctgcgcttttcagagctggagcgccggattgagggcgtaaatcaaaaaatgctgatccagcagcttaagcaactggaacaggatggcatcgtgacacgcacggtttatcccgaagttccaccgcgtgttgaatactcacttaccgatctgggaaaagcgcttgggccatcaatgactgctctgattgactgggccttcctgcgtcgtgaaacgctgggtcttgatggcgcctgaagctcgcaattcaagccagttataccgatgtgtctgaacgcagggcatggctgttcaggcaaaggctggcgtaacgagagagaaactccagccgatggtagattatgtcgtttctggctggtcccgatgatccggtaacagcgcttgcggataattcggaaccggccagcccggttacatcgccatatgctgggcggatttcagatgctgttctacaacaggggtatgcgcgtcggccagcgccttcacatccggatcctttatcttcgtcgcgtcgctcttcagcgtcgacagcaccatcttatgatccattattccggcgttttccatatacattttgtcaaaggcaccgccgctctgcttttccagcttgtcggccatgaccttatgtttagcgtctggcgcagtcggtaatgccacctctttttgcttagcaaccgcctgaacttttgtcagggcactgccatgatcttcgaccatcttctgtgcaaaggttttaacttctgcgctttgtgttttgttcagcgcaattttggcggcggcaatttcattgatattggcctgcgccatatccttcagtgctttttcatcaccaggactgagcttgtcattctttacggtctgcggtgtattcccaccctgcggggcgcttgtctgcgtctcagcctgtacgctggcagtgctgaagagagcgacgacggctgatatagccagccatcctttatagcttttattatttttcattttgtactcctgaatattatgggaagaccgatatcagaaaagttctgctcaaaattacctgctccgtctcatgagtcgacatggtttctgtctcgcttaaggtaccttacgtagcagagtgattaagcgttgtagtaatgtcaggtaatcgcaagtataaacaatgcattgcagcagcataaaaataacgaaaatgtattccgcctcgcttaaagccgaaaatttatctattgttagcaagggtttcagcataaaatttatacgaaatatcaaaacatcgtacagcttttctttgattactttgagataattcttaaggttgctaggtggttgtcggccgtttaatgctgggtaataactaacaggtgacataataatgtgaagaggttgagctcatgttacctccttacatcgctataaattttctggttcagattactgaataatattaaggaaaaataacatgctcaaatctcgcgctttaaaagccgcatttgcggtggtgatatcttttaccgtgcttgctgcgcccgttttcgcaaatccgggcaacggcaacggtggtggcggtcagggtaatggtaatagcggaaacccgggtaataacggcaaaagcggagagcacggaaacaaggggcatggtaatgcgggtccgaaagaaaaacatggaaatcgtaagaaacgcaggacggcccgatcacgtcgagtcagatatcaactactcgcttgcacgtaaccttgctgtcaattatggccttgtcggctatcagtctttgccgccaggaatagctaaaaaagttgcgcgtggtaaacctttgccaccgggtatcgccaaaaaaagtttgccagcatcaatgctaaatgagctgccctattaccctggttacgaatggcgagctgtcggagataatcttgtgctgatagccctgagcaccgctgtcgtgaccgccgtaattaatggggttttcgattaaccttcaaaactttttcgaatgggttaactttcctggtggagcgccagtaacacgcttaaatgcttttctgaaggcgctctccgactcatatcccagcgcggcagaaacgcctgaaatcgtttcgcctgaattttgcagacgatcgctggcgagcagcatcctccattgcgtcagagattctatgggcgtaattccaaccgtctgaccaaagtgttttgcaaatgcagcgcgggacatccctgtatgtgatgccagcttatttaacgtccggcatgtcatcgcagcgcccgtctccggtgtaaagtacctgacagactgattgccactcatgctttatacactctgtgacaggctccgttggtcccgctgatcgggaatgcgtgtaatcaccttaatttcaaaatcaaatcccgccagccacgtcacacccaccgctgtccagttaggatagggaggctgcggaaaaacgcgctgctttatctgcatgatggtttcgaactgatgctccggatcggtgtgaaatgtggtgacatcgatcagatcgtcaaaggtacaccctgccgcagcgagcgtggccgccagattctcaaatgcccgttctacctgagcagtaaaatcgggctccggcgtgccgtcggcacggctgcccacctgacctgagacaaacagcagatcgcctgagcggatagccgctgaataaccatgctgctcatagagagcgtgacgattggcaggaaaaatgggttcgcgggcgatcatagaatttcctcaatagcctttaggggattgcaggatgcagcgcacacgagtttgatttaatatacgcggcgtatgtcacattaatcacacatacgcagcgtatgtcaattaatatacctcgcgtatgtgaaaggagagtgtatggccgctaaacgtcgcgctgaaacaatggaagagaaccgggcaaaactgattgcagcagcacgcgcagcctttgccgaaaaaggctttgccgccgcgtcaatggatgaactgacggccagcgtaggtctgacacgcggggcgctctaccacaattttggtgacaaaaaggggctgcttgcggcggtcgtcgcacaggttgatggcgaaatggcgcagcaggctaaagcggcagcgtctggggtgagcgatgcgtgggaaaagctggtggcggaaggcatcgcctacatccgcatggcaatggatgccgaagtgcaacgcattgtgctgcgcgatggcccggcttttctgggagatccttcccaatggcccagccagaaacagctgcctggaagccacgcgtgaaacgattacccgtctgattgacagcgggataatgaagccggtcgacgccgatgccgccgctcatctgctgaacagcgcggcgctgaatgccgcactgtgggtcgcttccagcagcgagccggaaaaggcgctgccaaagatgatcgatgtgttcacacaactggcaggcggcttgcgccatagtgcgatttaaccctgaatgttcactgctgctttcactgatagccctgaagctctgagtgctgacgcctgcatctctttcaggcgcggtgtcgttttaattcagtgtgacagcggaatcaggccgctctcctgataggtcgcaatcaggttatcaaaaatggttatatcctggcgcgtgcgggctattaactgcgcgccagcaactgcggtgtaaattgccagcgcacgctgcgcatttttctccgcgttatcgggcgacttttcgcaaaggacctctgtcagccactcgacgttcgcatcgacaaaacactgaacctcacgcttcacttcctcgggcagatcttcatattccgccgccataaagctggagagacagagccggttggcatcttcaagcgacttgcggaaaatctgcggatagcgctgcaacgcttcatccggtgaggcactttgctcgcgtatagtctttaaatcctcagccgtatcctgccagtatcggttggcaaccgcggcacccagattggccttactggcgaagtgataatagatactggcattcttgatgcctacctcgtcagcgatactgcgaaaattaatcccgttatagccatgattctgggcagcactttttgctgcggccagaatggcttcacgcgcgttcaggctcataactcagttttccttcaggaggtggagacgcattataaggggaaaatatttacctgccaactggtagacaggggttgacaggagaaaagttcggcatcacaatccacctaccaattgacaggtaggtaacttaatcatgactgatatccacaatgcatctgcagttccgtcactccccgcgatgaagatttatgactggtatgatggcccttatcctgcacgggtcaggattgcgctggcggaaaagggattactttctgaggtcgaatttattccggtcaacctgtggaaaggtgagcataaaaaacctgaatttttagcgatcaattattcaggaaccctgccggttttagcgctgaatgacggatcgctgatcgctgaatgcaccgccattacgcaatatctcgatgtgctggatgacaatccggttctgactggcgtcacgccggcagaaaaaggcgttatccatatgatgaccaaacgggctgagatcgaatttcttgatgcggtcagcgtctatttccatcatgccacagcaggactggggccggaggtggagctctatcagaatccggaatggggtgcgaagatgcgtgaaaaggccatcagagggatgcactactttgacggcgttttacgctcacaaccttatgtcgcgggcaatacattttcgatggcggatatcgccgtaaccggcggaatgattttcgcggctttggtgaatcttactgtttcctgacgagtgtcgcgccctgaaagcgtggtatgcaaaaatccagagccgccccagctatcagcaatggcaggcaatggttgaagcgggccgccctgctgctgcttcgtctcaggaccgggcgtaagatcgcgctgatcgttctggataacgtgttctggctgctgtaaaaaaccccggaaaatcttccggggttttctgatctcaaaacacgaaatctcagtgcgtcagccttatcagaacgccgcttcagcctgcattacgctcaaagtggctgttcacaaaggcgcggcagcgtggcgagatcggatcgagaaacacctgctccggtgaacctgactcctcaatcatgccctggtgcagaaacaccgctttgttcgacacgtcacgcgcaaagcccatttcatgggtgacgataatcatggtacgtccctcttccgccagactgcggatcacccgcaatacttcacccaccagctccggatccagcgcggaagttggctcatcgaacagtatcgctttcggctgctgcgccagcgcccgtgcaatcgccacacgctgctgctgtccgccggaaagctgcgacggccaggcatcgcgttttgcatagagtcccactttatggagcagcgcttctgcttcttcaatcgcttctttatggctgcgcttctgcacatgaaccggcgcttcaatgatgttctgcatcaccgttttatgcggccacaggttgaagctctgaaatacaaagccgagctgcattcgcatcaacttgatgcgacggcgctgctcgcggctcagtttttcgtcggcgttatccagcgtaacgttcacctcgcctaccgcaatttcacccgcctgtggtacttcaagaaacgggatgcagcgtaacagcgtacttttgcccgacccactggcaccaatcagcgatatcacatcgccatcctgcgcggtcaggctgatgtcgtgcagcacttcgtgtcccgcataactctttctgagatgactcagcatgatggtaggtgcggtcatgagcgtgctccaaaatagtaaggtgataagcgtcgttccagcatcgatacgcctttgctgaccagcatggtgagtatcaggtagatcaccgccgcgctcaggaacacctccagcgcccggaaagtggaagagactatcgagtcggcaatgccggtcatctccatcaggctgatagtgctgaccagcgacgttgctttgatcatcgagatgatctcattgctgtaggccggcaatgcctgtcgaatcgcaatcggtaaggtgatgcgggtaaagattttatacgacgacatgcccgagactttagcggcctccagcgactgctgactcaccgcgcgcaggccgccgcgcaggatctccgaggtgtaggcggcatcattcagaatcagcgccagcaagccgcaccagtagggatcgcgcagcagcggccagaacaggctttcccgcaccgccggtaaactgccaaggccgtaatagaccataaagatctggatcagcagtggcgtaccgcgaaacagccagacgtagaagcgacagaaaacgctgccgacacgcgtcatgcgcagcaggttaagcagcagcgccagcacgccgccgccaaagagtgagagcagcgccaggttgatggtcagcggcaatcctttcagcagcgccagcagcgtctgctgtaaaaacatcatatccacgtggactccttaccccttcacgcgctgttgaccgcgcatcgcaaacttttccacgtagcggaaaaccatatcggaacaggtggtgataatcaggtagatcaccgcccccacgctgtagaagaaaaaggacatctgggtggagttggctgcggtggagacctggttcatcgtttccaccagtccggttaccgagaccagcgccgactctttgatcaccgattgccactggttgcccatgccgggcagcgcagtgcgtaacgcctgcggcacgataatgcggcgaaacatcatcagccgtcccatgccggtcacggtcgccgcttccagcgtttccgccgggaatagcgtagaaggcgccacggaataccccgctttgataggcaccggagatcagcccgatggcaatcgcgcccgccacaaaaccgttcacatcgaacggtccctggaagcccagcgcggtgcccacggtggagaccacctgtcttccaccgaaatagaagaggtagatcaccagcagttccggcacgccgcgaaacagtgtgatatagcctgccgccagtcgctgctgccagcgtgaaccggcaatctgcatccagcagagcacgctgcccagcaacgcacccagtagccaggcgcagagtgacacgctgacggtgacggcggcggcgttaagcaggacgccaccccagccctcatccccgaagcccagtatctgccagtcaatattcatcagcatcagcggttacgctttcggcgcgacatcttcgccaaaccatttgatcgacagtttgctcagcgtcccatctttgatcatggagtccagcgcctgattcagcacctgctgtagctcactgttgcctttacgcagaccaatcgccgagcctgcgccgagcacgccaccggagaagccatagccgctgctgctgattgcctcagcatgttttttcacaaaggcgttgaggttagtacgagaagccatgacggcatccacccggccattcatcaggtcggcaaaggtttcaggacccgcctgataggtgcggatagtggcaacatcgcccaggtatttctgcaggaaatccgcctgaatggttgcgacctgcaccgcgatggttttccctttgaaggtggttttcagatcgtcgatcgcttttttcatgccggcgtcatcatccgccgtcacaatcgtgccgctgcctggcagcgtggccagcgggctttttttcgcagtcacaaagctggagacactgacggtgtactgatgggtaaaatcgatcgcttcagcacgttttggcgttacggtcaccgcatcgatcaccgcatcatatttaccgtcgataagacctgggatcatgcccgaccatttctgggcgatgatttcatatttaaagccagcacgtttagccagctccgccaccatatccggctcatagccgacgattttgccgctcggggtggtctggttgaacggaggataagccgcttcagtcgcaaacttcagggtgccgaaatctttcgcctggctgaacgcggaagtggcgagcagtgccacggtcagagaagccgtgaacaggcggttaagcatcatcatataaacctcatttatttattattaagagagtaaatcaattgcaaggcgggtcagcgcctgcgtcccggcggtaatgctgcgtttcgtccggctgatagtcggagttatgcaggtgatcgtcacggcccggcgtggccgatccaatatgaatctggcagcccggtacccgttccgtgaacagtgaaaaatcttcggcaccaaagctggcgctgggctgcgcgatgatgggcttatcaaactgatgcgacagaatctgttccagtgaatcgatcaggcgatcgtcattcatcagaggcggcacgccacgctggaagttaacctccacccgcacgttttgcgccagcgccaccccttcgcacatccgtttaaacgaggtttccatagcagcgcgtacttccggcgacttagtacggatggtgccctgaaacaggcagctatcgggaatgatattgtgggtggtaccaccctgtatgtgcccgatggtcaatacggcggagtgagcgggatcgcgttcacgcgagatgagggtctgtagctggctgatgagatgcacggtcgcgatgatcggatcggtgcccatgtgaggacgtgccgcgtgggtcgatacgccatgcaccgtaacgtcgaattcatcgctggaggcagtgctggccccgcgcgtcagggcgacttctcccgcagccagttcaggcttgttatgcagggtcacggcccagtcgatgccatctgccgcaccgtccgcaatcatcgcctcagcgccactttctggcgtctcttccgcgggctggaatatcagccggacccggcctttgagctgctgacgatagtgcggcaggatcgttgcgacacccagcatcgttgcggtgtgaatatcatgcccacaggcgtgcatttttccgggatagcggctggcaaacggcagaccggtctgctcatggatcggcaacgcgtccatgtcggcgcgcaacagcagggtcttacccggctctgcaccgtcgatgtccaccacaacaccgctgcggccaacgccggtgcggggattaagtcccagcgcctgcagatactctgtgaccagactggcggtgcgcagcgtatcaaagcctaattccggatgcgcatggatatcacgtcgaatcgccactaactgcgattcaagttcattaactctggcttttatttccccggccagtcgtgctttttcctgattcatagcagccccggcaatatgcgatcggcactctgctgccgaccgctattttaatctcatcctgatgacggacgttgatgaccgtttatttattcacagcacgcgacagaaagcaacgcgcaacagcctgctctacatacttaaaaatcaataagatagtgttatttattggaaacctgtatgagataacagcggatcagcaataatattaataatccgccacacgacattactttccctactgtcactgaggtgatatttcgcttttatccggagagggaataaagaagtctgccagtatttccgctaatttctcgggttgttcgtcgggaataaaatggccgcagttgagaacagtttcactgcttacctgatgcgctacggtgcgcagcggggtggccatatcgggtatcgatccctggtcggcactgacagccagcagcggtaaagccagtttgccttttaacgcgcgctgtcgattctgctctgccgactgtgcaaaagcgcggtaaaaagccagtccggcccgcaaggccccgggctgctgaaaaacgcgcaaatattcatgacgggccgccgcatctatgcgatgtggattggctgacttacggttaaaaaaccagtcgaggtagatcgcctctctgccagtgatcagcgcttccggtaaatcatccacacagtgaaatccaaaatgccaggttttccaggcgctatcacccaccattggcagtaagtcaggcagcgtgataccgggaatgccgccatccagcagcgcgagacgtctaaccttttcgctatggcctgccgccagtgaccaggcgacccacgccccgatatcatgcccggccagatgaaagcgtttgatacccagcttgttcagcagcgccagtatgcgctctgccacgctgtcagtgtcgtaaccactggctggaaagtcagaatcaccctgccctggcaggtcgggtgcgatcacatgaaagcggctggcaagcaagggaataacctcccgccaggcataactgctttgcgggaaacccgcgagcaaaaccacagcctcagcgtgttcactgcctgcgctgaggtagtgtagccgctgcgagtcaatgttaataaaatggtgctggtagagtggatatacgcgcataaaacctccggataataaggaaacgatcgattccttaatgtgtaaaaaatttagtcgagtaaagtcagcgccagggggatgatgctggcatcgggccgggtagcagcaactttaccggcgacccgcatccccagaacaatgcaaagcattagcgaagcggtggcgtctctgtccagtgcaggattgaccgaaccatcctgctgacccaggctgattatctgctgcagattctgctggttgcgtatcagcgccgcgctgacggctccggcaagttcctcatccagagtttgcagctccacggcgctgacagccaccagacagccgcgctcaccttctacatcgcgcactgaatccacataaaaattgagtagcgccgccagttgctcacggccattttcacattgcgccagccgcgcggctaaactgctgttgcgcattgagagatagcgagcgaagacgtttgcaaacagcgtgcgcttgtcggtaaaagctttatagatgctgccggtagtgagctgcatagcctggcccaaatcgccgatcgaggtggcgtgatagcccttttgccggaataccagcattgcgctgtccagtgccgcatcggtatcaaacgcccgcggtcgtccccgctctttataacggttatcgttcatcgcaaacaccattagagaatgatcatttcctttaagatagactgatttgtccgccagataaaggctttcttatgcctggggctcgcctggaaatggaactcgcccctcaccatgaccttctcagataaaacaccgtttcgacggcgcgtgaaaggcataggcccagacatgttcggcacgtcaggcacgccgttttaatctcgcgttatgtaatcaggcctatctgagccacgtattgccgatcttgagcaggagcatgaatttcaggttcaactcaatggaacgctctctggcaatatccgtttatccgcaggggagcatgcagctcaaactctcgtatggccgaaattaaaacttttatcattggaagttcgtgaaggaaggaaaatcgttacgtgtcagagttgaaggacaggtcacgtttaattttctgtcagaaagaatcgatgccgtattatcgggttttggtattgcctgtgttcctgaagatacgatcagggagcatgtaaaatccggaaagctaattcagattctgcaggattggtgccctgcatttcccggttattatctctgttatccgagccgtaaacagcatccgcccgcttttgtgctgatgatagatgcgcttcggcacccggaatagcgggtctgcaattcgatgcagacccgcctgaatcttaacggcccacacgagcctgatgctcaggggagtaacgctcgccgacgatttctatcgtttcaagcgcctcttctatctgccgcacgtcgtcctgtgaaagcgtgatgtcggcagcacccaggttttcatccagccggtgcagtttagtagtgccggggatgggaacaatccacgatttttgtgccagcaaccatgccagtgctatttgtgcagacgtaaccccttttccggcagccagttcacccagtaatgtgaccagcttttcgttggcttcaattgcttcagcggcaaaacgcggaaccttactacggaaatcgtccctgccaaacgtcgtttcctgacttaatcgcgcccgtcagaaatcctttgcctaatggactgaatggcacaaaaccaatccccaactcctccagcaatggcaggatctcctgctcgggctcgcgccaccacattgagtattcgctttgcagtgcagtaacaggttgtacggtatgtgcacgacgaatggtttgtgcacccgcttcagaaaggccgaaatgtttgaccttaccttctgaaatcaggtctttcacggttcccgcaacatcttcgatagggacttccggatcgacgcggtgctgatacagcaaatcaatcacatctgttttcagacgacgcaacgagccttcaaccgctttgcgaatatgttccgggcggctgtttaaaatctgctgtttattgtcctcaccaaaggtaaaaccaaatttggtagcgataaccacccggtcgcgtaagggttgtaacgcttcacccaccacatcttcattaagatacgggccataaacttcggctgtgtcgaaaaatgtcaccccacgttcaaccgcggcgcgaatcagctcaacagcctgacgagtgtcggtcgccggaccatagccatgactcaggcccatacagcccaaaccgagtgctgacacttcaagccctgattttccgagatagcgtttttgcattattgaaagcctcttctgttgcgttttaaacgtcaggtttgcggccagtcagccactccaccatcgccggatcgcgatgagagaagaatgcgctggttgcggaatcaagcgccgcaatttgcaacatatcctcagaactgagtccaaaaacgaggatattgatgctctctaccattgttgagttttacagttggcatggcgttatccttcagccgttgtgtgtgaaaatcataacgtaaaataatttattggattaagtagggtaattagctagggcttattacttttattcatcaatgatgattaatcctgatctttgcctgcccgctattgcagatttcgctctttaagaaactggctgatgagatcgacaatctgcacattattcagatcaataacgcgatatgaatgaaactcatgaatatgtgtgagtcgcgacttgatctgacacatgcccctgaaaggttcagagtgaaggttttcctgatttatcagagcctgaaatttgcgcccctcccaccaaatggttatagttaaatgaccaattggaggtgacagatgaaaacattcagcttttctgcgaacaaaaccaggccgccacgcttatggcaggccgcaggcctgaacaacgctgatggtgtcgccctgctcggccagattaatgaaggccttgatggcaacgtagctcacctgatcgtcagctgggcgaagattacgcaaaacgacctgcgcaaaatgtccggtattccctccacgacgttcagccgaagcgtgaaagcgaaattcagcgctgaacaaagtgaacgactggtacgtattatccgtgtcattgatcgcgcagttgaactgttcgaaggtgataaggatgaagcgctaaaatggttgaatgagcctaacagggcgctgagctggaaaatgcccgcagaactgatggcgtctgaaaccggggcttacgaggtcatgaaattaatcacgcgcctggagcacggagtttattcttgattctctacaggctgactaagacaaagtatctttcgacagcctggacgggatttggcgcaaaagaggcgggcggccgctggaacagcatcggcatctccatggtttatgtttctgaaacagcatcactgactttgctggaaacactggtccatctgcactcagcacacatcctggacgcattcacacttctgcgcatcgatgttcccgatgcgttgattcagaccgctgatatcactgagttgcctgcaaactgggccgatgaagacgcaccggcagaaactggctgactatggagacgcctggtgctttgcctgcgatgcggttgcgttgcgtgttcccagtgccctctcccctgtagaatataactatctgttaaatcctgaacatcccgagttcttccggatagttcaacaggctgaggccattccgttccggtttgatcgtcggctgaaaccggatcgtacataaactatccggatagcttttggtcgcgcattcgtgcgttgaacaagggacggaagccaccgatgatcgtctcttaagccctgcgagaagcctttccccatctgacctgacgcaaggcactgaagcttaagcctcatctatactgcagcttatctttgctgaaggagcccaatcatgggactgagctggttcaccctctggccgccactggcacgcgtgctgtttatcctcgcctgtctgaccattattctgaccggcctttatctggcagcaccgctgatcaatcaggttctgctggcgatgttactggccatcatgcttgatcccctgattacccggctggaaaacaaacgcataccgcgcatcgtctcgtcactgctggtgattatgctgatgctgttgatcatggtggtcactatcctcaagttaaccgtgctgacgcccgatttgatgcaactcagccgccaggcgcccgtgctgctggcggcccggcttgaacagctgacgctggcctttgcccggcttgatatcggtatgacgcccgaccagttgctgacctttgtggatgctggggcgatagtgcgcattgtcactgcatttctgacgcaaatccctggcgtcatctcatggtggatcatggtgttcctgatgctgctgtttatgctctatgagatgccgctgctgaaagctgcactgcaacagcgggtaaagggaaaacatcaggccttttatctggcgctgcaggagggaattcagagcgtgattgtgtatgccagagtgaaaacgctgaccagtattctgggcgggttaatcgtgggcgtcggcgcgcatctgatcgggctgaagtttgcctttttctggggcgtactgatgttcatctttaattacgtgccggtgcttggctcctttctggccgcgattccgccggtgatccagagttacatcatgtttgatttacagatcgcgctggcggtagcaggtttctttgtggtgctgaacctctgcctgagttcggtgatcgaaccattgctgattgggaagcgactcaatctggcgctgaccacgcagttgctggcgtttctgttctggcaggcgttactggggattacgggcgggatactggctattccactgacctatttgattaaaaaggtcctgctggcgagctatccgcagcaggacccggaggcagaattaactcagtgatggcgtcttcacccgccatgcgcgggtgaggcgt

SEQ ID NO: 21 - DNA, 211409 bp, Pantoea agglomerans NY130
gcggagatcattgaagaggtggtgttacgcaaagagacaagcgatcgggttgaaactatcaacgattcggtacgccgtcaggaagtggatattgaccatgccagtacagatcctctcggcgcagaccggctgaccgggaatcgtactgtggccgatccgttgcttgaaagcacacgtcaggcccgcgctgaccacgacacccgtccggtaacgccaggcagcgagccagcgcataaagagggtttcgcggaaaaggccggtgataaaatcgcggaagcggaagagaaagtcgaagacaagtttaaaaagccgtaatgccggagcggtgactgtcgccttctatgcctgaaaacccgtcgcagacgggtttttttcataaatcacactgaaattccgaaggcaatttaatggaatcacttagacctggcacccgttgatggtgaatggccacattgaaagttatatagagctctcgtcttaagtgtatgtacgttattcgtgacctgcccccagtattagatacaacgatcagttagtaatgtcggtttgtttaccttctgattttccaattccccagcctgctgcaaattcagctgtagtctggtaattcagcgatgaatgaggtctggactcgttatagtcctgccgccggtcattaatgattttccgggcatgaagaacatcgctgaaccagtgcttattcagacattcatcccgaaagcggccattgaaactctcaataaatccattctgcgttcgcttacccggctggataagtcgcagctctacgccatgctcaaaagcccattgatcgagtgcgcggcaggtaaattccgggccctgatcggttcttatcattgccgggtagccacgaaaaagcgcgatgctgtccagaatacgagcgacctgaacgcctgaaataccgaaagcggcggtgatcgtcagacactccttcgtgaaatcatccacgcaggtcaggcacttaatccggcggccgctggcaagtgcatccatgacaaaatctatcgaccatgtcagattgggcgcatccggatgaagcagcggaagtcgttcattcgccagacccttacggcatcgtctgcgcttcacactcaggccgttaaggtgataaatgcggtatacccgcttgtggttgacgtgaaggccctcacgatgcaataactgccagatccgccggtaaccaaagcgacggcgttcaggtgccagctctgtgatgcgtagagatagctgcgcgtcagcagccggacgctgagctgaataacggcaggttgaaagagacagacctgccagcctgcaggcacgacgttgcgacagacccgttgcatcacatatgacttccacggcttcccgcttctggtctgtcgtcagaactttcgacccaaagccacctgaagcgcctccttatccagcatggcttcggcgagcagcttcttaaggcggacgttctcctcttcaagtaacttaagccgctttacctcagggacttccatgccgccaaacttcttgcgccaggtgtagaaagtagcgtctgaaatagcatacttacggcagagttcccgtgcagaaaccccggcttcggcctcgcggaggatactgatgatctgttcgtaggaaaacgcttcttcatggggatgccctcatgtggcttatgaagacattactaacatcggggtgtactaatcaacggggagcaggtcatatcagtcatagcaccatcgcctggcacgggctgactcgattaccatcccgatagtaagagggatggcctcgcgcgggttttttggatagtagaggctgaaagtcacctgatcagaatctattccaaacgcatcgaagacgttctgaaggcattccgcagcgtcctccgggtcaagcttcatgtcctgattaagcgacatctctggcgtaagtgtttttttccggaacgtaagcagcgatcggccgttccacggctcaatgagtgccattacgcgtgcctgtgtgtcatctaccataacttatcctccccgcgagcgatggcattgtacagtctgaccgaattgaaactgatatcggcaacgtctctggccagaatcacccagcccacgacgggtatcgcccgaccgacaaaggtgctgagcttatgcgtaaaaagtatacgcgcggtccggggcgggtatccccctacgatggtggggagctttatgccgaaaggaaacttggcgttagggaatactctgcgtgctgcccgtgaggcataggaggtacccttgagagcatcgcgcggtttggtgcgggtagtcaggacattacgtccagacaggatggccacgatcgctccgaagtcatcaatgcccagctgttcagcgacttcttcacagaaaatcatgaaaaagagctcaccagcggtgaggttcggtctgcctgcgtagaaataggtgttattgagttcttcagtcgtatccactgccagctcccacaagttcacttcattcatcatcctgatgcttcttaaacaatacctcgcgcgttcatgcttgacaacctgatggtctgggacaggataataaaaaacggtaatttcacctcatctccctgaaggcattcgcggcatcatttcagaaatgggcatggtttcgctatccttatgaattaaatgatttttttatgccgtcagcacgctgaataacgggagcgggacggcaccaggcactctggagtgcatacctggccatagagagataaaggttatagaaaggttcgtggggtattaaacatttcccattctttatatccataccttacatagacctgcatttatcgataccaccggaatctacattagagtcacataagcaattcgctagtgacagctttggcttgtttaagttttctccagggttttcttaagagataagaaggcttcctgtacatgctggttaccagtctgtgctgccacgaagcgatgaacccccctcgcgttgtgcagaccgcgatccctgactacccttgctgttgtttctattcccaaagcgggccggatagcctgaaacgccggattagcatctgcaatttttagtcattaacggcaggcgatcgtgaatctgccgtgcattatcaatcagggaaatcatgacagaacaacgcaacgccgatcattaccgcgctgatgagcacattgatccttatatctcggtacagggtgcaagaacacataatctcaaagatgtttcgttgcgatttcctcgcaacgccatggtggtgttcaccggggtttcaggctccggtaaatcgtccctcgcctttgataccctctatgcggaagcccagcgccggtttatcgagtcggtgtcgccacatgcgcgtcgtctgatcgatcaggctgctgcaccggatgtggataatattgacggacttccacccgcggtggcgcttcagcagagccgggctggcgcgcaggagcgttcaacggtgggcagcctcacccggatttctgtcacgctgcgtctgctgttttcccgtgcgggcgtaaggcctgaaggcgttccctttatgaccgctgattttttctcgcctaacaatcctgaaggtgcctgtccgcattgccagggactgggaagagtgcacaccgttaaaaccgagtcgatggtgccggatagctcactgagcatccgccagggagctatcgcttcctggcccagaggctggcataacaaaaatctgcgcagcatccttgagacgctcggctacgatgtcgatgcgccctggaatacactttcagcccgtgatcagcagtggatactgctgactgacgaacagccatcggtgccaatttttgtcggtctgaatgctgagcagcgcgaaaacgcgctggcggcgggcgaagagccggcttataccggcacgtacaccagtgcagcaaaaatcgtgctgcagagttattcgggtggcagcgagacgacgaagaaacggctggcgcgctttgtgacggtcactccctgttctgaatgccacggtaaaaggctaaaccgggatgcgctgtccgtgacctttgccgggcatgacattgccagcctgagtgagctgtcggtctcagagctcgctgaactgctgaagccttatgcgcgtggcgcatcaccggacctgccggcagaggcggcactgcgtgaggcggtcatccggatggcgtcggatatctgtatgcggcttgagcagctggaaacgctgggtctgggtcatctggcgccgggacgccgtaccaccgtactctcatccggcgagctgcagcgcgtgcgtctggccacccagctgatatcgcggctgtttggcgtgctttatgtgctggatgagccgtcagccgggctgcatcccgatgatgtcaaatcgctgctcgcatccctgaagaacctggtgcgtgccggtaattctctggtggtcgtcgaacataatattgacctcatcgccgaggcagactggctcattgaggtcggccccggtccgggaacgcatggcggtgagatcgtttataacggcgaaccagcagggcttgaagaagtcagtgcgtcacccacctcggcctatcttttctcacgaagctataccgggctgcgccagcgccggcctgcagagagctggctctgctttgaacaggtctattgcaacaatattgccggagtggatatcgccatccctctggggagaatgacggccgtcaccggcgtgtccggctccggaaaatcgacgttgctgaatcgcgtgcttccggaaatgctcggacgttttgacaaaacgcctgacatcgaggagggcgaggaagaggatctggtgccggacgttaagggtcaggttgtcagcggaagtgacgccatcggccggttggtcagaatcgatcagcgtcctatcggccggacgccacgctcgaatctggccacttacaccggatttttcgacattgtccgcaggctgtttgcagacaccgacgcggcgaaagccaaaggcttcagcgccagccggttttccttcaatctgccagccggacgctgtcctgcgtgtgaagggcagggacagatttcgattgagctgctcttcatgccgagcgctaccgcaacctgttccgtctgcgcgggaagccgttataaccccgaaacgctggaggtgaaatggaacaacctgacgatagcggatgtgcttgatctgaccgtggacgacgccactaaggtgtttcatggacatgacgggatccagcgttcgcttaaggcactgacgtcgctggggctgggatatctgaccctgggtcagcccgccactgaactctctggcggcgagtgccagcgtatcaagcttgcctgggagctgcagcgggtccagcgtacgcccacgctttatctgcttgatgaaccttcgacaggattgcacccgtctgacatggataagctgctggtagtgctggatgaactggtgaagcgtggtcacaccgtgatcatggcggaacacaacatgcgcatagtggcagaggcggactgggtgattgatctgggtcccggctcgggtcttaaaggaggaagagttgtctcctccggctcaccggaagaggtcagcgcatctgcagagagtctgactgcaccctggctttccgcacagctgaaaaagagggcgggcgatccggagtaagcgggcggtagagatatcttccgctgaaggtgatgtagtctgagggctcaggggctggcttcaaagcccgtcaaatctcaaccttgaggattatcactgatggcaatgtttaatccgccacaccctggtggcctgatagcggaatatctcgaagataacgacatcagcctgcgcagtctggctaaacagctgggcgtttccgcagcttcgcttagcaaagtggctagcggtaaagcctccgtcagcccggaaatggctgtacggctggaggcgggtctgggtattgcggcacggctctggttatccatgcaggccgcatgtgatctgcataaggcgcgagaaactacagatgtttccggcgttcctctgcatccagggatcgtagcatcattattgcgggacgagacggtatagttctcgccccgaagcggctttcctcatcgccaaaacaaaccttttatcttatcagcgcagcggcgcattaacctgtaacgcatccagctcacgggcgtcgtgactgcaaaaaaaggtgatttcgccgccgcgctggcaggagagctcacgcagtcgctgctgattgtgtcgtctggccacgttatccatgcccatcatccactggtaaaagcgtagtcctggcgtgcagtgccgcgtctgctgccgcatttcgccgcggtaaaaccaggcatcgccgccgtgcagcagccagccatcgggttgctgaatcgcgatacccgcgtgacccggcgtatggcccgccagcggaactaacaaaatctccggcggtaagtcacgcaggcgattaaccgcctcaaaaccaaaccacttttctccctgcggctgataggtttcccagttgctgatcccaccccattgtccgggccggtatcgttcccgtgacagccagctatggcgctgatgcgcggtatcaacctcctgctgcatcagatggattcgcgcctgcggaaaatcggttagtccgccagcatgatcgaagtcgagatgggtcagaataatatgccgcacatcctcagcccggaaacccagtgacgtaacctgtgacagtgcggtgagattatcgcggcgctgaatattgtttaatgcgcggaaaaagccggacaggcggctgccgggcgtatggatatcctggcgaccaaagccggtatccaccagcaccagcccgtcgcgatccgtctcaatcaacagacagtgacagaccagatgtgctttcaggcctttactgaatccatcatagaacgcgccgcccagcggacacatacagccacagttaaggtggtgaattttcatcgggcctccataggggcaatggggatatctctgagaggctacggcctgtccggcgcgcagcacatcagcctggctatagagtgtagagagggatgacgcagtaggcggagcggtgaagcggataaccgggcaaaattgccggttatccgccagaaagcagaggattatcaggtgtggaacagcgggaaagcaccggtcagcagaccacctgccatcagcaccagactgaccagaatcccccacttaattgcaaagcgctggtggtcgccgatgtcgactttcgccagacccaccagcaggtagactgacggcaccagcggactcagcaggtggaatggctggccgacaatagaagcgcgggcaatctcttctgcggtaatgccgtagctggccgccgtctgggcgataaccggcagaatgccgaagtaaaaggcatcattcgacataaagaaggtaaacggcagactgaccagcgcggtgaacaccgccaggtaaggtccgaagctgggcgggatcacagccagcaggctcttcgccatggcgtcaaccatgccggtgccggagaggatgccggtgaaaataccggcggcaaaaattaatgcggtcaccgccagcacgttaccggcatgagagctgatgcgggctttctgctcctccagcgtgggatagttgagcatcaccgctatcgcaaacgccagcataaacaggatctgaatcggcattaaaccaatcaccagcagcaccagcagcacggtggtcaggatgaagttaggccagaacattttcggacggcgattggctgcgcactcttcagcatcgcccagccccagctcaatgttgtcgagatgatgatctttcatggtcatcacgccaaggcgcttacgctcacgcaggccaaacagcaccgccatcgccaccaggctggcacaggccagcagcatggctggcagcatcggaataaagatatcaagggcgtcaatgcgcagtgccgccgcggcacgggctgtcgggccaccccagggtgagaggttcatgatgccgctggcaaggttcaccagacaggtcatcatcagcacgttcatgcccagccggtgatagagcggcaggaatgcggcaatggcgatcatgtaagtggtagagctgtcaccatccagagaaaccagtagtgttagtaccgccgttccgaccagcactttcagggggtcaccgcgcaccatccgaagaataaagcgcaccagtgggtcaaacaatccggcatcgatcatcagaccgaaatagagaatggagaaggtcagcatcacgccggtaggggccagctttttgacgccgtccagcatcatggcacccaggcctgcgtaaaaaccgccaatcagcgcaaatatggttggtatcaggatcagcgcaatcaaggctgacatgcgtttggtcatgatcagatacatgaagcaaacaaccatggaaaaacccagtatcgtcagcaaattaacagccctcgcaatggcggaaaagtaatgaaaaagttacatatcggcaggaaaattcaggtaattacttagcgtggtaatgattaacctgttgttttaattaaccctgcattcaaagatgataataaatagttgtcagtatttagcatttctttaacaaagaagggtgatcatgatcatctttaaacggttcttaaacgagattgtgtgactgagatcaaagggtgtcgaagtgtaaccggggtttcgggccagctgggggctgaatcaggcgggtagtagagtggtggagaaacagggtaaccggctgagccttgatgctcagccggttaacgttattagctgcctaacagctgaataattatttcaggggttttattcgccattttgctgacagcagtctgaccctgctgaataatctggctgcgtgccagctggcttgcttcttcagcatagtccgcatcctgtatgcggctgcgagccgctgaggtatccacaccctgctgcgataacacattacggttggactcgtagcggttgatctttgcgccatagatcgactgataaccgctgatcttctcgagcgcgctatccagtgccttcatggtggttgagatatcgccctctgtaagcagcgttgtgttgttcagccccagcgttttggtatccgatggcgttgccggaatagtatccgactggatcggctgaccgtaatcggcgctggtgaccacctccataggttcgctcttcttcggcggcgtcgcaggcacacctttgggttccggcagatttccccaggtcagattaccggtgaaggagccattgcccaccaccaccacaatcaaatcctcgctgacggtatccagcgtgatgcgctcaagccggttactggtgatggtgccgttgttgaaatcgccgctggcgacatcctcatagcgatcgccgtcaccgctgtaagtgatgttcatgccgttgtaggtgctgctgttactgcccgccagcgtccagctcgggccgccctccagtaactgcgagctgtcataagccgcaccgctggcaaatccgttactgctggtcagcaggcgactatccgctgtagccgcattagtgatgcttttgctggcccaggtgtaatcaggcgcactgccgtccagtggtgtaccgaccaggtgcttaccgtcgcgggtaaagagctggagatcgtcatccatacccagcgaatcaatcgtgatgcttatcgccgtcgagcctgccgggatataggccagcgggatcacgccagaggtaaaggagtaattcttgcccggcaccggaaacttcgtgttgatagggtcaacgttacccagttttgcagggggaagatcgggattattcgtcgccagcggatagcggccaaaaatctcggtgtggtctgccacttcattgatgcctgccataatctgctgatactggccgttgatgctctgtcgatcggcgtccgacagcgtgccgttggctgcctggaccgacagggtgcgcgcctggatcagcagatcgacgatgctgccaaggccgccactggcggtctgggaatagctgatggcgtcattgaggccacgcgctaccaccgcatcggcattaatattggccgtcatgcggttggcaatcgcctgacctgccgcgtcatctttggcactgttaattctcatccctgatgataaccgttcaaccgttcgtcccagaacagagtcagtgctgtaccgcgttttgttcgtaatcgcggcggtttcgttatggttgatcgttaacatggtcgcttcgaacagggagaggagtctctgttttatcggcagggtgataagcagctttaatctctgtggcgacaaaaaggcaggaaatacgggggcagacggtcaagaggctgatgattaaccgcttttcagataaaaaaaattaacggttcaacccggtcaggaaaaatgcctgccacgcgatgacgcagcaggcgaacgaagatcagttaaacaccatgccgccatcaatcaacagcgactgaccggtcatgtaatcggagtcaggactggccaggtaggcgacgcaggcagccacatcttccggttcagaaagacgtcccagcgtaatgcgtttcgcaaattcctcggtgccgtagccggcgggcttgccggctgcttcagagatctggcggtcgatctcttcccacatcggtgttctgacaatgccagggcagaaggcgttgaccgtgatgccggcaggtgccagatcacgcgcggcggtctgcgtcaggccgcgcacggcaaacttactggaactgtaaaccgccagctccggattaccgacatgacccgcctgagaacaggcgttgatgatttttccgccatggccttctgcagcaaacgctttaatcgcggcctgcatgccccagatcacccctttgacattgacgttgtagaccttgtcgaccaccgcttcggtgatctcagcaatcggcgtggagggcgcaataccggcattattgacgatgacgtcaaagccgcccagcgtgcggcgcgcctcttctaccgcttccatcacctgatcacgctgtgagacatcgactttcagcgcaatcgctttgccaccatgcttaatgatcttctccgcgacctggcgtgcggtctcctgattaaaatcggctactgcaaccgccagtccatctttcgccagacgcagggcgatcgcttcaccaatgccctggcctgcgccggtcacaaatgccactctgtttttcatcatgatttcctttttgagaaattaaagaagctggctcagatgcagctgacccatcagcagcgggttgtcggtgtaatcgaccggcaccgcgaccacggcgggtccctgaacatccatcgctttacgcagcgtcggctccagctctgccgcactggtcaccgcaaagcccgctgccccaaacgcttcggcataggctttgaaatcgaccggcccaaaattgacgcccgaaacgcggtgatattttttctcttcctgcatcgccaccatgttgtaggcgttatcgacccagacgatgtgcagaatgttggcttttaagcggacagcagtttccagctccatgctggattgcaggaaaccaccatcgccggaaactgaaaccactttgcgctgcggctcgaccagccaggcaccaatcgcccacggcagggccacacccatcgtctgctgaccgttggagatcatgatctgacgggcgcggaagctgtagaggtagcgggcgatccagatgtggaagctgcccatatcgacggtaaggctgacgtcactgttaatgatgtcctgcatggcgcgcacaatgcgcagcggatgcagagcaaactgattgaggctggcaccctgcatcgccagcaatttgcgctgctgctgacgatcctcaaggatggtggcggcttccggggtcagctggaggggggcagtgatgcgcgcggcgagtttacgcaccgtggcggcgatatcacccaccagtttctgcatccggcagatagcggttgtcggtctcagcgggtattacgtcgatatgaatcagggtggcgttaccgctgttccacatcgccggttcatattccaccgggctgtagccgatggtgacgatcaggtcagcctgttgcagcagcctgtcgcccgcctggttgttaaacagcccgacgcgcccggcgaagcgtgagaagtgatcctgtctgaccgctcctgctgcctgataggtgctggtaaccggaatgtgactgcgtgtcagcagctcatgaatcgcttcgctgttctctgtctggctcgccattaatcccagcaggatgaccggatttttagccccggcgatggcctcgctgacggcgtcgatcattgagtcaggtgcggcgcccagtacagggcggcctttgctgctcaacgctttgccggtaaccggctgatcgacaatatcctgtggcaggctgataaaggcaccgccgccccggccatgttcggcgtggcgaaacgcattcgacaggcattcagaaagtgcagcggggtcggtgacctcaaccgcatatttagtgattgggcgaaacattgaaaccgtgtccatgctctgatgaacctgcttggcgctgtcggagcgcttcacctgaccgccgatagccaccactggatcgccttcgctggtggcggtggccatgccggtgatcaggttggagcagcccggcccggaggtgaccagcgccacgcccgcattgccggtaaggcggcccactgcggcggccataaatgcagcgttagcttcgtggcgaaccgggatggtctggatggaggaatccagcagtgagtcgaagactttatcaatttttgcgccaggaatgccaaagacgtggcggacgccctgtgcctcaagttgcgccaccaccaggtcagcgccacaggtccagagtgtggtatcggttggagttttcatcgtcattcctctgattagctttctaccgcacgaatcgcggcgtcaagattggcggggttcaggtcggcattgagaaaatcgctgtcctgcggcaaatccacgaccagcttgctgatggcaccaaaggtcagggtgccctgttccagcgcatagtcgagaatgtggccgccgccttcgcggtcgtcggtaataaaatgttcgtgatagcctgcaacgttaatgccctgcatatattgcggtgtacggaatccgatcagttcgcccgcacgctggctgaaggcaaaggtcggctgatcgcccagcacttccggcattgagcgatagggacggcactggcatggcacggtgcgggtctcgacgcgactgaaacgaccgctgatgcgcagcgcgcagaactggttatcggaggtgatttcgttgtcgatcacctgatggatcgcctcacgcgacatcggccggtcaaattcatacatatgctgcggtttaaaaaaggtcatcacggcgaacggagttttctgcgccggatcggccgggtgcgcgctgccgtcggcgtgcagctgatagaccttgctgtcaaacgcgatcatctcgccatccagccggttaaaggtacccaggccgaaatcccctttacgcagcaggtcggcaatacggacattgccgtcgtaaacgccgctcagcagcgcactcattaaagaggtctgatagataacgctttctggtgcatcctgtgaaagcgtcaggacagtatgttttagttgatcctcacaggaacaatcagttacacaattgctcatttgatgcctcatcgattaaccgttaagccgtgttaacctaatggtgaaccgattcagtcggtgggtccaatagcgaaacctgttaactttgagacgtttttgatatggaacttcgccacctgcgttattttgttgccgtagccgagacacttcacttcactcgtgccgccgagatactgggcatatcgcagccgccgctgagtcagcagatactgcggctggagcaggaaattggcacaccgttgctgaagcgcctgacgcgcggagtggaactcaccgaagcgggcgaagcgtttctggcggatgcccggcagattgtgcaactggccgatcaggcgctggagaacgcacgcggtattgcgcgcgggatcagtggtcagctgtcgctgggctttgccagctcggtggcgtttaatccacgcatcttcaccctgatccgccagtttaaagaacgttatccggcgatggagcttctgacccgcgaagagaatatgtctctgctgatgcaggatttacaggagggattactggatgccgcttttatccggctgccgtgtgaaagcagcaagtcatttaatctgcgcgtcatctccaccgagaaaatgctgattgcgctgccgcgctgccatcccctcagcggcacacccactgtggcactatccgcgctggcgggagaaaccctggtgatcttcccgcgcgacgtctcgcccagcctgtatgagttgattgtcacagcctgtctgcgagcgggcttttcgcgccacacttttcagcaggctccgcagatcactacgtcgctgggcatggtggcggcgggctgcgggattgcgctggtgccggagtcgatgcgctgcgtcgataaccccggggtcagcttctgcgatatcgaaaacaacacgctatttacggatgttgcctttgcctggcgtcggcttcacccgtcaaaagcagtactgcacctgctggcgctgctggcagaacagcctgccgcaccaggcgaagcgggttgataagcgccagctattgaactgaaaacaataaccaactggcggccagggaccgggatgccaataatcggtgcatgactacataccgcgtaagagtcgggtttcacaacccgtcagccctgacattcaggcaactggatgaaattctggagccgcagcgattctggagaacagattcggcgggcggccagttccgctatttcatggagtatgagtaccagtctgacgtgcgcgatctctgctcggtctgctcgctggcctacagtcaggcctgcaaagtcagaaagtgcccgctgattctggtcgaggtgatgaactgatcctttccggcgatcccgccgttctcagcacgggatcgccggatgttgttttaacgtgaaccgcgctgcatcaacagacttaacgcggcgggcagcaccgtgagcgtcaccagcgtaccgctgaccagaccgccaataatcgccagtgccattggcccccagaaaacctgatgggcgatggggatcatgccgagtattgccgcacaggcggtcagcagaatgggacgcgcacggtgatgggcagcctgccggattgcctcacccgcggtcaggccggcccggctattcgcatcgacttcactgatcatgatcaccgcgttgcggatgatgatccccgccagggcaataatccccagcagcgccacgaaccccagcggtgtgccagccggcagcatcgcggatacgatgccgggcaggccaaacggtgccatgctcagcgccagcagcataccggagaagcgttgcagctgaatcatcagcaagaccagcatgacgcagattgttaccggcagcagagcaaacactgaaccgttgcctttgtccgattcggccgccacgccaccttcttcaataccgtatccggccggcagcgaggcgcgcagggcggcgacggctggtgcgagctgctgcgagacctgttcagcccgctgaccgggcgcaatatcggtctgtacggtgatgtaagccagccgctgacgtcgccatatcaccgggtcatccactccccagttcagggttgccacctgtcgcagcgggattttctgtccgctggcattggtgatcatcaatcctgccagtgtgtcagtgtcctgccgctccgggtcattgctgcgcagcacgacgtcgatcaggcggttacgatcgcgcagggtggtcaccacgctgccggacatcagagtattcagcgcggtggctatcgtctcggaagagagtccggctgcgcgggctgcagtctggttcaccgccagcgtcatgacccgttctggctctccggcggtaagattgacctcgcgagtcagcggtgagcgggcgatcagcgccgccagccgatcggccgcctgccgcaccctggcattatccgggccggtgatgcgatatttcagcggccagccgaccggtggacccagctccagcggcgatacccgggtagtgatatcactgaaatccaccgccagcttctgctccagcctgctgcgcagccgatcgcgtgccgccagatctttcgccaccaccaccagctgcgcgatgttttcattatccagcagcacatccatcggcagataaaagcgtattgcgcccgagccaacgtagctggtgtagttcgccacatcccgatcgttgcgcagcatctgttccagctgtgcggttcggcgggtggtttcagcctgggctgcactggcgggaagcgtcaggctgaccagcagctcgggccgatccgacgcagggaaaaactcaccctgcataaaagtggtggcgtaaaggctgaccagcagcaccgccatcgctgtgccaatcgtcaccagccggtgacgcagaatcatctccagcagccggtgatagctgcgcgtcagcacgcccggcggcttatcggccttgatgtgcctggccgacagcagccagcagccggtgagcggagagaagatgaccgcgacgacccacgagcagagcagcgccagggtaatcaccacaaacaatgagtagcaatattctccggcactggaggcggcgaaacccgaccggaatgaacccggcgatcattaccagcgtaccggtcagcatcggaaatgcggtggttttaaacgcataggtggcggcctgccacttgctgtcgcccgcttccagtcgcgccaccattgcctcgacggtgatcatggcatcatccaccagcagccccagcgcgatgattagtgcgccaagcgagatgcgctggagtccgatgcctgccattaacatgccggtaaaggtcattgccagtaccagcgggatcgccgccgcaacgaccagaccggcacgcagtcccagtgagacaaaggagacggctaacacgatgacgactgcttcgcccagtatccggacaaagccgctgaccgcgtttttcaccacggaagactggtcggccacgcgggtcatagtaataccgtgcggtaactgactggccagcatctgcatgcgctgactgagctgctgaccgaaatcgagcatgttgccgctgccggccatggagatcgccagcccgatagccggaacgccgttaactctaaacgtcggcgccggaggttcggcaggttgcaggctgatggtggccagatcggtcagcggaataaaacgctcaccgatatgcagggtaatcgcccgcagattttcaaccgaagtcagggtgccgctgacccgcagcgcaatattctcgcggtcggtacgcaggctgcccgccgggacgacatcgttctgagctttaatggcgtcgctgacctgctgtaaatcgagccccatgccgttcagcttgcgcggcgaaaaggcgataaccacctgctgctcctgtacacctaacaggctggttttaccgatgtcgggcagactggccagattgcgacgcaggttatcgacccggtcgcgtagctctctggcggtaaaaccctccgccgtgaagccataaatggtgccgaaggtgtcgtcaaactcatcgttaacggccggaccctgcacgccctgcggcagtgaaggggcaacatcctgcatctttttacgcagctggtaccagatgccggccacctgagagggcggcgtgtcatcgcgcaggttgacatagatgacggtttgtccggcacgggtttcgctctcaaccgcatccagcgacgggatctcctgcaccttctgttccagtacgtcagtgagcagttgcaccgtggtgttcacatcagcgcctggccattgggctgatattacggcggttttgatagtaaacgccgggtcttcattgcgtgacagatgttcatagctcagcacacccgccgccatgaccagcagcatgaaaaagatcaccagttgctgatgcgccagcgcccagccggagaggttaaagccagacgtttttttcatggagcctcctgcgaaagcgccactttttcgccaggttgcagggtgctgacgccggcggtgacgacgcgctctcccggcttgatcccggcagtgacgaagatttgctgcgcgttaaagcgggccagcactaccggacgaagctgcaggcgtgacgccgcatcaacgaccagcagcgcgggtttgtctgcggagcgggtcagggcgctggcgggcagggcgatgaccggcggctgcgcatcgggaagggtgacaatgactgtggcaccgggtgccatcgcctcaggcggctgattcagtgagatgcgcagccgccatgtgcgggtctgtggatcggcctgcgggctgatgtcacgcactgtgccactggcctgcacgccgggatcggcgagcagcgtcactttcagcggtgtccgatcatcaggatgcagcagcgcaggcgttgtcaggtcaaacaccgcatcgcgtgcatcccctgctgccagcgtcatcacattttgtccggcgctgaccacctgacctggctgaaccgtgatggcggtgatccggcctgctgcaggcgcagtcagctgagtccagctgaggttatcctgggcatttttcagagccgcttcgctgctgagacggcgggactgtgcgctctgccagtccgcctgtgcgctgtccagctggctgcgggcgatggcccctccgggcatcagcagccgcatccgatgcaggttaagcgcggcgacccgttcggcggcgcatgcgctgtcgagatcggcccgtgcgctgcttagctgattgcgtgactgatcattttccagcgctgccagcgattgcccggcgctgacgcgatcgcccagctcaaccgcacggctcaccacccggccatccagtctgaaggccagcgcgacctcttcatgagcgcggatttcgccagtcagcaccagcgatgcatcactgctgagcggtggagcaatcaccgatttaaccgggcggagcggggcggcaggcggagcagaactattgtcccggcaaccggtcatgatgaataccccgagcagcacgaagatgatcggcgcaaagatgtgaataccgaagagatgacgccacacctggcgggcagcatccgataagaagtctgtcataaccgggttcctttaatgagttgtgctcattgaacccggcatgtgtccagaaacgttccatgaaccatcaagaaatggtcaagccagaacaatttatctcgtcggcagcgttatcccgatcagcagaccgccgtcggcgggcagtgtggcgtgaagcgacccgccgtgcgcctcgacaatcgctttggcaatcgacagtcccagaccgctgccgccggagtggcgggcgcgtgaggagtcagcgcgggtaaagcggtcaaacaattgcggcaggaagtccggctccacaccctgaccataatcgcggaaggtcattatgatcgcctgatcgttctggctggccgtgatcagcaacgcgccaccgtcggcagcgtagcgcattgcattctcacagatgatggtcactacctggcccagccggaaggtatcggcatacagccgcagatcgttgggtgatgtcacgctgatggcaatccccgcctgttctgcctgcggcagaagccagccggagcgctcgcgcagtaactcgctgagattaaaccactcgcggttcagggtaagctgcccggcatccgccagcgacaagagatgcagttcgtctgtcaggcgactgagctgcgtcagttgcttcatgatcattgccagctgttgcggttcggcaggaaagacgccatccagaatcccctgcaggcggcccatcgccgccgtaagtggcgagcgaagctcatgcgccatcgccacatgcgaggtgcgcagctcacgctcgtaacgcgccagctgctgcgtcatctgattaaaatcttcagtaaaacgtaccagctcctgtggggcttcttttacgattaccgccgatcggccaaattcgccttttgaaaccgctcgcgccgcggtagccagctggctgaactgcgccgacagcggacgggcgaaacgcagcgccatcagcaccataaacggaatcgttaccacgaccagcacgatcacggtaagccagtccgacgaggccagcgacggatcggagaagttgatgccccaccactggtccataatctgatgaaagcgcacaggatcgctggcagggtggtggcgcaaccgggtgaactcatccagcagcgcgggcggcatccggtaatagacccagtacgcttgcactgcgaagcgcagccacatacagatggcaatgagcaccacgctgccaatcgccagaaacagcacccggatgcagatccagcgccacaatgaagtatgcgtatcgttcttcatggctgtctgaaccggtaaccgacgctgcgcactgccggtaagacatcagagatgcccgcggcttccagtttgcgacgcaggttatagacgtgggtatcgaccacccgctcaagcgcatcgctttccggcagacagtgctccagcagaaacaggcgggtaaacggacgcgtcggagcgcgcatcagggtgaccaacagggaaaattcggtcggtgtcagatcgaggcggcgcggtgaagcactgtcgctatcgaccactgcggtgagcgccaccgggtccaccactaaacccgcccagcgcagggtttctgcagcgggtacctgactctgctggctacggcgcagtactgcctgaacgcgcgccaccacttcgcccggatgatagggtttgaccacgtagtcatccgcgccatagcgcagtgcgccgatgcggtccggcgcatcacccatcgcggttaccatgatcaccggggtatcgtcacgacgtcgtagcgctgccagcacttcagtgccgttcatgccgggcagcatgatatccagcaggatcagatcgggctgccagcgtctggcggcatccagcccgcctggcccatcaccggcaatcatgacctcataattttcacgtttcaggtaggcctcaagtacgcccgccgcatcagcatcatcttcaataatcagtacacgttttgactgcattttcggatcaccttgactgtttcttcataaatccctggtcgttaattgacactcgcctcgcatactccggccattgacgcggctctgaacccctcagctccgcacctgatgtgataatgaggaaacgtgatgataaccggaaaaataacgctgcacatggtctgtttttcgctgggattcagtgccgcgactgccatagctgatgagactacgccgccgccaagcgtcacgctgggcattgcaggtatcaatgcaccacgctatagcggcgccgataagcagcactggcagctgatgccggtgatccaggcacgcgacggggccttctttttagactcacagaaaggcattggctatgacctgcaggcagataatggactgtatctggaacatacgctgggctacgggctgggccgttctgaccagaattcatcctggcgagatggggatgaccggctcagaggcatggggaacatcgacgcaacgatgaacaccgcgctggcgctgggatggtcggtaacgccgtggctggtgctggagggcaaagcgacgctgccattaagcgatagtcagggtgtgcagtaccggacttccgtaaccctgatcccctggcagaccagtgacgataccgtggcactgcaggtggcgggactgtttggcgacgggcgttatatgaatacctggtatggcgttaacagcaagcaaagtgcgcgcagcggatttgaacggtacgacgccgcgggtggattttatggcaccgataccagcctgacctggagccatcagttcacgcctgcctgggctgccagtgtgatcggtgactacagctggctggataagcatgcttcagatagccccatcgttgcacggcacaacggcgcatcggccaccctggcattgagctacaccttctgaatggcaccatgaagaaaagtgagatgcgcagccaccgccttttgcttgcggcactgattctgttgtatgtcgtggtctataccctgacaggcgtggcgcttagcctgttggatgcgccgggacggggatagggagcgagcggtataaacagcgtgatcgggctggttatgccgtgacttaaatagaaaattaacttttcgtaaagcggttcagacattaatggtcagcgttagaagtttcgggtacatccggatgttttaattatcgctatataaattgattaaggtggttaatttagattgcgtcataatgcatcttgctaataaattttttaaaagagcattggtgtagttaatctatatggattgggcaggatttaaatattataaattaaaatgtgatctattaagatagcctcttcgctgtggtagcagcgcatggaatttacaggggctgaactgatgaaaaataaaaatagtgctacacctcatgatgctacttttagacagtttcttacgcatccggatgttgccagagattttatgcagatccaccttccggagaaattgcttaaaatctgcgatctcaccacactgaagcttgagtccggatcatttgttgaagacgatttgcgtcaatacttcagtgacgttttgtacagtctcagaacctcaaccggtgacggatatattcatgttctgattgaacaccaatccacccctgacaggcatatggcattccgcctgatacgttatgcggtagccgctatgcagcgccaccttgaagctggccataaaaagctgcctttagtcatacctgtactgttctataccggtaagcgcactccctatccgtggtcgacccgctggttcgacgaatttgatgatccggtagtggcggaaagcctttatagaggcgccttcccgctggtggacattacggtcatcccggatgatgagatcatgactcatcgcagtatggccgccctgacgcttttgcagaaacatattcatcaacgcgacattgcaagcctgactgaccatctggtcacgctactcatggccgattatctttcttcaccccaggtgatgacgctgatacactatttactgcaggctggtgagtcagctgactacgaagctttcgttcgcgaactggcacagcgggtgccacaacacggagacgcactgatgaccatcgcacagcagcttgaacaaaaagggatcgaaaaaggtcgcgcagaaggtattgagcttggtgaacggcgtggtattgagaaaggtcgtactgaaggacagcgtgaagctaccctgaaaattgcgcgcactatgctacaaaacggccttgatcgtaaaactgtcatagaaatgaccggcctgacgtcagacgatctggcgcaaatacgacattaatataaacaagagtaaacccggtcatgaccgggttatcgttttgaataccgcaccagataaatcatcataattatcagaaaggtgtaacctgcatacgtcctgaactacaagccattatttgtctggctgacgctgcaggaaattccaggttgcgcccaacatgccggagtcgttgccgtaggtcgcggtatcaatgcggatatcaagatcatattttgccagttgctctgccagttcctcgaggaacggctcccgctcggtaattccaccaccgataaatatcatctgcggatcgaacacgctgaagaggttatataagcaggctgcaagatcctggtagaatttattcaccacctgctgcgcggcttcttctttgcgatcgtatgcgtcaaagacatctttacccgtgacgtcgtcggaagatttttcgatgagctggctgtaattctcccgaagcgccgtcatggtacaactctggctcatggtatggcgttcaatattgctgctggtggggcgcgaagtcagcagacagccaaactcgcccgcgcggttacgaccgccccggatcagcgcgccgttgcagaaggccgctccgcctaatcctgtgccgatagttaacatcagaaaatcactgagtttttttgctttgcccagccactgttcagccagtaaggcgcagtgggcgtcattttcgaccgtggcaggcagtgaggttttttccgtcagccactggctcagatgaaactggtcaaagtcccgaatggtgccacccatggcgatatatccggcttctgcatcaatataaccgggcgtgctgacggcgatgccagcacagccgggatttttctccagccaggccaggatctcatcaagtattttgtcgcgtgaattatgggaaatatcagcactctcactggtcagaatatttccctgctcatcaatcacgcccatttttaaagaggtaccaccaatatcgaaagctgcaatcttcattaacgttctctgaggttgttttcatccgattaattgtagtgctgaaagaaaaagggcaggagggctggcggaggcaattttgtcaggaaaggtacagatttataaagcgagtgttgtacagagggtgttttgataaaccccggcacacagggaacagctgtgcatgatttttcaggacgtccgatgtaatacccgcgctaagagggtgtctggcagcgcgggcttaatcgtcacactgcagtcattgccacttacgcaacaggagactggcgttgacgccgccaaaaccaaaaccgttcgacatggcataagtcagcgccgtgggacgtgcattgagcgccaccaggtcaagattgcctgcggcttcatcgggatgatggaggttcagcgtcggcggaataagctgctgccgcagtgccatcagggtgaatatcgcctcaacgccgcctgccgcacccagcagatggccggtggcggatttagttgaggcgatcgcgacctgcgaatcatcgccaaacactgcgcgaatagccgccagctcaccgtgatcgccaacctgagttgaggttgcgtgtgcgttgatatgctggacgtcttccgggctgatgcccgcctggcgcagggcggttttctcatcgcccgcgcagccccgctgccatcctccggacccgcggttaagtggtatgcatcggcgctggtgccatagccgacaatctccgccagcggtgtcgcgccgcgtgcttcggcatgggccagtgactcaatcaccagcaggcctgcaccttcggccatcacaaagccgtttctgtcacgatcaaacggacgtgaggcatggtgcggctgatcttcatagcccacacatagcgcacgtgcagccgcgaaacagcccagcgtgacgcgatccagcgccgcttctgtgccgccacaaatagcaatgtccgcttcaccgcttctgatcaacctggctgcatcaccaattgcctgaactcccgccgcacaggcggtaacgggcgcacccagcgggccggtgaagccgtgtttgatcgagacatgacccgcggccatgttggccagaaacgaaggtgctgtaaagggtgagagcctgcgcgggccgcgtgcatcggtggtgcgcaccgcgtcggcaatggcaccaaagccgccgacgcctgaagcaataatcgtcgcggtacgttcgcgcgtcgcctcatcttcaggatgccaggctgcctgattcagcgcttcttctgctgccagcagcgcgaattctataaagcgcgacatctttttacgctctttcggcgcaatgaacgcttcggggtcgtaacctgccagcggatcttcatcgatgcccggcacgctgccacctactgaaataccggtgccagcagtaagcgtatcgggaagggtacgtatacctgattctccagccgttaatcgccgccagacggtttcaacgccacaacccagtggcgaaacgatgcccgcgccggtaatgacaatgcgttgtgatgaggctaagtgactcattggattactcccgtagagagtccggacagtaattgaaatgctgccgcagacaatggatacacgccttgagcgcggaaggtgagaccctgcgtagaatggtgcgatggacgaacgcagggatggaatagagcagagagagataagcttagcagcatcagaatcctgagcgataaccagacagagtgctatcgttgctcttgtgactaaataagtcaatagtcacatcatgcgcattgttcagggcgcaaggctacgtaacaccagcgctgccagttgtgcagaggcttcttcagcgtcatcaaggctgtactgcagcagtaccggactggcgtagggtttgatcacccgatagattgcctccgccgcttcgtcagccggggttttacgctcaaactcacctgcttcacgcccccggcgcaggatctgctgaatcaggctgagcagtcgttcttcatgcgccatcgccgacggccagcggtcacgcgacgcgacggcagcaatatcatagagtttacgttcgtgaaaaaagagttcagtgccggtgacggaaagcgtgcggaacagtcgccgcagttgttccgatgctccaggcgcatcggcgatagcgacttcgacgtgctgcataatcatcgcaagccgggtggagcaaatcacttcgccaatcgcctgttttgattcaaaaaatttgtagatatacgctttggaaaagcctatagcacgggcgagatcggagacggtggttttttcgtaaccataatgcgcgaagtgctgcatggcagcatcgacaatctggtcacgcacattgtgcccggccgggccgcgtgtgccattttccgttacggattgagtcattgtcagaacctggcagatcaaaggtgggtgaaaaaattcagtgaccactgttaagggtggtcacattttaggccctgttgcgatcaaaagccatattttgaacgaactgaatgtatgctggtgttgctgagtgccaccagccggttattggcgcagcgtatctatagagatattccagtgattgagcttgttatagagcgccgtgcgagaaatgcccagcagcttagcggactgccgcagattacccccctgcgcgcgaagggtctgcaggatgcaggctcgttcattatcctgcaacaggctgctggccgctggtctgttttcggctgcgcgcgtcaccatcgctggcggcaaatcggcaaggtcgatgatgctgctctggcaaagattaacgatccgctcgaccagattttccagctcgcgcacgttgccgggccagtgccatgcctgcagggcgttcattgcttcaatgctcacctgcggaggcgttttattcagccgctgacacagggcgtgaatgaaggtattcaccagatcaggaatgtcgctctggcgttcacgcagggcagggatggtcagggagataacattgaggcgatagaacaggtcacggcggaaagcaccctgttccactgcactgagcagatcgcaatgggttgccgccacgatgcggacatccactttcagcggatgcgccgctccgatgcgcagcacctcactctcctgcagcacgcgcagcaggctggtctgtgcctccagtggcatctcgccaatctcatccagaaacagcgtgccaccgtcggccagctcaaatttacctgccgaaaccgccgcgccgtgagccggtgaacgcgccatcgacgtagccgaatagctcactctgcaccaggtcacgcggcagtgcgccgcagttaaccgcgacaaaggactcatgcgcccggctgctggcattgtggatcgcctgagcaaacagctctttaccggttccgctttcaccggttagcagaacggtactgtcactgcgactgctggcgcgggcatcctgaagagccttctgcagcgtgggtgcctgaccacgaatcatctcaaaggtatagctggcgctgacgccaagcacacgacgggtaatggcacggatgcgctgattttcccgcagcgacaggatgcgaccgccgtccggtgccggcatcagcgagaccaggcatgaaacactgggtctgccatcggggcggaacaccatctcgcggtcattacagcagggcagtgtgagcaatgaaccggactggggctgcagcacctgatcaatcagggcgttgtcggtatcaataccggcaaagatctgacgagcgtagcgattcagggttttgatgcgtccgtcgcggtcgcagaccacaacgccctcattcagggtctccagtatcgactgctgctcggccagcagacggcgtaaggtgagttgctggccaattgcctctgcggcagcctgcacggtgcccagcgtatgggcactgaaattgtcaggcgtggcggtcagcgtcagtacgccagtcatacgaccgctggcatcacggataggagctgcagcgcactgccggttacgttcacgcagcgcgattttccagttttctccgctgagtacatagaccagccgctgctctcgcaggcagcgcgcggtgcagttggtgccgagcacctcctcacgcaggatgctgccgaccggagtcaggtcgctgccgcaaaaactcagtacaatgccttgcgcatctgtaagattgatatgaccgtcgggattgtaagccagcaggttctccatcacgctatgcgccacagtaatcagctcactgttatggcgcagaacggcggccagctccgttggatcggaggcactgtactcaaaagataccggatcgatgccatgttcgtgcgagcggttccatgactgcaaaatactgcggcggatccagtgcggctgttcaccctggctaaatgcctgccagccccgggcaaaccgagcttcccactgtgccgcatcaccgccttccggcaggctgaatatggcatcgctctcttctttattaggcagcaaatcatgcagagattgcatttcactctcccgtggtcgatggaatgtccattttaatgacatgttaagttgacatgtaaattttattttcaatcaggacgcgtcatctgcgagcgcgttcacataaaagcccgctttaaaactggcatccactttgcaacgctgacattaactctcacctgtcaaaaacaatgggaaagttaaggtgttatgcgtaaacataatctgaagttgttgctgttcatctgttccatcgcctcattgagcggggtgatcctcggttatgacgcctcagtgatttccggcgttattgagccattaacggaacaccttgcgctaacgccgtggcaaagtggatgggctgtttcaaatgtcattctcggctgtatcgtcggcgctggctgtgtcggcgcgatctcagatcggatcgggcgtaaacctacactggtgatcaccgcgctgttgtttgccgtgtctgcggtgggttctgcgctggcagattcactaaccggttttgtgatttaccgactggtgggtggcctggcggtcgggatggcgtcggcaattacgccgctctatatcgcagaggtctcacctaaggactggcgagggcgcatgcttgggctgcagcagatgctgatggttggcggtcaggtcacggtctatgtggtgaattacctgattgcacgcggtatgccccatgcctggatagtcagtgaaggctggcgctggatgctggcgtcgggtgtggtgccttgcctgctgtttctggcactggtgccctttatgccggaatcaccacgctggctggcgttaaacggcaagcgtgaacgcgcgctggcagtgctgacccggctttcgacgcctgaacatgcgcggcgtctgctggcagaaatcagtgcgccggacgcggattctgttacccgtcagcagggaaacccgtctgctccgcgacgccagaatgcgttacatcctgttgatcggctgcgcgattgcaattctgcagcaggtttcgggcatcaacatcctgctgtattacgcaccgtcgctgctgcagaacatctcaccggatacacagacctccctctatcacagcattttcctcggactggcgctgctggtcggagtagcgttttgtctgaacgcagtggatcgctggggacggacgcgtctgctgcgctggggagcgctgggttgcgctgtcagcctggtgattacggcctgggcctttatagcgcagatcggtggcctgctgccggtcgtgggcctggtggcgttcgtactgatttttggtatgtcatggagtctgggtgcctggctactgatctctgaaatatttcccaaccggattcgtgccgtcgcgatgggctacgccttttcttcgatgtatctcgccaatttcatcgttactcagactttcccgatgatgaaccgtagccgtttgctgatggatcacttccatggtgcttttccactgatgctctgcgccgctggctgcctggtggccttctggtttgtaaaacgttttctgcctgaaacccgaggcatctcactggagcacatcgagccgctgatgctttcaaaatcccgtcgttttgccgccaaagcgcaggcgacatccggacaccctattcagcctgactgggctgacaacaaaaaacaggagcagttatgaaccttaaaacagtacgagtgggattgatcggtgctggccgcatgggcagttttcatgcagagaatctggcgctgcgggtgcctggggcacggctgacagcggtcgccgacctacaacccggcgcagcgcagcaactggcagaccggctgggggtggagaaagactataccgatatccaggcgttactcaatgacagcgaaatcgatgccgttgctattgctacgccggctcgcactcacgccgaactggtgatcgctgcagcccgggctggcaagcacgtgttctgcgaaaaaccgatggcggtaacgctggatgaggcagatcgggctattgccgccgcacaggatgcgggcgttgtgttgcaggtcggcttcaatcgtcgattcagtgcaggcttcgccgcagctattgaagctgtcagagcaggcaccaatggcaccacccagctaagccgttcggtgacacgcgaccctggcctgcgcgatccggccccgatcccgcagtggaccatcttccttgaaaccttaatccatgacttcgacaccctgctgcacttcaatccgggttcccggccggttgaggtctatgcgctggctgatgcgctggtgcgtcccgattttaaagataagggattacttgataccgcggtggtgaccatccgctttgataacggtgccattgccactgcggaagccaacttccaggcagtttacggttatgacgttcgcggtgaggtctttggcagtaaaggtatgctgcaggctggcaacatcaatcaggacaactgtgtgcgctatcacgccgagggtattgccatcgcaacgtctcgaatggataccgatctgctgcgtgaggcctatgttgctgaaatggcagaattcgcccgcgcgattctgcacggtgacacgccgcgcgctactggcactgatgcgcgtaacgcgctggaaattgcgctggcctgtattgaatcggtgcagcaacgcaaacccattctgttgggagaacgctaatggccggttatcagctttcagtctgtgcggagatggtgtttctcgaactgccttttatcgcgcgtgttgagcggattcatgcgctgggatttggcgtggagatctggaactgggccaacaaagatatcgacgcgttggtggcgacaggtgcgcgttttacctccatgaccggctacctcaacggtaacctgactgatgatgatgagattgcagagttgctgcatagcgcagaaacctcactggcgattgcagatcgtctgaactgcccgagcctgaatctgcatggcaccgggctggatgctcacggccaggcggttcgtccggttgaggtggttaccggtgagatgtggcttaaagcggccgacaccctgcggcgtgtcgctgcgctcggcgagcaggccgggcgggtatttactctcgaaaacctgaatctggcagttgatcatccgggtacgccgttcgcacgggctgccgatacgctggcgctggtcgaagcggtcaacagcccggcactgaagatgaatctggacctctatcacgcccagattggagagggcaacctgatagagctgatacgacgctgcggccccgctatcggtgaaatccaggtggctgatgtgccggggcgcatgcagcctggcaccggggaaattaactatcgcgccattgcccgtgcgctggagcaggtcggctattgcggcgtcgttgcgctggagggctgggccgaaggcgacagcgaaacagccctggcacagttccgcgatcactttacgttgtgagctctgccgccgggtatttgcctgttgcccggcggttctatcaataataaaccctacaggattacgcgatgaaaaccaaaatgttagcactgctgctcagcctgatgatcagcgttaccgcctgggctaaaacacctaaaattggtgtcgcactggctaatttcgatcttaacttcgtatcgattctgcggacgcagatggtggatgagataaaagcgctgaaaatggatgtgcagttcgtcgatgccaaaggggatgtagctcttcaggtacagcaggttgaagactttatcaatcagggcgtggatgccattattctcaacccggtcgatacacagggcgtactgccgatggtgaaagcggcagaagcggcgggcattccgctggtgtttgttaaccgtaaaccggaagtgaaattaccgtccagtatggcctatgtcggttctgactctgccctggggggtgagatgcagatggaagcgctggcaaaacagatgaactatcggggcaatgtcgccattttaatgggcgcattatcaaatgaagaagcgcgggaacggacgcgtgccgttgaagcggtgatcgctaaatataagcaaatggcggtaatcgaaaaacagactgcacgctggcagcgtaatgaagcggtagacgtagtttcgggctggctgcttaatcagcgaccgatcgatgcaatcgccgccaataatgatgaaatggctatcggggctattatggcgctgaatcaggcgaaaaacagccacattctggttgccgggatcgatggcacgcctgatggtcagcagttcgtcaaaaatggaaagatgacgctgactattttccaggatgcgaaagagcaggcgacaggcgctgtgaaagtcgtgaaagcgttactggataaacagaaagtcgaatcactgaactggatcccctataaaatcattactcaaagtaattatgcggagtttgctgccgctaatcagccataaaaatcgccgctaaccttatgattctttgtcgtttcttaaattattaaccagctgccgggcaggggcggactctgcccggcccgttctgctggctaatctgtaaaaatttccttaatcgcctgattaacgcgtctgtagtgcttcttcatataagctgaattatactgtcgataaatgagcggaaattcagtgatttcttaatgatttacataatcgatgatcaggtttcttacaattctgatgactgcacgcttagccacattcctactcaggagtcgctgagcctcagtatttcttcaggtcggctttttgagcagttactgaattccgggggagaaatactggcgcgtgatacgttgctgaccgaggtctgggataaatatggcctgcgtggatcgaatagtaatctgaatcaatatctgagtattgtgcgcagggcactcgcggcttatggttgtgaaaatctgattatcaccatcccgaaaattggtatacgcctgaataccgatattaaaattgaacgtcaatcagccccggtcatgggggggacggaggttttaactgatgacatatcggaaggaagtataactgaagggtctgctgaaaacgttgttctgcctgccactccgcccggtaatcagctgccagctacgtccgttaacgtcacccggcgatactggtttgcttctgttgctctgatattgctgggcatggtgctctggtatttcacggtatcgcgtcctgacgagcaaattattccaatgagtgccattaaacttgaaggtggctgcgaagcagtattattgcagggtctggatgaggttgaacgacaggcattgggtaagcaaatagtgcaaattctaagggaaaataatcaaacctgcgatgcgggtcaccggattatttttgataaaaacacatcttttactactaagaatttcggaagaacgattctttcatcgtgtaaaattaatagcgatggtcatatcatctcatgcgacaatttttattatcttgactggagaatgggatgaagcggagcattggtgttaatattatcttcatgctggctgcgctattaatggtgacttttgcaggggtttattacttaacacatcaggccaaagattttccttttcgatgctcagcgtttagccgttacgatctcagtcgtaatgatgataaacgaattgagttcgctgttgcccaggatttacgttttgataaaaaggattcaggctatcttttgctgaatgggcaggcaacgagcaatgacggtgttactattcttaacagaagggttgcattaatcaatggcgctaaaatttccgatgatacttaccggtatcagatcagcaaagttgtcacttcgaatactgatactactcctgatgtcatctttaataagttgttagcagagatcacgctggatccaacgcatctgcagttggatgtcgataagattgataaaaatacctatattatcggtgggccgatctcctatctctttacctgccagcgttactaagctctgtaaacggctaatttagcggtgttcagaatgcatgaaaccgggaagggtttatcctgcccggtttttcttttaacgttatgtcgtcaggctttgctgaggaaaagcatcagggccagctctggaaactcttcaggatattattaaacagctgaatttcttcatcggtcaggggggcagcctttgacaaagagaaaattaatacatcctccaggtttaaggtgaaaatcgcctgtttttgataaagccggatattatccgggcgcagaaaatcataagtaatcatgatgcctttgctcagattatcgcccaacaccacgggttgattttcttgctgttgccagtctttcatttgtctctgcagaatagcgagctggctgctgatatattcttctggattgttgtgattggccagtttatcacgagaaatagtgacgggtggcatcgctgaacggggatccgccagcgtgttcagggttcgctcgcagtagccttccggtaaagtaatcataccttcgctaaaccggcaaatatttttatccatgtgtaatctccatttttttagttttttctgtctggccaaataactgctctgcggtaacttcactgagcgtaccgttatttaacaggacgattttatctgcacttcttatggtttccgggcgatgtgcaatcatgattcgggtgattttcatttgctttattgcattgttgatctgcgcttcgttatagatatccagatgactggttgcttcgtccagtaccagtatttttggttcgcggtagagggcgcgagctagcagaatacgctgcagctgcccgccagagagaaacgatcccatatcaccgacaaggctttgatagttcatcggcattttcatgatatcgccgtgaatttgcgccaggcgtgctacacgggtaatttttgcgtggtcaggattattatcaaagaagctaatattttcactgatcgagcctgagaacaggatgtcatcctgcataacacagccgatgcggttacgatggtgttcaagtcctgtctgggtaatgtccattccgcccacggtgattgttccaccttccgggtgcagcagacccagaatgattttggccatggtggtctttccctgacctgaagggccgacaatcgcaacgctttcgccagccttaatttccagactggcaccatttactacccagggtttcggtaggtgcatagcggaagcggatatccgttagttcgatatcctgcggcgtttctgtctcatcatgcgtatctttactcaccagtaccggactggcttctgagctgacttcagtttctgacaacacgatatcggccagtcgttcaccatgcatacgcagcattctgaagtcgattacggcgttgatcagacctgcaccgcggctcataaactgatctgagaagctaataaaggcggtaagcatacctgcagagaagttgccatccagtacttgcagcgcagccagccagaccagtacgaccctgcctacagaagtgagcaatccctgggcggaaccaaacaaaatattaagcttctgaatcacaatgcctttgttggtcgtatccaccaggaaattcatgtaggcggagagacgaggcacctgcttgttattggtttttaccgcctggataccgcgaagcgtttccagtaatgaagattgcgtgcgggctgaactgatgatttgctcttcgttggcgcggcgaacaggatcataagccatgaagcgtaacagtgcataggcgacaaaaaggccaattaccagccaggcaagcttagcgttatagataaacagcatcactactgtcacgatcgacattatcccatccagcacagtactaatgaagcggctggtcagcgtactttggatggtgttcagcgagccatagcgggacagaatgtcaccaacgtgacgggattcgaaccattcaagtggcagctttaacatatggtgacagacattgaccgtccactgcacgctgagctggcttgagaaccagctcatcacccatgagcgcagcgctgtaatcatggtctgaaacaacgcaatcatgataaagccgatcccgagcaaggagagtagtgagtaatctgcggagaccagcaccatatccatcacccactgcataaagaagggggagagtacgccgaaaagctccagagcgatggacaggataagcacctgggcaaaggcagatttcacccctgtcacactgcccaccagcttcatcatcgagatgctttctttttcttttttgacctcaaaagtggaggagggaaccagctccagtgcaacgccggtgaacgccggtgatgcttctttaaatgtcagttcccgaatgccgcgtgcaggatcgtgaagcgtgatcttattgccgcgcactttttttagcacaacgaaatggttcaattcccagtgcagaatgcagggcatgcgtaatttagacagctcttccatatcaacgcgtaacgcacgggaactcatattgagttgttgtgccatggcaatgacatcactaagtgttgcacccttaagcgacgttgcgaacctgcgacgcagggtgatcatgtcgatttcatgaccgtgataattggcaatcatccccagacaagcaagaccacattccgtcgcctgtgactgacgaatcatcggcaggcggttaaaccatttaaaattgagtttctctaataacaacacagaacagaccttttaatcagagagagattttgtgtccaagcgcaaaaattggctccagcacccattcataaagacgacgtttgtcgacgataaaatcagcatccagcgccatacccggcttgagtttttcattctgcgcataagcagtaattgattgtttgtccagggagaccagcacgcggtactgctgttcctgaatattgtttttgccggttaacgtagtgacttcctgaggagacagagcggtgcgtgaaacctcgataacttttccatactgttgaccaaacttttgataaggaaacgctttatagcgcagcaccacccgctgtcccggttggataaaaccaatggactgcgtgtttaccatgatgcgggcgaccagttcagtattgcttggcaaaactgctatggctgactgaccggcggtgatcatctgtccatttttgaccataatcatgccgacatacccgcttttaggcgcacgtaattcaaacgagcggcgcgcttcattttcagccatcgactgacggttatcagccagttggcgctcgatatcgttacgctttttctcgtcatccagcggtttttcatgcagctgttgctcggtctgaacaattttttgcgagatgtccaacagctgacgttgatattcctggtagcgcgcctggctatcgagcagattagactcctgctcttccatctgacggcttgaggcatacccttcgttgtgcatggcttccagcttgtccaactgcattttcgccagggaaacctgtttccgacggtgtgtcagttgcagcttcaactgctcctgttgcagtttcaggctggcgatagtgtcggtcaggcccttcatttcaacctgatgaagcttttcaagcgtcaccagatcctgttgaagcctttcacgctggcctttcagattctcggcaataacctgacgagtctgacctaactgcgttgaaacctctgatgacaacaccatcagcacatcgtctttttcaacatgctggccctcttttaccggaatatcgaccaccgtagcgcttacggggggcggaatgatcagcatgccatttttaggcagcagtttctccggtagaggattcatattttgtataactgccaaatataaaaaacagcgctgtcgcggcagtgatcagcactacaacggaaataactaaccagcgataaggtgggcaatagagtgccacaatgcccaggtttccacggttggctgcatcaagtgcctcctgacggaatagtgactgttccatttatataatcatcatgagtaagggattaacggcactgaaaaaaattcagcatgtcgattgatagtgatccggtactttgtgccagattaatgagggcgttcaggtaattgaagcgagcttcagcctgatctttaagcgcactaaaatatttttgctgggcatcaagctcatcatttaccgtacggaaacccatttcccggccatattgaacagacaccactttttcgcgtgaagactcgacggcatttttctgcgcgttgattaacgcttttccattcgtaagactaagccatgctgaacgtgtatctgtagccgctttgcgttgtgcttccatggtggaatatttcgctgcctgacggcgataggctgcttcataagattgtgaaatctggctgccacccgcgaataatggaatagaaacgttaacgccatactgcagattattacttttagagttagtgccaaaaatagcatcataaagtaaattgtcgtcgttatcgttacggctccagtttttgccatatctggcgtaaagtgacacgacaggcatatgtgcgccatctgcagccaatacatcagcatcggcctgatcattctgaaacagggcaattttgatttcagtgttacgttgctggctggcattaatcgcatcagttaaagaagcgtagggcgaagcgttaaggcactgaaagtttaccggctcgacagtgtccgggctgacacccgataagcgacgaaatgcttctccagccagcaataactgactactcgcctctatttctttggcctgagcaagagcgtaattggccttagcttcatccagctctgtacgagtgttttgtccattcagaataccggcctgcagtttttgctgctgttgtttgaagttgtgactggcagctttcgcagcctgtaaaacttcctgctgatagagcaccgaaaagtaggcattactgatcgcatttaataacttttcttcagctttttttgactgagcttcagcggtattggcaatagcaacgcctttacgccagccagcatatttactcatatcaaacaggggttgtctgacactgagatcgtaactgtgatttgttacaccactttgatattttttatccggctgttcctgacgatcccagtttccttcgagcgtcaatgtgggcaacattccggccataccctgccagtatttttgctgatcggcttcactggtcatctggctggattgcaatgcagagtcataggttaatgcggctcgggcagcctgctgtaagctggtcgcataagatccaaatggcacgcaggacagtacaataaatgcaattttaaaattataaaatttcatgatgctcgctgtttcttaaaaattaagcccgaaattaaatgagttgctgggcaaagacatatttaatcaaatcagtattagactgcagctgaagtttacgcatggcgttatatttctgcgttgcaaccgtactgatactacgtttacgtgctttagctatctccattaaactgtacccgatagcaaaaagtctgattacttcaacttctgcgggtgataaaagagtctgtgcgggctcctctgaagcagaatgcgccagatctttcatcttttctgaataaaatattttagaattcgatgagcaaacccagtgcaaagcttctaccagatcccgtatatcatcacgtttgctcactattgcatttaccggaatttgcaatattcttttcaaaatggccgggctattctgtgccgtaaagataatgattttaaggttagcattatggttgtaaatttcttctagttttctaacgccgttcaaatcattacgttcaaagttaaagcaaaaatcagtaattaatatatcaggaggatcgctattcagttttacaaaaaggttttctgcttctaccgggtatgctgcaatgtccaggttgtgaaatccggttgagagtattttttgtattgaataaaaaataaaaggactctcatcagagacaccaactttaaacctccttccttttaatggcctatccactgataaaatcctttctcagtttataaagtctggtaaagggctccgaagagcccatatggttactgataactaatggtataggtagcaactgcgttagcactaccaggagttattgtggcagcagtctggtaataacgtgcatataagggcactgttatcaatgcagacgacagtggataagctgcaactctgtatggtgctgccagtgcaacaggttgctggctttcattcagaatctgaacacccactccgctggcagttgaggtcgaattcagagaaactacgccgacatccgatagcccatcagccgcatccccatccaactgcatcataacgtcaaaggtacctgaaagaagtgcctcacagttaagctgaagattgaaagcggtagatgggctggtttgtccaataccggaaacccaacccactactggtattcgctgtgtaactccctaatgacaccttcgggttaacatcgcctgctgctgagcaggtttgatccctcacagtgatgccgcttttaatatatctgacataaagtttcaggtcatttcctggtaccaatgagcctacatcaaatacgttgacatagtccggaagcaaattggggccagccatcgagtttgacgtccgcacaatctgaaaaggcacattcaatgtgacatcagtataagcaccgactgtaccgccactggttaacgcgtaagtagcgatcttgttgccggtaggaatatttgcagcgtcggtggacatttcaccaccgtaaccggtataaatggtcaatccataaccaagtgcatcttcagctattgttttacgctttaagtaaacctctgctgttaatccatctaaaaactgttgcagattatccagggcacatttgaacgtgactgttaaattgccactataaacgaccgtgccaaccggaacagctgccgaaatgtttatccctagtgagcggaaatctaataccgcatcagaaagagattttttgcacgtcagtgtgacatcatctgccgcgttcgcattaattggtgctagcatgacgaaaccagatactatagtcatgatgctgactattctggtcagtgtccttctaaagttaataaacatcataatgtcacccgattaaccctgattatctttgttcatttcgccgttagacacgtagcgaacaggttttgattgatcgctgctgcatgttgttgtgagccttgcaagtgtgttgttttcactggaattaacaacaccagactccaggttaaccagacacttatcactggctgctttaccccaggaaatatgcaggcggctgacatctttatttaacctcacataaatctgaccaccctgtgaaacagtggtgataaggttaccgtcttcatcattaaccgttgcaccaaatggcaaggcgtttccgttcggctgattagcccgaattaacagtggctttcctttgctggttttataatcaagtctgacgactgcaccctcaacaggaataacgcgctgctgagttgattcaagctcaacatccagtggaattccttttgggtcgatggccagttcgtttatccggtacgggttaaggtttggcacaatagctttgccgctgccgtttaacacaatattgggatagccaagtacacgcgcgccctctgcatcttctgcggtaacaacagcataagtcgtagactgataagcgctgaaattaatgctatcaggtaaagcgactaccgcaccgctgataccacccgaggcagaataatagttttcccctttagtataagacgccgtcagcatactgtagggcgaacggtattgcccactaactgaaccggacttctcattatcagtatcgcgcgctattccaacgttatagttatattggtcatgttcacccagaactccattgacagctgtttgtgcattcacaccttgtttattatgtgtcgcacttccggttacataactttgactatcgctaccaattggcaccgagaagtcgagtgacagttgagtgtcatgcccgccggttgaatataataatcggtttgctgataaagtataggagacccgaccaattgtattattgtaacccagctgaaattgcgtatttgttccggcagaatcccagtaattctgaacgaaaccagtaagatagatattcccatatgactccccaaaattttggcttgccgtcatagaaaaacgttgtttggggcgcgaaagataatttgacgaactgtttttatgattttttttataatagttattgatttgtaatgcattatcaaaactgtaataaccggatgatgagaagcggtaagccgccagagtaaaattcgtgttagtctgagaaaccttcttactataagttgcccgataacttacaccttgctttttctcatcaccatattttgtctgagccccagtaatatccagtgagatcgcaccaacaggtaaaccaaatgcacctcccaacagcacagaggtgtagttatctgatcccagaatacctgagtaaccggtcagactattgctaaaaccatgctgaatagtgccctgatagaccgaaggtgtataaaccatattgtcttttcgggatacaccaccggtcagactataaaaagtcatgcccggacgtttcagacgcgtcatcgctgcgtaaggaaactgagaaacgggtctcaccgccgtcagcttctttcacggtcacgtctaaatcaccaccgtagcctgtaggataaagatcggtgatattaaaagggcctggtgaaaccgtcgtttcataaattttgttgccattttgcgatacagttacctgagcgttggttcgggctacgccgcggatttctggtgcatagcctcgctgagagtctggccacatctggtcaactgtagatatttgcgcaccacgaaaagaaagcgtatcgaaaatttcgccactggtattgccttcacctaataacagccgtgattttatttgcggaatatcacgctggacataggtattaattgcatcgtaatgatgatactcgttgtttttttgacgttgccagctgagagaaccatcgtgacggaacatccatccgccaaggttaaagcccgccagcgcacggccataaaatgagtcatatggctgaccgtgatttacagagcgataatagttggtgttataggttagcgtgagtgctgtttcacccttatcccagaattctggcgcaacgtagccgcgcgcagatcgcaacagataaatttgcggaattgagatatccatctgcatatcggcagaattgatagcggcatgactctctttaaccacctcctccagcgccatacactgtttaccagagcgcaaatcttcagcttgtcccgggctaaaaattgtgtccttaagggacaagcttttgaccagatcataggaaaggcacgctttggttcccgccccttcacgaatgacctgaatattttcccgaccaatctgacgaccattcaggaaaatatccagcgtataagtaccaggatcaatagggttaccggttgcatagcgtgccacatcaactttaacgcccggtagattcttcacaaatgattcgtcaaaatcatacgaattttctgcaaatgcggcgcctgttgatgcagttaaaaaaagcgccagaaaagatcggtaaaatattttgcccgttggtttattatttttaatcatccttgccatcattattacccctgatgagttaccaaagttactgactaattttggcgtctacattgcgtgcagcgccataatcatccagatattgataatgaaagtttgtttttatttgatttgcgttcaatccttttagggagaagctttttgtttcgcctggtgcaagcatatctcccttttcactgactacttttcgccccgcgttatcctcggcattgatctgtgaaacgttgacgtaaaacgaagagttattggttgctgtcagctgattcgctttctccccttgatgccagataagacccgacgctgcttctgtggcttgcatcgcatcgaaccgggctgggcgaaagaaaattttgatgcggctacgaatagccatttgcaactgattttgattcgcaaggcttttatcgcgaggagggatgtcgagtacgttaagccagaataccgactctttatctttgggcaggtttgaaccggtataaacgatacgtaatgtctgtcctttgttagcctccatacggaaaacaggcggtagcaagacaaacggtacgtttattttatccagtgcttcatcaggatttccattgtcaatccaggcctgtaccagcgcaggttgattgccatggttatctaagcggactgtgacttctttttctgttgcggggtagattacccgggtgccgataatcgtcacgctggcaaaagccgatgaggtcaccgtaaaagccagcagacaggagatcaaaaatttaaaactttttttttcatgattttgacagaaatgatgatagaggaagagaggtgggaacagatgctcccaccataatcaattacaggtaattgattgaatagttcacagctgataagacggtaccagcagtagctgcaccagttgcatagtactgagcagaataggtcagagtacctgcaccagcagtcagagcgacagtttttggagaggtggtctgctcagtgctacccgcgttcaacacgccatttccgctatccagcagctgcaggtcaacattcgttgcagtaccagtattggtcaaacgaccatcagcattgacgttggcaccttgttcaaagtaagcgtacacgtcaccagtcgtagctgagcaattgctcagcgccatagtgaagcgagtgttacctgcagtctgaccagatgtgcttaaaatactacttgctactttaggcagtgtaacggttgcagtgctgccgccgccgtttacgcttacagtacaagtctgagacgcaatatttcctgtgaagttaatggtgccatctgaagcttcagcagcattaacgtgagcagcagccagcatcagaccaagagcaaccatagataactttttcatatactttcctttgtataaaataattaataacatcaattaatgaacgatttaataatcgttcacttccctggaggattcattcctcacaagagaattagaaaatcagcaatccaaatacgactgctgctgcgacaccaacaatacccatgccaaaggcagacccactaaccgggtttcgctgctggaattgagtctgggcgcgtccattcagttttctcttctgagcttgcgcctagctgcttaaagaaatccaggatcaccgaagttaatgaaccaccgctaacgccttcgatttctttattgttcaattcacgcatgttgtttccttaagctgtaattacagatgcattaggatcaaactggttttcaacgaccgcgttaaaccagcctgccgtgctatcccagccattcatagcaccatataaagcaccatcaacaagaccaaggactgcgccgacaatcagacctacaccggcagagacaataccaacgcctaacacgccaccggtgcttccgccactcattccccatttaagaccaaaagaactaatacccgtaacggcaccgacaactacagcgccaataaagtcaaaaaaacctgctcctgaaacgttttgcatttcaaaagatgttaactctctcatcgatatctccatgtatcattttttcaatattattatttatgccgcttctagcgaacggcactattagaatgggtggtcataaaaaatgaaatagtaaaacatccataattcttcttttgttatcgtaagcaaggatatggctattatatttttacataatattaactgctgttggtattctggaattttttgagcgtacattattcttatgcgtgatttaaccattaacagcactgcttatgcctgatgcttaaaattatctggcatccgggaagcgcatgccatgaacgcggttcagtgaaactgatttatctatgaataagcttgtgcataaagtcatgagttaatgatttcacttgcctgaatgtgatgtcatttgagaagtggaattaaaaagggaaaaatcccatttgccagtttctggtgatttgagctaattaaatcatatatgtcaggataaaaaactaaatatttaaagataatcaatttaagtgtctgttcgatgggtgccgtggtttaattccttccatgcaatgctgcctgacagcgtaactttagtaaggagcattaacattgatgccaatttgatttgtttcttttcagccatgctggaaaattgagagaggtgtttaaatacgggcttttaaaatagcatgctcataacatcatctttcaaatggtaatgggaaattctttttttaggaaaaaagttataacactgcccgtaaggtgccacaaagtagatttatgtgctaactaaacagcatttaaatggtgtaagatctggttattgtttcttttattagcctgaatgtctttatttgtttgtatttgcggttttgaattttgttgggacggttttattatagtggaaccgataaagactatttttaactgcccgagttatggaggcgagctcaggtaagcgagtacaccaggcgaaagagaaagagactataaaaaactgattttacgaattgttgctaatcactgaccaatacgtcagttagattgagttaattaatatgtatagagtgactgaaaatcatgaacggatcatcgatgcattagcaggatttacgcagattgctaatccagatgaaatttcaagaggcaagcgccgttatcatttgactaaagataatgtacgtcgcgttatgttcattcttgacggcgattttttacttaaacttaaaggcgagaataaggttttgaatatcttatccgctccgtttgttgtcggcgtcactccagctttagacgagccgccagtctatctggaaacgagtcgattatggaaaagtcagtttcattgactatgacgtgttctggcgattggtttttgagaaagatctttttaatgacgcaatgtctattttatcaggacagtattctgatctgatgaattacattcagttaccaaaaagtaactcatatgatgaagttatttctttgattgaaagatggaaaaaactgccgactcatttaaagaaacgattttcagcactatatcttattgaaaatagttctcatttatcaaaaagttccatttgcagagtgctcaaggaactaaaagagaaaggcgaattggtactgattaacggtaagttcacctgaatataatatttgtcatcgtgaattttgtgatgctgaagggaaaaaatggatgttaatgtggtttgtacggatgacaattacttcttcagactgggcatatcaaaggtaattgaggaggcactgctgtctgatgcagaagtaaaatttttatcaggttttgatagtcataacctgcggcaggctgacttcatcctgatcaatgtttcgcaatggcgtctttatatgtgtcaacccgcttatcgcgagcgaaagcctggccgtatcatattggtatttaccgatgatttcggagagaaaattaaaaacccgttaccattttgttatcaatctttgcttgaagtgtcaaaaagggattcggtacgtttaataactgagaaaataaccaaggcctggttaaacactcagggaagagttatgggatatctgccttcagactgtttacggtgcgaatttgcacgtatcaccgtggtgcaacttcaggtgcttagttttttgaagaaaggatacagtgtaatccagacagcaaaaaggttagatttgtcagttaaaacaatctatgcacataaatataatgtgatgagaaagttcgctctgaaaggagataaagaatttaatgcatttatcaatgatgtctcgttgcttgaactttacaaaggagttatcaatgtaaatgagatttaacgttatccagaggcgtaggctcacccttctgcgctgtttaaatttcccattttttattttttaaggagttgtcaactcctgttcaatatcggatataaggtgttttaaatatagtgattaagcaccttaaggagagttatatggaaaataattcacgtttaacatgcaaagcatcggatagtccctttaaatttatgcagggagcaatgctgagtatggttttattacttacaggctacctgtactgcaattatgttcaggcggcgccattgcagaaacgctcctgcgccatcgttgtttaaagaggtcaacactgacaaggcgccggagcagatacgcgacccgcgtgcgcacattattgtctaccgtattgatgaaaaaaatcctgccgcatcaaaacgcgtcgttaacgtatttgttaataatcaatactatactagcgtaatgtcaggtgatagagggactgaaattagtgtgtgtcctggccagaaaaaactggaagttatgttcagccagcatgattttgtccagccagcaaaaattgaagtacccacaccagagctgaaatcaggtgagcgctattactatcagttagcggtaaatgatcagcagaaaatcacggcgcgtctggtgcctgcaaaggaagctgaatctgttttaaccagtctcaaagcacaatcacgtacgttatcgcgtgtagtgaatgaacgttcttgttctgaagcgggcgagtcaaaactattgaatcacccggtggcttcttcactattaaattctgacagtagtcatgctcagagcaatgctatgaagatagctgataaaagcagtaaagctcagggcgctgcatactcactgcattgatgcaatctggcaccatattttttattaatcagttctgataatgccgttcactgactccagaatcaagagttgtgctggaagcaatgtcaggattgcagattatctcgtcataaaatcacggttattcgaaatatatgaatatagagattaagggtttgtgaaagccttatttctattgaatttaatcaatcctcgttaattaagaaggttgttatgttgaaagtgaacttgcgtggtgtgaagggtgttatctcttcatacactgttgatacaaaatctgaaaatcctacaacgatcaaagttccgcatcagggtgcattaaatatagaactgatcgatagcgctacaggacatgctccgcaaatggttgtaaccaggcgcgttggcaataatctgcagcttttctttagccaggatgattctcagcatcctgatattgtgctggatgattattatgataatgaaaacgttcatctgattgggctgggcgaaaacggtcaattttatgaatatgtgccgacttccggcgatgtggctgaatacccgccagctttaactgaaggtcagagcggtgaacaggtattaggtggtgaaggatatgccagtgccgatccgctgactgccagtgacaacaattttggttggttgccctttatgctgctgggcggcgcggcaggcggcgttgctattggtgcgtccgggcgtggtagcagtggccatgactcttccgctaagagtgtatcggtgacacttgatcctgttgcggacagtgataatgatggtcgtccagagttttccggaacatcgaatagccctaactcacaggttgtcattcaactgcctgatggcacccagatcacaacccagacggacagtgaaggtaactggtatgtggaagcaccgacttcacaaccaaatggcaccgtcactgttacggtaactgatagtgcgggcaatagcggtagcctgactgaagagtttactgacacctcttcgccagaagcggcggttataaatagcaatgatgatgaacaaatctcaggtaaagcagaaacctggttcaacagtggttatttccgatggcagtaccggtgaaaccaccacggttgtagttgatgaaaatggtgactggagtatccagcctaaccctgtcaatgaaggggataccgacgtaactatcgtggtcgtcgatcctgcgggtaatgtctctccgccgtccaacggttcccgaccggacataactcctccagataacatcaactccggcattgtcagtgactcagtcaccctgaccgacgacgtcggtgcgattaccggcgagattgccagcggctcggtcactgacgacgcgcagccgaccctttccggcgacgcaaccgccgacatcgatcacgtcaacatctatgacaacggcgagctcgtcggcagcgcagcggtggacgcggacggcaagtggagctggacgccggagcaggatatggcggacggcacctctcacgacctgacggttgcggcggtggacgcggcgggcaacgaaggcccgcaggcagacggcgactggagctttaccgttgacaccagcacggcggctccggaaatcacgaacaacaccgaggacgagctggccggtaacgcagagccgggcgcggtgatcgtgatcaccgatccggtcagcgacagcgtgaccagcacggtggcggacgcggatggtcactggagcatccagccgaatccggcaggcgtggacgccaaagacgtcgtggtggaagccaccgacgaggcgggcaacagcaacagcgttgtgatcgacggccccggcgacagcacgccgccggataaccagacctcaggcctggtcatcgacagcatcaccctgacggacgacgtcggtgcgatcaccggcgaaattgccagcggctcggtcaccgatgacgcgcggccgactctttccggcgacgcaaccgccgacatcgatcacgtcaatatctatgacaacggcgagttcgtcggcagcgcagcggtggaggcggacggcaagtggagctggacgccggagcaggatatggcggacggcacctctcacgacctgacggtttcggcggtggacgcggcgggcaatgagggcccgcaggcagacggcgactggagctttaccgttgacacctcggtgccggataaccagacatcgggtttagtggcggacagcatcacactgacagatgacgtcggtccggtacagggcaagattgaagatggctctgtcactgacgatgcacgtccgacctactcaggcacgactaccgcagacatcagttacgtcaatatctacgacagtggcaagctgatcggcagcgcagcggtggaggcggacggcaagtggagctggacgccggacagcacgatgagcagcggggcgcacgccctgacggtcgcggcggtagacgcggcgggcaatgaaggcccgcaggtaagcggcacggcggatgcggcgtgggacttcagcgtcctgaccagcgccccggcgcagccggcgattgaaaacgtggtggacgactacagccagggcgaagacgcggacagcggcttcctgcagaagggccagttcaccaacgacggcacgctgacgctgaacggcaccgcgggcgcggggctgacggtcatcgtgtgggccacggatgcggacggcaaccgggtaaacgcggggtcgggcgtggcggatgacaacggccgctggagcattaccacggcggcgctgggcgaggacggccgctatgacctgacggcgacggcggtgaacgcggcgggggtttcctcggcggagaccggcgcgtttaacgtggtgctggacaccgtggcaccggaggcggccgtggcggcgctgatggacgcccagggtgaggtgcagggcgaagtcgccagcggcggggtaaccgacgaccgcgcgccggtgctgaagggcacggcggaagcgggcgcgacggtgacggtatatctggacgacagcagcacgccggcaggcagcacggtggcggacgcggacggcaactggacactggcgctgggcacgctgacggacggggagcacagctggcaggtgaaggtgacggacgcggcggggaacgaaacccgcggcgagcgcgcgaccttcaggctggacagcagcagcgtggagctgagcattgaccaggcgaacgacgatgcgggaagcatcaccggcgcggtactgaacggcggcctgaccgacgacaacacgccggagctgaagggcacggcggcagcgggcgcggtggtgaccatcagcgacaaatcgggcgcggtgctgggcagcagcacggcaaacagcagcggcgtatggacgttcgcggtggcggagctggctgatggtgagcacgtctttacggcatcggtaaccaatgcggcgggcaacagcagcgaggcgaaatttaccctgaccgttgacaccatcgcacctgtcctgccgaccatcaccgggatgattgacgatgtaggcactgtacagggcacgtctacgaccagtggtggcgtaacggacgatccgtcgccgacctttaccggcaaggcggaaaaaggttcgctggttacgctgtatgacggcgacagcgtgctgggcagcgtttcgggcggatgcgcagggcaactggagctatacgccgaccaccaatatggtagacggcgatcatagtatcaaagccgttagcacggacgcggcaggaaacatctccgcgcctggcgcagaatggccgtttaagctggataccagcacggcggctccggaagtcacgaacaacaccgaagacgagctggccggtaacgccgagccgggcgcggtgatcgtaatcaccgatccggtcagcgacagcgtgaccagcacggtggcagatgctgacggtcactggagcatccagccgaatccggcgggcgtggacgccaaagacgtcgtggtggaagccaccgacgaggcgggcaacagcaacagcgttgtgatcgacggcccgacagacagcacgccgccggataaccagacctcgggcctggtcatcgacagcatcaccctgaccgacgacgtcggtgcgattaccggcgagatcctggatggcagcgtcaccgacgacgcacggccgaccttctccggcgacgcaaccgccgacatcgatcacgtcaatatctatgacaacggccagcttatcggcagcgcagcggtgggcgcggacggcaagtggagctggacgccggagcaggatatggcggacggatcctcacacgacctgacggttgcggcggtggacgcggcgggtaacgaaggcccgcaggtgagcggcactgatgacgatggctggagctttaccgtcgacaccactgcgccggatatcgacgcctttacagacagcagcatcacgctgaccgatgacgtcggtccggtacggggcgagatcgccgacggtgcaacgactgatgatgcacgcccgacctacagcggtagcgtgagcacggcaggaatagcgcagggtgtggtcagcgtcaatatctatgacagtggcaagctgatcggcagcgcagcggtggacgcggacggcaagtggagctggacgccggacagcgcgatgagcagcggggcgcacgccctgacggttgcggcggtggacgcggcgggcaatgaaggcccgcaggtaagcggtacggcggatgcggcatgggacttcagcgtcctgaccagcgccccggcgcagccggcgattggaaacgtggtggacgactacagccagggtgaagacgcggacagcggcttcctgcagaagggccagttcaccaacgacggcacgctgacgctgaacggcaccgcgggcgcggggctgacggtcatcgtgtgggccacggatgcggacggcaaccgggtaaacgcggggtcgggcgtggcggatgacaacggccgctggagcattaccacggcggcgctgggcgaggacggccgctatgacctgacggcgacggcggttaacgcggcgggggtttcctcggcggagaccggcgcgtttaacgtggtgctggacaccgtggcaccggaggcggccgtggcggcgctgatggacgcccagggtgaggtgcagggcgaagtcgccagcggcggggtaaccgacgaccgcgcgccggtgctgaatggcacggcggaagcgggcgcgacggtgacggtatatctggacgacagcagcacgccggcaggcagcacggtggcggacgcggacggcaactggacactggcgctgggcacgctgacggaccgcgattacagctggcaggtgaaggtgacggacgcggcggggaacgaaacccgcggcgagcgcgcaaccttcaggctggacagcagcagcgtggagctgagcattgaccaggcgaacgacgatgcgggaagcatcaccggcgcggtactgaacggcggcctgaccgacgacaacacgccggagctgaagggcacggcggcagcgggcgcggtggtgaccatcagcgacaaatcgggcgcggtggtgggcagcagcacggcaaacagcagcggcgtgtggacgttcgcggtggcggagctggcagacggtgagcacgtctttacggcatcggtaactaacgcagcgggcaacagcagcgaggcgaaatttaccctgaatgtggataccacaccgccagaaccagtgatcatccagtcattacaggatgacgtcggtacattgcagttcacctcaccagtggcaggtaatgccattgacgatccggcgccgacctttaccggcaaggcggaaaaaggctcgctggttacgctttatgacaatggcatcctgcttgcgacagtgacggcagatgcacagggtgagtggagctatacgccgactactaacctgctggaagggacacacggtattacggcgacggcaacggatgctgcaggtaacgtcagtgaaatcagcagtagctgggattttattatcgatatcacagcgcctaacgttgggatttcaggaaactcagaggagtcactgagcggtgttactgagcctggcgttgtggttgtcattgtcgataagaacggcacggaatatagcgtagtagccgatcagcagggtaagtgggtgatagcacctaacccaatctcagctggcgagtcaggagagatctacgctatcgatccagcagggaacaagggcgatacagtggccttccagggatctgcactggctacgtatagcttgctgaatgaaagtatgcaggtgaacactactaccactggagaccagcttaacccgtcgacgacccggctggcggacggccgcatcgtggtgacgtggcagggcgcaggtgtctccggcaccgaggtttacatgcagctctttgaggccgacggtatacgtaaaatcggcaccgagcagcaggtgaaccagcgtacggccaacaatcaggacagcccgcaggtgatcgcgctgaccgacggcggctttctgatcgtctacgagtccaacgttaacggactggacaacagcggcgacggcgtgatggcgcgccgctacggcgccgacggccaggcggtgaccgacgagttcctggtgaacaccacctacagcggtgcgcagaaccgtccgggtgcgatggcaaccgccgacggcggctacatcatcagctgggaagaccagggcacaggcatcgtgcagcgcagctacggggcggataaccagccggtgacggacgaagtgacggtggcaaccggcaagggcatgggcagctccggcgggccggaaatggcggcctttaccgatgcggcgcacggcggcatgtacgtgaccgtgtggaacgccaccagcggtccgggtgacaccagcggcagcggggttgtcgggcagatttttgccgcagatggcacgccactggggggtaacttccaggtgaacaccaccacggacagctcccagaactatccggacgttatcaccctgaacgacggcagcatcgtggtgttctgggacagcagcgacagcggcaccagcggctctgacatccgcgcagtgcactaccgcgtggatgccgccaccggaacgctgacgctggtcggcagcggtgacttcatcgtcaacagctacaccagcggcaagcagtataagccggtcggcgtggcgctggatgatggcggctacctgcttatctggggctccgaaggcggcgacggggatggctcggccatctacgcacagcgctttgatgcgaacgataacagggtgggacgcgagttcctggtgaacaccaccacgagcggcaaccagggtaccggtggcgactcggtggatgcaacgcacatctttgacgccgtgctgaccgcggacggcagcgtatacgtgacgtggcagtcggacaacgtggacggctcgggaaccggcattgaaggtatcgtgattgacgtggatgcggcgttctactccgagtacacggtgaacaccaccaccacgggagcgcagacggtctcgtcggtagccagcctgccggacggcggcgccatcgtggtgtggcagtcggcgagcggagacggctccggcagctgcgtcaagggtcagctgctggatgcgaaaggtcagccggtcggggcggagttcacggtgaacaccaccacagcgggcgaccagatcacgccgcaggttaccgtgctgtcagatggcactttccaggtggtgtggagcacggattccggtgcgcatatcaagggtcagggttatacctacagctatgacggtgcgggtaacgtaaatggtctggtggctgatggcacagagttcagcgttaacaccggtaccacggcaagtaaactgactgaacccgccattacctcgctggaagatggcggctatctggttgtatggcaggcaagcctgaacggtaactgggcgatttacagccgccagtatgatgcaaacggcacgccggtcacgccggagactgtactgattacgacttcgctgagcgtaaacggcgtgctgggctttggcgctgactgggagccgctgccgtctgttacgttactgaaaaatggccaggtcgctatcgcctataccgttaaaggtaccgggtatgacgcaggcgtgtcgatctacgatccttcactgcatgaggtaatcggcagcttcgtagcgaaccagaccctgactaataatcaggcatcacctgcagtaagcgcgctggataacggcaactacgtggtgacctgggactctaacgataccagcggaccggatcagaacggttacagcgtctggggccgcatctatgcggcagacggtacggcgctgaccagtgagttcctgatcaacacggcaacagcaggcgatcaacatctggcgaaagtcgtgagccgtcctgatggcagtttcgttgcgctctttatgtctgcaacagatacggcaccgggtgcaggtaccagcggcatctacgcgcagtactttgatgcagcaggtaacaaagtgggccagcagatgcagatccatcagctgacctatggcgagcaggttgaagtcgatgcgaccttccttgcgggcggtcagctctacgtgacctggactgacaaaggtgtgggtgacggcgaaggctcggcgattaaaggacgcgttgtggatctggttgaaacgctgggactggagcaaatgacgccggacaacaacgatccgacgaccattgactatcagcctgcgacgacaccagcgtcgagcgacaccgatgtactgccgccgaaacgtgggcctctctaccaatactaaggagactctgggtggccagaccgaagcaggcgctactgttatcgtaacgaatgcggctggaacggtttactccacggtggcagatgctgagggtgtatggagtattgtacctaacccactcagtgtcggtgaaaacggaacgctctcggctattgacgcggcaggtaaccagagccagccagtattgatctccggagccgcactgagtgcttacgatctgctgaatgaaagcgcgcaggtgaataccactaccacaggcgatcagctcaacccgtcggtcacccggctggcggacggccgcatcgtggtgacgtggcagggtgacggcacctccggcaccgaggtttacatgcagctgtacgaggcagacggtgtgcataaaatcggcaccgagcagcaggtgaaccagcgcacggccaacaatcaggacagcccgcaggtgatcgcgctgaccgacggcggctttctgattgtctacgagtccaacgttaacggactggacaacagcggcgacggtgtgatggcgcgccgctacggcgccgacggccaggcggtgaccgacgagttccaggtgaacaccacctacagcggtgcgcagaaccgtccgggtgcgatggcaaccgccgacggcggctacatcatcagctgggaagaccagggcacaggcatcgtgcagcgcagctacggggcggataaccagccggtgacgggcgaagtgacggtggcaaccggcaagggcatgggcagctccggcgggccggaaatggcggcctttaccgatgcggcgcacggcggcatgtacgtgaccgtgtggaacgccaccagcggtccgggtgacaccagcggcagcggggttgtcgggcagatttttgccgcagatggcacgccactggggggtaacttccaggtgaacaccaccacggacagctcccagaactatccggacgttatcaccctgaacgacggcagcatcgtggtgttctgggacagcagcgacagcggcaccagcggctctgacatccgcgcagtgcactaccgcgtggatgccgccaccggaacgctgacgctggtcggcagcggtgacttcatcgtcaacagctacaccagcggcaagcagtataagccggtcggcgtggcgctggatgatggcggctacctgcttatctggggctccgaaggcggcgacggggatggctcggccatctacgcacagcgctttgatgcgaacgataacagggtgggacgcgagttcctggtgaacaccaccacgagcggcaaccagggtaccggtggcgactcggtggatgcaacgcacatctttgacgccgtgctgaccgcggacggcagcgtatacgtgacgtggcagtcggacaacgtggacggctcgggaaccggcattgaaggtatcgtgattgacgtggatgcggcgttctactccgagtacacggtgaacaccaccaccacgggagcgcagacggtctcgtcggtagccagcctgccggacggcggcgccatcgtggtgtggcagtcggcgagcggagacggctccggcagctgcgtcaagggtcagctgctggatgcgaaaggtcagccggtcggggcggagttcacggtgaacaccaccacagcgggcgaccagatcacgccgcaggttaccgtgctgtcagatggcactttccaggtggtgtggagcacggattccggtgcgcatatcaagggtcagggttatacctatagctacgacggtgcgggtaacgtgaaacggcgtcgtgactaatggcgcagagtacaatgtggactccagcaccgccgccagcaaaatgcgcgttccggtgatcacttcgctggaagacggcggttatctggtggtttgggaagcgagcctgaacggcaactggacggtttatggccgtcagtatgacgcaaacggcacgccggtcacggcggagaccgtgctggcaaccacgaccctgaacgcaaatgccatcattcctgaatgggagccgttgccatctgttacaacgctggaaaatggccaggttgcgattacttatgcgattaaagccaccggatatgatgttggtgtgtcagtttatgatccgtcaacgcatgctgtaacaggcagcttcgtagcgaaccagaccctgactaacaatcaggcgtcatccgcagtcagtgcgctgcaaaacggtaactacgtggtgacctgggactctaacgataccagcggaccggatcagaatggttacagcgtctggggccgcatctacgcggcagacggtacggcgctgaccagcgaattcctgatcaacaccacgacggctggcgatcagcacatggcgagggtggtcagtcaggctgacggcagctttattgccgttttcctgtcaacaaccgacatcgcgccgggtgcaggtaccagcggtatctacgcacagtactttgatgctgcgggtaataaagtgggtcagcagatccagatcaaccagctgacctatggtgagcaggttgaagtcgatgcgaccttcctggcgggcggtcagctctacgtgacctggaccgatcagggcgtgggcgacggcgatggctcagcaataaaaggccgcttagttgatctgaacgagacactgggactgacgtctgaaacgggatcgacgcatattgagtatcaacctgctcagtacgatcttaatggcacttcaggtaatgatgtactggatgcacgcggcgcgaattccgtcgatgcaaaagagggcgatgatactatcgtcattaacagtactcattttagcagtgtgaaaggaggagaaggtcacgatacgctggtctgggattctaataacgatttagaactcggaacggtatcaggaaaaattagtggaattgaagctatccatctgggtaataacacggcgcagacattatttatcagcgtcagcgatgtgctcgaaattactaaagataatggtagtgaagcgaacacattacatattacgggagatgtgggaagttcaaacaatagtaatgcaactgataccgttaatattggaaaatcagaatggacggcttcagccgcacaaactgaaaatggcgttaattatgacgtctataccaataatgatgacaccactgtcaagctgttaatccagcatggcttaaacgttatctgatagaaactggcgatgacttcggtcatcgccagctttttttcacatcaaactcacctgatgggcctgtttaaggcaggcccatcaggtgagccccagatctgattgcacagatgaaaaaaataaataaagacatgtgagcagcatgtaaaatctaaatatttctttttagcagaattaacgttgccatatgacatgtcgggcggttaaaacagttccggtcgcaggattgaattagcgacagagaaaattagccatcccactttatttgttattttgagttaactatggaaaaaaacttgtttactacaaaatccagatgttcgctgcatggtttaattgcgggattgctattttttaatcccctgttaaatgcccatgcaacggactttattgaaatgattcgtatgacagccgaccatccatcggtaaagtctgctttatcaaacagcaccggtgctatgtatgatatcgatcaggcaaaagccgctgatggttttcaggtcagcacgggtatcagcgcatcaggatattcaggtcaacccggttatgagaataatccggtctccccgcatatcactgtaagtaaattactttacgatcacggacgtactgatgcgagcgttgccggaaagcaggctgcttattccatgcagcaggctcaggtaaatgtcacgcgcgaaaatctcaacgagcaggtgctttctctttttacctctgcagccactaatgccacagtggtcgctgtgctggataaagaaattaaagcactgcaggatctgcttaatcgggtaaagaatattgccagtattgatagcggcagagcttctgagatcaatcaggttgcgactcgcctcaattcggtgattgccagtcgtgaaatgagctacaccacctatatacaggcgcagcagcaactcagctcgctgctgaaccacgagattgttatcaccagaggcctgcccgatctgaaaaaagcgggtctgttgcccgcgtcactggcacaggcacaacaggtactgaaagaaaatcccaactgggcggtctcacgcgagcgtaaagaggaagcgagagccgcagtggatctggcctctaagtggaacaggccgaaatggagtgtgcaactgagtatggacagtccaaagcgcaatggtgaaatggaaccgtttaaagcggtgacgttacaggtgagcagcgatatcaatctttgggatggtggggctggcagggcaaatgccaaagctgaaactcagcgactcattgctgcagaggcggatcaggatgcaacactccggacattgaaacagcagctggatcagctgtgggtctccttaccgcttcgtgaaacgccagctcaatgcattacagagacagttagaaaccgcgttgaaaacctggaaagcgggggaagtgcagttcttcgcggggcagcgcccgttaacggatttaatctcgtttgctaccgactattactccagtctcgcaagttatcaggagcagcagatgcagtatctggctgcgcaatggaacatcgttgcggcactgggtaaaaccagccaactggtgcagaaggttaacgctttaccagcgaataccatcgaagcggtgcactaatcacgctgacgtaaaaaacgagtatttctggccgctgtcatgctttgccgccagaccagaatgaattagttgtccaggggacgccattgtgactgatatacaatttgagcctgctggctctgaactgaatgctgaaaacagagtgttatccagatcgccatcagatacgcaggagactttgctggttgcactgcaaagcgcactgcgcctgtttgacgtccggcttacgctaaatgctttacgtgtgggtatgcctgcatttccaccagacgctgatatcagcgcccagaatgactgggcattgcgcacgctgcagagccgcggcatgagtgctgcctggcagaagattgacctgacggatgtgaaaagctttgttctccccgccatcatgcgtctggaaacgggctattgcgtgctgacacagtgtagcgaaaagaagtgcgccattatcgatcccgcactgggcagccagcctgttgaggtcgatttcgctcgcctggctcagcactatagcggcgagttgctgctgctgcgacctaagtcttatcttgatcatcgtgccgatgacattgtccatgtcggtaaagggcactggttctggaatactttgtggggattcaaacgttatatctttgaagccgccgcattgtcagtcgttattaacctgctcgttctggcgatgtccgtattcaccatgacggtttataaccgggtactgcccaaccagacctacgtaacactctggacgatggctatcggcgtgagtctggcgttgttgtttgaactggctgcacggctgggtcgggcctggattaccgatcgcgccggtaaaaagatcgatctggtgttgggcgcacaactttttcgtcacgtgctgaacggcaaaatgtcgggtcgagcccaatccagcggtgcatttggcaatgtcatgcaaagctttgacagcgtccgcgagcttactacgtcagccgctttaacgacggttgctgacttaccctttgttttactcttcctggttgtaatccatctggttgccgggccactggtctggtgtgtgatcctgatattagtggtcatcgtggcgatggtgctgctgatgcagatccctttgaaacgccacgctgaagagtcaatgaaaataggcagtaaccgttacggtctggttattgaatcactggataatcttgaaaccatcaaagttctgcgtgctgaaaacctggtcgcctctaaacacgatgttgccagcgtaaaactctctgcagtgaatatgaaatcgcggttccttgccactatgggctcaagcgtcattcagacgacccagcagtttggtaccgttattctgctggtctggggtgcttatctggtcggtgatggtgatatctcaatgggaggcatcattgccactatgaccctgatggggcgcgccataatgcccatagcaacgcttgccgcgctgggattgcgtattcagcaggcaaaaacctcgctggccatcctcaataaagtgatgcaggcccctgctgaacgcgataatgagaaggtttatgtgcagcttccccagggcagccagaccgggattgtctgtcagggcgtttcattacgttataaagacgatttaccggccatcgttgagcagctagatgtccggttttctgtcagggcgagcgggttgccatactgggcaaaatgggcagcggtaaatcttcgctgctgcgcatgctggttgggctatatccacccacaacaggcacgatcaccattgctggcgtagatataggccaggtcgagccggtggaattacggactcgtatcgcgctggtcaatcaggaaccacgttttatgtatggttcgctgcgtgacaacctggtgatgggagcaccctatgccagcgacgaagaactgatggccgctgccaaaatgaccggggtgagtgatattgtcgcggcccatcccatgggctttggtatgcctgtcagtgagcgtggtgaaaacttttccggtggacaaaagcaggcgatagccctggctcgcgccattctgtcgaatccggatgttctgctactggacgaacctacatcggggatggatatggggtcggaacgcactatcctgcaggcgctcatcccggcaatggaaggccgaaccgtgattatcgtgacccaccgtccggcagtgctgaaatacgttgatcgggtgattgtgatggatgaaggcatcaaagtagctgatgggccgcgtgaagagattatcggtttattaaacagcgggaagatcccggccgcatcggtgctgcgtaacgcagcgaaacatgctggcgttgagataagcacagagcgtcagccacaatctggcgaggtaacagtatgagcagcctgtcccctgataaaaacgttgatcaaaagcgcctgaccgaacatacagccagtgacatggtgagggccgcccgtcaggatcgctgggaaggctggctatttattgcctggggcagcgtggcgttaatggtgctggtaatcgtctgggccgccaatttcaacatcgaagaggtgacaaccgggtcagccaaaattgttcccagttcccgcgaacaggttttgcaaagccttgagggcggtattttgcaggagttaatggtgcatgaaggcgatacggttgaaaaaggtcaggttgtggccaaaatcgatcccacgcgcgccgaagcctccttccgcgaaagcgctaaccgcctgctggcactgaaagcccaggccgcgcgtcttgaagcagaagcgaccggcagcgagcttgtgttcccgccagaggtcatgaaagtacctgaactggttacccgtgaaaccgatgcctggaaactacgcaaaagggcggtaaatgagtcaattgaaggctatctgaagtcaaaaacattgctgcagaaagagcttgaaatggcgcgacagctctcagccagatcgctgctgtcaaaaactgaggttctgaaacttgagcgtcagatgaatgatgccgaattgcaaattaccgagcgaaaaaaccgctaccgtaacgaggctaacgatgaactgtccaaagtcgatgttgagatgacaagcctgcaggaaactgcccatggccgccatgatacgcttgagcgtactgaagttcgcacgccagtacgaggcattgttaacagtattaaaatcaatacgcttggcggtgtgatccagcctggtgccgcaataatggaggtgacaccattggatgaccaactgctggtggaaacccgtatccggccctctgatgtggcttttctggcgcccggtcaggaagctgtggtaaaaatttctgcctatgactattcgatttatggcggcctgaccggacatgttcaaagtatcagttcgggcgcgctaaaagatgaggaaagtaaggctgcccgcaggccaggcgtcgatgatacttattaccgggtgatggtattaacggaaaataatacgctgacgaaaagcggcagtcaggaactacgggtgattcccggtatgacggccaccgttgatattcgtacgggcgagaagagcctgctgcaatatctcttgcgtcctctgttgcgcgtacaggaagcgtttcgcgaaaagtaaaacctgccctgaatgtaaaaaagccagcgctatagctggcttttttacacagaagtccggaattatttcagaatgaagagccgatcaacatcgatttcgctatggccgtcatcgcgatctacctcacccgttatccgtacctttttaccaataaggaagccgttgtcgtcttcgtcatcctcgttgacatcaatacggatacgacccgttgagtcctgtaaccagtagtggtcatcgtcagcccgtccactaatcgtaccggtaagggtaacatgacgttcgtctcgcatgttttttgcttctgcgatggtggactcctgccgtgcgaaagcggatcctgagcagatcaaggccagcagcatccataatgtttttttcattaacacctcctgttatacgagcgcttgctgcacgttgattctaaaaactaaaacggtagccagcattaacctgacgttggttaaaacgttttccgtctaccatatcggcctccaggaagagcgtatggctgctgatttgggcactcaggccgacgccgttattccagccatttcctttaaaggaaagacgttcatttgatccgttcagagcataagcagcatccccggcatactcgcgtattacacccgtttttacataggtgttgagtttgtaattgctctgattgatttcataccctgccagcacgcttgcccggctcatcagtgatttgtagcttgaaagtgtgatattgagaccattagacgcacctacggaagcaccatcctgatgacctgctgtcagctgtagttgtggttcaagataaaaacctgccagccgatcagagaagctgaactttttgcccgcctcaagcgatccgctcagacctgaagagacaccgttaccggatacctggttattctgtgtatcgtgaacattgaactgattccttagccggttgactttcacaacgccatcaacatagaaaccggcatcatttacccaggtggtgtagaagccataatgctcagaaacggatgttgccgttaccattttggtaatgaggcgatccttcagttacccccatgaacaggcccagatagatcggaatttcatcggacaaacgtttatcgaccccaaactgataaccggtgtagttcaggctgaaacggctcagcttgccattatcaaagccgctgaaccgtccatctatagcgcgcagccagacattcccggctgtcttaccctgacgaacatcacccatacgctgcatcagcgtctgcatttcggcatagttcatcagatagccagtgttgaggaagttagcccctgcgttggccgtgctggtaataggggaagttgcgttgtcttgcccggcaggcgccgtgccaccgttatcggctggagtcgcggcaggctcatccgcagggataacggccggatcatctgcttcaggggtttctggtgctttaggtgaggagagtacccagttgttgccttgcttattgaccgagtaaacatagccaccaagttccacgtcggcgttacctttaaaggtggcgatgccatcagtcgtttcaaccacagtcagtacttcgttgccagtggtgacggcactgccgcggttctgtatggtcagaccgtaatcaccggaactactctctgtcaccacaactttatcgccaatgttattcacgccagcaccatcgcctgccagattggtgcgcaaggcgaagtcgcctctgccgctgaggttggcgatagtcaatgttgaataggttgcgtcatccgaggctgcagagaggtcaaccagcgagttactcaatgtcagattatcgacattggatgttcgcgatacattccaggtgctgtcggtcagattaacgttcagatggccattattgacgttatcgctgctggcgctgccagaccagagtgaacccgatgtcagattgaggtcgatgagtccggcccgggataaaacgctaccaacgatctgcgcttttccgtcggtggtgatgacacctgctgtataaccttcatcatattgcgtagccatggctatcccatccggggagctcatatcaatggtcaaatcacccgtaagattcgctttaccaccagccatggcgtagacacctgtagcattctccgggccggtaatggtcactgcatcaccgttaactgtgccaccgcttgtggaccaaatacccagggtcatggtatccacatttttcatcataatatcggtgttctgcagattaatggttgcgccggttgactgtgcggatacgccataaaaacctgctgaatagaccgtattgcgttcttcttcactgccaatgaagttaacgatggcattgtcgcccatagccacaatgccgccagtctgatcagaggagatcacgctaccggcaccaatgtttgacaggctgttgtcacggcctgacagacctgcagaggtctcacccgcagtactgattgtcagatgatcggccttcagctcaccccagctccagatgccagcagaaagatccccagtggtaataatggtcgagttgctgcccagatcaaccgaaccattatcctggatattaataccctgcgaattattgccaagggtgttgatcgtcaatgcatttgctttcaacgtggccacgccattaatcgactcaccggtcaggttatcaacctgaacggcattactgttaagaccattcgtctgtaaattactgtcgtcgcccagactggcgtgacttccgtaaccgctgacgcgcagagccgttccgccagtgccctgggtgcttatttgcaggttgtttgcctgcagcgaggaactattgctgacaacgacgccctctgcgaaagaatcacctgatgctaccgtggtgaccgaggaacctgatcctaaactggcggttacattttttccgccgaactcaatgccgaccgctgttttaccggaaacgttgagggttaacttatctgcagtaaattcactgtttgccgcttcaataaaaatcccttttgcataacgttcagcatctgtcacgcgaaactgtgctgccgctgccgatggtaaccgttgcggcagtagcgccattaaccaggatgccataataaccgtcgccagatgactggtcggcaatcagcgtggtgccatcagttaagatgatctcattgtctgtctggcttccgatgactgcagcatagctaatcagaggcacaacccccatcccacttgccagcattaatgcttttgcgattttatttcgcgggaatttattattcatctcagtcactcttccttaagattttattgatagtgtgatcgttaaatggcacctgaatcgtgagttgttattcaggtgttaagcagcagcgatatttaagcgataccaataagttgtaggttttactgatcccattaatggcagtgcgcatacaaatgttgcggaattatgcagcgggaaaaggatttatgtaaaggcatcgcaagtgtgcctgttttaagtaaacgttaaaggcgatgccctattcgcgaggaatttccattaaaattaagataatgcatcgattgtaataatggggtttttgttaattatcttcacatgcattctaattttggctttattcattttttaatcactgcattaaaggtctatctgcttatgtgtcgcgtaaggttgttaagcgagggtttagtggcagcacgctataattatgtatcgctacccgcagtggtgagtgcagagtggacggcagaatggaaacatgatgattgtcacccctgaggttaacatgtggccggagaaaggaggattcctgataaagtcgttgttgtgctatcagacttaatcacaccactggagggtaaatgcttaattcacaaaaataaggttaagagaggttttatgaccgtcacaaacaggttagcaggagtttcactgatgttactggcttcactacttatcgcctgcacaccgaaacagcaaggaaccgcagcgtttaacaatgcgtaatccagccagtgaatattgcgttaatcgcggtggtcagcaggtccaggaaaaatcttcggcatattgcctgctaccctctggagaaaggattgagcagtgggctctgtatcatcgtgaccatctgaaatgaattcccgttttgttcgcctgcatgctccctgttcgggcgaacaacatttaaatttaatggtattgcatcatctgaatcagcttaatacacccttgcttaacgactgagcagccttttttatcaccctgacacgatttgccgttccgtgatcggtgctggtggagcatgagctaaattggcagcatatcgcctgaacagataatcattatcgtagtcgtgtgagtccggaaggcattatttgtacgagcttttctgaatacaacagatgaagccagttttggcgtcatatttaaaacggtttacagtggtctggcaggtttgtcttactatttcttacagcgctttatgtcgtgcgtttgttgagaatgacagagcatcacagcactaaaggtgatgctctgatttatctgttcaccgattctgcccgacggagatcaaaatgcatcgcgccaggattatcaggaattgatgatctgcagggtgatcagccctcagcagataataggttatgagtgatcctgccctccttttttcgcctcagcacaccagtctccatacttctgaaggaacttcactgtaggtttcattcattattagttcggctttacgatgatcgtaagcgccttcaaatgaagagaggtcgtcaccaggcagttttttccgcatatagcttgttacgatatccagaatatcggttgacgggcagttccttaacttattcagatagtagactttgtccataatattcttgctgatttaacctgtgaaatgagcttatacgcagtctgaacttaagttatgcagacgcgccgttatatcaatgctgccaggcgagagtaagcggctcctgacaccggatatacttgtttccttacgcatcggatacattcgggcgcgatcactcgcacgcgaagttccattagccggctaagcgaaaggttaatttctgaaagtaaattttaatggcatgatacattaatttaatatcttcattgattttgctgatcttccccaatcccataacaaattgaacagaaaagcataggtcagaaaaaatagcaccagtccggattcaagtctcaacgctgagaatagcgtaatatccagccaccatgctgcaaaggggattaacactaataacagacccgcctcaaacagaaacggcatggaggcatctcattcgcaagttctttttaaatcctattcttagctgaacactgtcaaacatcaggttgaacaggtagttccatcccatagccagagtcgatgagaccaatgtaagcaacaacgactgcgatggtgctgcggaggtaaaaataatcaggataaagaaaaccagcacattagcgacaacttcgaataccaccgcgtgcagcactctctcagttctggtacgcaccggatataaacacttttccaaatcagacgctcattaattagtcaggcaccgtactggcgcaggaaaaattcagggtggccgtaatatcagtgaaacggttcttcatactgccctgttttaaaccgacgagaacttagcatcaacctggcagaaagtgaaacccaatagaaatatgacgataaaaacccattaagttttgatattgatcaattctgcaaagtacgcttttaatggttaaccgttcaggacagcgagtgttattcctgctctgtttccgcacctctgtcgtacattaattcacccgtttcacttcgctgtttgttcagtcggatacgatattaacgtcatcactctgcatctgaatattaaaaccataaaaaatgcgtatttagatttatattttaatatttagatgatagttagattttttatctgacataaaggggcggtttcagcttgtcactgcgatcagattatctgtggcaggctattttctatgcacttctgagccagtgagccactttcccgggcactgtctcgcgcgggaaatagtgctgaatgcaatgatcgacggcaggtaaagcatatttctttaccggtggatatgacacaacgggcaatctttagagacagttttctgccgtataaatgatgaaatccacttttccgttaatgtagatatcgggtttctctccctgctccagataattcagcatcagctgcagcgcgagctgggcatgctgccgggtgttttgatccagtgtcagcgcaacgctctgctgcgccatcagcgtgcgggtggtggcgtaaagctcatgagtaatccagatgcactgattcagccgacgatgtcgtgccagcgcctgcccgatctcggtattccccagcccggtgttataaatgccctggagatgacagctctgaaccagctgcttctccagcaacttactgagggtgtcgcgattttcctgggcggccagaacttcacgtaactgaagatggggaaaccgactggttatcaggtcacgaaacccttcaatacgctgacgatgcgcgctgtaatcccggtgcccactgaccatcaacacctcaccgggttgatgcagcattttgcccatcagctgagcggctgtacgtccggcctgcaactgattgatccccacatgacagagtcgggcggcaccgggtaaatcggtgaccagcgagatcaccggtacgccacgcgcctggcaatggtccagcgcctcatagatcgccggatgttcatgggcaaaaacgatcaaaccatcccttgtctcaccgccctgcctgataagctttgccagacgtttctggctgagcctcggggacaaaagtgcggcgcagcgttaaccggcgatagcccagatgcgaggcaacctcagtaaaatcctgtgccagctgcttaaagaaaaacgaatcgttgctgctcagcagcagttctatctgccaaggatgacgatgctcctccggcaggatccgcttcagcccgacttcacgtgctgcctgcagcaccctgtgaaccgtctccggcgcgacgccgccacgttcattgagcacccgatccacggttgccagtcccacacctgcccgtcgggcgacctctttcagcgacatgccgatctcctgtgaggtaaacacctcaaaacaccgtgccgccagtgtaaaacgcagcgttatcctgcagatgcatctttctgccggactatgatggagttcaaaaaaatgaataaaaagcaacgtgttgccctgctggggtgtggctttattggtgaagttcatgccgcgaatcttcaggcgcaccccggagttgagttggtatgggttgcggatgcggatcccgcgcgcgccgccgcctttgcgacccgctttggtgcccgggccgcgtctgtcaccgaggcgataaatgatgagcagattgatatggtgctgatcgccagcgcgacgccgacccatgctgacttactggaagccgcagcccgcgccggtaaagccatctactgtgaaaaaccggtcgatctctctcttgagcgggcccgctctgccgtggctaatgttctcccctacaacgtgccggtcacagtagggtttaatcggcgttttgatgtcagccatcagcagctgaagcaacaactccgccaggggcggatcggcccggcggaactgattcagatggtctgccgctcctcagccatgccgccgctggcctatcttcaggcgtccggaggacagatgcgcgatcaggctatccacttttttgacctgttgcgctggctgactgaagaggaggtgaccgaggtggcagcgatgggtgcagcgctggctctgccctcgatcagcgaatttgacgacgtggacaccagcacgctgctattgcggctgcagggcggggcgctggcacagctcgataatgtccgccgcaccggctatggctacgatgaacgcatcagtgtgatgggaccgcacgggatgctggaatcagcctctcagccacagcgcggcgtcagctgctatcagggtgcgcagattcagcagccaggcttgttgcccgactggttcagccgggtgcagccaacttactatgctcatctggatgcgtttatccgatcgctgaacggtgagcaggttgacgatcttcctggccttgaggatggactgaaagcccaggcgattgcggaagctgcggtgatctccctggcggaacggcgtttctgtgcggtggaaaaactaccgttctgattcagcgtggcaccctggcaaaaaataattttatttttatcgaatagaaaccggcgcggagctgtttaccgtacagcgccgcgctagcggactgcatccggcgggctttatcgcctgtctcatagacccgataaggataaattatgacaacgcgttctggtttttctctgcttgccgttccggcactgctgctgatgctgcactctccgctgagtatggcgatgggcgacaatgacagtgataaaagacgcctgactgccccaaaggtcaggtctatgacagtcacactaaaagttgtgtgcctgagaagaccagcaagctgagtgacgacgataaaacccgctatgcctggcatctggtgaaaaagggcgaatatcaggcggcgctgaacctgctggatacgctgaaaaatcaggatacccgtgaagcctggaactatcgtggttacgccacccgtaaactgggccgcacggacgagggcattggctattatcagcgcgccattgcacttgatccccgttacgctaaagtgcgtgaatatctgggcgaagcctggatgatcaaagggcgtccggatctggcgcgtgaacagttaaaaaccattgccgggatttgtggcacagactgcgaggagtaccgcgatctgcaggccgcaatcaatggtcaccccgaggtctgatgcggcagggaggagcgaaaaatcactcacagtgacatccgtcagcaccttgcggaacatctgacgcggctctggcgttacggctatgtgctgtcacacaaccgtgacatggcagaagagctggtgcagtcaacctgcgtacgcgcgctggaacgcagcgcgcagttcacgccgggcacacgcattgatcgatggcttttttcgatccttcactccatctgggccagtgatttacgggcgcgaaaggtccggcagggacagggattcgtggatcccgatgcgctgctggccgcagacaaccacaccaacagcgacgacaaccgccatttccagcgcattatgctacaggttaacgccttacccgaggcgcagcgtaatgcactgtttctggtgtatgtcgaaggtctgacctatcaggaggcggcagagacgctctcggttcccattggcactattatgagccgtctggccgccgcacgtgccacgctggccagacagccggcgacctcgcccgcaccgcaggagaaacggagatgaacagggaaacttttacgccaccgtggcgcgatgaggcaatcgttgcctggctggatggtgagatgacgccacaggaagccgtgcagtttgagcaggcgatggcaggggatcccgaactggcggcacgggttgagcatttacagcacagtaatctcgattttgaacaggcttttgcgccgctgctggaacaggcaccgcaggccagaatggcacagcaactggcagccatcacggcaccagagtcaatgccagcaaaaggctacagccgtcgggcactgattgctgcgtctgtcagctttttgctggtgggcagtggcatcggtttcctggcaagaccggaagatgatgagaaagatgaaagccagaatatccgcgatctggaggcgcgttatatgtcgctctacagtgctgaaacgctggccgatacgcctgatgacgccgccatgctgcaaagggggctggaccgtacccgactcgatttaggattgcagctgcatcctcagcaactcagcctgccaggggctgaactgaaaatggtgcggatcctgcgctacgaacggacgtcgattgcacaaatcgcctggctgcatgctgattatggcccgatggcgctctgtatctcgcctgagccggacagcgcgaatcccatcgcccatgaaaagcgccatggcatgcaactggcctggtggaagcgtgacggctatcagtatgtgctgattggccgcaacccaccggctcaactggctgccacagcggaaacattgcagacagcactcagttaatcggacccttcagcggttaccgctacagcggctttctgccctgcgcggcaatggccagcgcaatgttgacgcgatcatcaaccaccccgaccagccgatccattccgaaggctgagcgggagatggcggtggaggcatgtagcgccagcgaaacctgaagccggatcaattgtctttccgctgtccagcgaggccagcatcacgactggccggctgacatttttaaccgtcagcacaccaaaaatacgataattgccgccacccagtgaggccacgcgactactgacaaagtgaatgtttgggtaacgctctgcatcaaaaaacaggttacttttcagttgccaggttaacaggctgttcgaggccaccagcgtccctaccggaatagtcacttcaatatgatcgtcacggtcttcatcaggattgagtgtcaccgtaccggtcacaccctgcagtctggcctgcgaaaattggtgaccaaaggcgcgccatgaaaggcctatcgacgttttatcgggggtaatggcataggttaccggcgcggcgtaaagtaccgggctgagcagggctaacagagtgcataaacaggcggcacgcatcatcactattttctcttttttaggcagacccaacgttaacgcctgaaaccgcgatcctattcactttttttagcactgtttttaccttacaggcacagataatctgacagatattaactgactgtcacctgagaatcaccaaagtgtaatgattattgcaagggcagaacattaataacgaaaaatattaagaatacattaagacggctttattaatctgtgattcatcctgagatgagcggagcgctatttttttcgatgtgatactgtgagtagcaggctgaatttagcccagcaatatcagcgtgttaatttttctctccagaagtgacttcatccggatgagctgaaccctgctctggtgactaacagagcctgctgattttaaacaaaatatcaataaatcaaaaagagttgaggccagagctattattagccatttaatagtgaactttttctgaaatccttaacttgctctcccttgattttatttaaattcacactcttcatttaatgttcagttaactttcatacggtagtttgtattagcagtccggtaaccttaattccagaacgggaaagcgtggtgtcgataacaccctggccgactgtgagtcattcgctatttcaattattttctggcgttgtgcctgattaacaacgcgcgacagcttatgggtttgatctgcaggagttttagcatggattttttgccattttcccggccttcattcggtgatgaagagctggctgctgttaaagcggtatttgactctggctggataacgaccggggcaaaatgcgccgaactggagcaggcctttgttcagatgaccggcaaccagcacgccattgcagtaagctctgccactgccggaatgcatgtcacgctgatggcgatggggatcgggcctggcgatgaggtgatcacgccgtccatgacctgggtctctaccctgaacctgatcacgcttctgggtgccacgccggtgatgattgatgtggatcccgacaacctgatggtcacgccggaccggatagcgcaggcgattacgccccgcacccgcgccattattccggtgcattacgctggtgcacctgccgatctcgcgccaatctatcaactggctcaacagaatggcatcgccatcattgaagatgcggctcacgcggtgggcaccacttattgccaaaaaccggtcgggcatcgcggcacggcgattttctctttccacgccatcaagaatatcacctgcgcggaagggggcctggtggtgaccgatgacgccactctcgccgatcgtatacgcagcctgaagtttcatggcctggcagtagatgcgtttgatcgtcatacccaggggcgtctgccgcaggcggaagtcatgatgccgggctttaaatacaatctgcccgatatcagcgcggcgattgcgctggtgcagttacagaaactgccgggctttattgcccgccgccgtgagattgctgaacgctatcttgaagcgctgcgcacgctgccgtttcacgccgctgtcactgcccgcctggccacatcagcatgcgtggcacctgtttattattcgcattgatgaacagcgctgcggtctgtcgcgcgatgcctttatgcaggcactgaagacgcgggatatcggcagcggattgcatttccgtgcggcgcatacccataaatattatcgcgagcactatcccgatttacgtcttcccgccagtgaacttaacagccagcagatgtgttcgattccactgtttccgtcaatgacggatcaggatgtcgaacgtgtgattcaggctttacatgacattgccggagcctgagatgcgcgatattaaaccgatcaatatgctctccgtggtcatcccggtctataacgagcaggagagtctgccggagctgcttcagcgcacctgtgccgcctgtgactcaattaagattgagtatgaaattctgctggtggatgacggcagcagcgatcgttctgccgaactgattgaacaggccgccaccgttcccggcagccggataacgggtgtgctgctcaaccgcaactacggccagcattccgccatcatggccggattcagccaggttcgtggcgatctgattattacgctggatgccgatctgcagaacccgccggaagagatcccgcggctggttgacgccgcgcgtcagggttatgacgtggtgggtactgtccgtcagcagcggcaggacagctggttccgtcgtaaagcctcacgcacgctaaaccggctgattcagcgggtcaccggcaaggcgatgggcgattacggctgcatgctgcgcgcctaccgtcgccacatcgtcgaggcgatgctcaactgtcacgaacgcagcacttttattccgatcctggccaacacctttgcccgacacaccattgagctgccggtgatccatgccgagcgcgcttttggcgattcgaaatacagctttatgcgcctgattaatctcatgtatgacctggtgacctgtctgaccaccacgccgctgcgattgctcagcgtggtcggcagcctgatagcgctctccggcttcgccttctctttggtgttgatcgtgttgcgactcttttttggtgcagcctgggcgggtgacggcgtcttcgtgttgttcgccgtgctgttcatgtttatcggcgcccagtttgtgggtatgggactgctcggggagtacatcgggcgcatttacaacgacgttcgggcacgtccgcgctatttcgttcaacgcattgttcacgctccagaagagccttcagtacaggatattcaatcatgaagaccgttgttttcgcctatcacgacatgggctgtgtcggcatcaatgcgctgctgagtgcaggctatgaaatcaccgccatttttactcacaacgatgtggcgaccgaaaaccactttttcggctcagtagcccgtctggcggcagagcatggcattccggtctatgcacccgacgaggcgaatcacccgatctggcttgaccgcatccgtaccatggcaccagagatgatcttctccttctactatcgccatctgctgagtgatgagatcctgcaatgcgctcaaaagggtgcttttaacctgcacggctcgctgctgccaaaatatcgcggccgggcaccgctgaactgggcgctggtcaacggcgaaactgaaacgggcgttacgctacatcgcatggtaaagcgcgcggatgccggtaatattctggcgcagcagaaggtcgctattgaggatcaggataacgcgctgacgctgcatcgtaaactgacccaggctgcagagcagttgctcggcgacgttttacctcgtctgcgcgagggtgaggtgagtgaatggccacaggatgagcgtcaggcgacccgggttgaccgccgcacggccgaggatggccgcattgactggaatcagcctgctcagacgattcacaatctggtcagagcggttaccgatccctggcctggcgcattcgcctttgccggttcggttaaatttatcgtctggaagagccgggttcatccgcagcagcatcaggcaaagccagggacggtactttctaagcagccattcctgatcgcctgtggcgaaggcgcgctggaaatccagaccggccagtccgagcatggcgtttacatgaatggcagccagctggcgcagagtctgggcatcgtccctggcgcactgctctattcaaaaccgcagtcagcgctgcaacgtcgtacccgcgtgctgatccttggcgttaacggctttatcggtaatcatctcactgagcgtttgttacaggatgagcatttcgaggtctatggcctggatatcagttcagacgcgatcagccgcttcctggatcatccgcgcttccatttcgtcgaaggggatatcgctatccattccgaatggattgagtatcacatcaaaaaatgcgacgtcatcctgccgctggtagccatcgccacgccaattgagtacacccgcaatccactgcgcgtgtttgagctcgatttcgaagagaacctgaaaatcattcgcgactgtgtgaagtatcagaagcgcatcattttcccatccacttcagaagtttacggcatgtgtaccgatgccagcttcgatgaggattgctctaatctggtcgtcgggccgatcaacaaacagcgctggatctactcggtatccaaacagctgctggaccgcgttatctgggcctacggcgaaaaagaggggctgcgttttaccctgttccgtccgttcaactggatgggaccgcgtctggataaccttaatgcagcgcgcatcggcagttcccgcgcgataacccagctcattcttaacctggtagaaggctcgcccattaagctgattgacggcggcaaacagaagcgctgctttaccgatattaaggatggcgttgaggcgctattccgcattatcgaaaacaaacagctgaattgtgatggtcagatcatcaatatcggtaatccggacaacgaagccagtatcaaagagctggccgagcagctgctggccagctttgaacgtcatccgctgcgcagtcagttcccgccgtttgccggtttccgcgaagtagaaagcagcagctactacggcaaaggctatcaggatgtggaacaccgtaaaccggctatccgcaatgcgcgtcgcctgctcggctggacaccgaccgtgacgatggatgtcactatcgacaacacgctcgacttcttcctgcgcaccgttgagccacaggctgataagtgatgaagaagatcggtctgcggattgacgtagatacctggcgcggcacgaagcagggcgtgccggcgctgcttgagctgttccggcgtcatgcggtgcggggcagctttttcttcagcgtgggaccagacaacatgggccgccatctctggcggctggtgaaaccggcgtttcttatgaagatgctgcgctcccgtgccgcgtcgctctatggctgggacatcctgctcgccggaaacggcctggccgggaaagcagatgggacgaagattgcggcacatcatgcaggacgccactcgtcagcacgaagtcggtctgcacgcctgggaccattttgcctggcagacctgggccggcgtctggccgcaggataagctggttgagcagatagcacgcggcaccgaaacgctgagtgagatacttggtcatcctgtcagctgttcggccgtcgcgggctggcgagccgatggccgggtgatcgccgccaaacaggattttggctttcactacaacagcgattgtcgcggcagcggcccgttccggcccatgctgccggatggacagatcggtaccgtacagattccggtgacgttgcccacatgggatgaagtggttggccgcgaggtcagcgcagaaggctataacgactatattctggggaaaatgctctcttctgacgatggggcggtctacaccgtgcatgccgaagtcgaagggattatcggctacccggactttcaccagctgctggctgctgcggaccgtcaaggcattcagttctgtccgttgagcgagctgctgcccgacgatctgagcaccttgccggtgggcaaagtagtcagaggcgaaatccccggacgcgaagggtggctgggctgccagaaactgactgaagaggcgaactagtgcggatacataacaacacgaagtggctactttttttcagcttttttattctctattacctgcttccgccgatgttccgcgacctctggcagccggatgagacccgttatgcggagatcagccgggagatgctggcaaccggtaactgggtgacgccacacttcttcgggctgcgctattttgaaaaaccaattgccggctactggatcaactcgctgggtcagtggctgtttggccacaacaactttggcgtgcgggcgggatcgatattctccacggcgatgaccgccgtgctgatctactggctcggcaggcggttgtttggttcggtacgcacggctgccgtcggcacgattattttccttagttcgctgctggtctatggcgttggcacctatgcggtgctcgatccgatgctgatgctctggctggcggccgcgatgtgcagcttctggctggcgacggaggccagcggacgcgacgggcgggcgggcggctatctgctgctgggtctcgcctgcggcatggggtttatgaccaaaggctttctggcgctggcagtgcctgtgctggcgattctgccttgggcgatctggcggcagcgactgcgcgaactgctctgcttcggtccgctggcgctgctctcagccgcggcgatcagcgcaccctgggcgctggcgatctatcatcaggcaccggatttctggcactacttcttctgggttgagcatatccagcgctttgctgaggacaatgcccagcacaaagcgcctttctggtattacctgccggttctgctgctgggaacgctgccgtggctggcgctgttaccgggcgcattgatgaccggctggcgcgagcgtcagcagcatcccggtgcgctctatctgctgatctggacggtgatgccgctgctgtttttcagcctggcaaaaggcaagctgccaacctatatccttccctgttttgtgccgctgtcgctgctgatggcgcactatggcctgaacgccgcacagcgggcagggcgcgcattaacagtcaatggctggctcaacctgattttcggcatcattaccctggcaacggtcgtgctggtgctcgctccctggagtgtgacgcatcatccgctgttcgccacgcacgagatgctgaagcttgcgctgggggcactggcatttttcatctgggggctggtgggcgcatatagctgccgctctgcacagcgccgctggctggcggccgcgctttgcccgctgggcgtcgccctgtttattggtacggcaatcccggataaaatccgcgacgccaaacagccgcagagttttgtctcgacgatcagccagcgtctggcctcaagtcactttatcctggcggacaatcccggcgtggcatctgctgcagcctggcatctgcaacgtagcgatatcggcttctatgacactaaaggcgagctggaatatgggctgagttacccggatgcgcaatcccgctttgtctctcaggcggacttcggcggctggcttgccgatcatcgccgtacgggaagcgtatcactgctgttgctggttgattcagtacacagtgatatcggcgaggatgttccggtgccggacgccgtctatcgccagggcaggctggtctgcctctattacagtcagatgaagtgatgctgctgctgatagtactggtcagtctgctcagttgcagcgcgcaactgtgccagaaacaggcgactcacgcggcatcgcgccgggtccgcttaagctggattggggtgagcgtgctgttgctgggtgtcgcgatgcttctctggctgctggtgctgcagcgggtgcctgtcagccaggcctatccgatgctgagccttaacttcattttcgttgcgctggcaggacgcatcctctggcgcgagcgcctgacgctgcgccagatcttcggcacgctattggtggtgacgggtgtggcgctgatggcgagccagctatgaaagggtatggatgggtcgcatgcagcgtgctgctggtctcagcggcacagctgatgatgcgctgggcgatgccgcgactgcccgatgtcagcagcataacatcgctgcctgctgttgccctgctgcccgcattgctgctgctggccgggctgggtgcttatggaatttcgatgctctgctggattagggcgctacgctattttccgctgaaccgcgtctatccgctgctcagcctcagttatgtgctggtgtggctggtggctgtctgtttgccggtattccatgaggcgttcagctggcacagcctggcgggcgtagtgattattgtcatcggcctgctgtgtatcgtggttaagccctgatttaagaatattgttagtgttttcgcatcaactatgctttttcttagccttttcgggcagcgattaaggctaaacgcgtacagggattaacaggtaacggctggttagcagagcggttttatcttagtggctaacgcacctatatcgctgaccatcagatcgggtgcaggtgctagtgggtagagtgcctgccctttgcgggtaacaaatgcagttttcatgcctgcatgttttgctccacccacatcccagccatgcgcagccaccatcatgcactctgagacgggcatgcccatctccttcatcgcttactgatgcgctggggagactctatccgctgaaacaggcatgcaatgagaacggggactgtgaaacgttcatgtttgcagaaatgtactgcggcgggataacggacatttatgcccgtatcggtgtgcgttacttccgcctgcttaattacacccacatgaccgatgctaccttatgcagattgcctgattgaagccggatttaatccatcagttcagatgtccgtcagttgatttgatattgatcctatcacggtggatatggcgtttatacagctttccctgctgggcattgcaactgaggttgtcaccggtaatacgctgacgctggagtttaaccgggtgcgctatacaccggcttactatctcaacgattttgaagaatgtctcaaaagccagcgccggatcaaggcgatgctggattttatcagggcaatgtaggccatggacaaaacagcaggaaactacatggtagggaagcagtggttacgggtttgtatggggtgcatgagtaatgcagaaattgcacaatatacgaaatttcgtataatgaggtgatgatgcgtaagaaaatcagttttattgacagcagtcttgaggatctacgggctttcccggaagaggcccggaccgcatcagggtatcagcttgacctgatccagcagggactggagccggacgactggaagcattttgctacggtaggtcagggagcacgtgaaatccgaatccggggtaatgacggcattttccggatcatgtatgtcgccaaatttgaagaagccgtgtatgtgctgcactgtttccagaaaaagacacaaaagaccagccagagtgacgtagaacttgcccgaaatcgttatcgccgattggttgaggagcgtaaaaaatgaatattcagacttttgataatgtgtgggacgctcttagcgaaacgccagagcaggcggaaaatatgaaactccgcgccgagttagtaggccgcctgaatagctggattaaacgtaatggcctgaatcaggccactgctgctgctgcgctgggcgtttcacagcccagagtgtccgagctggcaggaggtcggatcaactgcttttcaattgataagctggtcagcatgatgtcacatgccggactgcacataaccagtattgagataagcgaaccagaggaagcttgagctgcctttttgcatcgcgcgaaactgccaggacggtagccccttcggggcaggataaacccggtgctgatgcaccggctataccctttcacctgaccgtcttcatcccttcccatctgaagttgatagcttgccatttctgctatcaagtgacactaccaaattggccatctgcagaagtgcgcataataaactttatgtcgcctgctcacgggcacgcggaaacatcacttttatccccgaagccttgctgcgatcattccggacctgactggaaatgaagcttcatactaacgcggcaggagcagccgcccggcttcctgcggatccatcgtgaaccgcacaccaagctggcgggtgacgtccagcgcgaacacccgcgtgtgccactcggttgactttgcgtccttgtggcccatcagggtcttaataaccttctgcggcacctagtgctgcaccagatgcatcgcaaacgaatcccggaacgtcttgggtgtgaccggccggatggagaacgtcacaccgtcacgcgcagccgacgccacagcctggcttatccagctgcgcgccgtgtcttcactcctgatatcccagagccggctgcctgccggcagctgcgcagtcgcaaaccattccctgagccgctgcacaaaacccggatcggtggtcagtggcaccgcccgcggcgggggttctcccggatctccgcctcggtttcacgttcggccagctgctcttcctttgtcggacgcccgcgccggcggctgcgggccgcctcttccagcttccgctgcttgagggtgcgcagcaccacgaacggtgaactcagcggggcgccggtgagcggatcgtccagcacaaaatcccccccccgtcagcggcaggatttcgttgagacgcccgccggtattccacagggtatcgatgaacagccgcttcttaagatcagggacctttgacagcagcacggccacctcaggagcgagcaggtagcgcggcatgtcggtgccgtaagcggcggccaggttgcgcagcgctacggcgctttcgtagtcaaagtagcgcgcggcgccggatccggttacgttctgaccagtgacgtcgctacgcgaaatctgcgtcagttcgcggggtaaagagcccaaactttcaatctccgttgtctggcggtgtggaacgtattttccatgtctgtccagcgaaaaccacgggaataaatcgatccataaaggattcggtccggatcggttttcgggctttttccccgcatacggagaataacctggtcagcctcaaataaacagcagagcgtttgcaggcgatccgggtggcaatttactcgtaaaccactgacagaaaaggaaagaatggaaaatgggtgggggagggtgcgtaccaggcactcttaagcatatatcgggtcacaccgtgaaacgattgaagtatgaaatacagcagttgatctcggttgaatcaggccaaaattatctggcttcataaattttttattatgtctgctctgggacagacaacacatgtgctccgcataaagaaccggcatttacgtacagggtagtaagtaaattgctccggtaaaataagtgatttttcttaacccaataacggtactgattcaacatctgctttttgcattataaatatgaccgccatcatttacctataataacggtcatatttgaaagtatacactcacaaagataagggagatattctatcttttagaggttaagaataatctcaatcaagcgggcagacccgaataatatgaccatctggatcactaatcaaaaaagtgcgaccgaatacgtcagtataaggctcttttatcacattgatttgatgtgatttttgctttgtccattcattgaagagtttgtcaacatcttctcctgttggcagcataatgccgatttcagaaaaacgtggaatttccgctaccggttcctctccgcctgaccagatagcaaaaagagcatcgccagatgacgggaaagcaacatagcggggggtaacgaatacaggttctttcttaaagataaacctgtagaaatcagttgaacgctcaacatttgaaacgtaaaccaattgcaagtttggggttattgtagggccagctagatcagtcatgattcctccttttgtataacaaacgaaacaggattttccattaacattttaatccattacttaaccttaatggtttgacagtatttaagcaatatttttgcagcaaatatacttctgcaaaggattttctggttattattgacagttttttagctagcaataatcaataaacttgcttcaaaggcgatttttccggtttaaaaagtatttattatttccggaaaatttccttttttggaattttatagttattagattatttagtgaccaacttattttttaaagaaaaatatattagtgaagttgactcaaacgattttgaatgttaaaaaatcgacacattcaacatcccattaacctaattgaaacatcatcaattgtggggtttcgcgttgatctaattaaatgaggtttatatatgtatctgactgatgaagatgcaatccgtattcgtgaaattaaccgtcaagtagtatctcagtatttgtcatcgactcgcggcattgctcgtcttaaaaggcatgagctttttgctgaagatggcgaaggcggtttatggaccactgaaactggtgagcctataattatacgcggtattgagaacttagaaaagcatgctaaatggtctcttgagtgttttcctgactgggagtggtataatattaaaatcttcaccaccgacaaccctgaccatgtttgggttgaatgtgacggccgagggttaattcgcttcccgggatatcctgaaagttattatgaaaatcattttattcattcatttgaattgcgtaatggtcttatcgttcgtaatcgagaatttatgaatcctgttactcaattgaaatgtttaggtatagatgttccacgtatcaagcgtgagggtatagccagctaacttctgtaagaattctatcgccagtattaatactgaattttttttcgcgatatttacatttatacgaaattaaattttctattaattcatttggcacgcgtaataaactttttcagaaaaggccgagttatctgatgtacagaaccttaaagtctgagtcctatagtttatctaatatcattatacctgatgaacagcctttggcgtggaatatagaaccacaacgtagtgcgctattagttcacgatatgcaacgttattttgttgatgcgcttccatgtgaacctgtcgacactgttattcattcaatttcactgatactaaagtgggcaagaataaatgagataccggtattttatagtgcgcagccaggtggaatgactccggaacagcgcggcttgctgaatgatttatggggcccaggaatgaggacgactgaggatgagcggaagattatcactgagcttacaccttctccgggtgatacagttttgactaaatggcgctacagtgctttttatcggtctccattagccgaaatgctaaagaacgatcagcgtgactccttaattattacaggcatttatgcgtcagtaggtatatctgcgaccgctattgacgcttttacgcaagatattaaaccctttgtcacagccgatggaattgctgatttctcactagccggacatcagcaggcaatcaattaccttgctgataattgcgccaaaataatctcaactgatggggtggtaaacaatgtctgattccctgacacacattctgtcacagccccataaaccttatgctttactgtatcggcccgcagtctcgatggatagtgttgaaattttgcaccttacttgcggaaaaacacactccctggataaagctcttagcgcagatagccatcacggtaagcttttagttgttccattttgccaggtagccaaacgtggctatcacgctatcaatgatgaaacaccgattctgacgatgccaatcactgcgcgtcaaagcttgccattatcagaagtaattagcaggctaccggatttgcctatttcggtcacgaaacactaactttaaccttgacgatatacagtttgggcaacgtatcagtcagttaatcgaacatgaaattgggcagggagcaggttcgaatttcgtgcttcatcgtaagctacgtacctcgcttgtagattatcatcctgtacaacttcttagcctttttcgacgccttttgcagactgaatcctccgcatattggtgttttttaattaacactggtgatgaggcttttattggtgtatctccagagttacatgcatcactagataatggtgagatgtgcatgaacccaatcagcggaactttacgttatccagaacagggcgaaacaatcgaagctctgcttgaattcctcaccaatcagaaagaaaccaatgagctttacatggtggtggatgaggaactaaaagtaatgtccaggctgtgtgaacgtggagcgcaggtgagcgacttgcgactcaaacaactaagtcaggttattcacactgaatatgtcttaaaaggaaaaacgaaagccagtattgcggatatattgactgaaacgttaccagcaccaacgatcattggtagtccagtgcaaaatgcctgccaggtcattgcccgttacgagccagaagggcgcagatattatagcggcgtagtagctctggttgacggtacacatgataatccccgtctggactcagctatttgtattcgtacggctgaagtgactgctgatggaaaagtagagattggcgttggggcaactatagttcgtgactctgtgcctttggatgaagcggaagaaacgcgcagtaaagcgcaatcactttatgctgcattgacgcaagatagtttgccggccaaaaagaaagtgacacctgccagccttaaaaaattaaagcttggtgataatcctaaggttcgccctttgctgaacgaacgtaataacaggatttcgaaattctggttaagtgatcctgaaaagcgtcacaatcgtatatattctttcgctgacaagaaaatattaatactggacggtaatgatgcttttactgccatgtttaaaacacttttctcttcactgggcgcacttgctcatgtggaaaaaatctgtagcggcattgacctccagggttgggatttagtagtagctgggccgggcccggggaatccacttgatgttaatgatttcagagttaatgcaatgcgcgaagccattataaaaatgagagcgactggccagcctttctttgctgtatgcctgagccaccaattgctttgtctgcagctcggcttaccagtcgcccgcctctctccacccaaccagggagtacaaaaagaaatcctcctggataggaaccttgaaacagcaggtttttataacactttctgtgccagtattaatgctgtaacgcactctcaaatgcggcaaagaggtatagaggtttacagcgatccagataatggaaacgttcatgcgcttcgggctcactcattttcatcagttcagtttcatctcgaatcggtactcactttaaatggtcaagcgctgctcgaaagatttgtcgctcctcttttccaaaaaaattattcaggaatggcttcttaatggaaggatatcaggttgattacacggtattaaatgccttcacacattctcctcttgaaggaaatccggttgccgtttttcatgatacagaaaaactctctgaagctgtcatgcaggcgattgcacgtcagctgcagctttcagaaagtacttttatcagtgaaaagactgttgatggtcaggctcgagtgcgaattttcacgcccgtcaatgaattgccttttgctggtcatccactaatgggaaaccgccagtgcatattcacggcgccatggtctggatcaatttgtatttcatacagctcttggcgccgtcagcatttcggttgaacaccacaccgaaacactcagtacggtgaaaatcgaagtgcctctagcaagaactgtcccttttaaggaagagaagcgtctgcttaaggcgctggggctggaacaaagtgtgcttcctgtggaaatgtacgatgcaggagccaggcatgtactggtttccgtcgacagtattgaaaccttacgtgagctaaggccagaccatcaggtcctcgctgaatttgaaaatcttgcagttaactgtttcgcctggtgtggatttcaggcggaaaaccggatgttctcaccagcttatggggtaaaagaagatgctggtaccggttcagttgtcgggccaattgcacttcacctgatgaaacacggacagttaaaagctaacgaaaaaatcatgattgagcaggggattttgctcaatcgccgctgcgtgatgtatggcgaaatcaaacaggaaaatgaaattgcttctcatattgaactctccgggcaggttaccttgttttctgattgcagggccttgctgagtaatagcggaaaatgattcgcttaatttgaatgtgctgttttaggtatgaaaagtgaaaagactcgaatcgctaaccggaataacggatcttccgtttccgcaatatgacgcgccgcctgtggtgccttatgaaattttacataactggatgcaactggcgcatcatgaaaatgtacgtgaacctgatgcatggaccctcgcgaccagaagtgacgctggtatgatttcaatgcgcaccatatttccagttcgaatgaatggagaagatctatggtgcgctactcatcttggcagtcgaaagagtctcgatatgtgtgccaacaaagcggtctcctgccatatttactggcgtgagctggggcgacaggtgagcttaactggtaatgcaaaactgctgtcagatgatatcgccgatcaaatctggcacagccgtgcttctgcatatgatcctgtctcagtagcatctcatcaaagtgagccattaaacgatcttactactttgcaagcgaagatagctggaatgggttgcggaaagctggaacgtcctgagcgttttgtagtatgggggctggcttttgacacctatgagtttctggtcagcatcgtcctctcgaatccataaacgtctgttatatacacgtaatgaactggggtggaagcatgaaagattacagccttgaaatagatgctgtcatgaaggcagcccagataaatgacactaataattttgttcaggcattaatgcgctggcacttttcaaaggaaactggcagtcctttttggttgggaatgcgtgaacaactgaactttgacccaatcaaagacgttaaaacgattaacgatctgaggcagtttagtgatatctcgcactgcctgcgccaggagcccgtagctaatttagtgccgcaaggcctgcctgcggactcgcaccctcaggtatatgaaagtgggggtacaacaggcgctcctaaatatgtcgtggcttacgatgcttggatagaggcactcatttcctggcgaatgtcaggttatcagcataggccggggcgtccgtcaggtaatacactcgcagctattcccaccgggcctcacattgtgggtgccattaataaagaacgagcgctgcgtttgggtgggatgtttttttcaatcgatatagatcctcgctgggtaaaacgttctttgagtgaaggtgatacggcaactgttcgcaagtacacacatcatcttgtggaccaggtccagaatacccttatgaatcaggatatccggtttctggttaccactccacctgtgctacgtgagttgcttaaacgaccagaagttgtgttgcaaatgaaacagtctctcgctcaaatcacacttggtggaactgagctcaaccttgatgagattaaatttatagcgagtgaaattctgcccgactgtgaattcagtgccagttatgggagcacctcagcattgggcgtatctcggtccttactgattacttctgaaagccaacaagtcatttatgacagtttctctccttttataacctatgacgttgtcgacagtatcactgctcaaactgtcgaatatggtgaacgaggaaacgtgattgttacccacctttcaccttgggctttttatccacgagtggctgaacgagacacagctatcagactaccaggtgtatccggttttgcgggggaccggttggctgatattgaacctttgaaaatcagcgaaggacgtaaggttattgaaggagtttattgatgccaaacattgcgcaaagctgtcctcacgtaaacgccaatgaactgcctgttatctctgctataacgccgttatgctcaccgcagtttttgcgtcagcgagaggtggtaaacatatatgaaaagcccatagctttactgcagcagtctcccggcgtatttgcagattacgtaattgcgcatctgagaaaaagtcctgtactggatcgcgcctcacgacaaaaagcattgcaacaagcaggtgaattattcgcaggttcggtgctttgtggcatgaatcttacagaatataacacgaaagttagctctcttacggggttaccgcgaacggttgtggagaatgccagcgataaaattgcacagtcaatttctcatgcactgacatttgctttaaaggggatcccctatggagtccctctacaggaaaatcaagcgacagaccgttacttttgcgcacaaagcgtgaggcgtggtgatgtgcttactgtaatagcccctggtaacgggactggtgttcatgctctatggccgcaggcaatagcgctgggctatcgagttgtaattcgaccgtcggaacgggaaccgtttactgctcagcgtgtggtagcggcaatggtggcggtggggttgcaggattatgtgacattattgccctgtaattatgatgtggtcgaaacactaattgatgctgctgatttaagtcttatttacggcgctgatgaaataactgcccgctatgctgatcgcagaaatattctggttcagggacctgggcgatcgaaagttgttattggtgctgattaccccctagaaaaggctttggagctgatatttacttcggttgtcggtttgggtggcgcagcctgtgtttgtgcaagcagtgttcttgtagaaggggatgcggaagctttagctcggaaattctgcgcttttctgtccaataaaatgaaagatccaaagcagcgtgaagaatggcttactcatttttcaccacagcgttatagctggtggtgtggtcaggtagataattacgcctcggctttagttgaaactccagaggttttcaaatctacccaaaacacatatcaagtgatgccactagttatgcaggcatcagcaatcaatgatcctctggtccagctggagttacctgtggcggcagtgactttcttatcctttaaagaaggggataatttggattttcttgcccctgcgcttgtggtgactgtggcatcgggtaacaagaatttaattaatgcaatcgcaaatgtgcctggtgttaaaaatttttacatcggtcaggtgccaactgtttggatgcatcctgatgtaccccacgatggttatctggccgaatttctaatgcagactcggggatattgcgtaaataattctgaagatgaacatagtaaagtaacgtaatttttacatttaaatttacttccaattttattcaggtgttaaatatgaaaagtagtgatcatagcgaatatgataaagctgatttccagggcgtatatcagggtaaaacacttatcggtagtgctgaaataagtgtggttccttgggatattggtcaagcgcaaccagcagtgtgtgatatttttgataaagaaaatgctggcaggcttcttgatgttggatgtggcctgggacttaatgctcatgcagctgtgaaaagaggttttcaggttacagcgttagacagtttcgtctgcggcgattcaaaaatgcaaaaatgaaggaatgagtgatgttcgttttctaattgccagtgccagtaatacaggactggatgaaacattcgatatcatacttgattctgcgctctatcacgcgcttccttatgatgaacggttgacatatttgaaagagatgcgtcgcttagcgcatgaaaataccagaatgcatatcataacatttttacccgccaaaaatggcatgccagtaccattggccattcatctctcagaaatctgtagcaatgccgaaaatgccggatgggatgtcatttccgttgatcgtgttgaatataaaggaaatgctcaggcaattgccgatttttgcaaaaagaaaaatttaaccatactgactgatgaagtgggattcactcgtctaccttgctggcatgtagtgtttaacattagataaaatctctttattcaggtggattaatgttgagaaataaaatggccttctttggtctctgtcttggtttttttattattatgatggataccacgacagtgcccttgatttatacctcgataataaatgaatatcaggtgacgcctgccatggcagcgtgggttaataatagttatttaattacctatgcaggcttcttgttgtttggcggtcgacttggtgatgcaataaatcgtaaaacggtgctttactatgctctcattattcttgctattggtgcattactcagtggttctggtcaaaccctgatacaggtcattctggggcgtgcgcttatgggggtaggggctggacttttgacgccgcaaagcatggcctttatttccatcatttttacacaaggaggacgcggtactgctctgggtatctggggggccgttgctggcatagcaacggcaaccggccccgttgttacccagatatttctgcaaacaatcggttggcgatggattatgtggattaacatacccgtggcgctgatcgcactaatatttgctgttatttgtcttcccggcacaccgggtaacggtgctaaaagcaaagaattgctaagtaatgctatagcgggcattgcgctcgctgcaataattctgggattagagcttcttaacggtggcatgcagggaatgaccacagggctgcttttattattacctggtattttgctcttcgctttcatgctgcacggtgaattgaaaaatcataagcagtatcttttaccatcttcgctctggaaggatcgagctttcctgcgtacatgtttgatttccggtttactcggctttggcctgacagcgttttctacctgccgctagcttatttgattgagctgcgtatgggttttggaccagtagcgattagtgtcatcatggtgacaatcgctctggcaaacgcactggtgggtccatttgccggacacttctcggataaggcggctccagaaacactgattcgttgggggatgtgctgcttcgcagctgccaccatgattattggtattaccggattgatgacttatggtggatctgtagcttttattattattattaccgctatggctcttgcaggtatcgggacgggcctggcatttgcccccttagctaatcaggctttcagccgtgcaacgtttaacaattttggccgtgcagccgctttttttaacgtggtgcgtcagatgatgagcgcattgggtagtgtagcaatagccatatttttcgattatctgcttcataactctgaaaaaagaagtttcacgaatgaaaattccttattttcatctggctctccatctgttgcctttgcttcattcggctgcttcctgattattaccggactgctgggtttaggtgcctggttatcacggacttatcctgtcgttcaatcagttattaaggaaaccaaataatgaatacctggcttatcagtggatgttcaaacggactaggtcgatgctggacggagtctgttattcatgagtatggtgatcgtgtgattggaattacccgttcagtagaggctgcacaagagatgacagctctttatccagaacattttattccttgtatcgctgatgtacgagatgaagagtatctggcccgtatactacctcaactggctaaggatttcggtataccgagtcgggtagtaacgtccgccggctatgctcagtttggcacacttgaggacctttctacagaacagttgcgacagcagttcgctaccaatgtagaggggactctaaatgttattaaaccagtgctaccgctgatgcgtcagctggatgaagctcgcattctactggtgtcaagtatgagtggcgtggcgtgctggcctcttctgggagcttatcagatgagcaagcatgcgatcgaagcgatgggacaaaccctccgtcatgaacttgaaggaacgtctatacaggttggcgtaattcagcctggaccttatcgtactggctgggcaacgacttctgcgcaacgccagcctattggttctgaatatgatggtgaggcattaaaaaaacgagccacttgtggttttaacatcgaagatcctaaagctagcttgccttacttctggaggatgtttaacacacctgagatgcctgaaatgcttgcaacgtcagcagagtttgttgacctgatttgcgcgcaggcagaagagaaagttaaaaaatggagagcttctcttgcttaagaataatgatgtgctcagacgctggcaaaaagctgtcgatattttgaagtcgtcttggtcagaaaaagaacagcaggattctttaaagcaaggtgctcaggaagtattaaagggttcaccactgttgcgcatcctggacgaaagcgatctgtatgagactggtacgctacgtgaggtggtcgctgtatgtcgtgagctcggaaaaacagatgcttctcttggctggcttgtaggtgttgcgaattccgcttggtcgatgcgcgccaatttttctcttcctgagggggtgagtgaagacatgcgtgaaaacgccatgctatcaatggtattaggccgtcccggaaagcttaacgctgcagccgatggtcaagggtggtatctgaacggtagctggaaatatgcatcaggctacccctgttcttcacatttcttttgcctcgctgcaactccatctggagaagtgcgtgttgtcattgttccgtcaaatcaattgattgctgtggctgattggcaatcaaccggcctgagaggaacacaaagcgtgaccgttgaggcaagggacatcaacattcctaaagcctttactgttgcatattcaccaattctttcaggaaatgcgctttcgtatagcggaaagggctcttacgcacgctactttaccggcgtattgatgaactgtcttcccgccacactcttgggagcaacagaaagcggcatcagattagtacttaatgaatttaacgctcccattgctggcagttcttataacgctatgagtgattctggtgctgcacgttatgagatcggacggctctgttcaaccttcgatttgcttgtgcgggcagccgaatacaacgcctcaattattgatagcgcagcgcaagaaggcaggatgcttgaaagtgaagaacgagtagcgattcgcggccgggctactcagataatgcgaggttgtgttgatattgttcaggccttgttgtggctgcgaggttcatctgccttagaaaaaaatagccctctggaaaaaatctggcgtgacgtaaatgtcggggcacgacacggtggcttcgccaaacttgtgccagaggagctagaagggataagtgcattgaagggagagctttcttcactgacacaaatgtattgacatattggctctgtagggcgttgttactgcgacagcgccactacacaaacaattataggcgagcaggaatatgatgcagaaattaacccccaggcaagtccgcacaaagttaaagactataaatgattcaataaatcatatgctgagagataattcggaagctatggcggtaaatgatggtgaaactagcttaacgtggaagcaaatgtatgagcgtgcagtagaaatcataagatattttgataaagcgggcatgttgcctggccagagacttgctcttgatgcgcctaggtctatagaattatatctgatggttttagcatgcctgctatccgggatttcatttatttctgtaccaagaaatatgaataagcagcaaaaataccagtttgctataagcataggttgctcaggaatctgctcgtcattatgcaaatttgaggaattacaaagcacttacattggcgagtggtgtcttggtgtaacaacccgagaatgtagagcttcatatagcaatgaggtgtattgtgtaaggacatctggtaccactggagaaacctaaacttgtaccaattcacatcgctcaggttaatgcatttttgcagaatacccatagcgaaatcccggtaaagaaaaaaattaactggtcgtggattcacgatctaacttttgacttttctatctgggaattgtttggagcactgagttatggtggatgcctagtagttattagtgaacagataaaacttgatccgaccaaaactcgtgagatattggaaaaatctaatgttcacttgctatctgtcacgccctcagaatttcgctacatatttggtagccagtctccggcgatttttaaaaaattatgtcttaagcagatggtgttttgcggcgagaaactgacagctgaaactcttcgtgtattttttcccatctttaatgagcttaaggttcaattgctgaatacttacggcccttcagaagcaactgttttttgttctgcctggaaggtgagtcaggacgacttaacctacgatattataccaattggcaagccatttccgggtatggtattttctttagaggaatgcaggaaagaagggagtgggaatctagtattacaaggggggcaggttttttccggttatgaaggccgcgaccctatagttgctggttacatgacgggagatatttgccgcagcgataacgatggtgtatggcactatataggtcgcaatgaaggctattataaaataaatggcttccgagttgatcctctggagatagaggagtttcttcaatctataccgggtgtatttgaggctgtagtatggatggaggaatcttccacagcgccggcactattaaaagcttgtgttaacgtttcgagaggaaataatctaagtactcgtgatcttagacgcgcttgcatgacaatgtctccttggctaaggcctgcacaatatttaattatatcccaaaatgagtggccaataaattcacgtggaaaatctgatcgcgcagagataaaaaggaagttttatggagtgtaagcagaaaggtcatcaagttatagttgaagaaattaaatatatgttgaaagaaatggacgtcaggatggatgacaattttaccgatttaggagggaactcaatcatggctatgataattacggataatttgcagaaaaaatattctattaatatagagttagcccaactgctgggtagtaagattggtgaaattgaactgaaacctctgggcaagtaaatgaaaatattaagtacagggcatacattatcgcgagccgcacatcttgacgaagttgatcatcctaatcagttacagctagaagcgatcaaacgtgcgggttataagcaattctggactgaatctcagagcgttcgggaaatggctgcctcagctgcacgaaatgcactggaacaattccatttatcttccgaagatgtagggtttattgtcgctgggttttcgggagttcccgattttattggtatcgacttagcctgtcaggttggagcagaactaaattgtaatcagattcgtacactcaacttagttgagggttgtgctacggctgtcagtgtttggaagcatgcatcttcactttgtactgagatgccagaaggtaaatttgggctggtagtactggcgcagcgcatgagcgatactcatcaggacagattcggacttatgaatgctgcgttaagtgatggagcagttgcttgcgtggtaggaaaggcaatcacatatgcagatcagcccggattgcgttatatatctacagaagatatttctgactgccgttatgtagatatgatgcgcatagaatatggtggtggacatttacctttcctacctgaaggaagagatagcaaaaaagataaattaggtcgagagcgaattatggataattattgtttctcatctcaggatttaatgaattttttaattttacgcgaaaataacagtatcaatgtcattcgtcgtgtattggagaaatctgtaagccgagatactcctccttttctactacatactctcgaaggaaaacagagcatagaaaatttatgtaaccgaattggtattccgattgagagaagtaatattagcttgttatcggagttaggacatgtaggttgcgccgacccgctgttgtcatttcgattgatgatgcagcgtgggataatcagtcctggttcagagattgtcatgagtactatttctaccggcatgaaatggggagcatcccttttccggtatgaaaccgctataagtaaggataatgtaagctataaaccagaaaggagtaataattaatgctaacacttagtgggattaatgttatcaaagtaattgttatctccggtcttgccttatggaatttactggaaggcttagggctggtaaaagatttcactggcgcgcaaaaaatggttggcagaattatgaatatggaaatgattgaggcaccgcctgcggttcctacaaatttaataacccgccgcgttggtcatcctttctggcataaatcaggtgcggcagtgctggtattgtttaatttttcctgcgcgctgctccttttaattgctgtgtccaatatatttcgtgaggcattcagccctgccgggattgaatcatttattgaatggggtaattatggtctggctgtatttataacaatgggtttttccttaagtttcgtcggtttatggttcgcctattacataaagcagagtgagttaatgattactcactttttacttatcattctgggggtagtagtggctgggtttattaacctttcctaaatgttcatctgtcgctccttgcttcatatttgattttttttctgattttttaatgaaggaatgcggagtaagattaaaagctaattggtactgaacaatacggctgacggtattccttggaagtgaagggccatggcctagcgctgaccatgagttatcgcagccgtatagtataataatcaattaattccgtaccatctgattactgcgttttgataaccctattcttaacaactgttagtatagtgttgaacgatgttcagattatttagcgcgcgcctgaacagcgtcttgcaggtgcctcgtatctctgagtgacggacaaaaacacctcgtttttaatactgtaaaatgcggccggctggccatatttatcgagaaattgagtggcaatcatgtaatcaaaggctaattcactctgacagaggggcagatgcgatgtcatcgtcaacgtgaatcagcaggctgtattttgacgtgcgagcttcaaaccagacatgacgcgctcctataatctggatgatttcaccgagggtggtagatatgggtctgatggcatatgtgtaggtttccagagcccgtaagtagtcatccagcatcgttgcgtctctgtggagatattaatctcataacgctccagtaattttctgtggcaagtagatatggacccgaaactggcataatattcgtctagcagcgtcagtattcggtaacgaagagtctcgtcaatccgatgcgtgccaggcagaccgcgtcgggcgttgatcagtccggctgaaccagattcgcgataacggttcatcatctgatggacttggtgctctgtaagagccagttgagagaccgtattacggcgattcagacgtttttcaataacaaccagaatgctgggaatatggtgaagttattcgttcgacatgttcatcagcatcagcatcagcatcccataaaaggtggcgaaaacgaagtaaacgggtgaaattataaattagccaaaaagtgatattatcaaatcgagactattcgttaaatcgcaaaatattatttatgtttgatggtgcaagcggtacattctgcgttgctgtaacattctgccttccctaattaattcctggaaaaattttttcaaaaccaataattcttcaataaaatccatgacagacatgacttcaattttttttagtatggagctaaatattttagtaactttgccgataattaatgatgagtgcgcttttttcgttaaactattgaggtgtgaagttgaatcataaaaccgcgaatgcttttagagagagttacctagaagctcaagcttataaaaaagaacttaatagaagaaaattgataaaactatattcttatattccaaggattgttaaaactattttggtttttatatttttgctttggtcatcaactcacttcttaaacaataatgctgttggactagcatcagtaattttcgatttattacctacaggagattcttctttattttttatattacccgttctgttggtggtgtttgctggattgattggcgtgctttcaaatagagatactagtaaaacatcaaattcattcattgctagtgctcgtaaaagattgagccttcttgaagaggaattagcttcttataaagagcacaatgacaatttgcagggggatttgtcgaaatacctcaataaagaacataagaaagatttatacgacatgattcacgagtcgataaaatctaatgtcgttgatgattacattgaagatttaacttcacgaattaagaagaataattcattagctagggtggaagattactttgttgacattaaagacaggcttgttcaaaggtctaattcattgaatgtcacttccaggattaatttatttattggtatcagtattgcgacaattggtataagtatcttgttgtattttgtctttaatatgagttatcttaaacaagaaggcacactaatattcgttgagttgtcatctaaagcttgtgttagtttggctatcgagttgttatcttttttctttctcaatttatataaaagaaatttgcaagaaataaaatatattcaaaatgaaataactaacattgaggctaaaaaggtatcattgataatgtcagcagagttgcctgataaatttaaatttaaaatattagacgctctgtctaaaactgaaagaaacttcatactggaaaaaggtcagtctactgttgatattttacagaataagaatgattcaacagcagttttaaatggtatgaaaatagcttttgattatataaaatcaaagcctagtaagtaaaccatgctgtggtttcttatagcccttaatggtttattgttaagggctaggaattagtttttaattatatttttattcaattatttataaatttccataactaatgcttgatttcaaatctacaactttaattaaatgcccttattaaatccttagcatacttcagtctaactacatacttgtggagttacaatcataaatagccaatgtttaagtggcatagcgcctaatcaacacactttactactagctaatttttacaatcctaacttcatataataagagttttatgaaatttgcggagctcgcctcatctattgtcccggcgagtaatctgaatcctagacttacataattatgcttatataaggccagacagggcctcagaaagcctgtatcatgcggatcggggctggatcctgaactttacggccatttataagaaacggcggcgtttctggatggcgagcggctgaacgacaccttttcataggtggttaaaaagcaggcgccgctacgtaaaatctgacgggtattgctcctgcttctttttcagaattcacgtagcgctgccattcagttaacaggtgcaaacggagcaaaaatgaacgatatctccggttttaaaggtatggctctcagcggcagcaccggtgatgatctcaccgcgaaactggccgcgttcgtccgccatcgggaggccttttcggccaacacgtggcgtcagctgctgagcgtgatgcggatctgctggcgctggtcgcaggagaatcgccggtcctttctgccaatgacaccggatgacatgcaggactacctgtttcatctgcaggccactgggcgttcgacctccaccatttcagtgcacgcggcgcttatatcaatgttacaccgtaacgctgggctggtaccgcccactgttgcgactgacgtcgtgcgcgccaggaagaagataaaccgcaccgcggtcatgtcaggtgagcgcacagggcaggcagcgccattctgccggccggacctgaaccgtctggatgcagcatggagtcattcccccccgcctgcagcagctgcgcgacctggcgtttatgcatgttgcttacagcacacttctgcgcatgagcgagctttcccgtctgcggatcagggatatctcccgagcagcagacgggcgtatcattctggacgttggctggaccaaaaccatcctgcagtcaggaggcattgttaaggccctcagtgcgaagtcatccggcaggttaagcgaatggatcactgcggcgggtcttgccggcgaaacctgacgctgttatcttctgtcctgttcatcgatctaaccgtatcgtcagggtgtcggaagtccccatgagcgcaccctgcctagaagatatttatcgtcgtgcacgtcaggctgcgggtgagacgaagcctcttgaaaccaataaagggcgctatgcaagctggagcggccacagtgcccgcgtcggcgccgcacaggatatggccagaaaaggcatatccattgcgcagatcatgcaggaaggtacctggacgcagactcagactgtcatgcgctacatccggatggtcgaagctcaccggtgtgcaatggtcatcctgatggaaagcgatgatgaatagctgacaaaacgctctgcttcagagatccaatactgatttttcctgactcaaatatatctgtgctgatgatagaattactcttctacattgcaggcttcagctgacgtatgacattacgggaattaatggcagtcgataattatgggtttttaacctgtctggttttcgatgatgatagatgcgtgaaatgtcaaaacgttatgttgaaaaggccgctgcgaaaataaaaaaccgcagcggcctctttagcataatgtcattatgcgtaccattttatttgttttctattgttgccaatgttccatagtatgtcatatacatgtatgtggcctctttgaattgtgctgtgctcgtagatatccctactccatatataacattaccttcagctgatgcagaatttataaatccttcataagcctcttggtgttcattcctatttcgctcacttatatttcttatcaaacctttgttcgatatttcaattctatgagtgtattccacaaaaccatgaaccttaacggtcttgtaaatatctggaattactgatgagcttaacactaacatttaaatttctccttgaaatcatatcgttataggtacacaatctcactatgaatatcatctaactcgatgatttcaataggcattgggctttctctcacaactccatcaatgatttttatgttactccatgagtaccaagagttgggttcttttctaccgcagtttctagaaccatcctttacgaacagtaccttatcctccatattaaatctagggcttatatctttatataacccaccttcatttatgatcgcgtggaattcagcctcaataaagttatttcttctgtcttcccatatcatccaaccatacacaacctcacagttattttttgaagcatagtcttcacagttattaaaacagtagccagctcgtgtattttcaaccttagtaaggtttaaataactaggcgaggtggtaagctgaagatacttcattaagccttttatagctgagtttattttgattggtgtttttggttttaaggcaagtttaatcgacatttaaatcccttctccatgcatcaatttttatgtattccgtttatacgtaccctttttagacaaaggatattttagtcaaggccttttatcatgttatcccatgtcatctcgtcgacgctcaggcaatgatcgtctattttgtgtaactctctgatagttgctgtttttctgtagttctcaagcgcttttaacgtctcctgagcatcaccgactttttcgtataagcttgccttttcggcatcattattccattcgccagccgcttcgtcataacaccagattcgtgttcttccgcgagcaactacaaatccaagaaattttttcttcactgacgatgatcctccattatgacactctgttgcttaaatcttcaccgcgaagcggttcggggttctgtgacacccgaactttaccgtagtttcccacggtttttcatttagtttttttcagtttcagcatcttgaggtgctcgtcttttgtaagatgacgcttacttttaactttgtttattgtgcgatcaatgttaattaagtcaatgaaaagtttaataaaaaatatatcttcatcctgcatttcactgatagccgtcagcacgcgcattttgatccctgcttcttcaatggtcaggttttgcttatcgttcacgttaaggtttaggtcaaccttttcgttacttgtcctgacaatcgacagtaaagcagactcacttagcaacgataacaacgccagtgacatcatcacaaatcagcgtcagattcagaccacagttcagattaaagacgggcagacgttgcttctcggcgggctctcggactcaaacagcactgacagcaatcgttcagtttccctggttcgagagtattcacgtcatcggctggcttttccgcagccattcagattctgtcagcgatcgcactatgttcgttctgctgaccgctcacgttattcgcgagctgtgaaattgccaggtggtgcggcagcgcgacctggtaattcagcgaagcgtctttgttgctacgaattgactcatttttgcttgcgcagtggtatctgtcggcggcagaacaggttgatgccggaggcattttagggcgcgaaatacatttttatgggattctgaactcgaaccgcgccgacgccgctaacgaacggctttcatagataacggtacagcgcacgcgccccctgattaacgtctttagcatcggtatttcagaaacggaaaggtatgatggtcggagacgaaaggaaggcacagcgatgcgaaaaaccagttaacttgcatgaggtttattaaatggcacgaacaattgaacaaattgagtatgaacttgaaaaagctcgtcgtgaacgtgatgcatggcaaacgacaagaggtggtgagcataactacgcaatggttaaaatctacgtttcatcactagagaaagcgctttcagatgcaatccatgctcaagaaaacccgtctcaataagatccaaattttgtttcgcataatgtaatttatgttaaattgtagctgatatagtcacatctcccagccgtattgacgctgttttatgattccatcactcatctggctgtgcgaactgcgacgaagaatgattatgcttcgattattagagattgtacgatgaagcagtgtatccgaaaaaattaaaaataatccgaacggctacctgcaggcattgcagaactcttcgccatcaatatagacggttttctgcctgtggtaacatacagcggttatttttcagagccgggactgatgaagaagaagaaaaaccgcacaccaactcctcacgatgccacgttccggcagtttctgacccacccggatgtcgcccgtgatttcatggaactccacttgcccgcagagctgcgtgctatctgtgacctccgtacgctaaagctggaatccggctcgttcgtcgaggatgacctgaggcagtactttagcgacgtgctctatagtctgaaaaccacagccggtgagggttatgtccacgtgctcatcgagcaccagtcttcacccgataaacacatggcttttcgcctgatgcgttatgcggtggctgccatgcagcgccaccttgaggcgggccataagaagttgccactggtgatacccgtgctgttctatacgggtaaacgcagcccgtatccttactccacccggtggctgaatgagtttgaagatccggcgctggcaggcaaactctacagcagcgctttcccgctggttgacgttaccgtcattcctgatgatgaaatcgccggccatcgcagcatggccgccctgaccctgctgcagaaacatattcatcagcgggacctggcagaaactgactgaccggctggcgcccattctgctggccggcgatttcatcatcacaggtgatatcgctggtacactatattgtacaggcaggcgaaacagccgacgccgaaggttttgtacgcgaactggcacagcgtgtgccgcaacacggagacgcacttatgaccatcgcacaacagctcgaacagaaaggcatccagaaaggtatccagctaggcaggcaggaaggccgaaatgaaggcaagctggaagttgcccgtacaatgctgcagaacggtcttgaccgtaataccgtcatgaaaatgaccggactgactgaagacgacctggcgcagatccgccactgacttatttagcggcctctccggccgcaccgctgatccgccaggtacaaacgcctagggctcacggcaccatcgttagttcatatttttctgacgtcagcacataaagcccggaatgcccatcaatagccatctgccatccgcagcgattaagaagcgtttccagcccctgcacggatccggttagtcgcgccatcaccggtgcgacctgttggcccccatcgtcaaatgcagcatccaggctgcttcgggacagataaattccgtttacgccagtgttcaggaccgcggcataccttcccgaccactccctgtcgctgaacagccggtaagcccagcacatatctttcgccatctccagggcatatgtcagacggaacaggtcattctgctgagatagctcgccagtacaggagcgccagagatagtcgagcttgccggcaagctttgcggcaacgccatactggcgcccctgcgttagcagccactcaatgtcgggagccacctcacgggaaaagcgacgctgcttcagggcggttgccagccagcgtgtcagaaagagattttcctgagcagcagagcaaacggtaccgtcctgacgtgctaatgcaagggctgccagagcgcaccaggccagatgaccagatttatgtgtcagcgtcactgtagtctgtcctcctaataaatcatgtacggaaaatttacttaataattggtaaaacaataaatattgtgctctgtatgccgcttagtggcatggaggcgccagatgatgtcagagcaggacattggtcatacggcgccgtacgcccggcgtagccgattacggactgatatgtagcgcgacccaaccccatccttgtatctaacattatgtggtgattagctaccatcacacgaagcagagtgagccagtcccctcccagcgcacgatttaattatcgatcccgtctggcagcttatggccccctttttcacttttcacgccagcacattttgttgagcggttaccgggtgcccgactccgtatgtacaaggctaacaggcgtgacggccattgtgagaggagaaatacgatgtttcctgtaggcatagacgtaagtaaagacactcttgttctctgcatactgtattacgacataaaagaacgcatacggggaaaaaagataaaaaatgaccgcagcgcgttagccagtatattctgctggctgcccctgcagcacagcggacccggtgacgtttacctgaatatggcggcgatgggcgtttaccacgaacgccttgctttgtcgctgcatgaggccgggtcataattttcgctgaccaacccaggtctgattctgaaatgactgccggcatcggctcttcgtgaggtattcatgctgatagcacagataacagatatccacgccgctcccgataatgatcatcttcagcgcttcgggcaggcgctgtcgtggcttgaacaggtggggccggacataatggttcttagtggtgacctgacggatgaaggctgggatgagggatacgagcagatagctgctcaactggaaaaacaggcttacccctacctgctgctgcccggaaattcagacgatcgaaactatatgcgacaaacgtggggtaataaactctggttgcctgactcaccgggagagttgctgcacttcagttataacgcgggcgtaataagcctggcgggcgtggactcaaccgtcagcggacagagctatggatcactttcgggacgtatgggatggctggaaaagcaacttggcgaggctgatggtgctccggttttctgctgtttcttcaccatcacattttcccttccggcatacccactcttgatgaaacgatgtgtagaggactgagtgagtttgaagacctgataagaagatatcctgacaggatactcgctgtttcttcaggacatgtccaccgacctgttgctggcaactttgcggggatcccggcaaatatctgtggttcggtctgtccagccaatccattatggttcgggtcagcgaatgttccgccagtcagagaaaaccccatgctgatgattcaccggtatgatcaggggaaaatcagcagtcaccatgtctgtacctgattatttatcctctgagataagaaagcgttttgcctgacgctttcatctttttctttatattcttctgtctaaagggcagggaaaaattaattaggatctacataaacctcacctgccacttctaaaatataagaaaaacagaggggtaattattaaaaaagcaggaattatgaataaccaatcgtacgtttgcagtaagaaaccaaaaggtgcaatcatgacaaacatcactatcttatttactgtagcaatagtagacaatgtgacagatcgcagactgctatcagtatgcgacaccatcctggcataagaaataatttgaacaaaattgatataaaagaagataatacagaggaaaaacgctgacatgtagatattgttaaaataaagagaagacactgacgaaattataaccaaaaggaagaatataaaatgaaatctagcattagaagatgaaggtaaattctctgtcacaaagcccgttgcggactgtgcaagcataattaaaaagaaaacgatacccaaaattatagcctgaccgtcttccggtagatcttgtcctgctataacctgccagtattgaatgagagactggaggaagaatgaagatataatgacggttaataacgttaacaatcctgtacgacctacgaaaacctgccggataccattacacagcatggtgaaggtaaaaaactttgatttttcctcacttttaaattgacgatcggaaggtaagaaggctgacattaaaaaaatcataaacattaataaagatgatataaaaatagaggacttccctatataaaaataagcagtcgctcctataagagatgttacccccataaacataaactggtatttataatataaggaaaatattttttgggaagagatgttattgttctcatttttactatgatcataaagataactatcaaatgtaccactcatcattcccaaagataaggcgttgaaaagttcggccagcatgaaaaaccaaaaattatctgccactgccatagtaagcagccatgcagaagagaaaagtatactgacgctgattgaaaactttctgctatagcggtcagaaaaataagaaaggggtatatccaaaaagacgataatgattccctgaaatgtctttagcaggcctacctggctaacggaaagaccattctggagcatatatataacagaatatgcaccaatcaacatccttacaccggagtacattatgccagtgaatctgacggctgcactgcttttaagcacaattattctccctacataatcacaaaaactaacgctaccatccggtagcgttatcgttcattcaaggtacaatattttcaccattaacgcgtggaagcaactggaaatcctgaatatcattttctcttgttacccacattaaaaatctttcaatccccatcccaaagcctgcggtttcttactggatattcctctttcattctgatgtaccactcataatcatcaggtgcaacctgatgttcttcgagtgcttttctcaccccggcgccatcactatgacgttcacctgctcccaccacctcgccaataccaaataataaatctgcattcagtgcagaatgtggtttgttgggatccctgcattgatagaatggaacactcagaatgtcatagttagttacccatacaaacccaccaaaatgttctatgagacgccgttctcccgcatgagttaaattcctgaattcacctacgtcttcaatgtagctagtgtaattatcaggggatagctgtttaagtaggtcatcagcttcatctaatgttatttttatgaaaggagtattcttctccgcaagagaaattaaatgagaaatgtcacctaacttttcattcaataagtcaccatgtcgaagcaatatatgtcttgcgagatgaacaagataatcttcaacaagtactatcacatcatttatcgtacccggtatttcagcttcactatggtaaaactgagagaggtggcgtttatcgttatcttcaccacggaaagatggcataatgtaccatgcaccatttccgaataatcttgtaccgtattcaagcataaactgcattgagtcggcgagataaacatcctgctcaaacatttttactttaaccggaagcgagtcactgcctttacccatcgggctggaaatagatccagttgtaataggcagatgaagtgtttttatttttcgcagattgtaaaaatcaaaagtagcaaaagatagtgtattctgaagttccgccaacaattgataccatggcttacccagcactttcagataatggttgcgcgtatctttccaggtttgatctgttctgaaacggctcgtttcttttacctttggctcttttagcaatccatactgtactacatcagttagttcaccatctttgttttttgtataactacgtgcaacaccttcaagtttgaaaccgagtttagtgagcagtttttcagatgcgtgattatctggctgatgattcgcagagatgcgtttgaaattaagcacattaaaagcatgacttatgacaagtccggccgcccgcgttcctactccagttttctccataccttctgtgacaaagcgatgccgagttcggcgctttctctgaaattatcgacatgacttagggtcacagagcccacaacctctcctgaattgcgaagttctaatgcccagagatagaattctttattactgtaattctcaacccatccacttactattgcattagtttcattaatatctttatgtgctttccaggtaagatacttcgctacttcaggatctgacgcccaattctcgtagaccttggctgaatcattttttgtaaaaggtcttaagataatatctttagaatcaattaataaagtacctttgtggttaattcccatgtaatgactccttccgtaatcactcagtgagcctccgttataccaattatgacatttttgctaaaagcagaataactgttaagaatatgagatattttcaaatactggtgtttgatgataatccaattcagcttctttttttaaaggccagcgagcagtgcgcagctggccttatgaatgacgcgctagcctcatgaaggcgccagatgatgtcagtgcagggtacagtggtcaaacggtgccgtacgcccggcgcagccggttacggcctgatatatggcgctacccaaccccttcctgctaagccagacggcctcaaagcgacgataacgtttatctaatcccgaaccccggtgagcgggctggacggcgcagagcgacgtacagggcgtgatttccggggtctaagttttactgttcattatgaacagtaaaacttagaggattagttacaccatccattacagccactcctgttccgggccggggcgggggcggcctgttaatgggcactcggagtttcagaactgatttgcccccagtattagatacaacgatcagttactaatgtcggtttgtttaccttctgattttccatttctccagcctactgcaaattcagctggagtctggtaattcagcgatgaatgaggtcttgactctttatagtcctgccgccagtcattaataattttccgggcatgaagaacatcgctgaaccagtgctcattcagacattcatcccgaaagcggcggtgatcgtcagacactcttttgtgagatcatccacgcagatcaggcacttaatccggcggccgctggcaagtgcattcatgacaaaatccatcgaccatgtcaggttcggcgcatccaagctaagaatcggaagccgctcagtcgccagccccttacggcgtcgcctgcgctttacacccaggccgttaaggtgatagatgcggtatacccgctagtggttgacgtgaaggcccttccggcgcaataacagccagatgcgccggtaaacaaagcgacggcgttcaggtgccagctctgtgatgcgtaaagacagctgtgcgtcagcagcgggacgctgaaccgaataacggcaggttgaaagagacagacctgccagcctgcaggcacgccgttgcgacagtcccgcttcatcacacatgacctccacggggcttcccgcttctatctgaacctcgcgttcagcaaggcttgcaggcagctgatagttgccttgcttgccacggcggcggtcagccatacccagcggaccgtctgtataatagcgctgaagcaggcgacgacagtgcctgtctgaaatacctggacgctcagcagcgagatgggttgtcagccgccggtcgacgacgtcctgaataactctaagccggttaacttcgttcatcgtgaaaaactccgcacaagaagccgtcatatcaggatactcagcaggtagcccgaagcggccaggttagctttgcctgcataagcaatatgcgcataataataaatatgtaaaatattaatgatttgcgatagtgtgaagggttgttgctctctcttcttttcttaaacagtatttgtatatactccattatcacttcttctcgttccctccctgtcgtacggtttacacattgagagaataatttattatctctggaacggtaaaatctacacagggagagtgaaaatggatgctgcactactttcaatgatgcgttcaggtggccgcaaccgggcatgggccgaaacaatggttaatctggaagcgagaaagctggtagaagccgctaacgtaatttcaggctttcatctgcgcgacagcctcacgcgacttcagtttgttcaggagatcagggatgtcgttgagaaacagtttgccgcagcacgtcaggccaggaccgacgaagactgtatagcctgtataaaaaacctacgggaagagactgagaaccttcgtgaacaggatcgcctgctacggatgcagaccgcaaaactcatcgctaaagtggagtttgtccgggacaataacgaaattgtcgggtacgtcatatctgcggtacatatcgttttatccggggttgccatgtttggcgggatgatcatgatctcttccatgatccccatcggtatgctagccggtgccacgctgttcattgacggcgtaaatggcatatcgaaggaagtcagtcatctccgttacggcaaagagtcgcactctgaaggaatttttgcagatggggtaatagaggctgcgcagttcatgggattcagcccgaatacaggaatggcactttacaatgcggctacactgagcgccagtgtttacagtgtttttggtctggcaagaaaacccggcgcgtggcgtctgttccggtggttgccccgtgattattaccggaaagttgacaccatgagcagaccaaaattaacgatgaaaatcgtggactatggcgtcaaagcgaaagtggtttttgaccttctcacgaccgatcagcagagtcgctaatttctgttcgctctctggtatcgccaggacttataagacaacacaggcggttgtacaaaaatggcaaccgcacaaccgcagagcagcgcaattccgccggaaaaaacggtctcgctggagccagcaaagagcaaaaaaataaagatagcaagacaacacagcacaacggtcagcgctattgtgaagcgtctggacagatcctgaatggcatcccccagggaaccgccataactttccaggttgtttttgacttttcgcaggtctgcggagctaaagcctgagcgcagcagggcatcttcacttactatcattgcttttcatccttaaaatgctccagggaacaccacaagatataacaaaaagtggtccggttatcgatcccggttttccccacattgacccgactactattagatgtcatacgtgagattcccctacaaattattgataatattacacctaagtcatcgcacagccaggaaggaatttgtcatgtgttccagctttttcgggttttacggcgtatcaaaacagaccgtagctaacgttttcatctctgccaacacaatatacgtttttgatgccaacatcctcctgacccttattagtagtaaatcctgataagatttgtagccctgtcaaaaataggtgtgtacggccaaatccgccctccctaccgcatcctttcactggcaagatgataaacatcgctgcgctcgcgtttacccagagcaacaacggcaatcaccagctggtcgtctattacctgataaaccaggcgaaacccggacgctctgagtttgattttatagcagtctttaatcccacgtagtctggcagaaggaatatggggattgtcacaacatttcttcagttttttggcaaactgctgctggagagatttgtccagcttctgccattctttaaatgcctcttccctgaatttgacggtataactcacaaaagcgcatccaaatcgacatcaagcagacgctggccgctgcgctcactgaccagcttaaccagtttcctgatcgtcaagggcatcaagcatctgctcataaagctcagctggcacgcaatagaatgcaggctggttgcggttgagaatggcgaccggataaccgtccccggcattaacagtagccattggattttttttcagttcgcttacgctggcactgatatcgcttaaaatcatgtttggcatagggcctccaggactgcttaacaggttttaatattatcagggtggagaccagttaaccagtcatttcccatttacagaattcgttagtgtaaacacttactcgcttcaaaaaaaagtaaacgctaattctgttaacagtaaaaactgttgagtacaattttcgcaaccccctgccgctttcacctctcctctttcccaagagcagcatgacaaacgatgaaaagcaccaaaccacagacaggcttttagttctccttctcaccacggcctgaatgtggtttatgtcctgtggctcaccattcagggcttcaggatgacttttgtccagccattatcacgatcatcgaaatgcttatagccttcgggagcatctgccagtgcaagacgatgcgagataatctgtgccggattggctctgccctgatggataagccttgcgagctgacggttataggctttcacattacactggccggtcttcattgactgacctttaaaccagaaagtaccaaaatcgaaaggcactttaccttctttagccagatcggttgctcctccgggatcctgtggaacaaaaacgcctaccgtaccaatgccgcccgtggctttggttgaagcgacaaggctatttagtgtggcggagttatcctcgtggccatgtttattgcagcattgataacctacgcattcgcaaccacaatccgtgccgcggccattggttaattcaaggattttatttaccgcatcatcacccacaccattgattgccacagcgcccatttgttcggctaatgccagtctgtctggatgggtatcgaccacaaacacctgcgatgcgcctttaatcatcgccgaatgcgctgccattaagccgacagggccagcgccgtaaatggcaacactctctcccgggcgtaatcctgccagttcagtggcatgccagccggtagggaaaatgtccgaaagcataacgtagtcttcctccttttctgacgcatccggaggcagtaccagacagttaaaatcagcaaagggaacgcgaagtaactcagcctgtccaccctcccattcacccatctccgcaaagccataggcggcaccggccgtacccggatttgccgtcagacagtaaccggttaatcctttctcgcaattttcgcagaatccgcagccgacattaaagggcaggcagacatagtcaccgactttaattcgctcaactccgctgccgatttcaataacctgtcccagattctcatggccaaagatgcgcccctgctcgaagctggttcgcccttcgtacatatgcaggtcggaaccgcagatattggtggtggtaatacggacaataacatcggtgggacgaacgattttgggatccggaacgtctttgactgaaacgtcaaaaggtccgttatagacaactgctttcatggtgttctcctctcatgcatgatcagttttgatggcggcgactgcatgactttttgctgtcgcgaccctcatcgtgatgctgctttttccatcaaactgcttgatggaatatgtgagtgtagaacagtttatgaagcggtcgggtgaaacaaacatgctgtaactctttgaaatatcggcgccgcttcgttaaatcctcatttagatcctctgtttatccaggcatcagcaccttaaacagcgcactacttttcctgcctgatagagattatcgagcccccgatttctcttttcatggctgtcaataatgccggatgaacacacggaaacaggcagagtttgtcataacacactccgcctggccctaccttactgcttatccagcgaccaggttgcactgcggatatcgaccttcactggtaacagaccaatctgggtaaacttatcggccagagcctgctgctgcgtgaagacttcaggtgtcatccgctcagccccgaacggcatccttgccagcgcccgttgccagatcggctgcggcagaccggttgaggtggacatgatttttgccgcctcttcctgatgttgattggcccaggtacttagcgacccaagctcatccaccacctggctggcgatttgcggccaggtttccgcaaacttacggctggcaagatagaaggtgtagtgtggcaccaggccttcggcatttttaatcagccgcgcgtgggcgttggtttcaacttctgcgtagtaaggatcccagattacccaggcatccactgcaccgcgctggaaagcggcacgcgcatccgcgggtggcagatagaccggtgtaatgtctttatagctcagccccgcctgttccagcgcagtgaccagcagatagttaacgtcagagcctttattcagcgccacgcgtttgcctttgagatccgccacgcttttaatgggggagtcggcgggcaccacaatcgcctcagttttggggttggcgggagaatgtgccagataaaccagatcggcctgggcggcctgagcaaaagtcggtggcgcgtcgccggttgcggccagatcgatactgccgatgttcaggccttccagcatctgcggcccggccgggaactcaatccagtgaaccgcaatcccctgtttcttaaattcctgatccagcgtgccgcgatatttcagcagggcgaagatattggctttctgaaaaccaatgttaactgtttcgggtttctctgctgctgcctgggtgttgaacgctaatcccgcctgggcggcaataatcaatgcgctaagcaaaactcttttcatctctcattcctgagtctggttgttgtcagcgcaacataacaaacgcgggttgaagcgcttagcgatcaaatgttcgatgcttagcgaaaaaaacgctatggatgccagaccgactcacgtacccgaatggcgcgactcaatagccccagtgcatagaagcggtcagcgatggtctgctgttcccggatgatggccaagttcatgcgctgggtctggtggctgcgccgcgctaaggcatgcatcagtgaaggcgctgatatcccgagttcggtggagagcaacgcagcggcttcagcacggtgtgcatcgatgtagcggccagtctgctccagcgcggtgagcagaacctgcagcagatcgcccgactgcgcggcgaacccgcgttcggcaaggtaaaactgatgattattgacccggccggtgccatcagcgatcaccctgaactgtccgctgttctctgcatcgctgagcagcggatcccacatcatccaggcatccactgcgttgagatcgctgggcgtcagcggatatttgggcggtgcatagacgatgcgcacatcatccagccctaaacccgcttcatccagaatctgcagcagcagatagtgaacgttggaaccacgattcacggcgatgcgttttcctctgagatcgccaatctgctgaaccgggctgctgttcggtaccagcagtgccacgctctgcggcgcggcgggttcccaggcgacataaaccatcgggctgttgctggcctgagcaaacaaggggggaacttcaccggtcgtgccgaaatcgatctcctgttggctcagcgcatgcagaagctgcggacccgcaggaaactcactccacagcacgctgacgcctctatcggccaactgctgttccagtgactggcgcgctttcaggatgccgaggttgccaaatttctgataaccgatgcgcagttcccgctcccgttcgggctgctgattcagagaagtgtcgcgctgacgcagtgaagtgcggcgcggtttaatcacccccagatggcccagttgggtgcgcagcgtatgacgactgatgccaagcagcgcggcggcctgcagttgattgccctgagtgagttccagcgcattctttatcagcgcctcaatcacccggggatagagcggtgtttcgctctgctgcatctgctgccgtaaaaactgatccagcgcctcctctcccggtggcagctcgctacccgtcagattattcagccgcagctgctgcggcgtgaccagcgaggttttgctgagcaggacggcattatgcagggtgttctccagctcgcggatgttgcccggccagctgtagttcatcagcgtggcgacagcatcttcactgagacgtaactgaggtcggcccagacggcgcgcatagagctgcaggaagtgagtggccagcaccgggatatcttcgcatcgctggcgcagcggcggcagcgtgacgctggccacattcagccggtagtaaaggtcttcccggaagcgccgttcacgaatcgccaccgccaggtcgcggttggtggccgcaatgacccgcacattgacctttacagcccgggaggaacccacacgggtaatctcgcgttcctgcagcacgcgcagcagcttcacctgcagcgatgcgctcagttcaccgacttcatccagcagcagcgtcccgccctctgccgcctcaaaccagccgcgatgccgatcctgtgcgccggtaaatgcccctttctcatgaccaaagagctccgactccgccagactctcagtgagggcaccacagttgaccgccagaaatggctgtctgctgcgggcgctgtgatgatgcagatagcgcgccatcacctctttgccggtgccggtttcaccaatgatcagcaccgtcgcgtcggtaggcgcaagctgatccagcacgcttttaaaggcgcgcgatgcggggtcaatcaactcagggctggtaatctgcatctcatttaccgggttaacaggaaagccatgaccataccgcgtggctaacgcggaaacgagaggctaaccggaccggattgttgccaatgcagcaggctgtaactttacctgtcgcaaatgcagcaatatgcatcaagcgaaattatgaatatatcgttgaattaatgagataaatattaagtagcagactggcacgcatcctgctaacagctatataactaaagaatttatgcctatgtattaaattcaaatatcgttataaaggaatctgctaatgagtcatgcgacacaggaaaacctcaacctcttctggtttctgcccacccatggcgatgggcgctatcttggcaccaccgaaggcggcagagcagtcgatttaccctatttacagcaggttgcgctggcggcagataatctgggctactacggtgtattaatcccgaccggtaagagctgcgaggattcctggctggtcgcctctgcactggctccgatcaccaaaaagctgcgctatttagtggccgtacgtcctggcctccaaccgccaagcctggcggcgcgtatggcggctacgctggatcggctttctggcggacgtttactgattaacgtggtcacgggcggcgatccggtggagaacaaaggtgacggcatctttctgagtcatgaagagcgctatcaggtgaccagagagtttcttgaggtctactcccgcctgctgaaaggcgagaaggtcgatttttcgggtgatcatatccgcgtggaaggcgctgaaatcctcttcccgccggtgcaggaaaatggcccaccactctattttggtggctcgtctgatgccgctatcgacgttgcggcgaatcagatcgacacttatctgacgtggggcgagccggttgaacaggtagcggaaaaactggcggtggttcgtcagcgggcgcaggagagtggccgtagcctctcctacggcatccggctgcatgtcattgtccgtgaaaccgaagaggaagcctgggcggcggccgatcggctgatttctcatctggatgaagagactattgccgccgcgcagaagatctttgcccgcatggactcagccggacaggcgcggatgagcgcgctgcatcagggctcgcgagacagcctgcgcattggtcccaatctctgggcaggcgtcggcctggtgcggggcggcgcaggtactgcgctggtggggagtccgcagcaggtagccgatcgcatccgggagtatcaggcgctggggatcgagaactttattttctccggctatccgcaccttgaagaggcgcaccgcttcgctgaactggtgatgccgctgttaccgctggctgccaacgccgaaaagaaacagcgcagcgtgaacaccggtccttttggtgaaaccattggcggcgaccgtcgtcctgataaacaggccagcgccagttaacagaagagaaggttcgcttatgtcacagcagcagatagtcattatcggcggtggttttaccggcaccgcgctggcgattcatctggcccgggctggccaggcagggttgcacgtgacggtgattgaaccacgagcgcagcttgctcagggtgtggcatacggcaccaccgatccggcccaccgcatcaatgtgccagccgccagaatgcagctcgctggggatgaggagggcatatttgaccgcgactatcgcgcatcgcccgcctttcaggccgacccggacgcgttgtggcgtgacggcaatgtctacccgcaacgcggggagtttagtcgctgggtcaatgcgcagtttgtgcatcagcagcagcattcgccggtaaaacttagtcatctgcgtgacagcgcagttgcgctgcaggatggcgtagtcaccacagcctcaaggcagaagatccgggccgatcaggtggtgctggccatcagccatccaccgccggacctgcctgcgctgctgaagcccttacaggggcatccggggttgattgccaatccctggcagaatggcgcgctggcacaggtcgcacctgacgatcgggtagcgattatcggttcagggctgaccatgtccgatgtggtggcatcgctgcatcgccagcagcatcgcggagagattaccgccttctcacgccgtggacagctgccgcgagccaacctgagcggcagcgatgagagctacaccctggattacagtcagccgcagcccgccagcgcacgtggctggttacatcgggtgcgtcaggaggtaaaacaggcagccgcgttaaatctcccctggcagctggtgctggatgatatccgccgtaacggccagcgtatctggcagagcctttcactgcatgagcagcagcgttttctgcaccatcttcgcccctggtgggatgttcaccgctaccggattgccccgcaggtaagtcagattctcaaccagcagcaggcgagcggtcagttgtcactgctggcggcgcggctgatgggcgcggaagcgatgggaaacaatcttcagctgacgctgcgccggcgtggagcgcaatcagaaatccggggggtggataaagtgattgtcaccaccgggccagcgcacaacgcactgcttaaaagcaacgcgctgctgcgccagctccacggcgacggcgtgattcagcccgacccgctggcgctgggcattcaggttaacgcgctgtcacagacactgaatgcgcagggtgatgctaatcctcatctctatgtggccgggcctgccgcgcgtggtcgctttggcgaactcatgggattaccgcaggttgcagaacacgctgagtccgtagcacggcagctactctccaccacgccgctgcccatcagcgagcgatgtcccggctcactcatctactgaatcacccttccggaacaatcactaaaaggtgggcggcaagcgattgccgcatccgcccaggagtcgctatgtcatcgcaacgtgaaattcgcctgaatgctttcgatatgaactgtgtcggtcatcaatcgcccggcttatgggcgcatccccgggatcgttcctggcagtacaaagatctggagtactggaccgacttagcacgcctgctggagcgcggcaggtttgatggactgtttattgctgacgtgcttggtgtctacgacgtgctcaacggtaataaccaggccgcgattcggcacgccacgcaggtgccggtaaacgatccgctggcgttaatcacgccgatggcgctggtgacggaacatctgggctttggcctgaccgcctcactgtcgtttgaacacccctacccgtttgcgcggcggatctcgacgctggatcatctgaccaaaggccgcattggctggaatattgtaacctcctatctggaaagcggtgcgcgtaatatcggacatcaggcccagaccgatcacgatgcgcgctacgactatgccgatgaatatctgcaggttatctataagctgctggagggaagctgggaagatggcgcggtcctgcgcgatcgtgaacgtcatattttcagcgacccgaataaaatccatccgataaatcatcagggtaaattcttccaggtgcccggcatccatctgtgtgaaccttcgccgcagcgcacgccggtactatatcaggcgggcgcctccagccgcggtaaagcgtttgcggcggagcatgccgaatgcgtgttcgtggcggcaccttcgaaagttctgctgaagaaaaccgtgacggatattcgccggagagccgctgaagcgggacgcgatccccgctccatactgatcttcaacctgcagacagtcattgtgggtgaaaccgacctggcggcgcaggccaaatggcaggagtacaaacgctatgtcagttacgaaggcgcgctggcgctgatctcaggctggaccggcattgatttcgggcagtatcagccggatcaggtactgaaacatctgcacaccaatgcgattcagtcggcggttgagacattctccactgccgatcccaaccgccaatggacggtgcagggcctggcagactgggtgggcattggcggatttggtccgctgctggtgggcagcgccgaaacggtggccgatgagctgcaaagctgggtcgaagagacagacgtcgatggttttaaccttgcctacgccgtaacgcacgaaacctttactgacgtggtggaactgctggtgccggaaactgcaaaagcgtggcgtctacaagcaggagtatcagcccggtacgctgcgtgaaaagttatttggccaggggccgcggctggcgtcgccgcatccgggtgccggttatcgccggagtgcggatgtggaacagcgagcagccagggtggaagtttcataacagagacggctggctgcccggcatgaataaccggcgcatagcaaggtgcaaggagacaagagtacgtcttgtcgccggttaatggacaggcattaccggaccggtcattgctgttaaccgttgctaaacaggtctgccatatactgctgaaacttcaaccgtttcagcagtataaaaaacaacatttcgctgaacactaccggatgaattttaatatttcatgcggggtctggcgtgggtgaaatataatcctatcttattgaattaattataatagttatctgattttgttggttgttaactatgccagtaattcatataaaaccctcgttacctgctgaatataataacgaggatacgatgagtacattagaaattgacaacaccttaactgctccaccgcctcactctcaaccggttcgatcggtgagtgatgtggcccggctgatcaacagtaacaccgagaaaaacagctatgcgcgctggattgttttcctggcgctgggcggcgtgtttcttgatgcctacgatctcactaccctctcctacggcattgatgatgtggtgaaggagtttggtttaaccccggtactcacgggcctggtgacgtcgtcaatcatgatcggcaccattgtgggtaatctggtcggcggctggctgaccgataaatatggccgttactcagtgtttatggcggacatgttgttttttgtcgtctccgccattgcggcaggtctggcccccaacgtctgggtgttgattggtgcccgttttctgatgggcatcggcgtcgggatcgatctgccggttgccatggcctatctggcagaattctctaagttctccggcaagggcaataaagcatcgcgcctcgcagcctggtgcccgatgtggtatgccgcttcgtctgcctgcttctttattatttttgcactctatttcctgctgcccgccgaacatatcgactggctgtggcgcgcctcgctgctgtttggcgccgtaccggcgctactgattattgcggtgcgcagtaagtttatgaatgagtcaccgctgtgggcggcgaatcagggcgacctgagcggtgcggtgcgtattctgcgtgactcttacggcattgttgcgcatgaggagccgcccgctaaaaccgatgcggtgaaagcgaagccgaaagtgcgtttccgcgtactgtttcagaagccttatctggagcgcacggtcgtcagtgcggtgatgaacgtctgtatttcatttgaatacaccgccatcgctttcttcctgccctctatcctggcgcaatttctcggcgcgggcgtatttgaaactatctctgcctcgctgggactgaatgcgttgttcgcctttaccggcgggctgttggggatgcgactggcgtggaaatttccctcacggcatgtcgcaatcgccggatttgcgctgcagtttatcgcgctgatttcgctggcattgattggtcatccccaggcgacagctggcgtggtgtttgcggtgctgatgctgggtttgtggctctttgcagagggattcggacccggcgcgcagttgatgatctatccggcgctctcctacccgacccacatacgcgccaccggtgtcggctttagtcgttcgctctccggtgtgggcagcgcgctggcgctgtttattctgccaattttgcaggcgcgttacggcaccaatatgttctggattgtctcgctggccgcccttatcccgattattttcctgttaatcattcgttttgaaccgacccgacaggacatcgatgaacaacccgactcaggagaggatcatgtctgaattaaatcgtaccgaatttgccgaactggttcagcatttcaggccgctgtttcgcccgcatcgctgagggggcaagtgcccgtgaaaccgaacgcacactgttgcatgaaccgattcgctggctgaaagcggcgcgcttcggcaccctgcgtatccctaaagaagaaggcggctttggggtttcgctgccgcagctatttgctctgctgaccgaactggctgaggcagattcgaacctgccacaggcgctgcgtgcgcacttcgcatttattgaggatcgcctgaaccagccagccagtgaggatcggcgtcgctggttccgccgctttgtggacggtgagctggtgggcagcggctggagcgagatcggcgcggttaagctgggtgaggtcaacactcaggtttctcccgatgaggggggatggcggatcagcggtgagaagttctacagcaccggcacgctctatgcagactggattgatgtctatgctcagcgcgcagataacggtcgtgacgtgattgcactggtgaacacccaccagaatgaggtggagcgcgatgatgactgggatggcttcgggcagcgactgaccggcagtggtacgacgcgctttcatcaggcccgggttgaactgccccatgtctatgatttcagtgagcgtttccgctatcagacggcattctatcagcatgtcttactggccacgctggcgggcatcgggcgggcggtggtgcgcgatgctgctcggggtgtggcgcagcgtaaacgcatttacagtcatggtaatgcttcgcaggtgaagcaggatgtgcaggtgttgcaggtggtcggtcagataagcagctgggcatgggcagccgaagccgccgtcgaccgggcgacccactcgttgcagcgggcatttgagctgcaacttagtggcgcagatgaggcacagcttcatgcggcaaacgtgctggccgaagtagagtccgctcaggcacaggcggtggccgttgagctggtgacgcgtgcggcaacagaattcttcaatgcgctgggtgcatctgatacccgagtcagcaaggcactcgaccggcactggcgtaatgcacgaacggtgtcgtcgcacaatccggtgatctacaagctacgtaacgtgggagactgggaggtgaacggcaccgatccgacctttatctggcagataggcaatggaaatggcgtataaaaccgctgtttcatgggcagatatttacgtttgggaattgatcagcctgcaatggaagcaccaaaccgacagatttcattttattcggatgggaaactgacgctggtcatttaatagcacttatactgtccgtgatacaggaaacagacacgctaaatgcgaagaatattaattgccatttattaagtatgagtcagacattattatattcaagcccgaaaatttattttcgcgtaaagggaaaagagccagcatcacatcatgacgctggctcttttttcatcagcgcgtctgttaaggcttgcttacaggctctggcatagctgaagagtgatgggttgagattttccagcccttaccatcccagacataagtgaaggtgtaacgtgctgtgacgtgcgtgttatctttaaaagtaaatgtataaacgccggtatcaatcgctttattacaaccaattctgatagtccgggaatcaattttaccgctcggcccttttttcaggaaatctttaaaataatcgatacgttcctgatcggtcagacgtacctgatttgaaatggtcggcagcaaaacggcatcgctgacatataattcagagactttggttgcatcaccggttgccagagagtcattccaggcgtcaaacaggttggccacatcctgctctgaggctctgacacaggtcactgactgttgtgcctgcgtaacaactggggcgcaggaaagacctaaaagacacagcgataataacgtttttttcatgaaaatatcctcatatttaccctgggtgaagccagcgtttctgtgcgttcttccagacgccgccataaaatgtgtataactcgttaatacgtcttaatccggctgatgagccagaataatactgctgcgataaatacattagccgctttattcgattaaaaagctgatgcatatacttatcgacgcttttgatatgcaggggaacaagatagatgaaaggaagtgctgtctggtatttaaatcggcgataagctgttatttagttttttgttctgagggttaatgcctggatctcttgtggtagcgtaaatgacatgtcgcctgttcagaactatgaacgtaatatcgggaagttgtgtttaatttatgtactctataaaaattttaaaaggatatttcctttgagcagtgttatatggaacctttttatgagttattaatttaactgactaactaattaaagtcgtctgccatttttcaacatctctattttgatgctcctgctcattattgcgctgggaaaataaagcatcgtgatgcgctgatttaattaaataatgattaaaccgttcataccctggtttaaacgcgccttagtttgagacattttttttgcatcgtggtttcacttgaacaactcgcagtgagttacgttcagctatcgataaagcgtgtgacctatacctaccctgactgactgcgatgagcgtcaatccgttaaaagccagacgggatcggttacgccatactaacttcgtataattgttcttatacgaagtcatgacattgggatggtgccgggttaagatggatagcagtaaagttcgccctgaaaatgacaacgctacgtaaattctgaccggttatccccctgcttagttctcagaattaacgtagcgcgatcaccggcgtctttggttgataagtgagcaaatatgagtgagttagtgccgttaacccctctgacggttgaccggaatagcgatatcaccgagcggctccggcagtttcgttcaggataaagaggctttctcacctaacacctggcgacagctgcttagcgtaatgcgaatctgcaatcgctggtcggaagataaccagcgcagcttcctgccgatgagcgcagacgatttgcgtgactatctctcttttctggctgaaagcggccgggcctcctcaaccgtcacttcacacgcggcgttaatttcgatgttacaccgtaacgccgggctgccggtgcccaatgtctctccgctggttttccgtacgatgaagaagataaatcgtgtggcggtgatcaacggagagcgggcaggccaggccgtgcccttcaggctgactgatctgctggcgctggatgaagaatggtcaggttctgataaccttcaggcgcttcgcgatctggcttttttacatgtggcttatgcaacgctactgcgtatcagtgaactgtcgcgtttgcgggtgcgggatgtgatgcgtgccggcgatggtcgcatcattctggatgtggcatggacaaaaactattgtgcagaccggcggattgattaaggcgctcagcgcccgttcaactcagcgactggaagagtggattgaagcgtcagggctatccagccagcctgatgcctggctgtttactgcagtacatcggtctggccggccactgattggcgaaaagccgatgagcacaagggcactggaacagatatttagccgtgcatggcgtactgccggaaaagagggcgcagtgaaggccaacaaaaatcgctacaccggctggagtggccacagcgccagggtaggagctgcgcaggatatggcagataaaggctatccgattgccaggatcatgcaagaaggcacgtggaaaaaaccagaaacactgatgcgctatatccgccatgtggatgcacacaaaggtgccatggtggagtttatggaacaatacggtgaccctgattatcctgactgatggcctcctgaaaagagaataaagcccttattcaggctgaagttatccacagaaaaagtggacagcctgtgtgtaagccggtacggattatcactgtgttggccatccacagagctcatccggctgatttagttgatttattcttactgtcataccgcatgctgcaaatctgtctgcaaaacaggagccgctatccataataagggcatgctgcagtgcatggtcagatctgctttggtaaacatctgccttcaacgggcaggataatgcttctggccgggttaattgtcatgcagcctttgtcactgctcatacgctaatcatcccaccattctggcttcaaattcgtaagaacaatcaacaggacaatcctcacctgtccgctgcggccaggaatcgccggcagcggaaagagtgaatgtcatcagtacttatttttaccgggcaaagcctttctgcttatcacagccgccgtggcagccgctgcaactccccttttcctccctgagcatgaccggtattgactgcacccggcttcccgcttttcgcaatgccagcaggatgattccgttcagcaccagcacaattatcaggcaggtcgcactaaatgcaggatggtcggcaaaagtgacggtctggtaaaacagcgtggcggtggcgtaggcaatattgagtccccagaagaaggagaacatcatccattttttaccggcttcccgcgcaatagcccccatgaccgagacgcagggaacataaagcaggacaaaaattaagtaactgtaagcggcaaagccactgccaaatttggctgacatcacgcccatcgaaccagtcgccatctcaccatcgcctttactggcatcgatgggatgggccagcgcatcaattctgaaggcagccgttaaccccgcccaggtctctgtcagcgcctctttaagctcaccaggcaggtcaaaagcctgcggatcaaatggactgctctggattgcctctgtggtgtaaaggctgttgagcgtgccgaccacgacctctttcgccatgatgccgctcaccagccccactgttgcctgccagttatcctgagtgacaccaatcggcaacagcacgggcgtgatcgctttgctggtcgccgccagcgcagagtggttaatgtcattaaccatctggccattaaaggcaaaactgctcagtacgccaatcagcatgctcaccaggataatcacctgtccggctcgcaccacaaacattttcagccgttgccaggtctgcaacagcaggcttttgaggtgaggccggtgatagaccggcaattccatgataaacggcgaggcttctccgcccagcagggtatgcttaagcaccagcccggtcgcgatggccaccacaatgcccagcagatagagggagaaaaccaggctggaactgtgggtgttaaagaatgccgcagcgaaaaccgcaaaaatcgccagccgtgcgccacatgacataaaaggcgcaatcaacaccgtcagcagacgctcacgcggtgtatccagcgtccgtgtccccatgaccgacgggacattacagccaaagccgacaatcagcggcacaaaggattttcccggcaggcccagtgactgcatcagacgatccatcacaaaagcggcgcgcgccatgtagccggagtcttcaaggaaagcgaggaacaggaacatcaggccaatctgcggaatgatcggcagcacggtattgataccggcaccgataccctgcgccaggaaaaccgtcagccagtcagggaagtggcagacatagcccagccattgcgcaccatgaatgaatatcgccaccgaaactgctgtcgaacaatggctgtagcgcggcaccaatgttaattgaaagaacaaacatcacatacatcactgccaggaatatcggaatgcccagccagcggttcagcacaattttatcgatcctgcgggtcagaccggcgggcattgcgtgatgaatgttactcactgccgcgcaaagtgcattgatggtgcgatagcggtaatcggcaatctgtacaccggtctctccaccggcctgctgcataatctcgggcaaatgcggaaccagcgccggacaaagtttctgactgttgatatccccttccagcagttgcaaggccagccagtagcgtttttgtggggctatggcggcgggcatctgttggcagagcttctcaatggccgtttcaatcgcggccggataacgtacccgttcaggtgcgcggtaaatatggggctggtcaatcagcgctttgagctgggcaatgccatcacctttggttgaggtcagtgaaatgaccggacatcccagatgagctgacagtgctgcgacatcaatagtgatgttctggctggcggcaatatcctgcatgttcagggcgacaatgcagggtacgcccagttccagcagctgaaaggtcaggaacagattactttccagactggaggcatcgacgacgttaatcaccacatcggcgtgatcctgatagagatactggcaggcgatgctctcatctatcgagctttcagcagatagcgttgtcagcgatcgggtgcctggcagatcaataagcctgacatctgactgcgcggtaaaaaattgaccctctttgcgctcaaccgtgacgccagcccagttcccgacccgctgtcgggcaccggtgagctggttaaacagcgtggttttgccggtattagggttaccaatcagcccgatggttatcttcttcatcagacgatttcctccaggatgatgtcatccaggtcacgctgccgcaccgccaggctgacacggcgggtagagatctgcaccggatcgcccattggcgccacgcgaatgacctcaataactgcgccgggaagcatgcccattgtcagtaatttctggcgcaaggcggaatttaccgatggctgatagccaaggattcggtaggtactgcccatattcattgccatatcacgccctgcctaaaagtaagaagcactcattctataaatgatactcgtttcggtttttgatctggcatcgggcaggcagaagaaaactgccgtcagggtcaacagcaggtcaacagcgcattaaatgggggttcttccaggcgcgggttcaacagttaaaggcggatgtggagaagcactctagcagagagcttccatttagttacatcattcaatatgccgtaaataactattacggcccttcgggccgtgcggggcggctggtcaatgagcactcggattaacagaacggctccgttcaggtttaatcaaaaaaaccaatctgccaggatagcgccggtaacgtaatctgctcaaatagggtgttgtaactaattggcggccgctgtaatgaaagaaaggcgtcctggaaggatcattttcacaatggcagtgccctgattttcaggccaccgccaggtgatgagcgaataaggattacttaagaacccgaaccgtttttacatcaatctcaacactgttccagtctttatcaacttcaccttcaagacggactttatcactcggtgataacgattgtcccatccagcgcttgtcatcaatatcgacattaatcgttccggtagcatctttgaactcataaagttcatgcccgacttgtctgatgatgttaccttccagaaacgacccatgcgtcatcacgcagcgtcttaacctgagcgacagaagagacgccgggtgtcggacctttaaatccgccctgagaatacccctgccctgctggattaacaaaaccttcctgtgcagaaactccaaaactcataccggcaaacaatgctgctaaaagaatctttttcaaatttatctccgttaaaattgtcgggctaatttacgatgcagatcttaacgggatcttaagaaaagtgattacctccatgtgttttaaaaatgtaatgagcatgatgagcacgataaatccgcatcagaaaaacaatcaaagttaaatccatgttgttaaaaaaataaattaatagataaacagttacgtgagtggtgaacttttaacattcactgtattatggtcattgttacgctttcactttgcatcatttcatataaattccatagctaacatgtctgttaacggatattatttcctggcatagatatatcccagtattaaaacattatgtatcgcagttttgctcattaactatttttttctttttacaaccactcaactgagtggttttttttatgcctggttcccgatgatagtaacagaaacccagtaacgctgagtatgcagtgtatcgacaacggctcccattcggaatgcagccctttctggcattaaaagggtaagaatgttgcctgatactgtctgaaaatgcataaaaagaagaggagagtggtgatagcctgatgcccacccaaactgacaagagataaagggatatgcggaatttaccgatgttcggagattcgccagcgtgagcctacgagtaaatcagtttaattcagtctttgagcattagcctgttcttctttcagattcatttttgcggattcgagcttaagtttcttttcctctaccttgctggttttcttcctgattctctcagtacaaccttctgccttcgcttccgcaagtactggtcgcaaaacaatcaatacccgccatggttgcatactcctgagcaacccatgatattgatccagatcattatcatcctgataaagaggcaaacagccggattgttagcatgtcgtttaacaatcacagcgaataatgccgcatcttcttaaaaagaaacgacaggaaagtaaaatgacatcttttaatactggcaagaaattcgcttttgctattgcgatgataacttctgttatgtccctttccgcctgctcaagcaattatgtgatctccaccaacgatgggcacatgattacgactcatggcaaacccgcaaaagataaagaaacaggcatgatctcttataaagacacggatggaaacatgcatcagttacaacagcacgatgttaaagagattgtgcaaaagtaaacctgctttaatagcactcttaatcattatcctgaaaatctgattctgtgggaaaactgagcaatgaaaatttctgtaattggctttggcttattattgtgtgcatcctcctctgccatggccattggcctgaatgccgaacaaagtaaaaacacctcagtactggacgcagaaatcggccgttcatccggcgggctttatgttgatggccagtggatcaaaaatacagcggatggtgttcagattggtcaggcgggtaccggttataaccttgaaattggaccggtgatgctgacggctggcgttaaagccgcttacatcggcggcaaaaaaggagataacggcgttgcgtttcctgttggcggcggtgtgaaaatcaatctgcccgctaattttgcgttgtatggagaaggttattccgccccggaacagctgaccaacagcgttaagaatttcgttgaggccaatggcggtgtcagctggtcacctgtggatccactggttttaaaagtgggctatcgctatgcgggtgttgatggcaaagatggacgtccgggtcataccctgatcgatggtccctatatcggtggcggcctgacattttaacgtcggatgactcttccctttttttgtggtgaggaaaccctgccgatcggtttccttactcaatcactcgtctcaactcaggcggggagcactgagaaacagattatgaaacctcttatgctgatgttatttactctctgtctgaccggatgtgtgcagtataaatgggtcaagccagatgcatctgaacagcaggaaacaataacggaaacagcctgtcgggcccaggcactgcgggatttaccccctgacaatgtcgttagcggtaaatacacctcaaaagacagtaaatataaaaccactgacaccgattactccaccagcgacgccaatgaaagccagcgagagatactggttaaagattgtatgtttaaaagaggctggcaacagatcgaggtacagcaatagccccattcccctgactgaggccaggttaatccctggccagctctagtcttgtcagaggtcaggttcaggttttatttctgtatcatcctcttgccgatcagtacgctgccgccggcaccgtttccgagcaatacaacacctcgtcccagcatcgttcccacttttttcgccatgacatcggtttattacacgttttacagtagcgaaccggtaatgactttttattgcctttgaacacgccagtctctcctgataaccccttataacgctgacaatagcgtctcttatacagtttagcttgcttgtgagtaagtattgagggcaattgagaacgcactgtttaccgcttcatcggcgcataaggcaatatggtacccggatgatgtggctcaggttgccttgattagcggacagcctctctggccccatacggcggctaaaaagtcattacacccgtaaataatcaatccagggtcatacaggtcacgcgtgattctgactgttttatccccctttactggggtttgtctctccaggcttttaaaacaaagccataacccgtctggtgatgatcgccttaaccagaacgttatttaagtgataaattaatctgatttcatggccttacatattgtctgaataaatcagccacctgatggttattttttagtaattttgctatgcgtcctttacaaccctattatggtggcctcatggacatatccagccttatctggagaagtatgcacggtgactgcctctcagaacaaagcaggtccgcgattagcgaagcgattccgctggaaaagcggcgtgaaagcccggtttatccataacgtaactaaattattgggcatcatcagatgaggcacctttttgacattttgagcgaagagtgtaaaaaaaagagtaactttacttttgtttaagggtcttacgttaattacagtttaaactctttgagaaagcgattaatatgttggcgttgaactatcggttctgtattttgattcttcgaaggcaagcatcttaaaaaagcaggtctgacgaaaagcatcagcgtgaacccgctctgtattttattatctgaacatgactatggtgactttgatgagtgacactctcaacagcttgaataatatccgtacccttcgcgcaaacgctcgcgagcttgaccttgctgccctggaagaaatgctggaaaaactgtcggttgtggtgagtgagcgacgtgaagaagcacaggcttctgaagcagctaatcgtgaaaaagctgagaaactggcaaaataccgtgaattactgttgcaggaaggtatcgatcctaacgaaactgttaaatggtatgccgactgcaccagccgtgaagaaaaaacgcgctcctcgtccggctaaatatcagtacaccgacgaaaatggtgaggttaagcagtggactggccagggccgtaccccatctgctattaaatctgctattgatgcaggtaaatcgctggatgatttcctgatttaatccagtatgcataatgaaacaccgcctgcatcaggcaggcggttttttcgccataaatcgtcaggctcaagcatctcaattaccggccagcctgtaccctttcctttctcatcttgttattgtctctccatccataatcctgctcaggcgttaccctgaactcaataactgaaaagctttacgcagtcacgcaacaagtaatgggattcattctgttctctcaaccgctttatttattcagcgattgcgtgttgcgggctgtgataatttccagtccgatctgctgaccataagagagctcaagcgtattgccatcaggatcggcaaaaaatgcccagtagccgactggcacaccagattgctgcacgtcgcgtcgcaacacaccttcgagccgagcgagtgccactttttcatctatctcttcacggctgctacaggccacgcctatatgaccaaatggacccagcggcgtatcttcattgttgtcagattgcaccagcaccagcgcaaaaggtcgggttaaatccgacagccacgccactttctgtgcttcaggaatgccaggttcacgctgatgtatcacctgcatcccggcataacgctgataaaaatctacgctcttctctaaatcccgtacctgtaaagcaagatgagtgaaaccggtatcgtttgacatggccgctccctgtttaagttgagcagtcaccatgccacaggcaggattcaggatttgatcacggatgctcagccgctacgttcttcacacatggcctggttacgccctgcccgtttcgcgtgatacaaagcctcatccgcgcgcgctatcagcgattctttttcctgttgtgagtctgaagcaagatagacggcgcagcctgcactcagggtgacgtgcttttgcggcagttccgtggtgagatgcggaatatcgagcctgttaacggcgtcgatgatcgattcagcgaagttcaacgcggctgacaacggctgtccgggcagaatgatggcaaactcttcgccgccatatcgggccgtaagttcgtttttgcggcgggcggcgttcttcagaacagtagccacttttttcagacagtcgtcacccgacacatggccgtaggtatcgttgaaacgtttaaaataatcgatatcgagcaggattaatgacaccggctggccactgcgctccgcgtttctgcaggcattcagtcaggatgtgatcaaaatggcgccggttggcaacacccgtcagcccgtcactctgagccagattttccagtgcgcgattagccgcggtcagatcatcgcgtaatcgggtcagctcaagctgataacgcagtgtatgccgtgcctgacgcagtacaaatgcacccagtaaaagaataacaatcagcagcgccaggctcagaatcagatcatgtacccagctcttgagccagtggttaaacagcgcgcgcttgtcatatcccgcggccaccaccagcgggtatcgctgtgagcggacaaagccaaagatgcgttttttaccatcaagcgcagcggtccactgaccgctgcctttatccgcatgggcaagcatcctgaggaaaagcggacttactgagaggtttttgccgatgtagctatccggcatcggacgggcgtaaagcacggtactgtctgccagcatcagtaccagtacatcgccttcgctaagttcataatagctgtagaaacggcggaaatagtccactttgacggtggcgagtaagacgccccgaaagccgttaaaggcatcgttcacacgcagcgtaaccgggatcaccagctcgtgagtggtgcggctgcgaagcaccgggccgacgtgcagggtatcgcgcgggctggtgcggtgataatcgaaatattcacgatcggaattattgatgtcaggcggtatccggctcatagaagtcgctatccatttcccctgcgcatcatagtagaacaagccgtgtagttgtggcaggtggctctgcaacaggcgcatcgtctggctcagcgcctcgccatctacaccggttgtggcaatctgcttttcgagctcgcgttgcacctcgcgcaaagagagctcggtctgcaaaaatgtatcgtccgcctggcgcgcctgtgacagcgacagattaaccgccgtatcttcagctttatcgacggtttcattccagtcttcccgcagcgtccacacatttaagccaatcaccgccacgctgagcaatacgcctgaaaggataatacttcttagcagcggcgagatttttggcgctggaccctcatttttccggcgaaacttcatgcctgtccttaataaaccctgttgactgatttaagcacagttaatcaaaagcaaaaatgcaaatcccacaatcctgtttcaacaatgataatccgcaattaaccagcagattccgcttaaaatttcttctttattggttcaaccagcaccattaatagaggattaatagcgaataagactacactagcgcttcaaatatcacgtgggtaaatgttacccttgccagctgaataatttgcacttcattgattaagttgagtatttgaggatttgttatgagtaagaacctgagcagcctgaacaatatccgcacgcttcgtgcagaggcgcgcaatatggctttggatatgctggaagagttgcgccagaaattagagaccgtggtaaatgaacgtcgtgaagaggaaaacgcgcgagcagcggaagcgcgtgagaaagcagaaaaactggcgtttctaccaggagctgttaatggaagaagggattaacccggcggagctggtgaagagcgcatccccctcggtaaccggcaaaaagaaacgcgcaaagcgtccggcgaaataccgttacaatgacgaaaatggtcaggttcgttactggacgggtcagggccgaacgccctccgtaattaaggcggccattgaaaacggccagtcgctggatgatttcctgctgtagtcgcatttatttctgccggaatagtgaccgtcattacgcgggaatattccggcaggcaaagtcacagacgcagaaattcatccgggcctggtcactcatcgtcctgtcgtaatgtctcatcactcatcaccggatgcggcccccgaaatgtccggcgccactcgctgggagagacgccaaaccgggatttaaaacgctgacgaaatgacacgggcgaatcaaaacccgccttttctgccacacattcaatgctgatgccggtggtttcgagtaatagctggctgcgttgcagacgctctgctgtcagccactctcccagggacatgcctgtcgccttgtgaaaatgacgcgtcagcgttcgcctgctcatgccaagcgtccgcgaaagtgagtcaagatcctgcggctgatgcagattctgtcgcagggacgccagcaacgcgttgatcttactgtctcgcgttgtttccggaaccggccgctcaatgaactgcgcctgaccgccttcacggtaaggcggcaccaccatgcgtctggctacccgattagccatggcgctgccatagtggtgacggatgatatccaggcagcagtcgatgcccgccgcggtgccggcagaagtgatcagacgagtgtcccgggtataaagagcattactgtcgaggtgaacctgcggaaagcgctcgcagaagtcacgctcaaattcccagtgagtggcagcacgatgcttatcgagcaagcctgcataagccagtacgtaagtgcccagacatagtccaacgatctctgcgccgcgctgccaggctgccaccagcttatcaagcagcgtctgcgcaggtttttcagccggattatgccagtagggcacgataataatgaccgcctgatcaagcgggtcaagaccctgttccaccgtaattgacaaccccatctctgagatgaccgggcctggttccagtgcgcagatatcaacatgaaacagatcctgctgcggcagggctgagccgaacagaatacagggaactgaaaaatgaaacggactaaaaccggccgttgccagcaccgcgaccctcagagcagccatcctctcccccttattgtgtgaaagcgtagtgttgagaactcacggcacaattgtgccggtttagtgccacgacgctcagaaacgtcattgtttcaccatcttccgggatcagcacctggtcagcaataccctgttcggtagtccaggctcgcagctctgcgcgcgtcagcaaacagtggttgatcgcctccatgtgtgaggcaaccagcgttgcgtcaggcaggatattcagcgtgcgctgggtatcctcttttcccatgataatcggcccatagagatcgttggttgcattgccgatattcattaccaccacctgcggctgaaaacgttgcagcgctctgacatagggtttgacccatacggtatcgccagctatatagagggttttttcttccggatgggtaaagaccaggccacaggcgtcacccagaatatcgcccatcactttgtcggcatataacgcattgctgccgtgctgaccgtcggttttatagattgtcaggccatcaacaaacggattctcatcctgcagcacgcgaacattttcaaacccctgcgaacgaatcagcgctgcatccgtttcatcctggctgtagatcatcatcgtcttctgcactagctgctgcgcagcctcatcccagtgatccatatgcgtgtgggtgataataaccgcatcgactgccagcagtgcagcgaccgggacaggcagctcaaccatcggatttctcagatggggacgggcatttccggcaaatccgggccaggcctctttttcggccagcatcgggtcgatcaggaattttttgcctgcatagtccagtagcagggtggcattacgaatctgggtcagcttcattttggctccgtaaacagtctcagtgaaatcagccaggcttactggctaccatcaggttaatttacggcactgtttacctgcgcgtaacaggctcaaaggacagtgttcgatggaatcgggccaaactgcactattttcttgtggcagggtatttatcggtgctggcgtcgcgacgaaacagccctgaatgttcagtaatggcaggagttcccgaagttgcttttaactctttaccgacaacgataacgctctctgccgatgtctgtttaaagcattgccggttaaggtattagtagccctggcgggtcccggacctgtgttctgattatcaacctttgacaggagagtctgtgaacgacttatggaaattgcactggctggaggcatcgggtgatgttgggccctataaatcggcaatagtcagggccgctgagctcgcctgcgagcacctctcctccgtgacacgtgtccctcgtctggatattctggttcagtgcatgccggaggcagtaatacctgaaaccggttttgcaggccgggcttacgggcccaccctgttcggcctggccattgacccggcaaatccgaatctgcccgggatgctggaaaatggcacgctggtgcggcatatcgtgcatgaagttcatcactgtttgcgaatgcgcgggccgggatatggctggacgctgggtgaagcgctggtcagcgaaggtctggcgggtcagttcgtctgctggctgcttaaaacggcagcagagccctgggaacgagccatagagctaagcgaattacaggctagtccagtgccgctgaccacgctgcaaagtcctcattatgatcattctgcctggttcttcggcacgggtgactttcgccgatggtatggctatacgctgggctaccagatggttgccgcatggcgccgtgataacgcggaatgcgctacagagaaatggttcagcgtgacagccgatgaggtgattgccgcagggctggctaagggactgctgacaaattgaggataaaaaaatgccgcagcaggctgcggcatttcatttcagattcgcatcagaaatcggctttcagaaccacacgataattggctttaccggcgcggacgtgatccagcgctttattgatgtcagacatcgggaagaactcaacctgtggcgcaatatccgcacgcgaggcgagtcgcagcagcgaacgcagctggcctggtgagccggttgatgaaccggtcaccgctttatcgcccaggatcagatcaaaagcactcacttcaatcggcttcatcacggcacccacggtgtggaatttaccctgaggtgccagcgcagcgaaataaggtttccagtccaggtcgaccgccacagtactcaggatcaggtcaaaacggcctgcctgctttttcagagcttctggatcacggctgttaaccacttcatccgcgcccatatccaggatcgactgcttcttatctggcgttgagctgaatgccaccacttcggcacccatcgcgtgcaggatcttgattgcgatatggcccagtccgccgataccaatcacacccacacggctggttgccgtgatgttgctcatcagcagcggtttaaacacggtgataccgccacacagcagcggaccggcgctcgccacatccagtttttccggcagcggaataacccattgccagtcagcacgcagcttctcggcaaaaccacctttgttcatgatggtcgggatgctgccctgctgacagttaacctgctcgccgttaatacaggcatcgcagtgctgacagctttttgctgtccagccgattcctacacgctggccgactgaaagacctttgttcttagccgcttcgcccagggctgaaacccggccaatcacttcatgtcctgcaatcaccgggaactgagagatgccccactcgttgtcgatcatcgacagatctgagtggcagacgccacaatattcgacctggacttcgacttcttcggctgccagttcggcggcatcgtactcatagagttcaagggcctggccagcctgcatggctgcataacttttaattttcattcatacctctgcgtggttaatcaccgacaagtgtaacaactgaaagcccgccctgcctggtcgttacgcttacaccgcacttttttgtcttttatgctgataaatcaggccttaacctgcgcaccggaaagagtttgtaacaccttgagctgcgcgacggcctcctgcattgcatccatcccctgcgtcagttcacgcaggctgccaagatgcttcgcaatatcagcgcgctcatgtcgcgtctgttgattcatggccgccagcgtatcggctgcactgatactgcgctctgccatctgggcggcggtctgcgccgaatcactggccaccagccggatacgtgagatggtgctgactgcctcaccgatgttactggccgtagcttcagcctgctcttttgaggagtgcgccagacgacgaacttcgcccgcgaccacagcaaatccccgcccagcctcgcctgcacgagccgcttctactgcggcattcagcgccaggatattggtctggaaagcaatattgctgatgccatgcgtaatctcattgatgccgttggaaattttctccagatcgtccagaccatcatccagccggccctgcgcctgctgactctcggtggcgatgttactgatgttacggatactgctctctgccaggctcagggtttctccctggctctgagtggctgtttccagcaccggcagcgcctccatcagcggcgtcagcgcctgctgataagtgataacccgatccagcacccgcgtgtggatgctgttcagcgcttcccagcggcgcaacgctcgctgcgcgtagtgtgccgcatagccggcgtactctaccgggaactggctcatcgctttgacgtcatgattaaagaacaccagcgcggagagcgtctgattgatgggcacacccaggatttcgccgaagctggaaaaaccggcggcggcaatgcctttgaagaaatgggcattatgcagcttatcggcattaccgacacggcgcaggatacagtcgttcatcaggatcgccgcgggtttgccatgctgagcggtaaatgcctgccactcctgctgcgtcgtctgtttaaagtctttctcttccatcaggaacagtcgatcgccaaactcaagatcgcagaaaaagtgtacgccgcccgattcaattttggcgattgagcgaataaagtactcgccgccaactttaacgccgaaagtgagtcccttcagccgttcgctcagttgcgcttcgttgcagttgagatgttcacacagcgccgcaacaaacggctgctgctgcccctgacggttaaatactgacgtcacagtacgcgctatcggatcggcttcagcaatcagccagctctgatcgcgtggcgtaaagttctggcttttaaaaggagcaaatgattttcctggcgccatctggcagaacacaataaccgccttgccctgcaacaccttgccacctgtaccaatccaggtgccatcaaaggtgattttacccccggcagaaaccgccaatcgccaggcagggaaagcgcccgctgttataccaggcctgcatcagaaagccttcggatgcagacaatccgtcacagtaaatcatggcgaaagtacgatcggccgagagcggcatccgcacctgcaagcgcgccagctcctgctggatggcggtgatgcgctggctggcagtctgcgtgtcggcgacatgcagatcaacaatatgcgtctcatggcgtgcgatcagtgtgtccggcagccagaggtagcttccctccgggccattgccatcacagtaggtgctttgcgatctgctgctgctcagcgcgccgttggaagagagcgtcaacaccgtcaggtcggcggaattgaatcgctgccaggcctgactgacccgctgaaaatcggcttcaggcggaacgaaggtcatcaggatgccgcccgcccgcgagcttaaacccacggaggccagtgaatctggcaacgcacgacaatcgtaggtgccattggcaggctgactgctacgcctaagacgggcaacaggcaggtgtcttttgatcgtcttaatgatcgacatattattattttcgcttttatttgagtaatttgcgcttaaatcagcgctttctggtgtgtataaaaggagggctaaaagcaggtccgttcgcgttcagaactcgtcgcggagtgccgggttcatcaatgatcggcgcgctcaacgcctgttggttatcgccagtagcgggaaaacctttaacgattgctgcagttggtttaatggatgaagatgttatattttcgtagcataaaataagctttagcgtgattttaccgggaagatataaggctgtgcgggtgactgatgtttactgtttgcgatacagactcatcagtgcgacaattgtaatgtcaagtgtaaatacaaaggaactcgctatgggcacaattaacattcgaatcgatgatgacctgaagacacgatcctatgctgcgctcgaaaaaatgggtgtgactccttctgatgcgctgcgcctgatgcttgaatatattgcagataatgaacgtcttccctttaagcaaacgttactcagtgacgaagatgcggcgttagtagacatagttaaagaacgcctgcgaaaccctgagcctgtccgggtcacactggatgacctttaatgacctggcaactggagttcgatcagagggcactgaaagagtggcgcaagctgggcccgacagtacgtgaacagcttaaaaagaagctggctgagtgtcttgagtcacccagaattgaagcgaacaaactcagcgggatgcctgactgctataagatcaagctaaagtcatccggttatcgacttgtataccaggttattgacgaccgggtggtggtttttgtggtggctgtcgggaaaagagagcgctcagaggtttattctgccgcttccaggcgtctctcttaaacaggagacttcaccgctaacaaacaaagcggcgctattcctgtttacctgtcactctgctggttccagtgctgtttcgcagcgctcccgagcttcggcaggcaggtcgcgtaaatctggcagcgtgtcgccggaaccgtagcccattgattccctcgcttcctgctgttcatcctgcgcggcgaacgtgattttctcatccagctgctgccagctatcgccctgctgccggtagatcacagcaaaagtgggcgtctgtgcatcatcgccgtaaatttcatatttctgcttctgctcgtcagagcccagctcaagcgtgtcgattaaggtcgcattactcatagcactctcctttttcgtcaggtctgtaagcgtagttcatcacctacggccctgccgacactatcccctgcgaaaattaaaattatatatatcaataagttaattccatgcatttgcataaacgaagcgggcgactatgcttgcaggtgtgactagctagtcctttttatctaatggaacattgatatgaggtcttcctatgacacaacagaaatacagaggtggtgccggcaattttgccaacgatccagaacgggcgagtgaagctggcagtgcaggaggcaaggccagtgggggcaatttcaaaaacgatcctgaaaaagccagggaagccggtcggaaaggaggcaaaattagtcgccgtccttctaagtaattctgaataaagcgctttaggacgtattacgccatggaatggcatctattccaatcaggttcatcatgccccctcttttagccttaatgcctctctgaccagggtaaaagcgggtgaatgttgcttgcggctgggatagtagaggtaatagccgggaaacggctcgcaccagcgctccagcacgcggatcaaggtgccctgctccagcccttctgcgacttcctgctcaggcaggaaagcgatccccagcccggcgagagccgcttctgcaatgtgtgccgaagtgttgaacgttagctgtccatccacccgtacatttaacggcccctcttcaccgtcaaactcccagacgtacaacccacccgctgtcgcctgccgcatattaatgcagttgtgatgcagcagatcctgcggaacctgcggcgcaacatgacgacgaaagtagtcgggcgtggccaccgcagccatccgtaatggcgggcttatcggcatcgccaccatgtctttatcaatggtgtctcccatcctgacccctgcatcaaatcgatcggccacgatattgcgtaagccatgattagcatcgaactcaagccggatatcaggataagccgccagcaatggcgtcagctttggcatcaggagtgagctcagaatatgcggcccgcaggtgatccgtaccgtgccggctggcttgtcccgcatcgcggtcagcatatccagttccgcctcaatttcatcgaaccggttgccaatcgcctggattaaccgttcacccgccgcagtcggtgaaacgttacgggtcgtgcgggtaagcagccgaatctccatccggttttccagcgcggtaatggtctgactcaacgcgggctgcgtcacgcccagcagcgctgccgcgcgggtaaagctgccctcacgcgccacggtaataaaagcctgcaggtcgttcatgttgcgcttcatactgcactcccgccgatagatttataagttctggttataaccccattaaggattcattagctagtcaatataaagcgaaacagtaaaatttcctgagttcatcagcaccgcaaacaatgaaacaggacacaacatgacttccacggaaacaactgactgttccccccggcataaagaagcacactggggtggtgtttgggcaatgacgctgtgtgtattcgcgctcatcgcctctgaattcatgccggtcagcctgttatcgccgttatcacaagatctggcggtcagcgaaggtctggtcggacagggcatcgctatctccggcgcactggcagtgatcaccagcctctcaataacccgcatcgcagggaacctcgaccgcaaaattctgttgctggcgctcacgctggtaatgtcactatccggattgatggtggcgatggcacccaactatctgacttacatgactggccgggcattgattggcgtggtgattggcggtttctggtcgatgtcagcggcggtcgctatccggctggtccccaccgggcaggtgccgcgcgcgctggccattttcaacggcggcaatgcgctggcgacggttatcgctgcaccgctgggcagctatctcggttctgtcattggctggcgcggggcttttttcagcctggtgccggtagccttgatcgccctgatctggcaggcgttcacgctgccatcgatgccggtcaactcggcccggcagcgcagaggaaaaattctgcagctgctgcgttcgccactggttacggtgggtatgaccgcctgcggcctgctctttatgggccagttcaccctgtttacctatctccgcccgtttctggaaaccgtgacacaggttgacgtttctgcgctgtcgctggtgctgctgaccattggtgtcgccggctttatcggcacgctgattatcagtgctgttttgcagcgcggattctatctgaccctgatgatcatcccgttgattatggcgctggttgcgctgctgctcatggtgttcggtcatcacctgttgctggtggcgccactgcttggcatctggggactggtggcaacagcggcaccaaccggatggtgggcctggatcgccagaacctttccggataatgccgagaccggtggcggattaatggtggccatcgtacagctgtcgattgctttggggtcgacgctgggtggcctggcctttgaccatgcaggctggcagaccacctttgccatcagcgccatattactggtcactgccgccggactggcgatgatcaccgcccgtaaggaaagcgctgcctgatagcagatgtgttgtttaaccgggcaacccgttgccctcatgtcgtcaaccccgataaggatcttcttatgagagcattaaccctgatgtttggactgttgatcagttcacttgcggccagcgctgccgatatgtcacgcggcgccgataacttttatcaaagcgagaaagtcacccgcgagaaagtcacctttaaaaaccagtatcagatgggtgtgaccggcacgctgtacagaccaaaagaggccggtaaaacggcgcgccttccggcgattgtggtaggtcatccgatgggcgcagtcaaagagcagagcgccagcctctatgcgcagaaaatggctgagcagggatttgttaccctggcaattgatctttctttctggggcgaaagtgaaggccagccgcgcaacgcggtctctccggatatctatgccgaagacttcagcgccgccgtggattacctgggtacccgcgaatttgtcgatcgcgacaggattggtgtgctgggcatctgtggcagtggcagttttgtcatcagcgcagcgaagattgatccccgcatgaaagccattgctaccgtcagcatgtatgacatggggtcagccaaccgtaatgcgctgaataaaagccagacactggcgcagcgtaagcaaatcattgaagcggcggcacagcaacgctatgtagagttcaccgggggtaaaactgagtacaccagtggtacaccacataaaatcgatgctgattcgcctccgatagccaaagagttctatgatttttaccggacgcctcgcggtgagttcaccccgaaaaacagttcagctgcgctgaccacgcacccgacgctcaccagcaacgtgaaattcatgaacttctatccgtttaatgacattgagaccatctcaccgcgcccgatgctcttcatcacgggtgataaagcgcattcacgcgagttcagcgaagatgcgttccagcgtgcggcacagcccaaagagctctatatcgtgcctgatgcaggccatgtggacctttatgaccgcactgacctgatcccgtttgcgaagctgaccgccttctttaaacagcatttgtaatcttccgctaatcattgatcccagcccgtctgcagccgcctgcagacgggctttctgcgttattggcctttgcgatggcgggtcaggtagtgcttcaccagcacaaagaagagcggaacaaagaacagcgccagtaccgtgcctgccagcgtaccgccgatgataccggtgccgatggcgatgcggctgttagcaccggcgcccgtcgccaccgccagcgggatcaccccggcgataaaggccagcgacgtcatcataatcggccgcagacgggttcgcgctgcctgcaacgcagccgcactcagcgaacttccccgacgaaccgcatcctccgcaaattcgatgatcagtatcgcgtttttggaggtgagtccaactgtggtcagcaaagccacctggaagtagatatcattgcttaatccgcgcagtgccaccgccagcacggtacccagcacgccgagcggcaccgctaacagcacggagaaaggcaccgaccagctctcatacagcgcagcaagacagaggaaaaccaccagaatcgagatcgcatacagcgtggttgactgcccgcccgcctgcttctcctgcagcgaaagaccgctccatgcccctgtggtccctgccgggagttcattggccagtcgctcaatggtgttcatagcatcgccggagctgaacccttcggcgttctgcccctgtatttcgtaggaggcagagccgttgtagcggttaaggctttcgggtcccatggtccatcgggtcgaggcaaacgccgagaaaggcgtcatggtgccttcactgttacggatgtaccatttatccagatccgaaggtgatgagcgatactgaccgtcgccctgcacatagacccgctttacccgaccccggtcgatgaagtcattgatataggcaccgccccaggcgctggtcagcgtatcggtaacgtcatccagctgcagtcccagtgccaccgctttgctggtatcaatatcgacctgcaactgcggcgtttgcggcaggatattggcccgcacgccgagcagttccggactttgcgctgcgctttgtagcagctgatcgcgcaggttgcccagttgctcacgcgtggtgccaccgctggccagcagctcataggtaaagccgttgttctgtcccagacccggcaccgacggcggcgtcagcgcaaagatctgcgcgtcccgaatcgacgccagcgcgtaggtggcgcgcccggcaatcgcttcggcagagttttcactacccggtcgctgatcccagttcttaagcttgataaacgccataccggcattctgcgcagcaccgctgaagttaaaaccgttgatggtgaagaccacatcaatattctgtttctcttcagtcaggaaccagtcaacaatctgctgattgactgcctcagtgcggctggccgtggcacccgctggcaatgttgcctgaagcatgatgctgccctgatcttcagtcggaaggaagctgcccggcaagcgggtaaacattacaaacagcacaacgcccattgccgcataaagcgataccatgatcagcggacggcgcagagtgctcaccactttgtgacgatactggcgctcggtggcggcataaaagcggttaaaaccgccaaagaagcctttacgatggggtgaggtcggccgcagcaacatgccacacagtgcaggcgtcagggtcagtgccaccaccacggagaaggtcatggcggcgatgatggtgatggagaaactgccggtaaatcacaccggtcgacccggcgaaaaaggccataggcagaaatactgcggagagcaccagcgcgatagccaccagcgcgccggagatctctttcatcgacttttccgttgcctcacgcgccggcagaccttcgtcatgcataatgcgttcgacgttttcgacgaccacgatggcatcatccaccagcagcccgatggccagcaccatagcaaacagcgtcagggtattgatggtgtagccgcacagcgccagtacgccaaaggtgccgagcagtaccaccggcaccgccagcgccgggatcagcgtcgcacggatattctgcaggaacaggtacatcaccactaccaccagcgcaatcgcttcgatcagggtgatcaccacatcctcaacggagattttgatgaagtcagtgctgtcgagcgcataagccacctcataaccttccggcattgagtggcgatactcttcaactttgtttttcaccagcgtcgcggtggccagcgcattcgcgcccggcgccagcatcacaccgacacccgccgcaggatgcccgttgagtcgggtggtcatgtcataggattcgccgcccagctccacccgcgccacatcacccacgcgtacgatggcaccgcttttgtcacttttaacgatgatgtttcggaactgattcggcgtctgcagtcgcgactgcgctctgaccgtggcggtgagctgctgattatcaggcgatggcaggccgccgattttaccggctgaaacctgaatgttctgcgagcgtatcgccgccgacacatcggagggctgcaacgcaaaggagtttagtttgaaaggatcgagccagatgcgcatcgcgtactgaccgccgaacacctggatgtcaccgacgccttcggtcctggccagcggctcctgcatattactgaccagccagtcaccgatatccgtgctgttgcttttgcccgtggtgtcatacaaccccatcaccagcaggaagtttgactgcgatttggtcacggtaacaccaagctgctgcacttcgctgggcagacgggagagcgcctgctgcaccttgttctgcacctgcacctgagccgtgtccggatcggtgccctgactgaaggtgacggtaaccgacacattcccctgtgaactgctgctggaggtaaaatagagcagattatccagcccggtaagctgctgctcgatcacctgcgtgacgctgttctccagcgtctctgcagaagcaccggtgtacgttgcgctgatattcaccgaaggcggcgcaacatcgggatattgttcaaccggcaacagggtaatggagagcgcgccaagcagcatgattaaaatggcaacaacccatgcgaaaacgggacgataaataaaaaaacgagaaaacatcagcgggatctcttccttttgggcgggtgcaaaacctgcattcctgcaggctaacaaacagcgttgattatagggtgtaacctcaggctgaacatcctgacgtgatcttttcttaaggctggctgatcgtaccgtgacgctgcattttcgatttatcgcggatttaactgtgctgacatccgatgtgggcatcaaagagaaagccgatccataacgaatctgctgatgcattaagcaaaatggtgagccctgactattctcaaataaaggatattgatcaggagaaaaccatgaaatttttctacttcgtttcgcttatcgcctctgccctctatttactggccttcctgcctaaactccgcacccgtcgtgaacccatagcctactggggatgctggacttatctgggtgctaacgccattttctgggccgtttatggtgtcatgcattacatttgatgtcattttttaagcaaagcggtaaacagggatgttttgggtgctatcctgctgattaattgggttagcgtgagcgggagcttagagatatatcatttttgagttttcatcacagcgacaggattttgtgccttctcacaggcccggcagttattcaggattgcgagacgtgctggaaaaatcatataaggcggctacgcggattttcagctaaccctctggattttaaagcctcccgtccctcggaacacgatgatttcttcttctgttccgttatgggatatattggcatcactatcgtgaaattttctctgcataacaggttatcccggcaatggctttgatccctaaaaactacacgcggctggaaagcggctaccgtgagaaagcacttaaaatctatccgtgggtgtgtggacgctgctcacgcgagtttgtttattcaaacctgcgcgaactgacggttcaccatatcgatcacgaccacaccaacaacccggaagatggcagtaactgggagttgttgtgtctctattgtcatgaccacgaacactcaaagtacaccgaggctgaccagtatggcacccgtgtagtggctggcgaggacgcacaaaaagatgtcggcgaggctacctacaatccctttgctgacctgaagtcgatgctgaataagaagaagtaatgactgaactgtcaggctggccgacctgcctgacagtctcgcttgccgaagagaatcacaatgtctggccgcggccagaacgcagtgtagtccgtcgtgccagatgccaccttggccagactcagcgcgatatgaatcttttaccagccggttatttcagtttttgatatcagtcatggccgggtgaaccgtacgttaatccccccctcaccgacacgctttttgaggctatctgtcgacagcacctttcctattggcgtgtagctataggagctctggaatgtctcgtaaaaaagaaccagcgtcttattgccatacagcatcacatcgccctgctggatcgtgccgggtttctgcggatcgctattaagagcagcaggcaggtctgcaaacttctcattgccgttcagctcctccatcgtcatggtcagcgggagttgctgtacaaatgctttcgcggtggcgttatcagccagcgcaatctcatacgactgatggttgatcgtcataataatcttcatgggacgcagctctcctgcccgaaccgggccactggctttaacgggcatcagactataggtggaaagtaaaaccagcaaaagtaaggctcttttcataaggttgctctccggattatggcgcatctgttcagacatggagtgcgttactgcgatcgccgtccagccctgaataaactggctcacttacccgccgttatctgatggtaaagatttatccttcaccctttcgctgcaccatcaccctgtcggcggaactcgcgcgccgcttattctgcaacagcccggatgcgctgcgcttcatctgatgtgctgaactgatttgcggcttacgtttcgggcagtcgaaacattttgagaaatattttccctgaataacagccggtttccacgttgttgcaactatttctgtaccaggcttaacaaataacaacagagacaatgtggagcattatgaaagagcaaaatcgcacaaatggcatcgctccttatgggggtgccgccggaggctggggcgcattgaaggcggttgccgatgctatccgcggccagatgtctgtgaagcaggatgtgatcgccctgtttaaagtcaaccagccacagggctttgactgtccgggctgcgcctggccggacccgcaacatgcctcatcttttgagttctgcgaaaacggcgcaaaagccgtctcctgggaagcgaccagtaagcgcaccacaccggaatttttcgccgctcataccgtgactgaactgtgggagcgcagcgcactgcatctggagggcgaaggccgcctgacccatccgatgaagtatgatgccgctacggatacctatcagcccatcgaatgggagacggcgttccgggaaattggagagcatctgcgcagctacgacgatccggacagcgtagagttttatacctcgggacgcgcctccaatgaagcggcgtttctgtggcaacttttcgcccgcgaatatggcactaataacttccccgactgctcaaatatgtgccatgaaccgaccagtgtcgggctgccggagtcaattggcgtcggcaaagggacggtagagctggaagattttgatcactgcgacctggtgctttgtatcggtcacaatccaggtaccaaccatccgcgcatgctgggcacgctgcgggaagtgtcgaaacgcggtgccactattgtggcgatcaacccgctgcgtgaacgtggcctggagcgctttacttcgccgcagagcccgattgagatgctgtcaatgagctccactgagctggcatcgacctactacaaggtcagggtgggcggtgacgcagcgatgttgaaaggggtgatgaagatcctgctcactatgcacgaggaggcgctgagcaaaggcgaaacccggcgtcattgatgaagcatttattactgagcacactgaaggctttgacgccctgaaagccgacctggaaagcacagactgggagcatatcctgaaagtctcgggcatggcgcgtgaggaaatccagcatatcgcccggctctacgccagcgctgaacgtaccatcatctgttatggcatgggaattacccagcaccagtacggcactcagaacgtgcagcaaatcgctaacctgctgctgatgcgcggcaatatcggcaagccgggtgcaggtatttgtccgttacgcggtcactccaatgtgcagggcgatcgcacagtgggcatcacagagatcccgccgcagtcgctgctggatggcatagagagggtgtttggtttccgcccgccgcagaagcatggtcacggcgccattgaggcaataaaggcgatgcgcgacggcaaagccaaagcgttgctttgtctgggcggcaacctggcggaagcgatttccgatccccaggtcacattcccggcgatgcgcaatcttgatctggtggtgcatatggcgaccaaactgaaccgctcgcacctgttactgggtaaacataattatctgctgccggtgctgggccgaacagagaccgatgttcaggcaaccggcgcgcagagcgtcaccgtggaagattcgatgtcgatggtgcatgcctcacgcggttcgctggatcccgcctcaccccatcttaagtctgaaccggcgctggtcgcctcactggcgaaggcaacgctgccggacagcgtggttgactggtcagccatggcagccgattacagccgcatccgcgatgccattgaagcggtgttcccggcgtttgaaaacttcaatgagaggattaagcatccgggcggtttccggctctataacgccgcatcagaacgggtctggctgacgccatctggccgtgcgcagtttaaagtgatgcagggcatcaatgaagatccccgctcgctgaagtgccatgatctggtgctcactaccctgcgcagtcacgatcagtacaacaccacgctttacgggctgaatgaccgctatcgtggcgtgacaggccgccgcgatgtgctgtttatcaatgcagaagaggcggagaagcgacagttacgggtcggtgaccgtgtcgatctgatggcgctggacccggatggcaatcccacttcgcgccagatgaaaaacctgaccatcgtgattattgatatggccccaggttcggtcggcgcttactatccggaggccaatgtgatggttccgcttgacagccacgataccaaaagcggcattcccgcctataaaagcattccgatatccatgactcgtgtaactgacgagacccggacgacctcaggcgttttacgctagtcaggcggctcaatacgtgaatgttgccagcgtggccggtgctccggtcacgctgttttcattattgcgccctgaagttttatcgatcctctctgcctgctttaccgcctgtaaagcacccgacgtgaagcaagcctgacggtaacatcatatacactacagtcctgaaaacggctctataaacgatcgactcttttttgcctgcgcagatgttcagcgccctaccggaaaaatgccatgtttcacctgattttcagcttacccagctggtatgtaattgcgcgcgtaattattcctttgtccctgccacttgtcgtaaagatcctgctctccgctctggtgctgctggcgtcacaatatcttctggtgagccgttttacctcgggcgggatcttctccgctgaaatgccccgcatcatcatcattctgtttaactgggcgtacagcaccgtgctgctgctggcgctgcttcagatgctgatggatgcggtcatgctgattgccctgctgttgcgtcatccgctggagctggttcccggtgttcgctatctggccgtagtgctggcgatggggctggctgcctttggcgtttcagcaggcgatacgcgtgccgccagtcaaagaggtgacccttacgctgcccaatctgcccgctgaattcgatggctatcagctgctgcagctgaccgatctgcatatcacccggttgtttaatgcggcctggaccgccgcaatggttgaacgggcaatgtctctcaaagccgatctgattgtggtcacgggcgatgtgatcgatggcagcctggcgcatcggcggcaggacgttgcgccgctgcgcgggctggcagcgcctgacggcgtatgggctatcaccggcaaccatgaatatttcttccatcaggcaatctggacggcgcatctggcctcactgggtctgcaacctctgctcaacagccataccgtgatccagcgcggaaccgcaaagctggtgattgccggcctgccggacgcctccgcacccggcagaaacgcggtcggcccggatctggcccgcgcgctggaacaggcacctgaaaacgcgccgataatcctgctggatcaccagccacgcaatgcacgccagaacgcagcgcagggcgtggatgtgcagctctcaggacatacacatggcggcctgattatcgggctggacaggctgtttgctaaacccaacgccgggtttgtttccgggctttatcaggtcggcggaatgcagctctatgtgaataacggcacggcactctggccaggcatggcggtgaggctgggtcgtccctcagaactcacccggattacccttcgccgccagccgtaatcgcgtaacgaaatggcctcaggaaagtgcggttttcgcaggtgtgcataagattgagtgagacaaaggagatcaccatgacgatgttatgtaccgcctgcggaacggcttatcccgctcattccactcatcagcactgtaaaatctgtgatgatgaacgccagtacgttccggccgccggtcagcgctggctcgcgtttgatgaactgcgcgccagccacgccaataagtggacggctcacagcgatgcgctgttaagtcttaaaaccgtgcctgagtttgccattaaccagcgcgcttttctgctgcgcacgccgcacggcaacgtactgtgggactgcattgccaaccttgatgatgccacctacacgttgatcgcggcgctgggtggcattgatgctatcgcgatttcacatccgcactactacaccaccatgcaggagtgggctgaagcgtttaatgcgcccattcatctgcacgcccgcgatcgccaatggattgtgcggaagagtccgcatatccagttatggcagggcgagtcgctgacgctgatgccctctgtgacgctgttacggctgggcggtcattttcccggcggcagcgtgctgcactgggacgaaggtgatgggatgattctggcgggtgatattatccaggtcacgccgggtgcgcatggcgtgtcgtttatgtggagctacccgaatatgctgccgctgtcagccgctacggtaggcgacatactgcatcggctctccggcgtgacattcgggcaactgtatggcgcgtttgaagggcaggatatccatcagcaggcaaaagagaaggtgatgcggtcgggagagaagtatctggcctgtctgcaggatcatcaggcatagcgcggaataaatgctgagaagagaacagccgcccacaggcggctgtttaacaccattatgcggtctggaacaccgcaaccatcgtacgtaactgccctgcgcgcgcggcgagttcatcagctgaggaggccgactcttcaaccagcacggcgttctgctgcgtcacctgatccatctggttcaccgcaatattgacctgcgagatgccactgctctgctcttcggatgaagaagtgatgtcgcgcatcagctgagaggtctgttcaatggcgctgacgctctgtttcaccttatcgcctgcgttctgcgccatggcgatcccttcctgggcgtggccgaccgactgctcaatcagacccttgatctctttagctgcactggctgaacgttgtgccagtgcccgcacttccgacgcgacgaccgcaaaacctttaccctgctcaccagcgcgtgccgcttcaacggccgcattcagtgccagaatgttggtctggaaggcgatactgtcgatcaccgatgtaatctcttcaattttacctgagctgccacgaattttgtgcatggtctccatcaccgaatccattgctgcaccactggagagtgcagcctgcgtggcagattctgcacgggcagaggcaaagcgcgtgttatccgcgtttctgctgaatgattgccgccagctgctccatgctggcagccgtttcagccagtgaagccgcctgttgctcggtgcgcgacgacagatcgccattgccacgggcaatctcttctgaggagttggcgatggtagccgcgttacctttgatatccgacaccagctgagcaagacgctgctgcatccgcatcagtgcattcagaagctcagccatctcattgctgccggaaacgttcagctgtgccgtcagatcgcccgccgcgacgcggctggcaacttcaactgcttctttaaccggacgggtcactgaacgggtaatcatgacggccagcagaatggccagcagcgcgacagcaaacagacctgccagtaacagatactgcgcatagcggcgttcctggatctgcgtctgcatcattccttccagacgatggctggtttgttcacccagctcgccgtaacggttaatcgcctgggtaaagacccgcacatagtcaaccggcgtcacgctggcgtgaccgctgacaaagacactatcagccagattcagtgcactcagcgcctgctggttcgcatcctgtgccagattgccaaaggtggttttaagatctggctcaatggaaaatactttatccatgttgccgctaaactgtctcagcgccgttttgccataatcaagctgaaatgccatgcggctgcgatcggcatccgacacattcccacccgcaatcagcgacgtgccgctagcacgaatctgtcccagcgtttcagtcagttgcggcaggcgactaaagatactgacaatcagctggtaggtattcagatcggcatccagcgatagctgatagaaatcaagtacatcctggttcgtatcgagtagcacctgaatcagctgagcatgtcgcgtcaggctggttgccagggtcagtttgcccgcgttaatatcgttctgcagctggctccactcctgattaacccgctccagccgtttcagcggctgcgcctgctcattattctgacgtaattcgtcagcaatcgtctgagataagcgattaacctcactgaccaacgccatacgtggcgcgttatctggtttgttcagcgagatagcgatcgcactttccgcacggtgccgctgcagcaggttcagcaacttgagcacctttctttcgaccggtataccggtcagttccacattctttgtatcaataagctggttgcccgtctgaataaacagaaaggtgggtaaaataaacagcaccagcgcaaaggatccgagtaacaggaatttcgctggcaaattaatccggtcgagtatttttttcattcttttccgctctgatgtgtgagacgtgcaggtgtgtagcgcacgaaatagctttcgtaatattatttttaccgtttctttgacatagccagagatgcctcatgcagcacaatgtcgctatgaagaaaggagtttcgtataaaaatcagaagtacatataacacggaagggagtatagattgcgctgcgttattttacagtgaataaaatgacaatatttacttcaatattcacctaagccaaacttgaaaaatacccttaaaaatcataaaattgaaacaaaaacacctggcaaaaatcattaagccacaagcctgacttcagcgttattgttttgaagataaagaaattcaagttgcgtcatgaatagccgataactgacatcctgcctgtatctgactcattatcaccagactatcaaaacaaatatctacgcccggcaaattctaatttaaaccttataaccctaaagagttacctgcacttttataatgaaatcgatttcattttatatttatttcagaaaaagtcgtttatttattctgattaatgataaaaaaaagcccccacattgtggaggcccttaagttactgctcaaccattaaaaactttcccagttcgccttagtcaggtcgatggtctgctgctcaggctgctttgcgtgtaataccggacgccgtactgcagcggtctgctgcgactgcactgcacggtgattgctttccagcttaaaggtcgccaccagtcccgacagcgtttctgcctgctcctgcagcgacttagaggcggatgaggcctcttccaccagtgaggcgttctgttgcgtcacttcatccatctgaccaatggcctgatgaacctgttcaatgcctttactctgctcagaggtagccgccgcaatctcattgaccagatcggccacctgctgaatcgcctgacggacattttcactgttagatccaacgccgctggcctgctctaaaccgtgttcgacctgtgaaaccgatgttgagataagatccttaatttcacgggcggcagaagaggagcgctgcgccagattacgcacttcagaggcaacaacagcgaagccgcgaccatgctcgcccgcacgcgctgcctcgactgccgcattcagcgccagaatattggtctgaaacgcgatgccttcaatcagtccggtaatttcagagattttggcagagctggcgcggatttcatccatggtactgagcatctgcttcaccgccgtcccattctggattgacatgtgattcgcgttatttgccaggctgctggcctgttgcgcaccttctgagttctgtcgcaccgtttcgctcagtgtcgccatgctggctgaggtttgctccagtgaagccgcctgttcttccgtgcgtgcagagagatcttcattgcccgccgctatctgcgttgatccggtactcaccgattgcgcggcgtgactgacggagagcagcgtgccggagacgcgcgccagcagctgattaaatgccatcgccgttttgccgatctcatccttactgcggacctccgcgatatgagtcaggtcgagggtatgactcacctgcgtcatggtattgaccatgcctgagaggctctttttgatgccgagaatcaccttagcggagaaaccggccagtatcagaataagcagcagcgacccgccagacatcgcccacagggtctgactataaacgcgcttgtttctccacccttagctgttcaccaatatcaatgttcagctgaatctgacgggtgaaatccgcttccatcttacgggctgcagcacctactccgttctcactctgtaataacggcagcgtgaccgcatcatcatgggcgcgtgacgcggcaagaaatgccggcaatgcgctgcggaccgcatccagatttttataggcctgttccgtcatcgccttatcttcatcgctggagatgtcgttagccatgtagtaatcattgagcgacttaatctgcgtaagcagattctcaatgcgctcttccgcagcagggaattttgccgcatcgctggtgctgtggtggcgataaagcgcaatacccaactgattggtcacgctgatcgatttattgagatcgcgaatgctgggtattgcgttcatctgtacatattcaaagcgggattgaaagcccgaaatcactgataaagagataatcaccagcgcaatcagtgacattgcaagcagtgagaaaatcaataccagacgttgtgtaatagtcatacttgcccccggcaaaaaagaataatctggacataattcaaagttggatcgttcttatcggcttttgtctgcagggctttaattaagcatggcgaatatatttttttatttttccttgcgaatggtacagagtgaactagccagaacactactctgccatttattcatttttattttgacacacctttttacatctcatcatctgagataaatttgccacatctcctgtcagaagatttccactgccggatggtcacaatgaagcggaagcaggcattcatttggatctgataattagcccgctaattcaacagcgatgctgacgataattgttaaggagaaggcgatttaaattcgtgggataccgtcgcagacgcagcaaaggcagggcttgtaaagctgaagagctgaaggggtgaaaaaccagcatgacagtctgtcatcagattttctgataagaggatgactggctacctgtcagataacaggcgacggtgggagattttagccttttgtgtcagggccagattaaatcagtgaaatcgctggcggaatgctgaatctggtctatgctcactggcccgaccaggctttagtctgttgggtagcaataacgcttaaaataaaaaaaggtagtcgtcatggatttagccacatttgaaaccagaaccggtctttggccacacatgcagtttacggatgttgaatatgaagtgtgcagcgcaggtgtagagatctatgccattgatgtcagtcgtcagaccaagagcaagctatttatctgtcgtgtcaccaacgagcagcaggcagcgtcgctaacggcacagttcaaagagtggttgccgaagttaaagcttaaaaaacgcaaagccgcattgaatctggcgcgcatggcgtgcgagaagagcttccccgcgaatcctaaattccaggatcggtctgacatgcgtcggaacacatccaggctctgatgcctgcttcagcctgtatctgttacagcagtcaggctgaaagcctttcttatcctgtctgcgctgcggcacgttttaatcacgcgccgcaggcacacggaacaatcgacattctccgggctcaattgagatatcactgaaagtcgtgatatgcatctcgatccaggtattcgcggcccgaagcgtgtgaggtgatttgcgttgttccagttcagccacaaaatcccgggtactcactgtgcactgaccggtatcatcccgcctcaccgcctctttgaatgctgaccagacctcatcatcctgtgacatctctaccccacaccggctctcaatcgataatatgctgtatatataaacagtacaattattcgctttaagggtcaagtctgctctgtttaccagtctcagatcgctaagcaatggcttaattgtggccatttatagcagaagcagcagccgaaacaggactttaatcctaatcttagaaatcgttttcatatctgattaaggtattgatttaaatagccattgaatattgttagctttttaattgtttgatatctaattaaaaaaagagttaaccgtagcggcataaacttcgtttttgccctatctttgaatggctctgtaatgaaatccacttcttttacagagcgatctgactcctacccttgcccccttttacagggggcacttttttcagataaggcagatatcaacatctgattgtctctgcagaccgacaacgttcatgcgttgctgactactgtgctgatgacgttaagggagtgtctggaaaagtggttgatttgtaacctgatatttcattggttgtgctgacatcgcctgaagcctgaaacagtggattgaatctcaaaacaattttccgaaatagcaaataaacggattttttacccgcttaaaagcctcgccagaatgacgtggtaaggagaataaaaagtgcgtaataatctggcaatatcagattgaccagcgcctcaccagggatgctgtaacgttataataatgcgctatatctgctgttcgcccccgattttatgggggtttttcttttcccttcatttctatgcccggttattgccgcactgcgatctgatgtcctgattgtcgaatcctttagtactacctgaatctacgattaaattaatgctgcaaatataacggcataatggtcgtagttgtgcccttaaccagcaatatttctgtgatatgtttaatcagtaactttctgccacgtgagtctgattatgctctccacccttatttaccgtagccagcttgcgggtttctgtctcgccagagagattgaaagcgctggtggagcgcgccagtatcaaaaatgctgaggctgaagtcaccgggatactgctctatgacggacagcacttttttcaggtgctggagggtagcgtcgacaacgttcacacggttttccagcgtatcagtcaggatgagcggcattttaacctgattgagctgatgcgggattacgcccctgcgcgtcgcttcggtcatgccggtatggccttatttgatttacgtgattatcagaaacacaccgtagtggatgccctgcttaagcgggttaccctgagtgatgaacggatcagagatgaccgggtggtgaagttcctgcgttctttcgtcgaggggcgggataaagagacgtttatcaaaattgatcctgccagtcagtggacgctgacaacacccgtcacctccgaatctcagccagcctggcaaccggcaccgggtcagcgttgtgaatttgcgctacagcctatcgtggatacagcaaatcgccggattgtctcctgtgaagccttgatacgtggtcagcacggcgcatcacccgctgattacttttcacagttgccagaaagcgagcgttatcagggcgatctgcactctaaaacctacgctttccagctggccagacatctggggttgcgcgagcaaacgctctccgtcaacctgctgcccatgtcgctggtggtcattgacgacgctgttgaacatcttatccagcagatcaggcagcagggattgcgaccagagcaggtggtggttgaggtgaccgaagatgagatcatctcgcgcttcgacgcattccagtttgctgtccagcagctgaaagcggccgggatcagcctggcgctcgacgattttggcgccggtttcgccggcctgtcgctgttagccgatttccagcccgacaaagttaaaatcgatcgcaagctgatcaccgatatccaccgcagtggcccgcgtcaggcgattgtgatggccatcattaaatgctgtcaggcgctggaaattacggtcattgcggaaggggttgaaaaaattgaagagtggctctggctggaaggtgccggggtacgctattaccagggctttctgtttgcccgtccagccctcaatgccctgcctgcagtaagctggccagcacgacgcccggaatagaccccgccgtgataatcccctttccttcccttttgcccataatttgatgcggctcacaccgcttcgctgcaaaaggcaaaagctgtgccatgcttgattcatctgacagccttcaggcaatacagatattcatcaggtcactggataacaaccggaaatgggagagtcaccatgaacgaagatcgcattggcggtaactggaagcagttcaaaggtaaagttaaggaaaaatggggtgatcttacggatgacgatatgaccgttgtagaagggaagcgcgagcagctggtcggtaaaattcaggaacgctacggctacgagaaagatcgtgccgaaaaagaagtgaaagagtgggaagattccaacaagtaccactggtaacgtgtgcttaatcgccgggcgtctctgcgtccggcatctgccctgtacccctgtttaatccccctcacccactgccctctctgcacccgatacaccagcagattttggaaatgattgtttctttatttattcctgacgcgcatactgcgtcatcttccctgttcatgggatctcaatgcctttcggatatcaattatgccccagcactctaccgacaccgtatgtggtctcgtcggtgttcttcctgaaactctgcgccgctggcgccgtgccgggctgataacgccgcctggccctgctggttactcagataatcagcttacgcgtgcgctctgtgtgcgtgaaatgacctcagggggtcatacgctctttgatatccatactgcatttaactggcccagcgttgcgctgcctggcggctgggcctgccgggaagaggatatgttgcatctgctggcgcataatacggacgcagatgttgatcgcgaactacagatgatgaataccgactattgtggtgatgattatgttaatcgctacctgcggccgctcaacctctggctgcgcactgacctcagcgaaggtgcggcgcggcgccagcagcgctttcattcagcggtagtcagtcagtgggagcgcctggcgctggcctcacaacgacgcagcaccgtaccgctgtttcttgaagcagtcagcgtcacagatgaaaccgagatctggatggaagcgatacggcttaacggacaaggctttcgggttgaagttgcagcagatgcgtcaggtatccccgccgtggcgcaacgccgctttgagcatcatctgatgtggtgtggtgatggtatcagtgcatcgatgaaggctgcatttcactccagtcttgaggcgggtgaaccgatcatgctgaccggaacgaataccggcttaccgtcgcaaatcagccttatggcagccagcgcctgaactcttttgactttcttacctgccagtgaataaaaaggcggaaacagcctgtgccgtttccgccctgttcatgttactgatgttcaagagtacgctgaccgccgatcgcaatcgggatacggcgcggtttctcgctctccggtatttcctggatcagatcaatgctaagcagaccttccgccaggctggctccggtgaccttcatgtgctctggaatggaaaagctcagctggaaatcgtgtcgggaaatgccgcggtggatccagctggtgttctcttcccgggcctcgccagacgcttcctgtgacggtttctctctgtgaccggccactgaaagccgtccgcctcgtaactcgatctccagttcatgctctttccagccaggtacactgacggttaacgcatagcgattatcctctacccgctgcagatcgtaagcgggaaaccgacgttaccgggctgtcgccagtaagctgactgaacaatttatcgatgcggttaaagcggtctgaaaagactgaatcagacagcgaagggaacactgaaaattgttgtactgacatggtgataatctcctgaacaggttcatccaaaagttcatctgatcgggctcatatttccgatcatctccataaatagggatcagtagtcagttttcaagttggtaaatataatttttttaccgttatcagacagccggttaccacagaaataaatttcagggtattaacgcagccgttactttttgctctgaggtgcaagagcaaaatggggatgacagccagccagtaataacagcaactcatattctccctgacttaatagtgtcgggttacctgcggcttctttggtttgccagacgcgcaggctaaggtcaaaacgctcagcggcgctctgctgtgagagcccggcggcaagacgaagttcacgcacattactctggacgaccacaggcggcctggggggacgattcaccaaacaaagactccttcaacatgattaaaccgcaaaggcacagcgcttcaccatcaataaaagcgaagcaacctgagagcggccataacgaaaagaccacagaataattgactattttaaataaatgtcaaatttcaggtttaaaaatcatgcatgcttttttataagcgaagcggcatatttcgccctgacggagacttttctatttccatagagtgctttattcctcctgccaggaattatcctgttatttgccttaagggccattcagggattaatccgctacctcaagcgccctttcttcatcaggatagaggtatagcctgagggtcatgttcaggcagcatcattgaaaaagaggaggataatgaatgaaaaatcctatccagcgtcgctcgcccgacgatctgtcgcaggtggaaattcgtgaacagtggcaaatcacctactggacccaggaactgaggacaacacaggaaaggctgacacgcgcgatccgcgagcgagggccgcggaccgaaacaggttcgtgactggctggagcaaaacccgccgccacgtcgtccgacacaattcacacacggcatgaaaggttaaattgattactgtctgaagcgacacgttactggcagtcttgcggtggattgacctatagcagtcaggagtacactgacaggtcatatctgccggtcttcattttttcaggcttttacctgtatttttaataggttatcttcctgagcaaccagcggatagcgatccgtctctggctgcagacctgtttaattgtaaaactgacttagaaataacattaaccaccctgaatgcttattcatctcctgacggaaaataaacattaacaaccgtaaaaaccctctcctggctatataaaatgtacaaatgtaaataatcaggcgcatcttcgattaaattttcgaatcgtaacaacccctttaatgcgttaaagaaaatattaagagacacccgctgcatagtcccttattatccagttgaaaataaaaaatcacgccataattcctgccgcccgaatcacatttcgctccggacagttttcttttttcgctccgtaatcagccggtgcgggggttctacacacatgttaaacaatttaaacggcgacaatgagcgccgcagccgcgccttacaggcgttgcgcgaccctgatgaaagccgcgatgaagttctccggaagtttgtccggttagccagtcaggccctgggtatcccgggcagctttatatcggtgctggatgatgagttccagaccgttcgggcatcacacaattttgaactgcaacgctcaacgcgtgcggattcactttgtcgtcacgtggttgatagcgacagtgcggtgatcgtccctgatacttattacgatgcgcgttttgtcacgcatcccctgatcactggctcaccctttatccgcttttatgtcggtgtgccactgaaaacacgcgatggtattattctgggcacactatgtgtgaccgacaccgaaaccgcatgcgtttcccagtgaacaggtgacgaccttaacgctgctctctacgctggtaatgtcttttcttgaagcctggcactcggcgggttttaccgatccggtgaccgggctacctaaccgtcagcgcctgatacgtgatttgcaatatcttgccgttgccggcgataccacgccacgccgtctggttctgattgattgcatcgatatgtcgcgtgcttatgaactggcccgcaccatgggaatgagcccggttgagagcctgctgaaagatatggccactctgctgccgctgcgcctgcgtccggcggttggggagatgatctatacggtggccaccggccgctttgctatcctgacccgagcggatagccgactcagtgccgcgtgggtagctggtcgtctggaaggtatcagtgcggacatggatgaaggtctgtcggtcgcgctgactccccataccggtgaggctgactttgtcgctggcagcatgccagcatctgaaatattaggccgtgcggtcagtgcgttgcatgaagcggtcggccgcggactgccctctcagcgctttgacgctgaggctgaaacgcagcgttcagaagatttcctgctgatgaccgatcttaaaacggcattacgcgagaacaccgggctatatatggtctatcagccgaaaatttgcctgcaaagtggtaaacccgtgggtctggaagcgcttatccgctggcaacatcccagccggggcgagctttcacctgccgcctttatcccgctggctgagcagaccgatctgctctctgtgctgacagcctggattatcgatcgggcggttgagcgcctcagccggctgaggaacaactgcatccagctgccgctaacgataaacgtcagcgtacgtgactttgcgcgcgaggggttcgcttcagcgctggaaagtaagatggtcaaatctaagctcccgacctctctgctgggaatcgaatgtctggaaaccgaacgtatccttgaaagcccgaccgccctgcgcgggctggagatgctcagagcacgaggattcactatttcactcgatgatttcggttccggctacagcaatatcagttatctgcgtcgcatgccgcttgatgtgattaagctggatcgttccctgatcagtgagctttcctctgacacggcttcacgcatcattgcacgcagcatcatcgccatgcttaaagagctggactataccgtggtggcagaaggggttgagtgtccggatgcagtaacatccctgaccgagtatggctgcgatcaggctcagggctatttctattcgaagccgttgaacgaagaagcattggatcactggctgcactggaagctgcgtggcgagtgtcattaatctggagctggcgcaatctgatatcagattgcgttttcagcgatctgaacgatctctgatatcccccatggtaataattcaaaatatttgatcaatatcagcaaaagttagctatatcagtctggcgagatcgcgcctatcattcattccatcgaggcaaaacgcctctccctgactgaaatacgctaaggaattgaccatgaaccccatcaaaattttcgttgctgttactgcactctctctgatttcattcggtagttttgcccagactattaccgctaccgcgtctaccctggatgctgctgaagctaaagtcgcggcacaggccaaagatgcaggtgcatcctataaaattaccggcgcacgcgttgataatcgagcttatgtctctgctgaactgatcaaataacatttaccccttcaatacgatgaggctgccattacggcggccttttttattatgcaggaagcataagttcgtctgctcaggttcagcgtctctgatcccattacgattgttggaaccgtgccccgtaatttgccgtttcgcttattgccacctgccgtggtgcagtctgtgcgacagtgaataaggagagatgaaacattttttgaacaatgctagcgtgtgcgcaacaatcttataaaacggagctgcacatgctgactaccataatataccgcagccatatttcagatgactttcccatcagaaccctgcccgcgatggtcgacaacgccagcaaaataaatgcgactcacgacgtgaccggcatcttattatttaacggtacccatttttttcaattgcttgagggtccggaagcgggcattcaggcagtctatcagaggatttgtgcagatcgacggcaccacaatgtggtggagctgatgcgcgactatgcgccttaccgccgctttggtaatgcgggcatggcactctttgacctgcgtgaacacgatcgctcatcgctcctgcaggccgtgctggataaagggacgtcaaaatatcgtctgacctatgatgatcgggcactgcaattcctgcgcacgtttgtagagtctcgtgagaaagagaactattacgaggtcctcccgccgggttactgggagtttatttctgagcacaatgatgtgccggactcccgtccggagacagaaggcgtcagctttcgcccggtggtggatcccctcgctcgtcaggtcacagcgattgaggcgaccactctgcgacctgctcccgccgacgacacctcaggagatcagctttatgttaacgatctggaaaccgtgaaaaagacgtttgcccatgctggcctggtctgcccggacggtatgacactgtacgtcagcctgctgcctatgacgctggtggtgatacccaatgccgtcgatcatattgtggccgctattcagcaggcgggattggttcctgaacaggttgttgttggcgtgagtgaaaccgcagtgatctcgcagctggaagcgttctctgaagccgtacgcgcgctaaaagcggtcggaatcagtctgtcgatcgacaactttggtgacggctccgcgggattgtccttgctgactcacattcagcccgaccgcattcgtattgatgccggtatcacccgcgacgttcatcgcagtgggccaaagcaggcggtggttcaggcgattattaaatgctgttcagcgctggaaattactgtcatcgcggcagggatcgtacaggcagaagagtggatgtggctggaggctgcaggcgtgatcaacttccagggcacgctgttcgcagccgcaggacgctatgaagcacaatccgttgcctggccggaataccgggaggcgatgtaacactctctgtcccaacggtgataaagcggtacgtcagcgcgaggccgctttcttcaccgatgtcctgcagagcagtatcaaagccgcagcggccccgctaaacacctcccctcccccgcgcctccatcggacccgtttcttgtgacagggataacgacaacgccttcctgatggttccggccataccttaatctctgtactcattctggcttagcgctatttgataaccactgtagcgagcaaagttacctgtttaactcttccagtaagcaaatcagtggcggatccttctttaggatcaaacttcatcgcctatccactgtagcgagtaaagtaacgatattcagggttcggaaaccactgtagcgagtaagcagagcaagtaaatcgtcatccgtccctctaaattgcagcgcgaaggcgcattaccctttgtttcaggtacgccaggtacggtttcattcagtcataaccactatagcgagtaaaaaaccgatttctctctcaacaatgaattttgacccttgattgcacaatgcgccctgcgtggggcctcgcaaaggtgcttttaaggatgcagctaagctctataactgcaaaaacctgaagcacggcacattatttaacggctgtggcgagtaaccatttttaggtgtgggaatttggcaatttaacaggaagtcttttactgacagtgcaataaatgatagtgagtgcttactctatttaaggtaaccactatatcgagcataggccagtgacaataacaaccactatagcgagtaagctcctcatttctgctcccaattaacaaccactgtagcgagaatatctcattcatcagcgccagtatctgatcattaactgaacgctttagcgataaaacaacctgataaccactgtagcgagtagtttactcaccctggatggacaaaacggagatgaaaaagcgcggtaacggaggagataaccactatagcgagtagagtaatgacaccgattcccctgcacagcctgcgtgaatacttcatgacgggcgtactttctgtgctgtgatcaggtgagtaaccactatagcgagtgaatattgggtctcattctggctattacgcttttgaggccgctcttccgggagagactaaccactatagagagtaaacacagcaccgggctcaattcaggtcctgccgatggagagtgatgaatagcgcgattagccctgttcagacaggcgttacgtatgttgctgtcgtgctggtaaccactatagtgagtaacgttactcgctacagtggttattgcgtttcagcccggcgttcccgataagagattgaaagcggagtagcatgctagcagaaagcgtgtcattgcttcttctgcttcctgattttgttcagtagctctttttcttcacgcgagaccatcaccagctcactgctatcctcttcaatcaccggttcaggcaggctgacgtcaattacgtcggaatcgatatcaagatcgtcaaactcatccatctcatcatcgatcaggcctgacttactgagcggcagtttcggccgggcgcagcttaggatgacgataatgaacccagaagtagactgatgagccacgtcgggtttcggtgtagtcgagatagccgatctcttttaactgctccatggcctttctgacggtggcattctgggtaatcacacgcgatgtcaggttaagtcttgcgcgcagacgcgccatagatatcggcgcaggcttcggcggaaggctttcaatgaaggtgtagagcgcttgagcagactctttgcgtgccagctcattgatggctttaagctgcagcagaacctttctgtcgaactgatacagctcaaagatcttgggatcggcctgcagcgttaccgtgtccttcttgatgctgtatttcgcagactgcaccaggtgcgtcgtgtagttctctccgcccttgctggtaaaagtcagggtgttagaggcaatacgcgtcagcgaagcatccagacggctcctgagcttcgaggagagacgcactgagggtatgccgcatagtttggcaaattcaacgaaagagagcgttaccgtgtctcccagacactcatgcgtagcgaatgcacgaatgatcccgacccaggttttgaaatcattatccatatccaggcgggcacccagaatcttaatgttgtcatagccttctgacctgaccagggataactgtttaagatcctgggtcacatccatggcgttcatctggtttttctgactgcgcgctgtggattttaacgtcggaacaaataaaccgagtcgcatcaatgctaccggctggacggtgttgttactgttgggggtaagagtaacaacttcacctgtacgtttatctgtttcgctaaacgcatcagctatgttcaggatatctggttcttttcttggcattaggaagatccgtgatgtgaacaggcgagagccgctgttactcgatacagtggatactatcactcactacagcggttaatctacttaccatagtggttatttctctcgatatagtggttgttttactcgttatagtggttagcgacccggctttaacgtagtcataccgtggcctgaggcggtgctgggatctttaaggaacttaataaggatcttaaatggatctgttattggatctattcagtggataacctgagaaaactaactgaaaaagagtcgagccaccgccctccccctttactggatctccctctttcatcgcaagcactctggaaaaagccgtcatctacacataatcagggttatgcacaccgattcagaccacttactcgctatagtggttgttgagtactcgccagcgcggttgcttttctcgctatagtggttgttatactcgttatagtggttattcttctcgctacagtggttactgacccccttccaggccttgtgtcacaaggcttcagacgctgcagggatctgttaaggatctcactttgatctattgaggatcgaccaattggatctggcctgtggataacggggataaaacacacaaaacaaagaattagctgagagtcccagtcagaagtgattttcaccttcagtttctgaatgtgcggtttatcagaagcacgactgagaaggtcttttactgctaaaacgatctaacgctgagcataggtaagactggaatgttgcatacacctataaccattaaatctttagggttataagtttaaatcaggcctcagaaaatcggtcagtgaaaatacagaaaactcaccatgatgttaatcgcctatctatttgataaataatggattattttttattttcatgatgaaaacaccataagattcttacttaacgtaatatctttgttttgtcagtactcagaatctgtcagacatactaaaaaggcacttaaaataactttcccggaagaagttaataaggcaccagtgaaggaacaacaggaagaacaggaagaacaggaagaacgacagtaagaaaaatgcgttcggcataataacttaaactaataaataggcttagcgtgaatgaagtaatttcaggaatgtaagaatgatatgaagatgaaaagattgtatcgggagctgaatcaagcacagtagagcgttaattctgactgtccggcatagctacattatggtgacttgccccaattaatattgctctaagccttgccgcattaagcctgttctctactcctactcctactcatgctcttaaatcggcagtcttaactcttcgatgattttgattcgtgacatcacataatgatgaagggaattaaatccctctcttttctggattaagccttgcaataaaaaccctatgcggaaaacgcctgacattatgttgacaggcagcaacacagattatgaacgatacataatgacaaggcataaaaggtatagatttggaagcagtgatcttaagttagcaatgataacggtaacgattacttgcgcactttaccgttatgcctactccttcaggttcaaaagcactgtaatagcttctgagtaaaactctacgtcagcagtaaatgttgagtgaaagtgcattaatcctggaaatttttcaccaggccatttcacgcttaattaaatgatttataataacttttattgaattttcatgctgaaaacaccattaaaaaaacacgaaaacaatttaacgagcaacctgcagacttgcagatgatttatcagaatcggaatgcaccgctccgaatcattagtccttaaaatattcgtttaatgtcgccattttaagttatctgtctcaaccagcctgtaagacaaaaaagcagagcgattcactttccagtgattcacaaaagtaatgctgcttgcatctcaccatcgcggagaaaaaatccaggtttttggcatttttctaaaaaattggcagatatgtgctttttgtgtagtatgcaaaaaacattaacgcagaggggcttatgaagcgtgattatggtggagtgctggaaatggccacacgtgccaattccatgttacatggactgagtaaccatattgagcagcagcgtcaggaatttaaccagaccggtttttaccagaccttctcccggaatgctgtcgccaacatgccattgctgagtaagcatgctgttgtcgccgcaattggtgatatggaagcagcaggttatcagtttgggaaaaaacagaccggcagcacctcacaatatgccctgactatccagaatgtggtcgacatctatcagcatcgtaaagtaccgaaatatcgcgatcggcacgatggcccctttgtcgtattcgttgtcagccttaaaggtggtgtctcaaaaacagtgagcacagtcacgctggcccacggtatgcgtgcacatccttctatgttacataatgacctgcgtattctggttatcgacctggatccacaggcatcaagcacgatgttcctgagccataccaacagtgtcggttcagtttctggagacggcagcgcaggcgatgctgaacgatctggatgcagaccagcttcgtaagcaattcattaaacctactgtcatgcccggcgttgatgtgatcccagcctctatcgacgatggttttgttgcaagcgactgggaagagctcgttgctgagcatctgccaggcgttgcgccttcggaagtactacgccgcaacgtgattgatcgtctggcgggtgactacgattttatcttccttgataccggacctcaccttgattcattcatgctgaatgcaattgcggccagtgatgtactgctgacgccgacgcccccggcacaggtcgatttccactccaccatgaagtatctgacgcgtctgccggaaatgctggagcgtattgagtccgaaggcattgagccacggcttaaagccaatatcggctttatgtccaaaatgacctctaaacacgatcacctgacttcgcaaagctatgcccgggaagtgtttactaaatcgatgctggactgcagcctgccgcgactggatggatttgaacgctgcggcgaatcctttgatacggtgatcagtgccaatccctcctcttatccgggcagtgcggacgctctgcgcaaagctaaatatgaagccgagcagtttctcaagggctgtgtttgaccgcattgaatatatcaggagtaccctgtgagcaaacctatacagcgcatcgggcgcaagtttggtgattctgctatcgcaaacatgatcgacagcagcagccagtcgcgcacatttacgctgaagtcgggcgcgaaggccacctttgtgcgccagctaatcctgcatgatgatattgaaaccagaaccagcgttgacccaaaaattaacggacgtgaccagagcacgctgacgccggaatcgcttcaggagatcacccgtactattacgctgcagcaattttttccggctattggtcgtgtcaacggtgaccggattgaaatcatggatggttcgcgccgccgcgccgcatgcatcctttccggtgccagtctggaagtactggtcaccgctgatgaactgagccttagtgatgcgcgtcagctggctgcggacattcagacagcaaaagagcataacctgcgtgaattaggcctgcgctttatgctgatgaacgaaaatggcatgagtaaaacagagattgctaaagccgaaggcatctcaaacgcaaaggtctcacgagcgttccaggccgcagccgtacccgctgaatttattgaactctttccggtcgtatcagagctgacacttcaggattaccagctactgctcgatgtctgggaagaggcgaaagcggaagcggttgatgtcaccgcgctggtcagcgatattaagcaaacgctgaaagctgatgattccctgctaagcgccaatgcggatgagaagaagagcgcgattcttaacggctttaaaagcgcccgtcgtcagttaaaaaaacctgcacccgtcagcaagacggtgacggaaaagctggctacctttaccacagctaatacctatgcgcgtcgtaaaactaatgatgagaagcggactgtgcagtatgaattcagccgtctgccaaaagagattgctgaacagatcgacgcgtcaatcagacagatactctccacattaaaataatcctctttacgtttttgataccagaaccggcctctgtgccggttttttaattctttcctccaccggcctcccgacagtgcaatccgcatcttatcgcttcgcctgataacgacttctgttaattacgcatcatttccgcagggtaatacttgaactcagcacggtttatcgctatagctaaaacggtttagctatcaggtttaatcagaggagttttttatgtctgtacgcgtatggtgcctcggggatgccgtggttgatttgcttcccgaaatgccgggtcgcctgatgcagtgtccgggtggggcgcccgccaatgtcgccgttggagttgcccgtctgcagggaaacagcgcttttatcgggcgggtaggggatgatccctttggtgagtttatgcggcaaacgctcattgaagagaaggttgatacccgctacatgatcgctgatacgcagcaccgcacttcaaccgtggtggtcggattggataaccatggcgaacgttcctttacctttatggtgaggccgagtgctgacctgtttcttgaggtgcaagacctgcccgtattccggcacggggagtggctgcactgctgttcgattgccttatcagctgaaccttcacgcacggcgaccctgactgccatggagcagatccgggcagcaggcgggcatgtcagtttcgatttaaatctgcgtcatgacctctggcccgatccggaactgctgcatgcggtggtgaacgaggcgctgagccatgcggacgtggttaaactgtccgacgaggaactcaattttctctgtccggatcaggaaccggctatcaccatgccgcagctggcagtgcgattcagcataaaattattgctggtcacgcggggcagggaaggtgtgatcgcctgctatcagggccagctataccactatgctacttcgcccgtggccagcatcgacaccacgggcgcaggtgatgccttcgtggccggattactctgggggctggctaagtcgggtcttcctgccgatgaatcgcagctggcaatctgccttaccagtgcacaacgctgcggtgcactggcaaccacggctaaaggggccatgacagcacttccgcggctccaccagctggacgacctgccaggctgattatcttattgcccctgttttgggagctatctcacaatcactaaaccggtttagcaattttcattgcgcagggaaattacccgtggctatgatttgcgcctaaaccggtttagcaaaaaatccggtgatgatagcctctcttcagggacataaaaaaatgaaaaaaagcacgttagcagtgagtctctcaacgatattactttccacatcagtctgggccgactccagtatgagcagcattgaagcacgccttgcggccatggagcagcgactgcaggcagccgagcagcgagcgaatgcagcggaaacccgcgcacaggtcgcggagaaacaggcacagatggctgagaaacaggcacagcaactggctgccgtgcaacaacagacccaaaactccaccgctgaggtcgcgcagcgcaccgcgaaactggaacagaaatcagccgatgaaggtggcttcgagttccacggttatgcccgttcaggattgctgatgaacagctcggccgccaaaactcagggtggcccgaccgttacccctgccggggaaaccggcggtcacgttggtcgccttggtaatgaaccggatacctacgttgagctcaacctcgaacataaacagacgctggacaacggcgccaccacccgtttcaaagcgatgctggccgatggtcaacgcacctacaacgactggacagccgccagcagcgatctcaacctgcgtcaggcgtttgtcgagctcgggcagcttcccaccttcagcggcgcattcgataacgccacggtctgggccggtaagcgttttgatcgcgataactttgatattcactggatcgactccgatgtggtgttccttgccggtaccggtgccggtatttacgacatgaaatggagcgatcaggcgcgcagtaacatttccctttatggtcgtacctttggcgacattgaaaacaatgaaaacactgcgcagaactacatcctgtcgctgaataactttatcgggccggtacagctgatggtcagcggtatgcgggcaaaggataacgacgatcgccgtgacatcgacggcctcagagtcaaaagcgatgcggcagaaaccggcgtacatgcgctgcttggcctgcataacgacagcttttatgggctgagagaaggcacgtcgaaaactgcactgctttatggtcatggactgggcgcagaggtgaagtcgattggttctgatggcgcactgttgccggaagcggacacctggcgtctggcgagttacggtattaccccgctgggcggtggctggcacattgcacctgctttactggctcagcgtagtgaggatcgttacgtcaaaggtgacagctatgactgggcgacagtcaacctgcggctgattcaggaaatcacccagaactttgagatgcagtatgaaggctcttatcagtacatggatctgcgtcccgaaggctacaacaaccgtaatgcggtcagcggcagctttaccaaactcaccgttgcgccaaccctgaaagccggtgatgtcggtgacttcctcaaacgtccggaaattcgtctctttgcaacctggatgaactgggatcaccggctggataactatgccagtgacgacgctttcggcagtaaaggattcgatgccggtggcgaatggaacttcggcgtacagatggaaacctggttctgaccgggcggccccggatgccggggccagagatcaggatggataaaaacataacaagattgaggtgtgtatggactatgtaaaaatatcgcgggcattgctgcccctgctgggtggtaaagagaacatcgccagcgctgctcactgtgccacccggctgcggctggtgctggcggatgatgaaaaagcggatacgaccgcgattggccggattgaaggcgttaaaggctgcttccgcaatgcgggccagcttcaggttatcttcggcaccggcgtggtgaacaaggtctacgctgcctttatcgccgaggcgggcatcagtgaatcgagcaaatctgaggccgctgatatagccgcacgtaagctcaaccctttccagcgcatcgcccgcctgttgtcgaacatctttgtgccgatcattccggcgattgtggcatcaggtctgctgatgggcctgctggggatggtcaaaacttacggctgggtcaatccggaaaatgcgctctatatcatgctggatatgtgcagctcggcggcctttattatcctgccgatcctgattggctttacggctgcccgcgagtttggtggtaacccgtttcttggtgcgacactgggcggcattctcactcatccggcgctgaccaacgcctggggcgtcgccgccggtttccacaccatgaacttcttcggcattgaagtggcgatgattggctatcagggcacggtgttcccggtgctgctggcggtctggtttatgagcatgctggaaaagcagctgcgtcgggttatcccggatgcgctggatctgatcctgaccccgttcctgacggtaattatctccggctttattgcgctgctgattatcgggccggcaggtcgtatgctgggtgatggcatctcctttattctcagcacgctgattgcgcacgccggctggctggcgggactggtgtttggtggactctattccgtgattgtgattaccggcgtccatcacagctttcacgctatcgaagccggactgctgggcaatccttccatcggcgtgaacttcctgctgcctatctgggcgatggcgaacgtggctcagggcggtgcctgtctggccgtatggtttaaaacccgcgatgcgaagatcaaagcgatttcgctgccttcagcgttttccgcgctgctggggattaccgaggcggctatctttggtattaacctgcgctttatgaaaccctttatagcgggtctggtgggtggcgcgctcggtggtgcctgggtggtgtcggtccatgtttatatgactgcggtcgggctgaccggtctgccgggcatggcgattgtccaggcgggctctctgctcaactatgtcatcggtatcgcaatcgcgtttaccactgcgtttgtgatctcttacctgcttaaatacaaaacggattctgaataatggcctcatcaacacgtcttgccgccattctgcaggcggtgatgcagggtatgccaaaggcgctcagcgacagccactatcctggctggcatctggcaccggtaaccggcctgctaaacgatcccaatggctttatccatttcgacggtgaatatcatctcttctatcagtggaacgcgctggagtgcgcgcatcagcaaaaatgctggggacactggcgctcagccgatctgctgcactggcagcatcagcccatcgccctgatgccggacgaggagtatgaccgcagcggttgttactcgggcagtgcggtagaggataacggtgtactgacgctgatctacaccggcaatgtgaagtttgatgatggttcgcgcaccgcgtggcagtgtctggcgcagcagaacagcgccggcggttttgacaaactcggtccggttatcgccgtaccggagggctacaccggccacgttcgcgatcccaaagtgtggcgtcatgaagattactggtacatggtgctggccgcgcagaatacccagctgcagggcagggtgctgctgttgcgttctgataatctgcgcgaatggcagaatctcggcgagattgcgggcagcgaactgggcgggctggacgccgctggctacatgtgggagtgcccggatatgttcatgctcggcgacagcacctatctgatctgctgtccgcagggtgttatgcctgaagagaaacgctacctgaacagtcacgcctgcgcctggctcagtggctcgctggattatcagcaggctgcctacctgcatggcccgctgaacgaaatggatgccgggtttgaattctatgcaccacaaaccacgctgaccgctgacggccggcgtctgctggtgggctggatgggaacgccagacggtgaagagatggcccagccaaccgtggcgcatcactggatccatcagatgacctgtctgcgcgagctgagttcccgcaatggccggctctgtcagcagccgattgcagaactgcaggcgctgcgggagagggagctgcattatcagggccgcgccgatgacgcgccgccgatcgccgcgcagcggctggagcttgagctggagagcctgggcgatatagaactcaatttcgccgatacgctgatcctgacgtggcagcagaatgaactgcggcttgcccgtcgcagcctggtatcgggtcaatggacctatcgttactggacaggggctgcacgccggttgcagatcctgtgtgaccactccagcgttgagatcttcatcaacgacggggaaggggtgatgagcagccgttattttccggaccatccggcgatgctaaccctgcgcggtcgcgcagaaactgcaggcccgctactggtcgttacgtcgctgcatggtagaataagcccttgtttcactaaccgatgccttgccgtgagaaaaaccaaacgcgttaccatcagtgacatcgccgggctggctggggtttctaaagccactgccagcctggtgctcaacggccgtggcgaagagttacgggtggcgaaggagacgcgtgagcgggttctgacactggcccgggaacaccattatcagcccagcatacacgcccgtatgctacatgacgcccgcagtcatacgctggggctggtggtgccggagatcaccaaccacggctttgcggccttttcccatgcgctggaaaatctctgtcgcgccgccggtctgcaactgttgatctcctgcaccgatgaaaatgccggtcaggagatggccgtggtcaataacctggtggcgcgtcaggtcgacgggttgattgtcgcctccagtatgctgagcgacagcgactatgtcagcctcagcgaacagctgccggtgctgctgtttgaccgccacatgaacaataccaggctgccctgggtcatcaccgactctgtgacgcccaccgctgagctggtcgaaaagctggcgcgcacctgtccggaggagatctactttcttggcggacagtctgacctctccccgacccaggatcgtctggcgggattcaaagagggactgatgcgggcgggtgtgacgctgcggccggagtggataattcagggtaactaccatcccggcagtggctatgagatgtttgccgcgctctgtcgccggctgggacgcccccctaaagcgatgttcaccgccgcctgcggtctgctggagggagtactgcgctacatgagcgaacataacctgctgaccagcgacatccgtattgccagtttcgacgatcactatctctatgattcactctccattccgatcgacacggttgagcagaatgtcccggcactggcgcagtcctgcttttatatgctgactaccatgatcgctggtgaggatcccgctgacagtcagcttatcctgcccgccacgctgcggctgcgcggttaaccgccgggcgctgcagggcagggcgttaccattcgaccggcagggcgctgacgccgcgcagattagctctgtggttgcggcgaaacgccagcggccacgggccgcatctctggcaatcgcgtcagtaatacttccagcgccacctccatttctgccagtgccagccggtagcccatacagtgatgtataccgccaccgaatgccagacagcgcccctcatgccgccggatattcagccgttccggagaggtaaataccagcgggtcgtgattggctgcaccaaggctaaggaagaagcgggttccgggcgggatgagctctcctgccagctcaatctcttccagagtcgtgcggtaaagcatctggaccgaactgtcgtagcgcagacattcctctatggcatcgggtatcagcgcatgattctgtttcaggctcgcaagttcctgcggatgagcatgcagggccagaatggtgttgcacagcatgtttgacgttgtctcatgaccggcaagaaacagcagtatcacattggcgatgatctcatcgtgatccagctggtcgccgtcactgtcgctgcgcagaaaaagtgacaccagatcgctggcggtgctatcacgtcgggatacgatcacggcactgaagtaactttccagtacggcaaaagcttcagcggctttcagcaaatctggctgactgatttgaggatcgaaaaccctgaccagcgcagaggtaaggcgacccagttctggtgcatcagattctgaaacatccagcatccggcagataatgcgcaccggtagcggaaaagcgaatgcctgagccagatcgcaggcacgacgcccttccagttcatcaaccagttcattggctatcgtcagcgccatctcccgaagagatttaatctcccggccgctgaacgccttcataaccagtcctcttaaccggttatgatcgggtgggttcagcaccagaaacattctgctgataccctgaaacagcggcagtccggctgcatcatcaccaaatcttactctgacactttccatataatttttaccgacccgccggtcgttcagcagggcgtccaccaccgcgtgactgccgctgatgatgatcttatctccggcagggataagcggtccctgctgatgcagttttcgataaaggggaaagggattgtcagagtagtcggggtccatgagttcatgaagctgcatagcgtactccgctgatagaggattagtgctggcgctgaatgcgggagagggaagcgaacaggctgtttttatcactctcactgaggtgaggtgccgtgaggtgtgacatcagaaattctttgtcctcctgcgagaaggcgccggtcatcagccgctggctgatcgccgtcaggagctgggtatccagctgttgtatctgctgtctggtctcggtcagatccctgacaggaacagcgctgtctggtgatgagagccagtcagcccgatagcgatactggatcgccttgctggcgttcatcaaagcgtgaacaaacggctccaaggagtggggttcaagcccggcctgttgtgcgttttgcagcatgttatccagcaccacctgttcccgtggcagatcctcaataggtaaatgatgcagtgctttataacccgccaccgctttcatcacctgcatccgttcgttgagcgaggtagaaagcgccccaagagagacggatgagactgtacctgcaaaaacgttactgcacataaacagtgaagagaaaaaaattgccacaaagtgagtcatttgcctgctccataaatgaaaactggcactaatttatgcatgaaaaaataactatgtgtgattattttgttttcaaaatgtgaatcacaaggcgggtcagtgaaatgagaacaggtcattaattttaaagttattttttatctttatggtcatcaaaaattcacattaatttgcaatgctggcgggttgattggatatgacgtttgaatggattcccccctgatgcaggtggcgttgcgccatttacgtcatctctgtgatgccagaatgagtttacgaggcatgccgggtagtgcgcacaggaaagcgccatgccgatcagggttcaggtataatatgttccgcgagtgtggccgttttttagcagcaaaacgaggtaggtatgtctgtatccgaagctactaccggtggtaaaagtgtcgcggagttagttgagagcctggaaaaacaggcggcaaaacgttcagacgcgaactggcacgaaggtctgaaaagcagcaccaaaatcgcactggaaaaaattaatggtgcgtttgctgcaaaatggatcagcgcagacgagagcctgagccttaagcagcgcgtttacagtgtgcaggataagttgattgagctggctttatggtgatttaaattgcctgtcggccggctcgtaaatcgacaggggtaaaaaactgatatttcagcacgcagcgtcgcccggcattttgcgcgctgcgcagtgaaggggtgttaccgggcagaatggtaccggtcagcagtgccttctcaccataatgatgatgaagctgctgcagcaaacgctgctgagcgcgcgcggcgagtccacggccctgataagcgggcataatcacttcatccataatctgaaacccctcaataaaggtcagtcgccggggcacacaaatcatcagccctgccactatgccctgccagacaatcagaaacacatgtcccgcggcgatatcctcccgtaattcctgcctgctggttgccagtagctgatcgcgcagatgcggcagcgtgtgcctgctggcacgataggcgcggttaatcgccgtgatacaggcgggataatccttccggcaggctgtcaccagtgaaatatcttcgtcgacaggaacagagagtgaagccaggtcgctgaggaaaagcagttgatcggttataccgatgtcaggataagtcgcaggcaacaggatgcgcagcttcaggggtttcagcggctgccatgcctgcataatggcgctagcgaccctgtaatcgatgatgccgtcacgcgcaacaacctcaataaagggctgtgcaggatcgccacccagatagcgcggcccggtgagataacgctggccgtttatcgtcagtttctcgctgcaaaaaggcgtgctggggcagaccggtttcacgccatggaaaggcggcagaaaaatggtgatcgtggcatcgtgtctgctgctgcgccagccagctggcaagccagtcgctgagacgttcagatgagacaggaacagtacggtagagcgacaccatataatccagcataagattccttattgcccgccgtcagtgatctcctgcctctctccgcgatacatctgtacctttgccggattgcagatgaggctgatgagagtgtaaacgatgtgctctgtttatgaccatctcaacctctcagccagcaccattacatcccctctgcatgacggctctggacctgccagacggtgcaatgctgacaatgtgagcaggtatacgtcatcttctgcgatcgcttatcgtcgccaccctctgagctgcattaaacatgggttacgatctattcgggtctggctggatttcgtatacatggtcaaattaattgatgaaataaggcggggttgcccaaaaatttaaatgggaaatagaggtgaaatttttacgtaaatattacggaatcagataatcggcagccgataaatggattatgataaagaggcttttcaataattataaaatgtccgatctttttaacacccgggggttacatggttcatattgatttatgcacccaggagggcgtgatgaaagcttatgcttttcagacgccgatgcaggcaatgaccctgctggaaaaaattaaagatgatgaatttcagtggtttaatctggagtgggaagggcgccgctttacctgtccgcatcattttattaaaaggctcagcagccgctcttatattaaatcgttctggcgttaaattcgcttaaaagataaggctgatgcacaattacttattattgatgcaggttttatttaactgttctacgcatatttttaacgtaatgataaacggggcagagcctgccccgttattttcagcgaccatatggcgttgttatcacggtcagcggtaataatagtgcgtcatctgcacagataccggcctgctcagtatcattattaccgcttaatcattttctgctgttgcttatcagggctatcgaaacgctaaacaatcctttatgcagggctggacggttgtgtgctgcgcccggcaatgcgccgtgatcctgtgtaaatcatcttctgttcggcccttgacgtgaaacgtctactgttacactcagatgacacttaatccggatcccgactgcaatgccccatgaaaaaatgcgccttcgctcgctgctgactttgctttccatcgggggcgtcattctgacctccggtctgctgctgagtgcgctgctgctgtttcagaaggccaacatcgaagacagtctgcttgaagggaacattgcctatgcccgcaagctggctgataccaccgatcgttacctggcgacagcacaacgtgaactggcctggagtgcgtcgcagatcaaggggcttagtgatattaaacgactggaaggagagagcgatcgcctgcgaatgcagtcgggttttttcaactcggtggtggtggtaaatcatgatgccattattgcagcaacctcacccgatagtctgaatcttattggcgtgaagctgcactcacttgccagcctgcaggccatagcgacccaaaagccttttatctctgctccttttacctccgcggccggtaactatgtggtgtttttatcacaacctctgttcagcgaagatggccgctatctgggctacattggcgggactatttatctcaagaaacagagcatgctgagcgaaatcctgagccagcatttctattccaatggttcaacggtcagcgtggtcagcaatgaagggctgattattttcagtcatgacgcagcgcgcgtcggaacaaagatgctgctgagtctggcactgcagaaacggctcgccacgacagaaagcgggcatttcacgctggagagtgagggacagcactatctgactggctatggcacactgcataaaaccggctggaacgtttttattaccggcacctctgaaacggtcaggcatattctgatgcgcacggcagaaagcgccgtctggttcgttctgggcattattgccgtaacagcggccattattgcctttatggccggtcgaatcgcctctccactggaaaagctggcggacagagtgcgcgatggcggcagcgaagcccaggcggaatctctcgccacggttaaaacctggtattacgaggctgatcgactcaaagaagccgtgcaggctcatcggcacgccgttgcgggtcatcttgccgcgctaaacgatgaagcgatgaccgatccgctgaccgggctctgcaaccgacgcggattttcggcgctggcggcgcagtcagacagtgagcatgaacagtgtgccatcgccattgatattgaccattttaagaagataaacgactggtacgggcatgacgcgggcgatgcggttctggtgagcctggcagcgttgctgcgtcaagcttgtcgtaccggcgatatcgtcagccggtttggcggcgaggagtttattctgctgctgccgcataccacgctggctgatgccgtccgcaccgcggaacgcatccgtgagaccgtcagcgccaccacctttccgtttgccggaacgatgaccatctcagccggggtggcttcgcggagcgatcaggatagcgatcgcgactctctgctgcggcgtgccgatgaagcgctttacgaagcaaaagccgccgggcgtaataccgtcatcattgccggagctgaggagttcagcgcgtctgggtcggccgggtaagattccggggtgagtgggacaggctcagcacttactgcgtaatcgccagccgagccactcatccagtgccgcttccggcagcggcctggagtagaaaaagccctgcgcctggtcgcagccgaactcggtcagcgccgtaacggtttccgcattctccacgccctcagccagcaccatataatcgagatctttaagcatcgcaataatactgcgggcgatgacgcgcgatgcggtgtcagatgaaatttcgctgatcagtgaacggtccagcttgatcacatccagcggaatgcgccgcagataactgatgttgctgtagccggtaccaaagtcatccagtgaaataccgaatccacgaagtttcagcatctcaagcccccgcattgcggtcgcgctctccagaatccgttccgtctccagacactcaatgcccagcagcgaaaccgggagcttcgccctgatcatctgctcttccagctcgtcggcaaaaccgtcacgtgaaaaatcgctgctgctgacgttaatggtgatgggcaactgaatatagctgttgcgcagccgggagagccgggcgatggcgtgctctgtcacccaggtggtcagttcgctgagcagctcggtttgcacggcaaagggtaaaaactgtgcaggtgacagttcgccgcgctgcggatgctgccagcggatcagggcctccaggccaatcggcttgccgctgtgcagacagattttaggctgatacgccagccacaatcccttatcctggcgtatcgcgatggccaggtcatgcatcagggtaaagtcctgcgtatggcgcgtatcagtggcctcgctgaaaggcatcgaggcgacgtcgcgtgtgatggcctcgtgcagcgcgctgaccgcacgccgcaggatctcctgggcaggcatctccccggtattgaaactcgcctcaccggtgtgggtcatcagtgcaaccgacagcccatcgccgagatccgcgctgatcccggccagcttgtttgccacccagttagcagtgagtctgctctcctgacgtgtcagcagggcaaagcgcccggtggctacggtgtagagcatctctcctggcgcaggcctcaggcgcagcggcagcagtgtcgccacatctttcaacaggctttcaaccggtcccatgcccattgagcgcgcaagctcgtaggcgcgcggcatatcgatacagtcaatcagcaccagccgccgtggcgtggtgtcaccggaggcggcaagaaactgcaggtcgcgaatcagacgctggcggttgggcagaccggttaccgggtcggcaaagccagccgagtaccaggcctcaagaaatgacatcactagtgccgccagcatctttagcatggcgacctgatccgcattaaagggatgaggcgcggtgtcagtcacgcacagcgtacccagtatcagacctgtgctgcttttaagcggtacgccggcataaaagcggataaaaggcgcgccaacaatcagcggatgctcagcaaagcgggtatccagcaacgtatcgggtactaccacggtgctgtcactgtccactgcatgccggcagagcgagtcctgccgggaggattgagtgagtgtgaaattttgcgcagccttaacatgctgcatctcatcatccagtacggagataaagctgccgggtataccgagtgcctggctggccagccggacgaactgtcgcaacacatcgtcacgactttcgtcgttactgcgcagcgcgtgcagggttcgcgtgcggcaatcgtcgccgccgctgagactcataagcatggattcctccgcaccggctggttacggcgcgaaattaaacagaaaaattgaagggtatgatgtcatgactacaggcaaattctgcaaaaagaaagagtcatgaccatttattttttatcccactgcacgccattgctggtcagaatagcaaatcacttttctttaacgaaatattttagtaatcacgattctattattttgtcgttaaaaacttttaatttcttaaatatcctgccagtatacagagtataaacatagtgcactatataataacgcactaaagtagatgacataacttatttttgtttaattttaactacaccaatgacaacatcggggaaacctcatgaattcactcaggcatttcactatccgccgcgttgtgctgtggatgatgatcgtctcactgggcatcgtcgtgctggccggtggctacagcagccaggtcgtgcgcgatatctttcgtcaaaccgatcgttcagccgtttctgacgcagcaactgagctttctggcgcacagcgctatcgtcatgcagagcggtacgtcagccgataaaaacgcgctcgtcgcctcaaccccggccgatgctgactgggataacgtccgcgcggcacttacgacaaccccctcagaatacgcaacggttgcacgtgcgcagctggacaaggtgacgcagcagctggcccggaatcaggcacccctgaaggctgaccggcatcggcttgagggcgtattgctggcagcactgctggcggcagtggcgttgctgctgttttgtgaccgctatctggtcgttcatctggtgcgtccggtaggtaaaattcgcggtcatttaaaaattattgccgatggcgatctgacgcgcgagccggaagatctggggcgcaactgtgtcgggcaactggtgccgctggtcaaagagatgcagcacagtctgttgcagacggtcagcgctatccgtgacaacgcagccattcttcatcgtgaagcgggggacattgctgcgggtaacgccgatctctccgaccggacatccactcaggctgctgcgctggagcagaccgcagccagtatggaggagattaccgtcaccgtgcgtcacaatgcagagaatgcccgtgaggcacgtgaactggctgccagcaccacggatacgactcagcagggcgtggaactggttcagttggtatcggcagccatcaccagcatcgctcagggatcagaaaaaatccggcagttcaccaccactattaatggtattgcgtttcagaccaacattctggcgttaaacgccgctgtagaagccgcccgtgcgggtgaacagggccgcggcttcgcggtagtcgccagtgaggtacgctcactggcacagcgaagtgctgctgcctctaaagagatcgaagagctgattgccgataccgtggcacgcgttgacgatggccggcgggcggctgagagcgcaggaaccaccatggaggccgtgctgcgcggcgtcggcggcgtgaatgaactgatcggacagattgcgctggcttcggatgaacagagcaaagggattgcccaggtcacggtcgccgttgcagaacttgaccgcgtaacgcagcagaatgcgacgctggttcagcaggtttcggcgacagcaggcagtctcagtggacagactgaaaagctgggcagcgtgattacgcgctttaccctgccgcatcgccctcttgccgtagagcctaaacgcgtcatgcctgctgaaaaaggcggctgggcaacgtttgcgcgggcatagcctgaacgtattttttctgaactgtagataatgtctgtccggcacggaataacgattaatattcactctttttaaaagagggatgaaacggtcattttttgtgactgtgattgacgttgatcatcattcgatcaacgccaccattcagaatggcaattactattctcagcggtgcaaaaattatccgggcagcgatttaaatataattcaggttattttctctgtttttactggtgcgttacgctttcctgataagtgtaaaacgccgggctgttaaaacttaactcaaatttatgttttggccgcaggcgtgtacttccgcccggccatctcgccggggcaccgtatgcggagcgtttatatgggaaatcagattttacagcggcctgtcgccgtccagcacaacgtgcgtgagctgcgccttgcggccggtctctctcaggagattgcagccgagcgtttcgatcttagccagcgtgtctggcagacgaaagaagcatcgaaaaatcctgcgctgctcagtcagggagagtatgaactgctgatgctgctcgccggagagcatccgcactatcaactggtaccaaagctgaaaaagtaaggcgttcatcctctgttttctcttaagtaaagtcatgtcgggccgatatagagagctaagcgaggcgcattaccgcctgtctgatctgctctggccagataatcctgggcggtccgccgcactctctctggcaggcataacgtgttaactgatgcctcgctgtctgcggtgtcagctttatcggactcagcgcggcaacctgttgctgccgggtttactgacgggcctttcttccggcaacggatcggcagcgaactctgcgcgtttctgtctgattgaacgtgtcctctttatgctgtgtcaggccagccacagcagataacaccagaggagagttacgctgaaacgtccagtttatcatgatgccgaggcggctcgcctcgacgcacttaagcagtatcatctgatggattcaccgccgaccgatgcgctggatcgcctcactacgcttgccgcgcggctgtttcgggtgccggtcgcttttgtctcgcttatcgacgaaaagcggcagttcttcgcctcccggtacggtttaaatatttcaggtacggcacgcaacgtcgccttctgccaccatacgctggcgcagggcgatatcctctgcgtgcccgatacgctgaaagatccgcgcttccgcgacagtccgctggttcacggctacccctttatccgcttttacgcggggatcccgctttcgaccccggatgggcatcatattggcacggtctgcctgaccgacagccatcctcgtgagccgttaactgcagaggatcgaaagcatctgaacgatattgctgcactggtgatggatcgcatggagatgcatcgtctggagttattgcgctacaccagccagcagcgactcgaggcgatctcatccacttcgcctgacgccattgtctgcaccgaccttcggcgtggcataaccttctggaacccggccgccaccgcgctgttcggctacagcgcagaggagatgcgcggccagtatatcagcgagctgatccctgctcgctgccaggctgactaccgtaatgaactggtccggattacctctgacgaagcggctatctcgcaccctcgctctttgcagatatggggtgtcacgcgtgaaggtcgtgaatttccggcagaggtctctttttcgggctggcgtgaagagggcgaacggctggtgggcatgatcatccgcgatgtcacggcccgctatgagagtgaggcgcggctctgtgagctggcctcactggatatgctgacacgtctcgccagccgcagcgcgtttatggatcaggtcggccagctgaccagggcgggcgtcccctatacgttactgatgaccgatctcgatggttttaaagaggttaacgatacgctggggcatgctgcaggcgatgcgttgttgtgccacgttgccgaacagattcgtgcggtctgcgccagtgccgtgacggctgcgcgcctgggtggtgatgaatttgtgatcctgttagcaggcggcagcgcagaggcggcgatcacggcggagaaactgattgcggccgttcagacgccgttccgctatcacgactcaccggtggtggtcggtgccagcaccggcatcgcctcctatccggagcacggtagggatccctcttcggtgatgtccgccgcagatctggcgctctatcgcgccaaagcgtcgggtaaaggctgcagcatgctgtttatgcccgcgtttcgtgaagcggagcagcagcggcgccgttttgagcgcgaactggaaacggcggtgcggcagcagcagttcactctttactatcagccccgctacgacgttgaaagcggaaagcttattggctgcgagacgctggtgcgctggcagcatccgacgcgcgggctgctgttgccggctgaatttatcggcatgctggttaaaagtccgctttcagtcacgctgggtgaatggatcatccgcagtgctctggcacaggtccggcagtggcaggttcgctctcctcagcttcgcgtcagcattaacctgtttccgcgccagctggcagggaacagcctggagacggtgatacgtgagagtgccggaggcgatgccggttttgttgagctggaagtggatgagccactgctggccgtgctgatgcaggatatgccggttcaggttgacgccgtacgccgaacgggagcctcgttcgttatcgatcattacgggcgtacgctaggggcgattaacctgctgcgctatagcgttgtgacgggttttaaaatcgataagtcgatgacgcacgagctgggttccagcatgcgggtgcgtatgatgttccgggccattaccgcgctcggcaaaagcctgggtatccgggtggccgccgaaggggtggaagacaaagagcagatcgcttttgttactgccgccggatgcgacattatgcagggcaatggcctgtgccagccactgacgccggcggactttgaggcgatgctgtgcggagaggagcacagtgcgcccgctatcgctatcgccagcggttatgacgttacgccacgctaatcggtctgattgtggcgagcgtagcggaggatgcccgacgctgatagtctgcgcctcagggtgagtgtgcgggctggtattcctgtttcagcaagccgaagatccagtcatcctgccactggccgttgaggaagaagttctgccgcaacgtcccctcctgcacaaagcccgctgaaatcagggtccggcgtgaggccgcattgcctgctgtcaccgtcgcgatcagtttgcggtattcctgttgctcaaagcagaacgtgataatggcatgcagagactcgctgccgtagcctttgccctgcgcatctgcggccagaataaagccaaactccgcaataccctctccacgatcgataaacccgcaaaagccagccggagcaccgaatgttttttctccgataaccagacagagccagtgcctgcagcccttgtaccaggcgggcaggcggacatcaaatgagtgggttctgatcttttcagcgctgcgcggatcgctgatgtactgcatcaccgatctatcctgactgactgccagatagaagggccagtcttcctgccgaagtggccgataagtcaggcgcggcgaggtgactttcagcggtatttcagccggtactttagcagactcttcagttgtcatcgtgcaactccctgcggatcggatctctgtggcgatggcgcaaaaataacacagagtggctgactggcgggacgcgctttcgccgctctgcgaggtatcccgcaataccgacgttatctcaacagctcctgctctcgtgcattgtccagctcccgcttgccacatttgctcttatcgctgcgctgtcaggccttctgtccacttcattgctacgcttttagccagatggctgaaaattgatcctgatgagagtaatccccatggaattgaaaacgtttgaagcagcagcctgggctgggctgcaggaatctgcgaccgatccgcaggccggatttcgttatctgatgctctgtacggtcgatgctctgttgcaacctcaggcgcgcaccgtggttctgcgccagtgtgccgacgaccgccggatgttgacatttcatacggatgttcgcagcccgaagtggcaggagatggcggcgaatccgcaggtcaccgtggtgggatattgccatcagcgtcgcctgcagttgcggctggcagggcgggttgcgtgttatgcggcgggaagtgatgttgcccgggcagcctggcgtgcgttaccgcagcacacgcggcagacttacaccggcggacctcctggggaagcgcggacaacggctaacgagacgtctgatgcgacggcagcggaaaccggggaatcccgttttggcgtggtgattttgcaggccagtgtgctggacgcctatcagcttcatcgaaacgaaaatcagcgcgccctgtttcgctattcggctaacggcgagttgcaggaaagcgaatggctcaacccctgacccgatatgcctgattcacttcgggtcgggttaacacctgattgatcctctttttgcgtatgcgataaaagagatttcactgtctgccgcttcgttatctgatttttatctgccgcaccgcttaatcgattttagcaccacgttatcttcttataatggcttttttctgctttttcctgtcttttggcattgtttgtgccaggctttaactaaccgaaaagcagtgacttatgctcaaggtaaagaaaagtacaaatgatcgctctgtatcacaggcaggttaaacatgaacaatcaacctcctgaaaaaccagggtcagagggtagcgaccaggtgataagcctggcggaggaaaccgttgaggtctcaaaacagcgggtcatcgacggtcatgtcagggttacccgacaggtcactgagcatcagcagaagattgcgctgatgctccggcaccagacggcggaaatagaacgcattcctaaatcggaacggctggctgagatgccggagatccgtgaagaaaatggcgttctgatcattcctgtcgttgaagaggaaatcgagatcgttcgtcatctggtgctgaaagaggagtggcatatccgcaaagttgtcagtgaggaagcgacagaacaggtcgtctccctgcgcaaacagcacgctcacctgacccgaacaccctattcagagccgtccgaatccatcaccgaggaacacaacatggcgcgtgaaacaatcgtaacaatgttcagcaatatctcactggcagagggtgcaaagcgtaacctgatcaaggccgggttcctggatgatgacattgatatcatctccggtgatcgtttgcgtaccgaaggtcaggaggcccgtcaccctggcttctggcaacgcctgttcggcaatacgctggaggaggatcaggccgaagtgtatgaagacgcgatgcgaaccggcggagtagtgctgtcgctgcgggccgatgaagatgagttacctcgcgccctgggcatccttgatgcacatgaagaacttaccgagcgcagtgcggcgctgcccgatgattacgcgcccggttacgcgaccagtgatggtctgactgcacctgccagtggaacgcttcaggataatgccgccgtcgatccgctctctaccgatcctgcccatcgtggcgctgcccgtactgccctgaccggtgacgaaagtgacgaggatgtactgcgtctggccgaggagcgactggaagtgggtaaacgtctggtcagtgaaggttcaacccgcgtttcgtcgctacactgtcaccgatcaggtctcagaaaatgtctcgctgcatgagcagcacgccgcaatcttccgtcgtccggtgaatgaatcaggttcacccactcatgttgactggtctgaaaaaactgtcgaagtggaagagacgcatgagcagcccgtgattaataagacc
